United States Patent 11,410,750 (METHYLATION MARKERS AND TARGETED METHYLATION PROBE PANEL) - sequence listing, part 8

SEQ ID NO: 105156 - DNA, 417 bp, Homo sapiens; identical to SEQ ID NO: 70484
  chr10:121301494-121301911
  Hyper

SEQ ID NO: 105157 - DNA, 165 bp, Homo sapiens; identical to SEQ ID NO: 70485
  chr10:121307203-121307368
  Hypo

SEQ ID NO: 105158 - DNA, 148 bp, Homo sapiens; identical to SEQ ID NO: 70486
  chr10:121354399-121354547
  Hypo

SEQ ID NO: 105159 - DNA, 30 bp, Homo sapiens; identical to SEQ ID NO: 42674
  chr10:121398024-121398054
  Hypo

SEQ ID NO: 105160 - DNA, 27 bp, Homo sapiens
  chr10:121718497-121718524
  Hypo
gggtgcggtggctcacgcctgtaatcc

SEQ ID NO: 105161 - DNA, 1278 bp, Homo sapiens
  chr10:122216112-122217390
  Hyper
ctcctgagagcaaagcgaagcccgcgagtgatctctggggaacttcctagaaaaaagaaagaatttcaggttcgaacggtgtagggagggccgaacacgggagcaaggttggccagggctgccctgagccctggagaatccccagagcgatcgtccactacatgcccacgtgcgtgcgtgtgccagggagcgagagcccggacagcgggagtcggaggcaggaccaggagctgcagaggggccgcgggcagagccccagcgagcgcgctgccctggcgcggagcccaggggccgcccactggcgggggaggcggggagcgcgcagggaggcggcggcggcggtggggcttccccgggcttcccctccccggtccgcgggtgcccggcgcgggcccaggaggcggaggcggctcctggggagagggatccgggagtccctgaggcggccccggctccgcactaggaggcggggtccgcagtatcgccagcggccggcgcggcttcccggagccccggagcccgaggcgcgaggtttaggctgagccctccccggcgcctgcccccgcccggcgcccgcctccgcccccgcccgcggcctggagcgcgcctccctcgcctcccagggtctggcgagccggcgccggccgagctgcgggagccgcggagagcaccagctgacgccgcgggagctgctccggccgcaccatgcgggagctggccattgagatcggggtgcgagccctgctcttcggagtcttcgtgtaagtagtggcgcaccgcgggcagggcgcactgacgcgggggaacaaccgaccaagcctctctgtgccctaacttagtttgcgcagccgcttcccactggggcctgggttcgaggtcccttccccgccaagtgcccgcaacgtgtcctacgggaccaagagagacccttcctctctccttcctgggaccctaggcgcggagcgaccaccgcgcgccgaggctgagacctgctcccgggtctcaccgggcccgcgcctgtcgccagccccgcaccacctgcccgggggatccagggctgcacctctaaacagggacgcgcaccctggcccgtgccctcgggaagtttctccttctgtgtgatctttgaggcccacgttggaagtctttacccctggccccgtctccgattcctccccgctgtgcccagggccagactccttccgtgtccctggctttagcgcccgcggtcctggcgagcgttttcccagcgggcgtttgcggcgcttctcctactga

SEQ ID NO: 105162 - DNA, 30 bp, Homo sapiens; identical to SEQ ID NO: 70493
  chr10:122222277-122222307
  Hypo

SEQ ID NO: 105163 - DNA, 92 bp, Homo sapiens; identical to SEQ ID NO: 70494
  chr10:122319368-122319460
  Hypo

SEQ ID NO: 105164 - DNA, 31 bp, Homo sapiens; identical to SEQ ID NO: 70495
  chr10:122319520-122319551
  Hypo

SEQ ID NO: 105165 - DNA, 120 bp, Homo sapiens; identical to SEQ ID NO: 70496
  chr10:122379107-122379227
  Hypo

SEQ ID NO: 105166 - DNA, 30 bp, Homo sapiens; identical to SEQ ID NO: 42676
  chr10:122394238-122394268
  Hypo

SEQ ID NO: 105167 - DNA, 120 bp, Homo sapiens; identical to SEQ ID NO: 15393
  chr10:122492432-122492552
  Hypo

SEQ ID NO: 105168 - DNA, 265 bp, Homo sapiens; identical to SEQ ID NO: 70499
  chr10:122708495-122708760
  Hyper

SEQ ID NO: 105169 - DNA, 437 bp, Homo sapiens; identical to SEQ ID NO: 70500
  chr10:122738879-122739316
  Hyper

SEQ ID NO: 105170 - DNA, 152 bp, Homo sapiens; identical to SEQ ID NO: 70503
  chr10:123356838-123356990
  Hyper

SEQ ID NO: 105171 - DNA, 46 bp, Homo sapiens; identical to SEQ ID NO: 70504
  chr10:123357614-123357660
  Hyper

SEQ ID NO: 105172 - DNA, 63 bp, Homo sapiens; identical to SEQ ID NO: 70505
  chr10:123358268-123358331
  Hyper

SEQ ID NO: 105173 - DNA, 143 bp, Homo sapiens; identical to SEQ ID NO: 70507
  chr10:123820809-123820952
  Hypo

SEQ ID NO: 105174 - DNA, 34 bp, Homo sapiens; identical to SEQ ID NO: 33445
  chr10:123873006-123873040
  Hyper

SEQ ID NO: 105175 - DNA, 988 bp, Homo sapiens
  chr10:123922604-123923592
  Hyper
gggagagccaggtgccgcagctctccctggtacagacttcagctgcctccaggacccggggcctgaaggaggcagaagccggcggtggaaaagggcgcacgtctctcccagcgtcgctcccgctgcccgctgcccactgcagcctatttacctgttcctccagccatccccttagtcctgggccgggagagaccatttcctccttcctggagggatgagccaacagggctgagccccctactctctcggtggtcagcccgcccgaccaccacgcccctcctttctagggccccagctcccgggccgcggctcgtttgcatttcaaagctacacaatgcgggcggtcccggcgaggcgggaggggccggggcagagggagggtcttcgcctccccacccccagccccgtttccggagcccgcgatggagctttgtgaagatgcaggcgttggggctgctcggcgatgatgacatcatcgtgtcacacacaggagccggctgccggggggtttaagagaagagcctttcggaccacaccggcgctcacgctcatacccgcacgccccgggcagagccgcgcacgccggccacactcgggcgcgcgccggccacactcgcgcgcacacatacgcggcgctcgccccccggcccccggctcgggccgcgagtcgcagctccctgccgccgctcccgccgccacggatgcccgcagctgctcccctctgcagtgcagcaaccccggccgccggccggctcgccccggctcccggctgcaggaatcgcgccaggacgctggccccgctcgcggctagcttgcacgccagggcacagcgaggatgggagggtcgcagtccctgcagccagccccagccagcgacctgaacctggaggcttccgaggcaatgtaagtgctccgcccgggccgccccgagtctcccggggaggaggagaggatgcccgggctttgttagtgtcgcctttcctaatgc

SEQ ID NO: 105176 - DNA, 377 bp, Homo sapiens; identical to SEQ ID NO: 70512
  chr10:124133936-124134313
  Hyper

SEQ ID NO: 105177 - DNA, 100 bp, Homo sapiens; identical to SEQ ID NO: 70513
  chr10:124220556-124220656
  Hyper

SEQ ID NO: 105178 - DNA, 148 bp, Homo sapiens; identical to SEQ ID NO: 70514
  chr10:124220901-124221049
  Hyper

SEQ ID NO: 105179 - DNA, 206 bp, Homo sapiens; identical to SEQ ID NO: 33449
  chr10:124221715-124221921
  Hyper

SEQ ID NO: 105180 - DNA, 394 bp, Homo sapiens; identical to SEQ ID NO: 70518
  chr10:124639132-124639526
  Hyper

SEQ ID NO: 105181 - DNA, 30 bp, Homo sapiens; identical to SEQ ID NO: 70520
  chr10:124714138-124714168
  Hyper

SEQ ID NO: 105182 - DNA, 147 bp, Homo sapiens; identical to SEQ ID NO: 70523
  chr10:124892251-124892398
  Hyper

SEQ ID NO: 105183 - DNA, 37 bp, Homo sapiens; identical to SEQ ID NO: 70529
  chr10:124897936-124897973
  Hyper

SEQ ID NO: 105184 - DNA, 4778 bp, Homo sapiens
  chr10:124892918-124897696
  Hyper
acaagcacataacagcgcccctgcgcgcccctgggaggggagtcaaccggagaacttggggcgacaaccggaaagccgggatccggtagccgcacagcagggatgcgggcggctgtcccggactcttctcccgccacactgggcctgtcccctccccatctgagtctagcgctggagttgtgatcagccacgagtccccctccccagactgaaccctcagcattcccagtttaaagtcgactttcgtgcgtcagaactctagccaagtttgcatgcgtctgcgctgaatggcgaagctcccaaaacacacaggcatacacgccggggtctctccacgcatactcggccgcgtggcaggctgtgtgcaggcggtgcccacccaaccctcatagacctacgtgcatcgagctatttctgcggttgggggaaaatgacctctgggtatccagcagcgattgggcgacctaggcccagtttcctcctctctgggcgcgggtttccacttacaaaatccaagtatgagacccaccctgctggggtctcagggcagtgatccgttccaacccagattttggatggcgtagcgttttgcattccagtaaagccctgtgtaaactcaagggagtaataacagtaattgtttatggaagcgccatttacgtttccagatttccaaagcaaaaatggggttcgctgctgtagatgaatgcagaaagaaacattacatatgcccgtcgagatttggtgggggagggtctgacgccccaggaccgaaaaacaaaatctacctctcaagtggggaccccacacgatcacgtctgccaatgcagggcggccttgaattaggcgaggctcaatctaacgaaaaagaaagcggtggggaggtgaagggatcccaaaaagccctcgtgtgcgggagcttcaccagggtggaagagggtgaggccagtttgtcacctttctctgataagaaagctgtctctcgggaggggacctcacaaacaattctgatttacttgatgcttaaatcatgagtcttaaatgtctgcctcatgggcttctcgtgcgaaccggggagctgtttttaaagccagtggagtggaatgtcctttcactaagccgttctgcaaaggtccagtgtggttctctaaggacttcgctgccgtcgagacgcgcagcggatgccgctgcttgccgcggcggaggaagctacgccgctgcgccttcggttcaccttgcccccattaaagcgttagttagacagctccaaacgccagctggccggagagacttcctgggagaaagtgctgtcgtcggggtcacagactcggagttgatccgcgagccttgggcaccggcggccagagcagaggggtgcccttccgagagcagccgtcggtgccgagaagctgttgccccagcagccccaccgagtgacgcgcgggttttggccgggtcagcgcgcatacgcacacaggcacacccactcctggtcccgggggaaggctcactcttcggttttccagggctaaaggccaaggccacgcggatttctgagtccgaagacgcagtgcgaggacttacacctggattcccttactatcggctggatggtgggtggggaacccaaatccctctcttcttggcctcgcccttcctagcaggctttaggaaaaataccgaggtcgccggaccccaaagggtaggaaaatgatgagttctccgagggccgaggtcacgtcctgcctcttgggccggcgctgcgtggctctccagctgcgtgggggcggcgggcccctgtccagccccagggggcgggggagcggcagctgcgagcgcagataaccccgaggtgacccgggagggcctggtccgcccctcccccctcccgcaggcctggcggcgggaagcgggtccctgcgccgcaggggggagaggcaggcgcggtctccgggctcgcggccgttagtgcgcttcggccaagggcgccgcctgctccgcgtccctcgctcgcctcctgcgctcgcaggagcgctccgagtgcctctttagcgggagccaatatccttttgtgctaataggcttgtcctcatttgctgcctaattggactatataaagccaataacgggcgggctcttatagcccgaagccaaagcgccaaaatccgagggaaggcgaggagggggcggtggcggaggcggctgcggggccggggctcggctgagccttcgcctgcctaatcccatttgccattgtacgcgcccaatcgccgtatactccccgcatttaacttggatgacattttgatttcatcattagcatccggcgccggattgacgcagcctcgagccggggactgctcttgctgcctcctccgcgggagccgcagccgcagccgagccgcctcgatccctcggtgccgcggcagggccgctccccgcccctccgcacccctccctcatgcgagcccgcccgtctgggtcctcactccgccctcccgccgttggatttgcgcccggggcggcccccgactttgcgccccgtagttgagttccgtttatggtctgatttccggcctctcgcctgctcgccccgccgcccgcctgtcccgctccctccctcccggggacccggaggagaggggaccatgccggaacccgggccggacgctgccggcaccgccagcgcacagccccaaccgccgccgccccccccacccgctcccaaggagtccccgttctccatcaagaacctgctcaacggagaccaccaccggccgccccctaagcctcagccgcccccacggacgctcttcgcgccagcctcggctgccgccgccgccgccgctgccgctgccgcggcggccaagggggccctggagggcgccgcgggcttcgcgctctcgcaggtgggcgacctggctttccctcgctttgagatcccggcgcagaggtttgccctgcccgcgcactacctggagcgctccccagcctggtggtacccctacaccctgacccccgccggcggccacctcccgcgacctgaaggtaccgacctctctttgaactttcgttgtccccctgcgcgcccgccccgtccccgccccgcgctgcttccctccgcagttctgggaccccagcacccgcaaaccctctgctcggtcagtttttttcggcccctagcctgccctcgcgctgggttgcgctgcccgttaatccaatcccacttggtgagaaaagaagtggaattggagccccgggcacggtgcttcccgggaaaagtggcctcgggcgtgaatagggaggcttcggacggccggggcttgggacacggcctggaaggagggggtgattccaatgcgcctaagccgaaagggaaccgttctgccggcccctggcgaggaagctgagggaatggaaggaggtggccgcgctaccaccatctgcttgcctgtcctcgggaggagggggatcccaggactcggcgtcccttctctggcccagccgagaaggaggcagcccgcgggaatggtgaggcctcatggcctgggacctggaggccggcgcgggttgagcctgccgtccccaggcgccgggcctcgctcaaggctgtgtcggtgtgcatgtgtgtgcgtccgtctgtctgtctccccagcctcggagaaggccttgctgagagactcctcccccgcctccggcacagaccgcgactctccggagccactgctcaaggccgaccccgatcacaaggagctggactccaagagcccggacgagatcattctggaggagagcgactccgaggaaagcaaaaaggaaggcgaagcggcgccaggcgcggccggggcgagcgtaggggcggcggcggccactccgggcgcagaagactggaagaagggcgctgaaagtccagagaagaagccggcgtgccgcaagaagaagacgcgcacagtcttctcgcgcagccaggtcttccagctcgagtccaccttcgacatgaagcgctatctgagcagctcggagcgagccggcctggccgcgtccctgcacctcaccgagacgcaggtcaagatctggttccagaaccgccgcaacaagtggaagcggcagctggcggcggagctggaggcggccaacctgagccatgccgcggcgcagcgcatcgtgcgggtgcccatcctctaccacgagaactcggcggccgagggcgcggcggctgcagccgcgggggccccggtgccagtcagccagccgctgctcaccttcccgcaccccgtctactactcgcacccggtggtctcttccgtgccgctgctacggccggtctgaggccccagaggggtgggggagggagcgcccggcctccttgtccggaccccggaggagactgggccgggccgagggcgccgagaagtccagcggccttcaggaactggggcttgggcgcgcagcctctgcttcccctcccccagtcggtagcattttgtaagtatttgcaatgcattttcgtgcaattcatccctaatggattggaggcgcttcccctcttacttttggtttttggcttatattaagagaaagcaggaacaagacaaaattttcgggtcagagatttcggccgatagtttttgtaaaatgtgcagccctcccttccaaatttccattgcgcggtggctttttggttttatttttatagaaggaaaataagcgcaaaacctaaatccctctagtttattcttttctgcttttttttttttttccgagacggaatcttgctc

SEQ ID NO: 105185 - DNA, 152 bp, Homo sapiens; identical to SEQ ID NO: 70530
  chr10:124899035-124899187
  Hyper

SEQ ID NO: 105186 - DNA, 644 bp, Homo sapiens; identical to SEQ ID NO: 70531
  chr10:124899554-124900198
  Hyper

SEQ ID NO: 105187 - DNA, 77 bp, Homo sapiens; identical to SEQ ID NO: 70532
  chr10:124901589-124901666
  Hyper

SEQ ID NO: 105188 - DNA, 2115 bp, Homo sapiens
  chr10:124901892-124904007
  Hyper
ctgcccccccaccaccgggcgctcattctgagccgcgacgccccctcaacaggctcccggcaccgcagagccagaggccacgcggtgagaaccccagtgcgtgcgctcttcttgtgtgagaggccggaggtagagttgggagaaagaggagccggcgaaaaggttagtgggatctgctttcccttctgcggccttctgggccagctagggcctgggagatggggaccagggtcggaggcttgggggcgggagggcggtgctgccggctgcttcctgcaagcggtttgaagaggcatcgcgttgtccggccgcctgcgcaagggccacgcgctgctgctttcacccccttgcgcccgcggggcacctggactccccttaagagtccccgtggggcctgagcttctgctgggcgctacgctgccctccacgattccattttgccccatttactcgggtcgtccacttcccgcggctcagtgacccagccagggggcgtcttccgctagcggtccaaatgtagactccgcaaagaggctaagaagacctgtctacccgggtgcgcgcgatggggtcagggtgtaagaaccaggagcctcatagaaacctctgcttggggtccaaagcccagccgggcactcccagaggacaacatccgcccccgcatgtacacgtggccccgcaggacccagccgcagggctcccacgctcggctccccgccctctcgctgtcccccaccccctaacccgggctttgaggtgtgagcgatcccttgcctctgggcctaggactctggaagtgtgcacggccgttgtgcagggtggatggtgttgaccttttgacctgaaaacagttgggggctggggagcggaggaaggatggcggaagagaggaaagagccacgagaacaactaggcgggatgtacttttgagccctgccgggtgtctccgatcggagtctggggttgagatttgggctgcacttgtccccggtgtgtctctccggcggagtaccctgaaggtgcacgaggtggggagcataggctgaggtgggtaatcgggtcctggatagaaacacaaccctcgtcctcactggggcccatgtatgcgcctgggattcctccccacccttccatttccaggacccctaagggtatcactccagcgacggggcggttctggagacccgagggaagggatagctggagactgcagcgcgccttctccgagagtcccctggaggtgcgcatgagttgtactagcgcagatctcttccttggctgctgctcctggcgatgcatctccgggggaaacttcccaaagtctgagttgccggggttccaaaaggatccctttgggtttaggcctgggagaggtatagagccagcgagagagcgcgttgcgcctatcactgaggcaggagcggtgaggtggagtcacctgctgtgcctcacccaagcgctaatgtcttaaagaaatataaagaatccccttctttcgtgagctccttcaccgccctcgcccccgttggtgatggagtgcacgcatcagattttcatcaaagttctattaagtgaaacataggttgcagggcaccctttgattgaaacagtttaaattttaattgtgtttttaatttgacatatagttgcagaaaggaatgacactgcgtcgccaaggggcggtcgattttcttaatttctcccagaggaattgatgagtctatcaggccactagattggaaacccattaaagctctctggttaggctgttaattggaacttgatggatgtgggggggtggggaggggggtggagagtgtcgggactcggctatgctgatccaatcttcatgactttctgttttccaataaattacacaattcattttccagcagcagattacataaattgtacacctctggggctctctttttcaaatagggagcccttttccccaaaagcctattgtgagatgtcatttgcaccaaagaacgaacagcagaggcccttgaacgaaaatcgaaacataatcaacgtttatacttagaaaatttattgagatcattttctctggtatttccttattttaaagtttggacgcgccatatatcataa

SEQ ID NO: 105189 - DNA, 30 bp, Homo sapiens; identical to SEQ ID NO: 33465
  chr10:124904318-124904348
  Hyper

SEQ ID NO: 105190 - DNA, 677 bp, Homo sapiens; identical to SEQ ID NO: 70537
  chr10:124904557-124905234
  Hyper

SEQ ID NO: 105191 - DNA, 629 bp, Homo sapiens
  chr10:124905481-124906110
  Hyper
ttccagcatgttccccgcacgacatatttacagttcaggaaggttcgaccaactttccctgcctgcccccagctttcttccccagcggggtggctggcactgctccccgagttagctggccagttcccctcggggctgccttgaccctggctccggaggcagcgcctagctcaggatgtctgcgagaagcggatggttagtgagaatccgacgattctttcgctgaacctcccgcgtaccccccaacagcgcgggagcacgcgggacccgctgcgacgtggcccaggagcctgcgccgccgcggcgcagaggagaacgcacaaattgtatttcagcgccaggtccttccgggttaatgagctgacaccatgattaaagctgaccatttgtaatgtgtctcgaccctgccgctgagccctgaagaggttaatgcggtgacggaggccggcacctgcccctcgctggcctcccgggccgctgcgcgcaccccctggcccccgccccctcgcctgcccctgccccggctgcgcggccgactcctaatcaattagcccattaacgagcccctcgaggagttaagtagggaagagttctgccacgggcagggccgcagtcggtaactcaccgcg

SEQ ID NO: 105192 - DNA, 174 bp, Homo sapiens; identical to SEQ ID NO: 70540
  chr10:124906770-124906944
  Hyper

SEQ ID NO: 105193 - DNA, 1105 bp, Homo sapiens; identical to SEQ ID NO: 70541
  chr10:124907268-124908373
  Hyper

SEQ ID NO: 105194 - DNA, 769 bp, Homo sapiens
  chr10:124908904-124909673
  Hyper
gtcgcttttaaaggacggggtgctgggtttggggggccagtgagagggataagaggaggggattggtaaggtgggaccaaggctgcaggcgcttgccaaccgcttggtcccagggagagctggcggtctccgaggctccccaaccaactccatggcctttctgtctgttctcgctcctcaggtacccccaagggcagcggaggctcgggcccgggcggcttggagcgcacgcctttcctctctccttcgcactcggactttaaagaagagaaagagaggctcctgcccgcgggctcgccctcgccggggtccgagcggccgcgggacggcggcgctgagcggcaggccggcgcggccaagaagaagacgcgcaccgtcttttcgcgcagccaggtgtaccagctcgagtccaccttcgacatgaagcgctacctgagcagctcggagcgcgcctgcctcgcctccagcctgcagctcacggagacccaggtaaagacttggttccagaaccgccgcaacaagtggaagcggcagctctcggctgagctggaggcggccaacatggcgcacgcgtcggcgcagactctggtgagcatgccgctggtgttccgggacagttcgctgctgcgcgtgccggtgccgcgctcgctcgcctttcccgcgccgctctactacccgggaagcaacctctcggccttacctctctacaacctatacaacaagctcgactactgaccggcccgccgccccgcgccgcccccagctgccc

SEQ ID NO: 105195 - DNA, 1027 bp, Homo sapiens
  chr10:124910201-124911228
  Hyper
gtgggcttggttacccggcatgataacgcacggaaggttttcaggtttttcggtggaaagacttgcatgcgtctgtctgtggaagtttggctcgctccacgtggagggtgggaccggggtcaggggttaaaggtcgggaccttggcgccgcccagactgcacgtggctggagctgcccgcccactctccctcctaacgcccagaatcgtcgcgcgggctggggcgcaccccggctggaatccagctcaagagtccgcgcggagaaagacaaagactgggaggcaggcctcgccatttaagcgattgccttctgggaacaagcgagctgggtgcccagcggcatattcccggcactgggctcgccttgagcttggccacagcagctcccgctatgacatgccctgtgccgcgcacttcctctccaggggtataaagcaggcgatggcgctgcttgtacctagtaaagcctccactttgctcgccgcgagcttggcgcgaccagcttgtcgctgcgcccagctacccggccggtggcagagttatgtgtctcgcgcggagagggaactgggcgcggtgaggcagttctgcggctcaggagagatccgaggcccgggaccaggcaaagaaggtgagggaggcaaaggcgcttccctacactcttttgttgttaatagtttgcattggttcagcgtgtggctggatcaccggctagcacgcggccgcttgctctgaatggaaccttgacgcgcggcgggggcgcccacggacttcctcgccctgacacctgcggccgcgcaggggctgggagggcgctgcaccgagagaatagccgcgggagtatcatgcaaattgcagattctcgctcccaatagattgcagccacctgttcttggcaaaacctcggaaaaggaagcctgagcttggaggaagccggtggttcagcaccacctggggcgagctcctccggcctctggctgggcagagcggatgcaaaggagcctggagtccgcagcgctgaggccctatc

SEQ ID NO: 105196 - DNA, 30 bp, Homo sapiens; identical to SEQ ID NO: 70546
  chr10:124962095-124962125
  Hypo

SEQ ID NO: 105197 - DNA, 30 bp, Homo sapiens; identical to SEQ ID NO: 70549
  chr10:125219999-125220029
  Hypo

SEQ ID NO: 105198 - DNA, 194 bp, Homo sapiens; identical to SEQ ID NO: 70550
  chr10:125252113-125252307
  Hypo

SEQ ID NO: 105199 - DNA, 572 bp, Homo sapiens
  chr10:125425515-125426087
  Hyper
agcggagacagagctcgcgggcatggggtgagagcgggaggaagcagaggcagaggcggagcaggggcgcaggtgcctgcaacccaggatcccggggcgctaaaggcttcgggttctaccgcacgctcagtcgctggctccagaggtgctgctgggggccagggttcactgccgcgcgccaggtgcctgcccgtgaggcggcgcggggctcccgggtggctgcgcgcccagacgcctgcccgggaggccgcctgaggctccggggtggccgcgcgccctcctgggagccatggcggctggggccggtggtcgccgggcggcggcggcgccgaggggctgagccggccgcgggcagcgccatggcggcgccgggttgcggaccctgagcgccggcgcggggcgcgcaccatgaactcgtgggacgcgggcctggcggggctactggtgggcacgatgggcgtctcgctgctgtccaacgcgctggtgctgctctgcctgctgcacagcgcggacatccgccgccaggcgccggcgctcttcaccctgaacctcacgtgcgggaacctgctgtg

SEQ ID NO: 105200 - DNA, 717 bp, Homo sapiens
  chr10:125650749-125651466
  Hyper
caacagggagattcccgggactggcccatcccagacacacacaatgggagaagccagttgtcccctggaggcgcgcaaccaccggcgccccctcgggctgcccagcgcagaaagttccttacctggtggaggcggctccggagccgacttctccctcttgggagctttcttgggcttggtggccctcttgggcggcctgggctcctgcgggcgccgctcccactcctccccgggccccgcaggcagcggcggagagaaggtctcgagctcgggctccgggcgcgcgtagtagggctcccggctccagatctcctgcccgtaataatcagggtcctcgagggctgcgccctgggctccgaccccggccagggtcactgccaggagcaccagggccagcgctggggtagcggtccccgggcgggacatgcctgctccgccccgcgcccagggcagggtcacggtcaccgggggcgccgggcgggctgcgggcgcagaagctggcgcggggcaagggcgcagggcacagcagagcggcgcgcttgggcgcgggaggcggccggctggctgcgcgtgtgaccggcccgcggggctgggctgggctgggccggggcggacaggggcgcgcagaggcgcggggcgggcgcaggggggccggccccgcccttccttcttccctccctttcccggcgacccctccgaggccggtccttggaggca

SEQ ID NO: 105201 - DNA, 110 bp, Homo sapiens; identical to SEQ ID NO: 70559
  chr10:125732094-125732204
  Hyper

SEQ ID NO: 105202 - DNA, 764 bp, Homo sapiens; identical to SEQ ID NO: 70560
  chr10:125851165-125851929
  Hyper

SEQ ID NO: 105203 - DNA, 1145 bp, Homo sapiens
  chr10:125852132-125853277
  Hyper
ctccccgcccggaaccgccgcaaggctagagccagggttctggaagcgcatccgagctcgcaaccggggagagagtggcggatgcccacttacctgccccgggccgcgcctggaaacttccccaaagtgcgataggggtgtgggggcggagcgcaaggctggggggaatccccgtcccctaccgccaaacgacgcgcgctcacaccgtgaaagcactggtctgtccgtcggtcggtcccccgcctgcggctcccagagctgggcggtgcaggggcgccccgattccgactactgggctccttctcccggacagcccgccggtgcgttccacgcggcttgcgccccccgccggcctccggctatccacggcgccaccacgccactgctcggtcccctgtcccctcgctccggccgcgtcctctctgcgagggagggggcgtgtgtcgccgctgggtaacccttcccgcggggtcctcaagcgcgcagggcgcccggagcgcggccaggaccaatggcgaagggactcctcccgctggggatcgctgaagcctcggggaggccgggccaaggagcccggggcccaaacctgcctcggctcgtcgagctcgcaagttcattgtctgcctgggccgccgccgccaccgccaccgccaccaccgcgccgggagcgccgcggggagtgaggctgcgcgccgcctccgccggcccggactccctacgcccagccccggccgccgccggcgctgcctggcccgaacccgcggaggggcgccggagccccgagcccagggccagacctcctaccgccgctcctcgccgaccccacctcggcgtctggcacctaacttgtacctgagaagcctgagtccagcccgggagcctctgcggctccggctccgcgggagcgcgcccagccccgagcctctagccccgcatccagggcgcgtcaacctgactccccgagcgctgggaggaaaagtttgggagtgacgtgcagacggcgaatgaaacatccgaggagaaccctccccccgccccatgtcgcgctgacacacatcagctccagtctggaatgtgagatcaaggcgtgtgcgccgagcggtgggtttggcccctgccccctccccctccgagtcaacactgct

SEQ ID NO: 105204 - DNA, 198 bp, Homo sapiens; identical to SEQ ID NO: 70563
  chr10:125853693-125853891
  Hyper

SEQ ID NO: 105205 - DNA, 38 bp, Homo sapiens; identical to SEQ ID NO: 42679
  chr10:125919683-125919721
  Hypo

SEQ ID NO: 105206 - DNA, 58 bp, Homo sapiens; identical to SEQ ID NO: 70567
  chr10:126077654-126077712
  Hyper

SEQ ID NO: 105207 - DNA, 115 bp, Homo sapiens; identical to SEQ ID NO: 70568
  chr10:126083109-126083224
  Hypo

SEQ ID NO: 105208 - DNA, 907 bp, Homo sapiens
  chr10:126135816-126136723
  Hyper
ggacactttgaaggacggcagatccctgaccccttggtggcccgcgaggatcgcgggtgcgcgcggcgggcaggggtgcgctgacacccgcgcacctgcacccccggtggaggagccgagggcacacgacgatgccaatccctcgtgaatcccgcgaaagaggggccagggggctccggattcatagacgcggggcgtagaagggggtcaggtaggaaggcccaaggaacggcgcgaaagggctcccgggggcggcagccgtcagcgggaaggaggcggcggacgggaagaggacattggccgcggagtaggaggggaaagtctggaagtgcagagcgccggtgccgggagggccaggactgccccccgagccgccgccgccgccgccccccgccgcccctggctggggcgcgccaccccccacctgcgccgcgccgtcggcacccgggttctgcttcttccacttggtcctgcgattctggaaccagattttgacctgcgtctcggtgaggctgagagacagcgcgaggttcaggcgctcgcacactgacaggtagcgcgtggcccggaacttgttctccaaggccaccagctgctcgtaggtgaaggcggtgcgcgcgcgccgcggcttggcgcagttgggctccaggcgccggcgcctgggacgcggggagccgggggatcccgggggggacctcacagggccgcccccgccgtcctcgcagggctccccagacgccaatgccccggccggggcgtcaggtgagcgcgctaggcccggcagcaagcgcgcagcccgctcccgcagccgcggcctcctcggatcctccgcatcctcctcctcttccgcctcggaaccctccaggggggacgcctggccggcgcctgggcccgcagcatctagggg

SEQ ID NO: 105209 - DNA, 1885 bp, Homo sapiens; identical to SEQ ID NO: 70571
  chr10:126137221-126139106
  Hyper

SEQ ID NO: 105210 - DNA, 30 bp, Homo sapiens; identical to SEQ ID NO: 70572
  chr10:126184143-126184173
  Hypo

SEQ ID NO: 105211 - DNA, 186 bp, Homo sapiens; identical to SEQ ID NO: 42680
  chr10:126198949-126199135
  Hypo

SEQ ID NO: 105212 - DNA, 30 bp, Homo sapiens; identical to SEQ ID NO: 70574
  chr10:126254787-126254817
  Hypo

SEQ ID NO: 105213 - DNA, 30 bp, Homo sapiens; identical to SEQ ID NO: 70575
  chr10:126278930-126278960
  Hypo

SEQ ID NO: 105214 - DNA, 216 bp, Homo sapiens; identical to SEQ ID NO: 70576
  chr10:126314006-126314222
  Hypo

SEQ ID NO: 105215 - DNA, 209 bp, Homo sapiens; identical to SEQ ID NO: 70577
  chr10:126314738-126314947
  Hypo

SEQ ID NO: 105216 - DNA, 159 bp, Homo sapiens; identical to SEQ ID NO: 70578
  chr10:126331927-126332086
  Hypo

SEQ ID NO: 105217 - DNA, 31 bp, Homo sapiens; identical to SEQ ID NO: 70579
  chr10:126479341-126479372
  Hypo

SEQ ID NO: 105218 - DNA, 31 bp, Homo sapiens; identical to SEQ ID NO: 70580
  chr10:126479612-126479643
  Hypo

SEQ ID NO: 105219 - DNA, 209 bp, Homo sapiens; identical to SEQ ID NO: 70581
  chr10:126697825-126698034
  Hypo

SEQ ID NO: 105220 - DNA, 30 bp, Homo sapiens; identical to SEQ ID NO: 70582
  chr10:126710554-126710584
  Hypo

SEQ ID NO: 105221 - DNA, 90 bp, Homo sapiens; identical to SEQ ID NO: 70583
  chr10:126712034-126712124
  Hypo

SEQ ID NO: 105222 - DNA, 30 bp, Homo sapiens; identical to SEQ ID NO: 70584
  chr10:126744811-126744841
  Hypo

SEQ ID NO: 105223 - DNA, 87 bp, Homo sapiens; identical to SEQ ID NO: 42687
  chr10:126809890-126809977
  Hypo

SEQ ID NO: 105224 - DNA, 171 bp, Homo sapiens; identical to SEQ ID NO: 70586
  chr10:126814656-126814827
  Hypo

SEQ ID NO: 105225 - DNA, 49 bp, Homo sapiens; identical to SEQ ID NO: 70587
  chr10:126847190-126847239
  Hyper

SEQ ID NO: 105226 - DNA, 48 bp, Homo sapiens; identical to SEQ ID NO: 70588
  chr10:126850174-126850222
  Hyper

SEQ ID NO: 105227 - DNA, 30 bp, Homo sapiens; identical to SEQ ID NO: 70590
  chr10:126881168-126881198
  Hypo

SEQ ID NO: 105228 - DNA, 30 bp, Homo sapiens; identical to SEQ ID NO: 70591
  chr10:126914656-126914686
  Hypo

SEQ ID NO: 105229 - DNA, 194 bp, Homo sapiens; identical to SEQ ID NO: 42689
  chr10:127380217-127380411
  Hypo

SEQ ID NO: 105230 - DNA, 30 bp, Homo sapiens; identical to SEQ ID NO: 70593
  chr10:127445232-127445262
  Hypo

SEQ ID NO: 105231 - DNA, 108 bp, Homo sapiens; identical to SEQ ID NO: 70594
  chr10:127451959-127452067
  Hypo

SEQ ID NO: 105232 - DNA, 134 bp, Homo sapiens; identical to SEQ ID NO: 70595
  chr10:127463291-127463425
  Hypo

SEQ ID NO: 105233 - DNA, 36 bp, Homo sapiens; identical to SEQ ID NO: 70596
  chr10:127464167-127464203
  Hypo

SEQ ID NO: 105234 - DNA, 93 bp, Homo sapiens; identical to SEQ ID NO: 70597
  chr10:127475463-127475556
  Hypo

SEQ ID NO: 105235 - DNA, 30 bp, Homo sapiens; identical to SEQ ID NO: 70598
  chr10:127568161-127568191
  Hypo

SEQ ID NO: 105236 - DNA, 36 bp, Homo sapiens; identical to SEQ ID NO: 70599
  chr10:127582121-127582157
  Hypo

SEQ ID NO: 105237 - DNA, 35 bp, Homo sapiens; identical to SEQ ID NO: 70600
  chr10:127601472-127601507
  Hypo

SEQ ID NO: 105238 - DNA, 36 bp, Homo sapiens; identical to SEQ ID NO: 70601
  chr10:127753348-127753384
  Hypo

SEQ ID NO: 105239 - DNA, 338 bp, Homo sapiens; identical to SEQ ID NO: 33489
  chr10:128075686-128076024
  Hyper

SEQ ID NO: 105240 - DNA, 1201 bp, Homo sapiens
  chr10:128076244-128077445
  Hyper
tggggatattcactgcgggatagggccagcaagaggacccgacacgcatcgtcccgagtgacacgtgtaaatgtcaagatacagagacatctgcaaatgtcacccaagagggtgaggacgggggagcggtcccgaggctgtgccctccggggcaggtactggctcctgtggggctgcgggccaagtgtcgcccttccccaaggaattggcacctggggggggggggtcggtctcgccgcgctggaagcgcaagccccggggctccggagatgcgccggggcgcgtcgcccctcggggcagccctggacctcggcgcgcccaggcgcagcgtgcggtgccctcggcggggcgggcagcgagccgccctagttcggcgacttacctcgggcctcgcagggcgcgagcagagcaccggccagggcgagcaggagggcgcgggcgggggacacgggcagcgggcgcgctgccatcgtcgccggccttcagtgcagcagctctcgggcccggcggcgagcgctgcaccatcccacgcgggcgccgagccggggccgggcgtcgcgaccggagggatttcctgcctcggcgagtcagctccggagccctcgcgcagcgcccgcgccgccgctgagctcttctagcctttcatttttaaaaaagtttccccccgtgtgtgtgcgtgcgtgcgcgcgcgcgcgccgttctggcacaagccagccttgaccgttgcaataaatgagcaaactgtccgagttggcccggggactaggaagagcgttagtgagagaaggcaggcctgtgaaatggatccacggccagcagtcaccgttcttattaccgcggaacaaattattgtctcccccgcacccccgccagttggcggcgtcccgcgggtcctagagaccgctcgggtccccccgccagggtcccgccccgagccgcggctcgctcacccccgagggtgggcggctcagacgtggctcagtggcgtccgggcgcccggagcgcacacgtccccgccccaggatgatgtggccgcagggcccggggcgcccggctgccaagcgcacatgcggcggcacggtccagcttttcaggctgaagctggaaacgatgactctgctactcgctccccggctctctgggaaccctcggagtgcgggtcaggtctccaccgcggcccacagcccggcgcgcgaccccg

SEQ ID NO: 105241 - DNA, 32 bp, Homo sapiens; identical to SEQ ID NO: 70608
  chr10:128593761-128593793
  Hyper

SEQ ID NO: 105242 - DNA, 203 bp, Homo sapiens; identical to SEQ ID NO: 70611
  chr10:128888576-128888779
  Hypo

SEQ ID NO: 105243 - DNA, 992 bp, Homo sapiens
  chr10:128993490-128994482
  Hyper
ctccaggagctgccccgaccccgggctgcccgcgggctccctcctccctcctgccctcgcccgccagctcgcagtctcttaggtctgcagcgttggttggtttcccacgcctgtcccggtctgactcgggctgccaggcaccgggaagccccgcggcgccgaccccaacccgcagccccgggaaggtgccaaccccagcgagtggaggagacgagcatttcacgtgggcatctgccttcactgctgctcgcgcctctcctcaacggccggcgtcagggcccctctgttccaactcatcccccccccgaagttaatcagccgtacttgtactttccagggcgctttagtttggaaaatacttaaaagcctcgaaaccttccggggagacggccgcccccagatctcccagttttgcctggctagggctgtcgggcgctcacgaagctgtggcgtctgtctggaacccacatcgcagaggcgcagccccgctcctccctgacgtcgccaaagttgccagacgcccctcagcgacccggtcgcgccagatgcagttgcataaccttgccccccacctgcgaccgcaccgggtccgctcccggctgcaccggggtgtcccggccccgggagccgccgagtttccggccaagccggtttggggccgagtgtgtgcgcccgaatcggggtcggcgcccgtcccagcggtgctctgcccgcggccaagtacgacgggcgcgggggcgcgggaggagggcacgcggggctccgcttaccttccgctgcttacagataagtcgaggtcgatgcagcgcctggctcgggcatgtctcgctgcggaccctggcaagcctggggcggcacggagcactccggacagggcatccgcggccagactcgccgcgctcacgcggaggaagcctcggctccggggacttggcccgctgcgcgcctgctgcccgccccctccaccgctgccggcccggccctgctggccc

SEQ ID NO: 105244 - DNA, 225 bp, Homo sapiens; identical to SEQ ID NO: 70614
  chr10:128994686-128994911
  Hyper

SEQ ID NO: 105245 - DNA, 1662 bp, Homo sapiens
  chr10:129534660-129536322
  Hyper
cagcagagagcttggcgctctccgctctgcgcgcccgaggtcacagcgcggagaaacctggcggggccccggactccccggcttgggaaaagcgatgactgccctgaactgctggggcgttcgaaatttccagggtcccgaccctccgtggggtacgcgcgacttcggcgcagatgtcagtccgctgccttccgggttgagggagcgaggactccagacgaccccagggccgctgtccaggcccagccccgcgttctccacctcgccacctcgctctgcggctccagcctggagatctacggacttcattgcgatctcttgcgcagtgtagtcgccctctatccctagccccgagtcccgggtaacccaggggccccggcgaggcgagtttctttggggcgagatgtcccgagccgagcaaaggggccgcgcattggacggggctcccaagccacagccctgggggccttgaggagtcgtggtacggtccagggcagtcggggctgcggggcccgtgaagccagacgaggctacggacttagggtccctgcaaccaagaccgcgagcgactgtggactcgggacggatcgcacaaaggaggaagggggaatcagaggggcgtccggtccaggacgtgtcaggcctgggcggggcggaaaactgacaccagggcgaggacaaggatttcgctcctccagggctgccaggggaggggctcgccaccgtcactctccatgggctctggccccgacggtgtttaaagggcggagggctgggccgggctggtcgcacccgggcgctgctggcggccaagctggatgggtcgccagtgagtttcggtgcggcaccgctggcccaggcccgggcgcggctggacatggccacctactgcgacgacctgggcccctcctcggccccgcccggccaggcccaggccaccgcgcaccccccgggctatgagccaggggatctgggcgcggtgggcgggggccccctcctgtgggtgaacgcgccagcgctcagccccaagtcctacgcttcgggtcccgggcctgcgccgccctacgcggccccgagctacggggctcccggcccgctcctcggcgccccgggcggcctggcgggcgccgacctcgcctggctgagcctctccggccagcaggagctgctgaggctggtgcggccgccctactcctactcggcgctcatcgccatggccatccagagcgcgccgctgcggaagctgacgctcagccagatctaccagtacgtggctggtaacttccctttctacaagcgcagcaaggcgggctggcagaactccatccgccacaacctgtcgctcaacgactgcttcaagaaggtgccccgcgacgaggacgacccaggtaacagcggcgcgccggctcgctccgtccaggactccccatcttcccgccgggccgcgggcactccgggggtgggagcaccttagacaacctaatttctccctgcgcggttggggatacccggggaggagggagaaggggaagaagtgcttgggcatggacaggttctcagacagcggctgagcccaccacaggcccgcgtttacagtgcggcggtcccggggctctcaatctctgtgcgctccttcggaggaagaagcgggagagccagcaa

SEQ ID NO: 105246 - DNA, 30 bp, Homo sapiens; identical to SEQ ID NO: 70618
  chr10:129684716-129684746
  Hypo

SEQ ID NO: 105247 - DNA, 402 bp, Homo sapiens; identical to SEQ ID NO: 70619
  chr10:129705629-129706031
  Hyper

SEQ ID NO: 105248 - DNA, 30 bp, Homo sapiens; identical to SEQ ID NO: 70620
  chr10:129885942-129885972
  Hypo

SEQ ID NO: 105249 - DNA, 135 bp, Homo sapiens; identical to SEQ ID NO: 42695
  chr10:129888855-129888990
  Hypo

SEQ ID NO: 105250 - DNA, 30 bp, Homo sapiens; identical to SEQ ID NO: 70622
  chr10:129897051-129897081
  Hypo

SEQ ID NO: 105251 - DNA, 117 bp, Homo sapiens; identical to SEQ ID NO: 70623
  chr10:129914687-129914804
  Hypo

SEQ ID NO: 105252 - DNA, 122 bp, Homo sapiens; identical to SEQ ID NO: 70624
  chr10:129925726-129925848
  Hypo

SEQ ID NO: 105253 - DNA, 24 bp, Homo sapiens
  chr10:129947242-129947266
  Hypo
taggtgatgggtacacggggtttg

SEQ ID NO: 105254 - DNA, 211 bp, Homo sapiens; identical to SEQ ID NO: 70626
  chr10:129947985-129948196
  Hyper

SEQ ID NO: 105255 - DNA, 30 bp, Homo sapiens; identical to SEQ ID NO: 33501
  chr10:129948725-129948755
  Hyper

SEQ ID NO: 105256 - DNA, 17 bp, Homo sapiens
  chr10:129953663-129953680
  Hypo
attatttttttgagacg

SEQ ID NO: 105257 - DNA, 735 bp, Homo sapiens
  chr10:130008498-130009233
  Hyper
cacagtaatcagaggcggcctttacaaatagattgcatttgaccttgttggtttgatggacgggagtggagtccggccgcggacggcgtcccttccagggccggccgccagagggcgagcgcgccttcccgggcggggcggggacgggacggggacggggaggggacgggacggggacggggaggggacggggacacggacacgggaggcttccgctcgcccgcgggtggcgtctctgctcccactagagcgggccaggcctctgggttccgtttctcaagcacacagggagggtggccgcgggccaggggcggccgcgagactccacgtccacgtcccgggcagtccctccggaggttgggccgcgcggcccggggagcggagcgctgcgcttctctgcgagcaccccggggcctttaggcgcccccgtttcctcgtcagtggggggcgcggtgccgcttctccgcgggctaaactgctgaggaaggggcgagttcctgcggcccctgcctgtcccggccacgccccacctccgccccgccgcgttgcgcgttcccgcggggccccgggcacccctggggccccggggatctctgacgcccccttccctccaacccccgctgcgatcccacaggtggggtgaacagcgcccctgctgtcccacggggcgtcttcgcgggtgatgcccacactctcagcctgaagagcaggacctgtccgcgggtggggcccacc

SEQ ID NO: 105258 - DNA, 53 bp, Homo sapiens; identical to SEQ ID NO: 70631
  chr10:130012130-130012183
  Hypo

SEQ ID NO: 105259 - DNA, 104 bp, Homo sapiens; identical to SEQ ID NO: 70632
  chr10:130065661-130065765
  Hypo

SEQ ID NO: 105260 - DNA, 545 bp, Homo sapiens
  chr10:130084893-130085438
  Hyper
taccagcacctgggccgtagttgtctcctggctcctggggtccgcggagctctagatgtacctgcagctcctcccgagtcctgcaagccacccttgtccctcttctcccgctcaccccccggcccccccatctcttttgctattccggggaaggccacgcagggtgcaacccggacgcgcccccgggggaagcccgcgacgcagcagccacacccccagcctgcactggcgcccaccccatgacttcgccttcgcggtcgcgggcagggagcgcgcgtttccatcggttgattagaagcgggagtcggaggagcccccgcccgccggcggccagcgcacagcccggccaggggcgccctccctgccgccgccggccctttgatcgcccgcggcccgcggcccgcagaccacagccagcgctgtgctgggcaggtggcggcagcggggcgcggcgcgctcaggcgcacgggtccccgggccgcggcgcgctccccgccacgccgcacatcaaggcccggccggccggcgggcgccttcattagcag

SEQ ID NO: 105261 - DNA, 34 bp, Homo sapiens; identical to SEQ ID NO: 70636
  chr10:130166708-130166742
  Hypo

SEQ ID NO: 105262 - DNA, 232 bp, Homo sapiens; identical to SEQ ID NO: 70637
  chr10:130203334-130203566
  Hypo

SEQ ID NO: 105263 - DNA, 36 bp, Homo sapiens; identical to SEQ ID NO: 70638
  chr10:130268452-130268488
  Hypo

SEQ ID NO: 105264 - DNA, 53 bp, Homo sapiens; identical to SEQ ID NO: 70639
  chr10:130268909-130268962
  Hypo

SEQ ID NO: 105265 - DNA, 30 bp, Homo sapiens; identical to SEQ ID NO: 70641
  chr10:130299142-130299172
  Hypo

SEQ ID NO: 105266 - DNA, 176 bp, Homo sapiens; identical to SEQ ID NO: 70642
  chr10:130317077-130317253
  Hypo

SEQ ID NO: 105267 - DNA, 207 bp, Homo sapiens
  chr10:130338788-130338995
  Hyper
cgtaactttgggggtcggctccctgggcccccagctcacgatgcccgctaggagccggcgccggggcgccccaaggctgcctccccccgcagcgctgcgcagtgcgccctggtgggatggggacgctgcacccctgaacccccccaaatccggcaggcctagggctggaggcgcggaaaccctcactcctgccgagctcccgagcgg

SEQ ID NO: 105268 - DNA, 89 bp, Homo sapiens; identical to SEQ ID NO: 70644
  chr10:130339328-130339417
  Hyper

SEQ ID NO: 105269 - DNA, 137 bp, Homo sapiens
  chr10:130339653-130339790
  Hyper
tatgtgcataaccttcgctgtctcgctaaaggtcagcgcgcccctgctcatttcccgggctgccttttgggggcactctgatgccggggatttcctcgggtgttggggaaacaagacgtgctcgcctaacaaagact

SEQ ID NO: 105270 - DNA, 29 bp, Homo sapiens
  chr10:130402649-130402678
  Hypo
tggagtgcgatggcacgatctgagcgtgc

SEQ ID NO: 105271 - DNA, 30 bp, Homo sapiens; identical to SEQ ID NO: 70650
  chr10:130520011-130520041
  Hypo

SEQ ID NO: 105272 - DNA, 63 bp, Homo sapiens; identical to SEQ ID NO: 70651
  chr10:130546173-130546236
  Hypo

SEQ ID NO: 105273 - DNA, 243 bp, Homo sapiens; identical to SEQ ID NO: 70652
  chr10:130577739-130577982
  Hypo

SEQ ID NO: 105274 - DNA, 20 bp, Homo sapiens
  chr10:130754356-130754376
  Hypo
gacgccgatgctcctgcaga

SEQ ID NO: 105275 - DNA, 22 bp, Homo sapiens
  chr10:130803707-130803729
  Hypo
agaactgaggccaggcgcggtg

SEQ ID NO: 105276 - DNA, 30 bp, Homo sapiens; identical to SEQ ID NO: 70656
  chr10:130829116-130829146
  Hypo

SEQ ID NO: 105277 - DNA, 110 bp, Homo sapiens; identical to SEQ ID NO: 70657
  chr10:130829975-130830085
  Hyper

SEQ ID NO: 105278 - DNA, 85 bp, Homo sapiens; identical to SEQ ID NO: 70658
  chr10:130855248-130855333
  Hypo

SEQ ID NO: 105279 - DNA, 144 bp, Homo sapiens; identical to SEQ ID NO: 70659
  chr10:130855393-130855537
  Hypo

SEQ ID NO: 105280 - DNA, 30 bp, Homo sapiens; identical to SEQ ID NO: 70660
  chr10:130911792-130911822
  Hypo

SEQ ID NO: 105281 - DNA, 152 bp, Homo sapiens; identical to SEQ ID NO: 70661
  chr10:130914837-130914989
  Hypo

SEQ ID NO: 105282 - DNA, 41 bp, Homo sapiens; identical to SEQ ID NO: 70662
  chr10:130938219-130938260
  Hypo

SEQ ID NO: 105283 - DNA, 179 bp, Homo sapiens; identical to SEQ ID NO: 42702
  chr10:130946123-130946302
  Hypo

SEQ ID NO: 105284 - DNA, 134 bp, Homo sapiens; identical to SEQ ID NO: 70664
  chr10:131034780-131034914
  Hypo

SEQ ID NO: 105285 - DNA, 30 bp, Homo sapiens; identical to SEQ ID NO: 70665
  chr10:131058458-131058488
  Hypo

SEQ ID NO: 105286 - DNA, 208 bp, Homo sapiens; identical to SEQ ID NO: 42704
  chr10:131058908-131059116
  Hypo

SEQ ID NO: 105287 - DNA, 81 bp, Homo sapiens; identical to SEQ ID NO: 70667
  chr10:131146694-131146775
  Hypo

SEQ ID NO: 105288 - DNA, 30 bp, Homo sapiens; identical to SEQ ID NO: 70668
  chr10:131171764-131171794
  Hypo

SEQ ID NO: 105289 - DNA, 49 bp, Homo sapiens; identical to SEQ ID NO: 70669
  chr10:131265287-131265336
  Hyper

SEQ ID NO: 105290 - DNA, 47 bp, Homo sapiens; identical to SEQ ID NO: 70671
  chr10:131323870-131323917
  Hypo

SEQ ID NO: 105291 - DNA, 30 bp, Homo sapiens; identical to SEQ ID NO: 70674
  chr10:131377867-131377897
  Hypo

SEQ ID NO: 105292 - DNA, 30 bp, Homo sapiens; identical to SEQ ID NO: 70677
  chr10:131456424-131456454
  Hypo

SEQ ID NO: 105293 - DNA, 30 bp, Homo sapiens; identical to SEQ ID NO: 70678
  chr10:131503379-131503409
  Hypo

SEQ ID NO: 105294 - DNA, 30 bp, Homo sapiens; identical to SEQ ID NO: 70679
  chr10:131510626-131510656
  Hypo

SEQ ID NO: 105295 - DNA, 30 bp, Homo sapiens; identical to SEQ ID NO: 70680
  chr10:131592644-131592674
  Hypo

SEQ ID NO: 105296 - DNA, 213 bp, Homo sapiens; identical to SEQ ID NO: 70681
  chr10:131606675-131606888
  Hypo

SEQ ID NO: 105297 - DNA, 36 bp, Homo sapiens; identical to SEQ ID NO: 70682
  chr10:131636273-131636309
  Hypo

SEQ ID NO: 105298 - DNA, 120 bp, Homo sapiens; identical to SEQ ID NO: 42706
  chr10:131641071-131641191
  Hypo

SEQ ID NO: 105299 - DNA, 218 bp, Homo sapiens; identical to SEQ ID NO: 42707
  chr10:131647719-131647937
  Hypo

SEQ ID NO: 105300 - DNA, 174 bp, Homo sapiens; identical to SEQ ID NO: 70685
  chr10:131739036-131739210
  Hypo

SEQ ID NO: 105301 - DNA, 30 bp, Homo sapiens; identical to SEQ ID NO: 42709
  chr10:131739627-131739657
  Hypo

SEQ ID NO: 105302 - DNA, 1316 bp, Homo sapiens
  chr10:131757029-131758345
  Hyper
gagcgcgggctcctccgcggcccggcgcgcggcctcgggccgattacatttcaatcgatgcccttcccggagctgggcggggtggcggcgcctggacgcggcgtcctttgtagacgcagctggcgccgaggcagcccgcgcccccgccgcccgccgcccgccgctcacctgcacatgatctcgtgggtcagcagcacacggcacatctccgggttcttgtcctggccctcgtagacgatggcctgcgcgagggacaagcagaggctggggttacgcggcgcccgcggctttggcgccaaatcgccccgggcgctgcaggcctggctggcagcaggtgcaccacgctcgaggggaggcgatgcgcccccctccctcggccaccctcccgatggggtcaccctcggagctgggctaggccgcgatggcttctccctcccctgcctcccagcctcctcccccgggcgcccgccaggcctgcgaggggccttcggctgcagggaaggcgccgactgggctcgggccgcggggagggcagggcgagggaggccggggccggggcgcaaggagcgagagcccgctggcaccgaccccggaacccggggctcccgggccccttcggcattccgcgccgccgccaggccgcgtcctcaggccattgtctacaacgagttccaatctgcatgttgggagaggccgatcagaacgccccgaggctaaagaagcagggaaggatggtcgcggcgcaggagcagtttgccaagggccgagggccgcgcccgccctgccctgcgcgctcccccggctctagcaagtctggcgccccgcggcttcccgcggcttcccgcgttccaaacccaggcgcccgcggggagcaggccgccctggaccggccgccgtcccgagctcccggggcctccctgagtggtgggcagcgacctggcctctgcacgctgcgggcggcctgggagcccaggcgggaggcccaggagcagcaaccgcacgtgggccgcggcgtcgccagcgccccgcaggagtgccggggccccagggcgcccgagcccgcgcggccacgtgctcctcgccggatgatatttggaaagaaagtgctaatggccaatctggtgtttattttgaaactgctaacagtgatttttctcgggtaaaaaggcagtctctgcgcgcacgctcgggtgggttttgagcagaggctccgccagatggtgcgaagccctaggtgcgctcacggccgcgctcagcccggctccgccgctgggaacccgagctggggatcgggagccgcccgcccgggctgggcc

SEQ ID NO: 105303 - DNA, 2936 bp, Homo sapiens
  chr10:131761007-131763943
  Hyper
tacttcaagccccaccggttaatcatgtgaagtgccatcgacttattgatcgtttatgttttgttttccttctatgccatgagaagatttcgtgtttacatccatgtcattttaatctcaaatctttatgtcctttcaccagcgcagaaaaggagagccagccgctgcaggggcggcgagcacgcagcaggcacttaccgttgctgtacaataactggagtttatagtggatgccgttgttggttttctcgttgtttggctcctgaaagtaacgataaataattgcatttagtgcgatcggtgtcaggcgcggccaccacgctcggtccccctccgcgaccgaggctctcggcctcacacatggcaggattcctagctcgaagcagcgcggtgatgtcactttcctgctggaagcccagcgttctcctcgccccgagtaagtccgagggcgcagagaagttgcccagccctcggcggtcccgggcggccgcacgtggcggcggcggggtggcctggcggagccgagcccgccgcctaggggggcactcgaacccccgcgcaccggcaccgcctgcctcccgcttctagaaagagagagggtgtgatcgtgtgtttgcacttactttctctttctccacaaagtccacaaaagcggtcctttcaatctccaccggctgcccctgcctatcgtagagcgccagcacgaagtggaagaaattggatttccggaggttggaaggcggctgcttctcgaagtgcgcccgcgccagccccacgccgctgcgggaggaaagagacagcggcccggtgaggagcgcggcgccggccggcggagggggccgggccgggccggggccggggccagggcgcgcgggggcggccggtacgtacctctgggcggccgtgttggcgtccaccacgcccgccgtgtgcatccacgagcgcaccgggttcatgccgctgcccagcggctcctccttcatggtcgtccccccgcgcggaatattctcctgaatcccaaacatgaaaactgctggcggcggccgcagctcccggccgaaagcgtttcctcgagcagcggcgctcggggcttggcggcaggcggctgccctggccgccctcgccctgctcggcgcctgcggtccggccccgccgccggcttcagcccgtcccgggcaggcgcgacatacaccagcggccgggcgctccggacggccaggggcgcggaggcggctccaccggcggcggcggcgcttcgaaggagcaggacgcggtggccgcggcggcgcttgttgttgttgttgtttgcaggcgcgctcaacgtggtgtcatcctagccaggcggcgtccgcggctgcaggacactgcgggatcgcccgcttctggcgcggcccgcctgctccaaagacaaataaacggggcagtgagtgctgcggcgcagtcccgggcgcaggcggggcgcggcggggcctggagcggcgcgcgcagcggacggaggcgcacaaaactcagccctctctccccgaggaatggaccctttcccgggagccaaaactcgaagcccccgggagcggcgctgtcagagggtgacgtcggggggcggtgcctgcgccatatatgggagcggccgcccctcgccgcgcccctcgccgccgccgccgccgcgctcgccgactgactgcctgacggcgccgcgagccggcccgagccccgcgagccccgcgagccccgccgccgccgagcgccaccgagcgccgccgccgccccccgccacgcaccgcggctcctcgcgtccagccgcggccaaggaagttactactcgcccaaataaatcttgaaaagaaacaaacgcagccactgcacaattgcagtttggccccttaatacctccctgcaaaacctgccacacagtcgaacacgatgggcggggcggggggctgtaaaatgctgaggcgccccaagttgcccagatgcatgcaataaatgcaaggggctgcagcttgtcctggggccgcccgaaggagaagtgggaagaggcaggtcgaccgcagggagggcgccggagggaggagcgggcaacggactgggaggaggggtgcccagggctccccggccaaggctggacgcgcagctcagcctgatttctaagcagacctaaggctgctgcagggccggccggtcccggtctgagccccgccaggtaccccaagcttcctaccccggcggaggccgccgagtgccgggcagggaatcacgtcggaggcagggtctgccagatgctccctctcccccggtggccgcggcagaccccggcccctggcctgttcttacgcacagcgagtgacaaagaaggctccggtctctccgggccgacgggaagcgcgcccggcctctccggcgacccggagccgggtgtctggctgcgcgacctgcgcggtggccagaccgccctggagccaactgctccaaaaaccaagcggacgccgcgggcgctgtggcccggccctcggagccgccggacccgggtgagcgcgcggcgcgcggcttcccgacctggtttctaggaatcgggagggcagccgggcgcgggcagactgtgggccccgcggcccagctcctgtagccgggactccgcgcccaggagcgcggcccgcccaaaggacgtctgcgcgacacggagcagagacccaggggacgaccaggaactgtcctaggcacttccctgccaagagaaatcaggcccttttgattaaaagaaaaaaaaaaaaaagattgcagggcgcaagtgtgttgcagggcagcctcctcccgccgggtctggggcagcactcccttttcccgtgaattggcagcgtgtgtacgttaatattttaattaatcgggaaagtcgaagtccgattcacgttgtctggggacccccacgcctcttggaagga

SEQ ID NO: 105304 - DNA, 30 bp, Homo sapiens; identical to SEQ ID NO: 70692
  chr10:131767417-131767447
  Hyper

SEQ ID NO: 105305 - DNA, 1645 bp, Homo sapiens
  chr10:131768685-131770330
  Hyper
cttctggaagctaaccgcgcacaaaagtttgccaataaaattctagtttgaaaccgcggtttgccaacacgagtaaaggaagttggggtggtggagagctacagtgggcacggacggaaagggtggccacggtcaccgatgtactaatgtcctcctcctcggctacccgatctcactccttcacagcaccttaacagagtgtatacacccgttctggtgcgcaaaagtggggcgatgggtgccggcggccgggccggggagtccgtccgggtaattaactcagctccggcgactgcgacgatgaggccgggagggaaggaagagcataccgctcttggacagaaatgtgtcaagctctcctcccttccagcctgcataaaccctttcgcgcacattcgcgcgacttctaagggatccaagccagcggactgggtccagcagcgcgcggcggcgggacgcacccctcctctccccccaggaaggcgggtgcacgccggggctggaagggggagggtgcacctctggctacaaattcggccgcgaagagattctttaccaactctaagggtttgctgaatgtacagaccagaatgagtcccgttaaaaggaagctattcccacattaaacatgtgtgttttccatactaatggagtcacttaaagctgttgctaatttaactttttaaaaaggccacactgtggaaatttgcattttctttaggacattgaaatgaagagaaaactgctgggcggcaaggcggcccagggcatagctaggggccatgtagaaataaaaacagataaagaaaagaagaaagaaagaaaccggcttctcttctagactattaataagcaatttgtcccgctgaaatttacattgcaaagcggagggcgccggcagccgtggcggcgggcctggcgcgggctccgggggtgcgtcggcgcgggggcggggggggtcctccggccatccgggccgccctcgggggcgatccaccggcggctttgaactcggtgtccttgccgccgtgccgccgaccctcgcccgcacacgcgcgcatctgcacgccagggccccgcctgggctgcgcacccggaggccgggactggcgctgcgctagcgccacccgggctgagctgcagccttttgtggggggggcgggaatccctccgctcccagtgacgccttggactcgcggacccccatccgccccaaacgactgcccaggccttaaattaaaaatggcaacaataagcttaatttttttttcctccttagccgcgccgccccggtccaagtctaccgcaagcgtggagccccgagcgccgcgcccccgccggctctcccgcccgcgcgccgcccgacggagccgcggatcccgggcctagcgtggggccagggcgccatctacgggcgccgcgcggctccgggcggccgccgcctcctccctctcagcgtccagagcccgctcctcctcccgccgccgccgccctcgccccgcgccgcctgccacttatcacaattacccgacgctcccgtgccattttgcttatgaaacactgattgctagttatgcggacttttaagcactatattaaaactttcgaaatgaaggcgctctcctgcctgcgatttttaggtaca

SEQ ID NO: 105306 - DNA, 889 bp, Homo sapiens
  chr10:131770569-131771458
  Hyper
ttttggttgttaatccgaaaggaggagttttaattgcttcctgcgttgtcgtccaggcatctaggcgcttcgaccttccccatccctctctccaagggtctggcgtttgtactgggggaagacggagagtgaaaaacgcggggtccttcagctaaatcctcggaaccccggatcttcgcccgtgccggtacgcgcctcccccgcgccgagaatccctggcacgcgatcgcctccccgcaggcccgccgggaaggccgcgagcagaggccaacggaggcctcccaggcagtgctcgccaggaaccaagacgctgccagggcgcggcgcaaaagttcactgcgaggccaggcctgggcgcagctcatggtcaggggctcctgcctccacagtcccaccccgcgcctccgccgcagccccgcccgcgctcccgtaggcgagaggagcgcacccggctccggggccccggcaacccggcccccagcgttcagtgtccggcccgccacgcgcgaagttcaactttgctggcgccgcggccgcctgggggccgcgggctggggcggggagcccccgacgggatcgagagcgcgcttacctgtgccgctcactcgacggacatcgcgggcgccccggccgcgaggtgtcggcggcgccggctgcgggccgggaggtgggcggccccgcgccttcccacgttcccacctcccgccctcccgggagagcccacgggcccggccgcgagcacgccagtgcgcacgcgccacactgccttccaccgcgggcggcgggctagggccgagcgggggcgcgtggaggtgcccgtaggcggcccagcggcccgcctgccaccgtgccccggggccgcagctgcgcccagcgctagccacctgga

SEQ ID NO: 105307 - DNA, 315 bp, Homo sapiens; identical to SEQ ID NO: 70698
  chr10:131825216-131825531
  Hypo

SEQ ID NO: 105308 - DNA, 786 bp, Homo sapiens; identical to SEQ ID NO: 70699
  chr10:131843979-131844765
  Hypo

SEQ ID NO: 105309 - DNA, 211 bp, Homo sapiens; identical to SEQ ID NO: 70700
  chr10:131845025-131845236
  Hypo

SEQ ID NO: 105310 - DNA, 32 bp, Homo sapiens; identical to SEQ ID NO: 70701
  chr10:131851993-131852025
  Hypo

SEQ ID NO: 105311 - DNA, 86 bp, Homo sapiens; identical to SEQ ID NO: 70702
  chr10:131936580-131936666
  Hypo

SEQ ID NO: 105312 - DNA, 94 bp, Homo sapiens; identical to SEQ ID NO: 70703
  chr10:131937390-131937484
  Hypo

SEQ ID NO: 105313 - DNA, 39 bp, Homo sapiens; identical to SEQ ID NO: 70704
  chr10:131987277-131987316
  Hypo

SEQ ID NO: 105314 - DNA, 30 bp, Homo sapiens; identical to SEQ ID NO: 70705
  chr10:131988259-131988289
  Hypo

SEQ ID NO: 105315 - DNA, 44 bp, Homo sapiens; identical to SEQ ID NO: 70706
  chr10:131988602-131988646
  Hyper

SEQ ID NO: 105316 - DNA, 262 bp, Homo sapiens; identical to SEQ ID NO: 70707
  chr10:132001274-132001536
  Hypo

SEQ ID NO: 105317 - DNA, 35 bp, Homo sapiens; identical to SEQ ID NO: 70708
  chr10:132005005-132005040
  Hypo

SEQ ID NO: 105318 - DNA, 75 bp, Homo sapiens; identical to SEQ ID NO: 70709
  chr10:132050760-132050835
  Hypo

SEQ ID NO: 105319 - DNA, 98 bp, Homo sapiens; identical to SEQ ID NO: 70710
  chr10:132229336-132229434
  Hypo

SEQ ID NO: 105320 - DNA, 30 bp, Homo sapiens; identical to SEQ ID NO: 70711
  chr10:132237416-132237446
  Hypo

SEQ ID NO: 105321 - DNA, 30 bp, Homo sapiens; identical to SEQ ID NO: 70712
  chr10:132280529-132280559
  Hypo

SEQ ID NO: 105322 - DNA, 30 bp, Homo sapiens; identical to SEQ ID NO: 70713
  chr10:132290329-132290359
  Hypo

SEQ ID NO: 105323 - DNA, 30 bp, Homo sapiens; identical to SEQ ID NO: 70714
  chr10:132308764-132308794
  Hypo

SEQ ID NO: 105324 - DNA, 92 bp, Homo sapiens; identical to SEQ ID NO: 70715
  chr10:132317215-132317307
  Hypo

SEQ ID NO: 105325 - DNA, 247 bp, Homo sapiens; identical to SEQ ID NO: 70716
  chr10:132365670-132365917
  Hypo

SEQ ID NO: 105326 - DNA, 30 bp, Homo sapiens; identical to SEQ ID NO: 70717
  chr10:132447397-132447427
  Hypo

SEQ ID NO: 105327 - DNA, 174 bp, Homo sapiens; identical to SEQ ID NO: 42719
  chr10:132525800-132525974
  Hypo

SEQ ID NO: 105328 - DNA, 165 bp, Homo sapiens; identical to SEQ ID NO: 42720
  chr10:132586486-132586651
  Hypo

SEQ ID NO: 105329 - DNA, 30 bp, Homo sapiens; identical to SEQ ID NO: 70720
  chr10:132600977-132601007
  Hypo

SEQ ID NO: 105330 - DNA, 194 bp, Homo sapiens; identical to SEQ ID NO: 70721
  chr10:132609120-132609314
  Hypo

SEQ ID NO: 105331 - DNA, 150 bp, Homo sapiens; identical to SEQ ID NO: 70723
  chr10:132768174-132768324
  Hypo

SEQ ID NO: 105332 - DNA, 194 bp, Homo sapiens; identical to SEQ ID NO: 70724
  chr10:132811723-132811917
  Hypo

SEQ ID NO: 105333 - DNA, 164 bp, Homo sapiens; identical to SEQ ID NO: 42723
  chr10:132818146-132818310
  Hypo

SEQ ID NO: 105334 - DNA, 124 bp, Homo sapiens; identical to SEQ ID NO: 70726
  chr10:132859296-132859420
  Hypo

SEQ ID NO: 105335 - DNA, 35 bp, Homo sapiens; identical to SEQ ID NO: 70727
  chr10:132871489-132871524
  Hypo

SEQ ID NO: 105336 - DNA, 141 bp, Homo sapiens; identical to SEQ ID NO: 70728
  chr10:132873732-132873873
  Hypo

SEQ ID NO: 105337 - DNA, 155 bp, Homo sapiens; identical to SEQ ID NO: 70729
  chr10:132893493-132893648
  Hypo

SEQ ID NO: 105338 - DNA, 182 bp, Homo sapiens; identical to SEQ ID NO: 70730
  chr10:132976493-132976675
  Hypo

SEQ ID NO: 105339 - DNA, 191 bp, Homo sapiens; identical to SEQ ID NO: 42726
  chr10:132977044-132977235
  Hypo

SEQ ID NO: 105340 - DNA, 97 bp, Homo sapiens; identical to SEQ ID NO: 70732
  chr10:133058323-133058420
  Hypo

SEQ ID NO: 105341 - DNA, 23 bp, Homo sapiens
  chr10:133089975-133089998
  Hypo
accgcgcccggcctccataaaca

SEQ ID NO: 105342 - DNA, 1857 bp, Homo sapiens
  chr10:133109124-133110981
  Hyper
agctgaaacagctatcgatttccagcttgctttcaagtctggcagagactgtgaaagtcctaacttctccgcgatgtcagccacggcccgcggcggtcacggagccacttcagcacctcgcgatggacagtgacccccggcgtggcgcgagttccctgcggtccccacgcgggcctgggcggcgggtccctccacggctccgtccagacacccggaggcacctgccaaagctgcggaggtggacgaccgggcgtccaagcacgaactttctcgccgaggcacggctgccgggctccgtcctgagggtttggggcggcgaggaccgccggggaggagggcgcgcgagccggaggccagagccgggccgggcagggcgcgcccaggagcaggggagacggcgacccgggccgaggcgggacggggacacgttacctgcccgtggagcgcggggaaggggtgcgcggcggcggcggcggcggagtctggcgcagagggcagcggcagcagcgggagcaccggctcgctcggggccggccagccggggagaccggggagcagcggggccgcgggcggcggggccgaggcgagcagcaccgggggaaccacgacccccgcgctgagccggagcagcccggccgagcccggcaccatccagacccagggcggcggcggcggcggctctgcgtccatcggccagaggagaggctgccgccgccggggctgctgctgctgcagctgccgccgccgccgctggaacctggcgcccgcctgcatcctacatccccgcgctgacggcggcggcgggggcggcgggcgcccgagatgctgggccggcggcggcgcggctccggagcgaactcacttggctccgcggcgcggccgctcgctccgcccctgccccgcgcgggaagctcctcctcctcccgcccgcgccgccgccgcccccggacccggcccccgccccggtccccgcccgcccgcgcccctccccgccggaccccgccccgccctcgcgctccccggccctggccggggtctcctccccgctgcgcccctggacccgggcggccgcggaggacgtgggtgggagagggccgagggcgcgcccggctgggctcccgccgatgccggccccctggtggcctctggccctctgggacccagcgcaccgcgagggaggctccgggctccgcactcaagggcaagcggaagccgaggtggcggcgccggagccaggcatgtcccgctgcccagcgcggggctgagggcgcagacggggaccgcgcgagccgctctctacctggcctcctcggagtccagggcgcggagggtactgggctgcggatccggcgcaggcggccccggacgctgctaggcgcgggcggatttctgttgcacaaatgggccaaacaggttcgtaaggcccccgcgggtcccctggcccggaagttgagccgcgggtgcctggtctgaagttccgcgccccacagtggcccgcgggcctcggcggctcctgccctacgccctccaaggcaccaggcaggtggccccagggcctttgcccacgacaccccctgggtggggcaggaccacccctctgtgaattcgtcctggatgcccccaggcacagtctgtactcctccctcccccagcacacgcggcctctgacgctgcacgccgagcttcctgggacccaggacgaaccgggctccaaggaccctcgctccgcccggaccacacgcaggcagcgccggccgagccgagcctgggtccgcactggccacgcgcagccaccgccagacggcgctagccctcccccgctgtagaccctgcttcggaggccgccagcctcctccc

SEQ ID NO: 105343 - DNA, 183 bp, Homo sapiens; identical to SEQ ID NO: 70738
  chr10:133117656-133117839
  Hypo

SEQ ID NO: 105344 - DNA, 43 bp, Homo sapiens; identical to SEQ ID NO: 70739
  chr10:133226414-133226457
  Hypo

SEQ ID NO: 105345 - DNA, 30 bp, Homo sapiens; identical to SEQ ID NO: 70741
  chr10:133495425-133495455
  Hypo

SEQ ID NO: 105346 - DNA, 192 bp, Homo sapiens; identical to SEQ ID NO: 70742
  chr10:133516016-133516208
  Hypo

SEQ ID NO: 105347 - DNA, 279 bp, Homo sapiens; identical to SEQ ID NO: 70743
  chr10:133530719-133530998
  Hypo

SEQ ID NO: 105348 - DNA, 194 bp, Homo sapiens; identical to SEQ ID NO: 70744
  chr10:133532602-133532796
  Hypo

SEQ ID NO: 105349 - DNA, 51 bp, Homo sapiens; identical to SEQ ID NO: 70746
  chr10:133555035-133555086
  Hypo

SEQ ID NO: 105350 - DNA, 30 bp, Homo sapiens; identical to SEQ ID NO: 70747
  chr10:133589829-133589859
  Hypo

SEQ ID NO: 105351 - DNA, 30 bp, Homo sapiens; identical to SEQ ID NO: 70748
  chr10:133590138-133590168
  Hypo

SEQ ID NO: 105352 - DNA, 30 bp, Homo sapiens; identical to SEQ ID NO: 70749
  chr10:133603524-133603554
  Hypo

SEQ ID NO: 105353 - DNA, 30 bp, Homo sapiens; identical to SEQ ID NO: 70750
  chr10:133645234-133645264
  Hypo

SEQ ID NO: 105354 - DNA, 157 bp, Homo sapiens; identical to SEQ ID NO: 70751
  chr10:133783240-133783397
  Hypo

SEQ ID NO: 105355 - DNA, 1531 bp, Homo sapiens
  chr10:133794727-133796258
  Hyper
gccatattttaaaaacgctgtaaccccctcccatctccgcgttcacccttgaggaaatcctaacagtcaccatggatataaacattaataacaaaattaaagctcataacaggccacttgccacgccttggtgtttggtcattaaaaccaatactggtctgaactacagaccgcggagggcaacgtggactttgaggctgttcggtccaactgcgagacgcagattcacctccaggtggaattctagctcgcgcggagctggagaatcggggctttcccgtgcggtccgacccgggtccaagccaacccccgcccgagtggcgaggccgcgaaccccgggcagtacgcggggtccccacgccccgggctccgcatgcccgcaggaggggtgggtacggaaggggaggatggcgcagcctcgcccggcccgcgatgccccctaggcctccccggcaacctccccttggcgccctcttggccttccccaggcttcccccccgcgccccctcggctcccgcgccgcctcctccgcctcaccctgcaggctctcctcctgcatcccgggcgctccgttctgcgacatggcgccagagggcaactgcggcgatcggagtccgcgccgggctgcgggatgtgcttcagctgcgggcggtgggaaagcggaggtcggagcgccgcggcccagctgcgctcccggactgagcggagccccgcagcccggccggaggaactcacagggcagggcggggccgggcggatctgcggccgcgtcgcccattggccgcgacttggggcctgcgcgtgcgcaggggcgtggggtgcgtgtggcacgtgcggcgcgtgcgcggggcgggtcctgcggtgggcgaggggcagaggcctgcggtgcgcgggacgcgggcggggagaggggcggggcgaggggcgcgcaggcgcgagggcggcagcgaccgcctgaggtgagccggcccgggctggacgccgcgggccgcgtgacgagtgggctgcgcggtcgccgccgcggcgggcggtgggccgggttctcctttgaaggggcggtgggaccggcggactctctgggcactggctaccacggagacgccgctacgcttcggggcggggcccgtctttccatcctgctagtggggaaactgaggcgcggggctggcggcgtccgtgcggggggcgtgaggacgtgcagggaagcggccgctgcggctccgagacggcccgtggggtcgggacctgcgcccggggcgggagctgcgagcggtgggccggagctgagcgtctcgggacgggaccgcgtccccgggtctttgcccgccccgccggggcgcccctgcgtgaacagcggggcccgttgtgtccggggcgtccgcccgcaggaagaagcggaggctcgagcagagtcgaaagagtctgcccgagggaggcgcggaccccaggggcccgggagaggcgcgccgtccgcctctgcggcaaggggcctccggggtgcaaacgcggtgtggggcgggcgtccccgggg

SEQ ID NO: 105356 - DNA, 408 bp, Homo sapiens; identical to SEQ ID NO: 70755
  chr10:133806718-133807126
  Hypo

SEQ ID NO: 105357 - DNA, 34 bp, Homo sapiens; identical to SEQ ID NO: 70756
  chr10:133836708-133836742
  Hyper

SEQ ID NO: 105358 - DNA, 1178 bp, Homo sapiens
  chr10:133849661-133850839
  Hyper
cctgaagtcccagcccggagcacgcggccgtggtgagctgcgatcccaggccccggcgcagcgctgagactgtggctctcaatccgcagcagctgcttcatctgctcaatgccagactccaaaaagcatttctctcgcaacaggccaggggaggcagcgttcggggatgggacgccaagagttaagggtgaggccgcacgcgtgcagctcccccgtgctgcgcatggcgctgggatcggcctgagcggcgggtgagtccctctaagccggcggcgcccggtgcccggctccctacgcgcgccccgcggcccccgggctattttcagccacgccgagccctgttttaggagcttgcacagcggctccgcggagaccgggactgcgtgggggaggatcgcggcgggggccgtcgccgagcaaggagcgcggccgcggggaccgcccgggagtgggggcggcggggcgggccgggttcggggctcctgcccgcggtgacggtgacgcgcgcccccgcccgccgcctctgccatggccgatccggtccgtcggacgccgcccagagtcgctcgcggggagcctcggtgagcagcggccggggtggggccgcgaccgggggccgggcctctgcgctgcgtctggcacggtgcgtccgggacgcgggcgccctggcggccgtggggcgggcggggggcgacgtcccgagggagggggtcccgcggcagagacgcccctgtctggggcggggtcctccttgcctctcccggcggtccccccgtgggcgggtcctctccacggcaccccctgccctgcacaggcctcggcgctggcgtgacgcggccgctgggtggggcccgcgcaggtgctgggccagggctggggacccgcatctccgtgtctccgactgtgcctcccgcggaaaggggcgccgtgcgattatttttatgttggtgtctggtttttaaatttcacagcccccatttcagggatggccagcgtggccgtgggatgctgacgatacgggaagccagagaataaaggctttggtggaggtcgggaggaggcgccggcctggacagttttcctagaaaatattctctgcgtgtacccgcgaccttgcctctcgtggaaagccgctgggagttggagcggctccctcctgcccccgtctgaggtctggc

SEQ ID NO: 105359 - DNA, 32 bp, Homo sapiens; identical to SEQ ID NO: 70759
  chr10:133858093-133858125
  Hypo

SEQ ID NO: 105360 - DNA, 61 bp, Homo sapiens; identical to SEQ ID NO: 70760
  chr10:133910786-133910847
  Hypo

SEQ ID NO: 105361 - DNA, 139 bp, Homo sapiens; identical to SEQ ID NO: 70761
  chr10:133913329-133913468
  Hypo

SEQ ID NO: 105362 - DNA, 277 bp, Homo sapiens; identical to SEQ ID NO: 70762
  chr10:133913780-133914057
  Hypo

SEQ ID NO: 105363 - DNA, 30 bp, Homo sapiens; identical to SEQ ID NO: 42732
  chr10:133921177-133921207
  Hypo

SEQ ID NO: 105364 - DNA, 32 bp, Homo sapiens; identical to SEQ ID NO: 70764
  chr10:133935358-133935390
  Hypo

SEQ ID NO: 105365 - DNA, 49 bp, Homo sapiens; identical to SEQ ID NO: 70765
  chr10:133935785-133935834
  Hypo

SEQ ID NO: 105366 - DNA, 128 bp, Homo sapiens; identical to SEQ ID NO: 70766
  chr10:133947267-133947395
  Hypo

SEQ ID NO: 105367 - DNA, 307 bp, Homo sapiens; identical to SEQ ID NO: 70767
  chr10:133949128-133949435
  Hypo

SEQ ID NO: 105368 - DNA, 68 bp, Homo sapiens; identical to SEQ ID NO: 70768
  chr10:133949784-133949852
  Hypo

SEQ ID NO: 105369 - DNA, 556 bp, Homo sapiens; identical to SEQ ID NO: 42735
  chr10:133951469-133952025
  Hypo

SEQ ID NO: 105370 - DNA, 144 bp, Homo sapiens; identical to SEQ ID NO: 70770
  chr10:133952229-133952373
  Hypo

SEQ ID NO: 105371 - DNA, 85 bp, Homo sapiens; identical to SEQ ID NO: 70771
  chr10:133955427-133955512
  Hypo

SEQ ID NO: 105372 - DNA, 228 bp, Homo sapiens; identical to SEQ ID NO: 70772
  chr10:133962619-133962847
  Hypo

SEQ ID NO: 105373 - DNA, 65 bp, Homo sapiens; identical to SEQ ID NO: 70773
  chr10:133979162-133979227
  Hypo

SEQ ID NO: 105374 - DNA, 152 bp, Homo sapiens; identical to SEQ ID NO: 70774
  chr10:133982809-133982961
  Hypo

SEQ ID NO: 105375 - DNA, 201 bp, Homo sapiens; identical to SEQ ID NO: 70775
  chr10:133984033-133984234
  Hypo

SEQ ID NO: 105376 - DNA, 1656 bp, Homo sapiens
  chr10:133999769-134001425
  Hyper
acccccgcgaggtcccgcccaccaccgcgtcccggtccctggggagcgcgtgcgcctccttctgtctctctctctctctctctctgtcctattcgggcccctcctgccctccgtctctcgcggccagcgtggaacagcctcgcggggtcacagcctggcgctcggaccctggcccgggtcatctgcgaaggagccggctttggccaaggtgccttcctggacgggtgtggttcccagagcgtcgcggcccggggttgactggctcggaatcccggggccttgggcgcctcgcgtctcctgggacctgggttccgcgctggagggcagcgggggcgcgggcggggcctggcaggacgtggccggactctctccctcgcctccccggggtgcaaaccccgcgcacatcagctggagcaggttgaaatccccacccagcgctcgtccgcgggtctgcgcgggggcccggggtgcagagatcagaccctgcagcggttccagcgctgggggggctttaaagcgaaggagtggctgagggcgggggcggggctgatgggcggggtgaggcggggctcgggctggggcgggccctatcgggggcggggcctgccgggggcggagccggggtgggggcggggcccagcgggggcgggaccggaacggagccgtgcggccccgcgcgctcgcagtctgtctcccgccgtccccacgcacgcgtcccggctcacgcgtccccccgcccgcccgcccgcccgcccgcccccgcttgtgccgcccctaccagagacccccaggagcaggatgtccttccagggcaagaaaagcatcccccggatcacggtgagcccggtcccgcttcgcccggcgccccctgcccgccgcccggagtggggcctggacgccgggcggaccctcctggtcttgtgcgtgggtggggggtccctgcctttgcgtctggtccctgtcctggcgcccgcccttccctgctcggctccttcgcgccccagggtccgagagtccccgctagcgccgcgcagacccccttaaggagcggggcgcccaggcccggcccggcccggccctgcccggccctgccgggccctgccgggccctgcccggccttgcccggccttgccggcttccgggagcctcggctgcgcccggggagaacccggggccgggcggcctgtccctcggagcgctagcggctcctttctcccacggcggtcgggtggcgaggcgggcggacgcggccctttgttggcccgggctggtccggggcgcggggagatgccgttcccggcgcagcccgtgggtcgcccgccccttggacgcactggcgctgcgtcgggagctctttgtccgagacaaagcgatttagccccggccgctctggccggagtccctggtggccccgaacccttccagtaacctgggttcagcgactccaaggaaagcgagcggtcaagggccactggccgggaaccctggcagcccctgaaccttcgagagcagagacccctccccaacacccacacgcaccggcgcgggaggtcccgctctgccagaaacaaagcctccccgctcgggcggggggagatgggggtgggaggaaggaggcttcgggacccggcaggacctgggcgggggagtccatgg

SEQ ID NO: 105377 - DNA, 168 bp, Homo sapiens; identical to SEQ ID NO: 70782
  chr10:134010456-134010624
  Hypo

SEQ ID NO: 105378 - DNA, 354 bp, Homo sapiens; identical to SEQ ID NO: 70783
  chr10:134012163-134012517
  Hypo

SEQ ID NO: 105379 - DNA, 342 bp, Homo sapiens; identical to SEQ ID NO: 70784
  chr10:134014286-134014628
  Hypo

SEQ ID NO: 105380 - DNA, 341 bp, Homo sapiens; identical to SEQ ID NO: 70785
  chr10:134016098-134016439
  Hypo

SEQ ID NO: 105381 - DNA, 152 bp, Homo sapiens; identical to SEQ ID NO: 70786
  chr10:134016763-134016915
  Hypo

SEQ ID NO: 105382 - DNA, 48 bp, Homo sapiens; identical to SEQ ID NO: 70787
  chr10:134018023-134018071
  Hypo

SEQ ID NO: 105383 - DNA, 30 bp, Homo sapiens; identical to SEQ ID NO: 42745
  chr10:134019334-134019364
  Hypo

SEQ ID NO: 105384 - DNA, 328 bp, Homo sapiens; identical to SEQ ID NO: 70789
  chr10:134022624-134022952
  Hypo

SEQ ID NO: 105385 - DNA, 257 bp, Homo sapiens; identical to SEQ ID NO: 70790
  chr10:134040240-134040497
  Hypo

SEQ ID NO: 105386 - DNA, 41 bp, Homo sapiens; identical to SEQ ID NO: 70793
  chr10:134058780-134058821
  Hypo

SEQ ID NO: 105387 - DNA, 63 bp, Homo sapiens; identical to SEQ ID NO: 70794
  chr10:134063725-134063788
  Hypo

SEQ ID NO: 105388 - DNA, 30 bp, Homo sapiens; identical to SEQ ID NO: 70795
  chr10:134064125-134064155
  Hypo

SEQ ID NO: 105389 - DNA, 42 bp, Homo sapiens; identical to SEQ ID NO: 70796
  chr10:134066350-134066392
  Hypo

SEQ ID NO: 105390 - DNA, 849 bp, Homo sapiens; identical to SEQ ID NO: 70797
  chr10:134093628-134094477
  Hypo

SEQ ID NO: 105391 - DNA, 385 bp, Homo sapiens; identical to SEQ ID NO: 70798
  chr10:134095563-134095948
  Hypo

SEQ ID NO: 105392 - DNA, 17 bp, Homo sapiens
  chr10:134099613-134099630
  Hypo
agcgagactctgtctca

SEQ ID NO: 105393 - DNA, 30 bp, Homo sapiens; identical to SEQ ID NO: 42751
  chr10:134118399-134118429
  Hypo

SEQ ID NO: 105394 - DNA, 132 bp, Homo sapiens; identical to SEQ ID NO: 70801
  chr10:134119982-134120114
  Hypo

SEQ ID NO: 105395 - DNA, 308 bp, Homo sapiens; identical to SEQ ID NO: 70802
  chr10:134120706-134121014
  Hyper

SEQ ID NO: 105396 - DNA, 658 bp, Homo sapiens; identical to SEQ ID NO: 70803
  chr10:134121693-134122351
  Hyper

SEQ ID NO: 105397 - DNA, 230 bp, Homo sapiens; identical to SEQ ID NO: 42752
  chr10:134123040-134123270
  Hypo

SEQ ID NO: 105398 - DNA, 30 bp, Homo sapiens; identical to SEQ ID NO: 70805
  chr10:134126884-134126914
  Hypo

SEQ ID NO: 105399 - DNA, 37 bp, Homo sapiens; identical to SEQ ID NO: 70806
  chr10:134209613-134209650
  Hyper

SEQ ID NO: 105400 - DNA, 30 bp, Homo sapiens; identical to SEQ ID NO: 70807
  chr10:134232907-134232937
  Hypo

SEQ ID NO: 105401 - DNA, 237 bp, Homo sapiens; identical to SEQ ID NO: 70809
  chr10:134272641-134272878
  Hypo

SEQ ID NO: 105402 - DNA, 30 bp, Homo sapiens; identical to SEQ ID NO: 70810
  chr10:134281135-134281165
  Hypo

SEQ ID NO: 105403 - DNA, 145 bp, Homo sapiens; identical to SEQ ID NO: 70811
  chr10:134292484-134292629
  Hypo

SEQ ID NO: 105404 - DNA, 299 bp, Homo sapiens; identical to SEQ ID NO: 42755
  chr10:134301017-134301316
  Hypo

SEQ ID NO: 105405 - DNA, 30 bp, Homo sapiens; identical to SEQ ID NO: 70813
  chr10:134316646-134316676
  Hypo

SEQ ID NO: 105406 - DNA, 37 bp, Homo sapiens; identical to SEQ ID NO: 70814
  chr10:134341480-134341517
  Hypo

SEQ ID NO: 105407 - DNA, 371 bp, Homo sapiens; identical to SEQ ID NO: 42758
  chr10:134481125-134481496
  Hypo

SEQ ID NO: 105408 - DNA, 36 bp, Homo sapiens; identical to SEQ ID NO: 70816
  chr10:134489067-134489103
  Hypo

SEQ ID NO: 105409 - DNA, 205 bp, Homo sapiens; identical to SEQ ID NO: 70817
  chr10:134499328-134499533
  Hypo

SEQ ID NO: 105410 - DNA, 30 bp, Homo sapiens; identical to SEQ ID NO: 70818
  chr10:134516665-134516695
  Hypo

SEQ ID NO: 105411 - DNA, 167 bp, Homo sapiens; identical to SEQ ID NO: 42760
  chr10:134518611-134518778
  Hypo

SEQ ID NO: 105412 - DNA, 60 bp, Homo sapiens; identical to SEQ ID NO: 42761
  chr10:134542152-134542212
  Hypo

SEQ ID NO: 105413 - DNA, 127 bp, Homo sapiens; identical to SEQ ID NO: 70821
  chr10:134557418-134557545
  Hypo

SEQ ID NO: 105414 - DNA, 64 bp, Homo sapiens; identical to SEQ ID NO: 70822
  chr10:134562719-134562783
  Hypo

SEQ ID NO: 105415 - DNA, 30 bp, Homo sapiens; identical to SEQ ID NO: 70823
  chr10:134565567-134565597
  Hypo

SEQ ID NO: 105416 - DNA, 196 bp, Homo sapiens; identical to SEQ ID NO: 70824
  chr10:134566161-134566357
  Hypo

SEQ ID NO: 105417 - DNA, 142 bp, Homo sapiens; identical to SEQ ID NO: 70825
  chr10:134581976-134582118
  Hypo

SEQ ID NO: 105418 - DNA, 30 bp, Homo sapiens; identical to SEQ ID NO: 70826
  chr10:134589397-134589427
  Hypo

SEQ ID NO: 105419 - DNA, 137 bp, Homo sapiens
  chr10:134597657-134597794
  Hyper
accccgcgtgacccacgggaggccccgccgctccgcgggcggaattatttcggatttctctttgcggtcctagttcggaagaaactgctttccaccgcgggaagatctggcgggatggtgaccgaagggcctccgtg

SEQ ID NO: 105420 - DNA, 613 bp, Homo sapiens
  chr10:134598087-134598700
  Hyper
gtcccgggctcctggcggctgtcgctgcggttccttcccgcgggccgggccccttccctgcgccttcgccgcctcctcgcgcctgcccggggcccgcagcctccgcaccgggaacccggaggacccgaggcgggcgcaggggcgaagccggggccggggaggggccgcctcgctccgggttcgagacggaagaaacacgcggcgcaggctccggagcgacggctccgacggggacccgttaaataatttattgatgatacaaagcgactcgcgcccacccggggccgcccccggattctgcaaaaatagattcgcccccaccccgcgggtcctcacaaggcgtcccccgcgccgccgccgcacgggctgaccagcgccaagttcgagggtttgtgcttcttgagcagccgcgtgatcttctcgtcgtccgagttggggtccaggggccggttgtattcgtcgtcgtcctccgcgtccgagccgcccaccttcagcttctcggcgtccgagtcctgcttcttcttggccgacgccatctccaccgcgtgccgcttgcgccacttggtccggcggttctggaaccagacctgggagtggacggggcggtcaggcg

SEQ ID NO: 105421 - DNA, 1941 bp, Homo sapiens
  chr10:134599032-134600973
  Hyper
cgcgggccactcacccgggccagccagacgcgggtccctccagggcgcgccctgcaccacgccgggccagaagatgggcgggcgccccggcagctcggccaggggcttggggtagccgcgcgccacagcggccgcgggcccgaagtaaacgccggcggacgacgcgagcccgttgagccggggcagcccccccaggaggcccccgcccgccgcgcccacgggccggcccaggatgtcgctgatgccgtgcggggtcccgagcgggagctgcgcgcccaggccccccagcgcgggcgccttgaagccggccggaccctgcagcgcgtaggggaacagcgacgtcttcatctcggccatgttgtgcagcgcggccagcggggcactgctcagcacgaacgcgcccgggcggttagtgtccatgggcgccgccgccgccggcccgggctcccatccgggccccgccgccgccgcccctgcccgccggcccgggaagtttgcgcgcggcccgggcgggcgtcggctgcagcgcggggcgcggggcgcggggggcgggcgggcggctccggcgcggggcgggcgggcgggcggcggcggcggcggctccggggccggtcggagcggcgccgcgcgggacggacgcgctgataacgggggctccccggggcgcggcgcgcgcgctgattggctgcggaccccgcggtccggccattggccggcgccccccccccgcccgcgcgcccccgccggccgcgcactccatgaagggcccattagcgcggcaggtgcctcccgggctgtaaattcgccccgatttatctccccggggacgaaataaatccagcttggatgggagtgtagttaggcaaaggttttcatgcgaaatcaggaaaaaatacgagaacgtattttattaacggaaagaatgcagatttgaggacccgcccgcgcgctcggagcgccccactcggggaagagtcccggcccgcgtcccagtcgcgactgctccgccgcccgtggctggggtgggtgtgagcggcagcggacgccggcggggaacgcgctccgggcaggtcggggccacaggagggcggaggacgcgggcctcgagtccacggaatccacgggcctcacggccgggcgaggctcgcacggagctgcctctggtttcgccgacacgcggccggcgcggtggaggagtgaggcaggcgggagcggggcggggaggcgggtcccgggaccacacgcgcggctcggcacttccccgtcatcggcctccaggtctcccgctgggggtcccccaggatgtgacctgggcccacgacttcgcccacgggccgcctctcgcgaatccccggccgggagaacagagaccaggacggcctcagcgcggaagccctgtccagggcccgaacgtgggtgcgggctgggggcgcagcggcagaaacgcggccttagacgcgcgcggggggccggtgtcccccccgcccccacggcaccgggagccgctcgctcatccatcccgcagaccgggcggtgagatgactccgagccccgcgcacggcggccgcgagcaaacgctccgacgtctgtggtgacgtctcgtattgatttagggacacggggcggctgtggctgtggcccacggctcgtggggagcccgagtctgtgcgcagggaacgccgctgcgtggcctctctcgggcctgtgccgcggaggaaggcggcgcccggggttcggggccggggtctcacgtccgccccctcgcccccctccagcgtccgttttcgttttgtgcaggtcgaggcggggacttggcgccgtcggccgctcctggatggcggcttggaaaagccacctgcggccaaactccggggcagtggtgcggccgccgggtgtgtgcgcgctcggggctgccccggcggcttccggctccactgaggt

SEQ ID NO: 105422 - DNA, 1210 bp, Homo sapiens
  chr10:134601204-134602414
  Hyper
cccagcaccccaaggcgacggcgcccgcgcccaaggctcgggctctgagctgagacgcgggaactgcggggccggggggggcgggcagggggagttgggggcgggggctgctgtcgccctgggatcccccactctgcgcggccgggcagaccctgggcgggccgggaggggtgcgggtcgcccgaactgaggcccaggaggcgcgcgcgggcggaacggcgggaggaagccgcgctcgggacaggctctggctcttctcacagcctggaggggcggggcagggggcgtcgctagcgctgttttatggctgaggaaacatggacctggaggcgctgcgctgcggcccgataaaccctgggtctgtctgcgccccccggtcctccctgggctgccgagggaacgcgtggggtcgcgggtggggctggcgtgtcactggctgcggagcgcgcggctctccagggctcaggggcgcgggatgaggggccagggtgagttgggggcgcagaggagccgggtaagggggggtccctctcccacgttcttgtaagccgtggaagtcttggcgcgctccgcaggtgccgcgtcctacccggctccccggcctgcgccccacgcgctttcccgccctcctcctcgcggagctgcgcgtgggtccggtggcttcacctcctacgcttcccggcgcccactccgggccccgtcccctctccggcccccgcccgcaccttttctcctgcgtcccccggtgccgccctctcggaaaccaccgaggcaactccccctcctcccgggaaggtccgagcgcctccgaccgcgatgtctttgcctgggctccgccgcccggcggccccgctgcctggagaggtccgcgatgccacctcctggcccgcgagcagatgtcccgcgaggaaggctgccggcatcggcgccgacgctccgcgctggaaaaccgagagcgcggggtttggcagaggccattcaagtttgttttactcgttcagcctgtatttgtggggctcctaccgcgcccgggctgtccggggggtgcaccgtgaacgcagcgggctccggcccgggcgcgggcgggtcagagcagcaaacgcgctcccccggcacccccgcggcgtctgcaggggagcgggcgacggggaggacggcgggggtgtcggcccggaaggagagccggcctaggccccggtgtccccgcgct

SEQ ID NO: 105423 - DNA, 364 bp, Homo sapiens; identical to SEQ ID NO: 70834
  chr10:134607832-134608196
  Hypo

SEQ ID NO: 105424 - DNA, 387 bp, Homo sapiens; identical to SEQ ID NO: 70835
  chr10:134610574-134610961
  Hypo

SEQ ID NO: 105425 - DNA, 30 bp, Homo sapiens; identical to SEQ ID NO: 70836
  chr10:134611744-134611774
  Hypo

SEQ ID NO: 105426 - DNA, 32 bp, Homo sapiens; identical to SEQ ID NO: 70837
  chr10:134613038-134613070
  Hypo

SEQ ID NO: 105427 - DNA, 60 bp, Homo sapiens; identical to SEQ ID NO: 70838
  chr10:134621273-134621333
  Hypo

SEQ ID NO: 105428 - DNA, 102 bp, Homo sapiens; identical to SEQ ID NO: 70839
  chr10:134623057-134623159
  Hypo

SEQ ID NO: 105429 - DNA, 81 bp, Homo sapiens; identical to SEQ ID NO: 70840
  chr10:134624068-134624149
  Hypo

SEQ ID NO: 105430 - DNA, 42 bp, Homo sapiens; identical to SEQ ID NO: 70841
  chr10:134626641-134626683
  Hypo

SEQ ID NO: 105431 - DNA, 142 bp, Homo sapiens; identical to SEQ ID NO: 70842
  chr10:134629717-134629859
  Hypo

SEQ ID NO: 105432 - DNA, 37 bp, Homo sapiens; identical to SEQ ID NO: 70843
  chr10:134640686-134640723
  Hypo

SEQ ID NO: 105433 - DNA, 123 bp, Homo sapiens; identical to SEQ ID NO: 70844
  chr10:134647633-134647756
  Hypo

SEQ ID NO: 105434 - DNA, 57 bp, Homo sapiens; identical to SEQ ID NO: 42767
  chr10:134648015-134648072
  Hypo

SEQ ID NO: 105435 - DNA, 30 bp, Homo sapiens; identical to SEQ ID NO: 70846
  chr10:134651763-134651793
  Hypo

SEQ ID NO: 105436 - DNA, 74 bp, Homo sapiens; identical to SEQ ID NO: 70847
  chr10:134659532-134659606
  Hypo

SEQ ID NO: 105437 - DNA, 87 bp, Homo sapiens; identical to SEQ ID NO: 42768
  chr10:134662545-134662632
  Hypo

SEQ ID NO: 105438 - DNA, 55 bp, Homo sapiens; identical to SEQ ID NO: 70849
  chr10:134663367-134663422
  Hypo

SEQ ID NO: 105439 - DNA, 193 bp, Homo sapiens; identical to SEQ ID NO: 70850
  chr10:134664613-134664806
  Hypo

SEQ ID NO: 105440 - DNA, 406 bp, Homo sapiens; identical to SEQ ID NO: 70851
  chr10:134665007-134665413
  Hypo

SEQ ID NO: 105441 - DNA, 153 bp, Homo sapiens; identical to SEQ ID NO: 70852
  chr10:134671588-134671741
  Hypo

SEQ ID NO: 105442 - DNA, 128 bp, Homo sapiens; identical to SEQ ID NO: 70853
  chr10:134672396-134672524
  Hypo

SEQ ID NO: 105443 - DNA, 315 bp, Homo sapiens; identical to SEQ ID NO: 70854
  chr10:134676338-134676653
  Hyper

SEQ ID NO: 105444 - DNA, 52 bp, Homo sapiens; identical to SEQ ID NO: 70855
  chr10:134679419-134679471
  Hypo

SEQ ID NO: 105445 - DNA, 30 bp, Homo sapiens; identical to SEQ ID NO: 70856
  chr10:134679999-134680029
  Hypo

SEQ ID NO: 105446 - DNA, 230 bp, Homo sapiens; identical to SEQ ID NO: 70857
  chr10:134682617-134682847
  Hypo

SEQ ID NO: 105447 - DNA, 56 bp, Homo sapiens; identical to SEQ ID NO: 70858
  chr10:134683657-134683713
  Hypo

SEQ ID NO: 105448 - DNA, 41 bp, Homo sapiens; identical to SEQ ID NO: 70859
  chr10:134684038-134684079
  Hypo

SEQ ID NO: 105449 - DNA, 65 bp, Homo sapiens; identical to SEQ ID NO: 70860
  chr10:134690483-134690548
  Hypo

SEQ ID NO: 105450 - DNA, 164 bp, Homo sapiens; identical to SEQ ID NO: 70861
  chr10:134692244-134692408
  Hypo

SEQ ID NO: 105451 - DNA, 183 bp, Homo sapiens; identical to SEQ ID NO: 70862
  chr10:134693583-134693766
  Hypo

SEQ ID NO: 105452 - DNA, 60 bp, Homo sapiens; identical to SEQ ID NO: 70863
  chr10:134699346-134699406
  Hypo

SEQ ID NO: 105453 - DNA, 425 bp, Homo sapiens; identical to SEQ ID NO: 70864
  chr10:134699648-134700073
  Hypo

SEQ ID NO: 105454 - DNA, 99 bp, Homo sapiens; identical to SEQ ID NO: 70865
  chr10:134720606-134720705
  Hypo

SEQ ID NO: 105455 - DNA, 70 bp, Homo sapiens; identical to SEQ ID NO: 70866
  chr10:134726229-134726299
  Hypo

SEQ ID NO: 105456 - DNA, 63 bp, Homo sapiens; identical to SEQ ID NO: 70867
  chr10:134729962-134730025
  Hypo

SEQ ID NO: 105457 - DNA, 170 bp, Homo sapiens; identical to SEQ ID NO: 70868
  chr10:134730580-134730750
  Hypo

SEQ ID NO: 105458 - DNA, 30 bp, Homo sapiens; identical to SEQ ID NO: 70869
  chr10:134730962-134730992
  Hypo

SEQ ID NO: 105459 - DNA, 177 bp, Homo sapiens; identical to SEQ ID NO: 42783
  chr10:134731838-134732015
  Hypo

SEQ ID NO: 105460 - DNA, 1043 bp, Homo sapiens; identical to SEQ ID NO: 70871
  chr10:134732792-134733835
  Hypo

SEQ ID NO: 105461 - DNA, 205 bp, Homo sapiens; identical to SEQ ID NO: 70872
  chr10:134734065-134734270
  Hypo

SEQ ID NO: 105462 - DNA, 339 bp, Homo sapiens; identical to SEQ ID NO: 70873
  chr10:134734696-134735035
  Hypo

SEQ ID NO: 105463 - DNA, 30 bp, Homo sapiens; identical to SEQ ID NO: 70874
  chr10:134735976-134736006
  Hypo

SEQ ID NO: 105464 - DNA, 543 bp, Homo sapiens; identical to SEQ ID NO: 42786
  chr10:134738145-134738688
  Hypo

SEQ ID NO: 105465 - DNA, 286 bp, Homo sapiens; identical to SEQ ID NO: 70876
  chr10:134739166-134739452
  Hypo

SEQ ID NO: 105466 - DNA, 37 bp, Homo sapiens; identical to SEQ ID NO: 70877
  chr10:134739723-134739760
  Hypo

SEQ ID NO: 105467 - DNA, 53 bp, Homo sapiens; identical to SEQ ID NO: 70878
  chr10:134740858-134740911
  Hypo

SEQ ID NO: 105468 - DNA, 34 bp, Homo sapiens; identical to SEQ ID NO: 70879
  chr10:134754790-134754824
  Hypo

SEQ ID NO: 105469 - DNA, 332 bp, Homo sapiens; identical to SEQ ID NO: 70880
  chr10:134755846-134756178
  Hyper

SEQ ID NO: 105470 - DNA, 30 bp, Homo sapiens; identical to SEQ ID NO: 42788
  chr10:134757661-134757691
  Hypo

SEQ ID NO: 105471 - DNA, 30 bp, Homo sapiens; identical to SEQ ID NO: 70882
  chr10:134771907-134771937
  Hypo

SEQ ID NO: 105472 - DNA, 179 bp, Homo sapiens; identical to SEQ ID NO: 70883
  chr10:134772301-134772480
  Hypo

SEQ ID NO: 105473 - DNA, 30 bp, Homo sapiens; identical to SEQ ID NO: 70884
  chr10:134773161-134773191
  Hypo

SEQ ID NO: 105474 - DNA, 147 bp, Homo sapiens; identical to SEQ ID NO: 70885
  chr10:134773880-134774027
  Hypo

SEQ ID NO: 105475 - DNA, 33 bp, Homo sapiens; identical to SEQ ID NO: 70886
  chr10:134777879-134777912
  Hypo

SEQ ID NO: 105476 - DNA, 90 bp, Homo sapiens; identical to SEQ ID NO: 70887
  chr10:134787026-134787116
  Hypo

SEQ ID NO: 105477 - DNA, 87 bp, Homo sapiens; identical to SEQ ID NO: 70888
  chr10:134788030-134788117
  Hypo

SEQ ID NO: 105478 - DNA, 30 bp, Homo sapiens; identical to SEQ ID NO: 70889
  chr10:134789538-134789568
  Hypo

SEQ ID NO: 105479 - DNA, 36 bp, Homo sapiens; identical to SEQ ID NO: 70890
  chr10:134793932-134793968
  Hypo

SEQ ID NO: 105480 - DNA, 98 bp, Homo sapiens; identical to SEQ ID NO: 70891
  chr10:134794346-134794444
  Hypo

SEQ ID NO: 105481 - DNA, 54 bp, Homo sapiens; identical to SEQ ID NO: 70892
  chr10:134794878-134794932
  Hypo

SEQ ID NO: 105482 - DNA, 176 bp, Homo sapiens; identical to SEQ ID NO: 70893
  chr10:134795866-134796042
  Hypo

SEQ ID NO: 105483 - DNA, 161 bp, Homo sapiens; identical to SEQ ID NO: 70894
  chr10:134797569-134797730
  Hypo

SEQ ID NO: 105484 - DNA, 41 bp, Homo sapiens; identical to SEQ ID NO: 70895
  chr10:134800646-134800687
  Hypo

SEQ ID NO: 105485 - DNA, 30 bp, Homo sapiens; identical to SEQ ID NO: 70896
  chr10:134806473-134806503
  Hypo

SEQ ID NO: 105486 - DNA, 51 bp, Homo sapiens; identical to SEQ ID NO: 70897
  chr10:134807256-134807307
  Hypo

SEQ ID NO: 105487 - DNA, 54 bp, Homo sapiens; identical to SEQ ID NO: 70898
  chr10:134809821-134809875
  Hypo

SEQ ID NO: 105488 - DNA, 30 bp, Homo sapiens; identical to SEQ ID NO: 70899
  chr10:134818621-134818651
  Hypo

SEQ ID NO: 105489 - DNA, 30 bp, Homo sapiens; identical to SEQ ID NO: 70900
  chr10:134823987-134824017
  Hypo

SEQ ID NO: 105490 - DNA, 119 bp, Homo sapiens; identical to SEQ ID NO: 70901
  chr10:134826512-134826631
  Hypo

SEQ ID NO: 105491 - DNA, 37 bp, Homo sapiens; identical to SEQ ID NO: 70902
  chr10:134830634-134830671
  Hypo

SEQ ID NO: 105492 - DNA, 87 bp, Homo sapiens; identical to SEQ ID NO: 70903
  chr10:134832028-134832115
  Hypo

SEQ ID NO: 105493 - DNA, 30 bp, Homo sapiens; identical to SEQ ID NO: 70904
  chr10:134833453-134833483
  Hypo

SEQ ID NO: 105494 - DNA, 84 bp, Homo sapiens; identical to SEQ ID NO: 70905
  chr10:134834266-134834350
  Hypo

SEQ ID NO: 105495 - DNA, 395 bp, Homo sapiens; identical to SEQ ID NO: 70906
  chr10:134834562-134834957
  Hypo

SEQ ID NO: 105496 - DNA, 30 bp, Homo sapiens; identical to SEQ ID NO: 70907
  chr10:134837231-134837261
  Hypo

SEQ ID NO: 105497 - DNA, 58 bp, Homo sapiens
  chr10:134844792-134844850
  Hypo
gcgaggtgcttctgccggtttctcctccgctggggacgcaggccgggagtttgctgct

SEQ ID NO: 105498 - DNA, 103 bp, Homo sapiens; identical to SEQ ID NO: 70908
  chr10:134855666-134855769
  Hypo

SEQ ID NO: 105499 - DNA, 30 bp, Homo sapiens; identical to SEQ ID NO: 70909
  chr10:134860784-134860814
  Hypo

SEQ ID NO: 105500 - DNA, 30 bp, Homo sapiens; identical to SEQ ID NO: 70910
  chr10:134863667-134863697
  Hypo

SEQ ID NO: 105501 - DNA, 343 bp, Homo sapiens; identical to SEQ ID NO: 70911
  chr10:134875810-134876153
  Hypo

SEQ ID NO: 105502 - DNA, 258 bp, Homo sapiens; identical to SEQ ID NO: 70912
  chr10:134886068-134886326
  Hypo

SEQ ID NO: 105503 - DNA, 144 bp, Homo sapiens; identical to SEQ ID NO: 70913
  chr10:134886921-134887065
  Hypo

SEQ ID NO: 105504 - DNA, 38 bp, Homo sapiens; identical to SEQ ID NO: 70914
  chr10:134890001-134890039
  Hypo

SEQ ID NO: 105505 - DNA, 30 bp, Homo sapiens; identical to SEQ ID NO: 70915
  chr10:134894556-134894586
  Hypo

SEQ ID NO: 105506 - DNA, 165 bp, Homo sapiens; identical to SEQ ID NO: 70916
  chr10:134895279-134895444
  Hypo

SEQ ID NO: 105507 - DNA, 30 bp, Homo sapiens; identical to SEQ ID NO: 70917
  chr10:134897792-134897822
  Hypo

SEQ ID NO: 105508 - DNA, 354 bp, Homo sapiens; identical to SEQ ID NO: 70918
  chr10:134898266-134898620
  Hypo

SEQ ID NO: 105509 - DNA, 1078 bp, Homo sapiens
  chr10:134901183-134902261
  Hyper
ggaataacacagggtcgtgcagtccgcccggcggcgttttcgggcgagggtctggtgctggggagcgagcgcggagcgaggtgtctctttaaatacgctctgcagtgtgacggcggccgcccggctggaagagccatccccaccctgcggcaggagcccgcccgccgccatcgcccgccccggtccccatggttacgcgcctgcctccggccccgggtccccgctgtcgccgcgggaggtgcgcgcagaggcggcggcgctgctggccgggctgggccgctcgtgcgcggggctgtgactcaccggccggcgccgcagccccgcaatctgttgataactcggtcccagctcggccgctgccctcgcgaatggagagcgggtccccggcggggggagcgcagcgcgtctgtctccgggagcgcggcccggccgccccggcagccgcttcggccacagcaggtgggaaggacgcgcgggtctgggcggcgggagggacgcgcggggccgcggctcggcagaaaagctcgcgccccgaggtgacactggccgcgaggaaagcagctccgagtaactttcggctccgctggggcgggaggcgccacggataatccagggcccccgccccgcgcgcccggcccggagctcgagccacatccaggcagagcaggcgccgcggccgggctggggcgggcgggtcactcggtgccggttcccggtgcaaaccccccggcgcgcctctggctttgtgcagcccgagatggttgagtttggctccggagccgggagtggggcgcagattgatttttaaatatggagaaggagacgcatctgccgctggcgcgttcggtccgagccccccaccggtccccaccggcaccgcctccgccagccccaggcgcagcccccaggccgcccgcggaggggagggagcgacaggggccgcggctgctccctggcggggtcggggctgcgagctgccctccgcggggaccctccgcccgccccgctgaccgccgctgtcttcacagatgggagcagctcccggactgcgcccgccccgccgcggtcaccctgaggc

SEQ ID NO: 105510 - DNA, 91 bp, Homo sapiens; identical to SEQ ID NO: 70922
  chr10:134907606-134907697
  Hypo

SEQ ID NO: 105511 - DNA, 218 bp, Homo sapiens; identical to SEQ ID NO: 70923
  chr10:134912118-134912336
  Hypo

SEQ ID NO: 105512 - DNA, 354 bp, Homo sapiens; identical to SEQ ID NO: 70924
  chr10:134913693-134914047
  Hypo

SEQ ID NO: 105513 - DNA, 60 bp, Homo sapiens; identical to SEQ ID NO: 42804
  chr10:134916714-134916774
  Hypo

SEQ ID NO: 105514 - DNA, 30 bp, Homo sapiens; identical to SEQ ID NO: 70926
  chr10:134928644-134928674
  Hypo

SEQ ID NO: 105515 - DNA, 202 bp, Homo sapiens; identical to SEQ ID NO: 70927
  chr10:134930863-134931065
  Hypo

SEQ ID NO: 105516 - DNA, 269 bp, Homo sapiens; identical to SEQ ID NO: 70928
  chr10:134937581-134937850
  Hypo

SEQ ID NO: 105517 - DNA, 569 bp, Homo sapiens; identical to SEQ ID NO: 70929
  chr10:134940715-134941284
  Hypo

SEQ ID NO: 105518 - DNA, 248 bp, Homo sapiens; identical to SEQ ID NO: 70930
  chr10:134941647-134941895
  Hypo

SEQ ID NO: 105519 - DNA, 687 bp, Homo sapiens; identical to SEQ ID NO: 70931
  chr10:134942452-134943139
  Hypo

SEQ ID NO: 105520 - DNA, 64 bp, Homo sapiens; identical to SEQ ID NO: 70932
  chr10:134943548-134943612
  Hypo

SEQ ID NO: 105521 - DNA, 201 bp, Homo sapiens; identical to SEQ ID NO: 70933
  chr10:134944571-134944772
  Hypo

SEQ ID NO: 105522 - DNA, 30 bp, Homo sapiens; identical to SEQ ID NO: 42811
  chr10:134945693-134945723
  Hypo

SEQ ID NO: 105523 - DNA, 150 bp, Homo sapiens; identical to SEQ ID NO: 70935
  chr10:134955035-134955185
  Hypo

SEQ ID NO: 105524 - DNA, 52 bp, Homo sapiens; identical to SEQ ID NO: 70936
  chr10:134955660-134955712
  Hypo

SEQ ID NO: 105525 - DNA, 30 bp, Homo sapiens; identical to SEQ ID NO: 70937
  chr10:134968447-134968477
  Hypo

SEQ ID NO: 105526 - DNA, 30 bp, Homo sapiens; identical to SEQ ID NO: 42813
  chr10:134970630-134970660
  Hypo

SEQ ID NO: 105527 - DNA, 565 bp, Homo sapiens
  chr10:134973889-134974454
  Hyper
tccatggagccagggcgcgcgtagccgagcccagcccagcccagccggaggccccgggggcggtgcgcggcgcggccgcaggatgcaggccatggacccggccgcggcggatctttacgaggaggacggcaaagacctggacttctacgacttcgagccgctgcccaccctccccgaggacgaggtgagcccccggccccactggggggccccttccgccgccgaggggtccgcggagagcgcccggggggaggacccgggaggggctgtgagctcccgcctccccaggcgccctccatggccgaggggttcccaccgccgttctcagcccccgcgttaggattttcacccggaggggacagcacccccgaatgcgcacgggacggcggcgggtgggcagcccctgcagaagttggtgcgcggtagctcctggtggaaaccctggcgggacagtgtgggggcagcaaggaggacggaggggggtctgcttactccctgccgggccccaggaggccagcggggtgcagagcagcagagtccaatcaggcgccgctcaggagctggg

SEQ ID NO: 105528 - DNA, 166 bp, Homo sapiens; identical to SEQ ID NO: 70941
  chr10:134980970-134981136
  Hypo

SEQ ID NO: 105529 - DNA, 107 bp, Homo sapiens; identical to SEQ ID NO: 70942
  chr10:134992393-134992500
  Hypo

SEQ ID NO: 105530 - DNA, 651 bp, Homo sapiens; identical to SEQ ID NO: 42815
  chr10:134996258-134996909
  Hypo

SEQ ID NO: 105531 - DNA, 248 bp, Homo sapiens; identical to SEQ ID NO: 70944
  chr10:135001179-135001427
  Hypo

SEQ ID NO: 105532 - DNA, 230 bp, Homo sapiens; identical to SEQ ID NO: 70945
  chr10:135001972-135002202
  Hypo

SEQ ID NO: 105533 - DNA, 99 bp, Homo sapiens; identical to SEQ ID NO: 70946
  chr10:135002734-135002833
  Hypo

SEQ ID NO: 105534 - DNA, 23 bp, Homo sapiens
  chr10:135004548-135004571
  Hypo
taagccccaactggccgggcatg

SEQ ID NO: 105535 - DNA, 36 bp, Homo sapiens; identical to SEQ ID NO: 70948
  chr10:135008797-135008833
  Hypo

SEQ ID NO: 105536 - DNA, 121 bp, Homo sapiens; identical to SEQ ID NO: 70949
  chr10:135010570-135010691
  Hypo

SEQ ID NO: 105537 - DNA, 330 bp, Homo sapiens; identical to SEQ ID NO: 70950
  chr10:135011761-135012091
  Hypo

SEQ ID NO: 105538 - DNA, 398 bp, Homo sapiens; identical to SEQ ID NO: 70951
  chr10:135012320-135012718
  Hypo

SEQ ID NO: 105539 - DNA, 716 bp, Homo sapiens; identical to SEQ ID NO: 70952
  chr10:135014688-135015404
  Hypo

SEQ ID NO: 105540 - DNA, 217 bp, Homo sapiens; identical to SEQ ID NO: 70953
  chr10:135016590-135016807
  Hypo

SEQ ID NO: 105541 - DNA, 563 bp, Homo sapiens; identical to SEQ ID NO: 70954
  chr10:135017049-135017612
  Hypo

SEQ ID NO: 105542 - DNA, 35 bp, Homo sapiens; identical to SEQ ID NO: 70955
  chr10:135018010-135018045
  Hypo

SEQ ID NO: 105543 - DNA, 47 bp, Homo sapiens; identical to SEQ ID NO: 70956
  chr10:135018352-135018399
  Hypo

SEQ ID NO: 105544 - DNA, 167 bp, Homo sapiens; identical to SEQ ID NO: 70957
  chr10:135018825-135018992
  Hypo

SEQ ID NO: 105545 - DNA, 208 bp, Homo sapiens; identical to SEQ ID NO: 70958
  chr10:135020704-135020912
  Hypo

SEQ ID NO: 105546 - DNA, 30 bp, Homo sapiens; identical to SEQ ID NO: 70959
  chr10:135022018-135022048
  Hypo

SEQ ID NO: 105547 - DNA, 573 bp, Homo sapiens; identical to SEQ ID NO: 70960
  chr10:135023063-135023636
  Hypo

SEQ ID NO: 105548 - DNA, 33 bp, Homo sapiens; identical to SEQ ID NO: 70961
  chr10:135025715-135025748
  Hypo

SEQ ID NO: 105549 - DNA, 30 bp, Homo sapiens; identical to SEQ ID NO: 70962
  chr10:135029314-135029344
  Hypo

SEQ ID NO: 105550 - DNA, 382 bp, Homo sapiens; identical to SEQ ID NO: 70963
  chr10:135030573-135030955
  Hypo

SEQ ID NO: 105551 - DNA, 62 bp, Homo sapiens; identical to SEQ ID NO: 70964
  chr10:135032634-135032696
  Hypo

SEQ ID NO: 105552 - DNA, 428 bp, Homo sapiens; identical to SEQ ID NO: 70965
  chr10:135035009-135035437
  Hypo

SEQ ID NO: 105553 - DNA, 77 bp, Homo sapiens; identical to SEQ ID NO: 70966
  chr10:135037520-135037597
  Hypo

SEQ ID NO: 105554 - DNA, 30 bp, Homo sapiens
  chr10:135040234-135040264
  Hyper
aacagcctaaaagaacggactcccgtaacc

SEQ ID NO: 105555 - DNA, 1633 bp, Homo sapiens
  chr10:135043162-135044795
  Hyper
gatgctggctgcagacgcgctgcagatggaagaagttcagattttaaaagctacttctgcgagcgcgtgaattccgacacccattcccgcggctggcgtggcttctcctcggacccatcccctggcctggcgactccccctgggacccgggtcggtcctccggacccctcgcgtgcaggtgctgagcccgggcgggggcggcgggggcgggggcagcactgggggccggacaagggggcgccagcgccttccggagcgggaggggctccgcacacacctcgacgggggcgggggtaggctcggcacaggctaaaaacgagcggagccgccggggcttaggcatcgcggcacctccgttgaacgggtctaagaacagaactcctgaggaccctccgtttccaaccgaagccagtctttgctctgcgtcttcccggccgcagcgccaggaccgaccccttaggacccggcgggcggggcggggcgcgcggggcggggcggggatggtgggagggtcgcgtagacccggctgggacggagggacggcggcgcgggatgctcagaacgcgtgtgggcggcccgggcggcgtctggccctctccccatcctcgcgcgccgcgccccagccccgggatgctgctccggccccgcaggccgcccccgctcgcgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacggagctgctgctggggacgctgctgcaaccggccgtgtggcgcgcgctgctcctggaccgccgccaggccctgcccacctaccgccgcgtgtcggccgcgctggcccagcagcaggtgcgccgcacccccgcgcagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccaggtaggcgggggactggggggccaggtggggccgaggactgcggaggaaccgggggctgccgagggctgcgggggaggggcgggcgcgccccgcgaaaatccgcccgaccgcctgctccgcgttcccagacgccaccccgctgcccaccgcccgcgaccgcgacgcggaccccacctggacgctccgcttcagcccgtccccaccgaagtctgcggacgcctcccccgcccccggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctgaacaccgccctgctgcagaccctggggcacctgggcgacatcgcgaacat

SEQ ID NO: 105556 - DNA, 635 bp, Homo sapiens; identical to SEQ ID NO: 70970
  chr10:135048782-135049417
  Hyper

SEQ ID NO: 105557 - DNA, 1183 bp, Homo sapiens
  chr10:135049727-135050910
  Hyper
aggcatctgggccctcgctgcccctggccgggacacactgccggtcctgtgcagtggctcaaagcccctctaccgggggtgacccggtctctccggagatgaagtgcagcgggggtctaggccggcttcctggccccccacccctcctggctttacccccgaggccacgtccaaagcccccagcgccccacccccgccagcctcccccttgagggcccagtgacctaactgggccggcagggtccgaggaagaccagggtcagcggcggcacggtccgttccgcgacccctctcctgtgaccccaggtaggccgccgatcggttcccggctgaggtcccgccccagcgcccgcctcccgggctccaacctctttgctcagcccgggaggctcggctggctggggcgggcgtaaccgtggggcgaggcccgccggtctttctgatttccgcgggcggcgtgggcgctgaggcagccgcggtcaggacctggccgggagtcggggctgctccgtggaccccgcgtctgcgccgaaaccccgcatggcttcgggggccggacctgcgcctccgcctaactccggccgccggagacgccgtgcggaccccaagccagtgcgcggaagacaccgtcctaccctcggcatggctgcctcccacccggtcacgtcggtccccgcgccccacgccgacgcgcaggcgacccggggacgcggagacgcagacagctcgggactcaggttcgtgggagcagcggccgcgcgtggctatgaccgtcccgggggcccgtgctcagggcgtccccgtgaggtttgggcgccacagtcaccggcggctctgcccgcgccctggccacagtggggacagcctggcttggcggggacgcaccagtcccgccgccgacgcggagttcctaccccgccgtgcgaggcagtggctccggcccttccagctcgggatggagtcagggagccgcccgcgcccgaatgcagaggctcctgcgatggccccggagtgagtcccccagaggagccggattagggctggaggcggccgagtcccccgagaggcccctcccgacattcccgcccccgcgcgccgctccccgggtcctccgcgtctctttcccgggaaagcctccctcggttcctgcgcggccgcacagcctggacgcagcgcacgcggg

SEQ ID NO: 105558 - DNA, 50 bp, Homo sapiens; identical to SEQ ID NO: 70973
  chr10:135064477-135064527
  Hypo

SEQ ID NO: 105559 - DNA, 30 bp, Homo sapiens; identical to SEQ ID NO: 70974
  chr10:135066354-135066384
  Hypo

SEQ ID NO: 105560 - DNA, 165 bp, Homo sapiens; identical to SEQ ID NO: 70975
  chr10:135069783-135069948
  Hypo

SEQ ID NO: 105561 - DNA, 202 bp, Homo sapiens; identical to SEQ ID NO: 70976
  chr10:135076386-135076588
  Hypo

SEQ ID NO: 105562 - DNA, 81 bp, Homo sapiens; identical to SEQ ID NO: 70977
  chr10:135078929-135079010
  Hypo

SEQ ID NO: 105563 - DNA, 47 bp, Homo sapiens; identical to SEQ ID NO: 70978
  chr10:135084770-135084817
  Hypo

SEQ ID NO: 105564 - DNA, 90 bp, Homo sapiens; identical to SEQ ID NO: 70979
  chr10:135086744-135086834
  Hypo

SEQ ID NO: 105565 - DNA, 233 bp, Homo sapiens; identical to SEQ ID NO: 70980
  chr10:135087412-135087645
  Hypo

SEQ ID NO: 105566 - DNA, 227 bp, Homo sapiens
  chr10:135121807-135122034
  Hyper
tttcacgggagctgcggggactggagaggtcgacaggaccccgacaaaccaggaaagggcctttgaactaaagtaacgggaagtcacccaagggctttaaattaaaaacggttacaataaaactggagtcactttggctccagttcgcgactggtttagagggaacaagatccagggactgcagcgggagacgacaggcggggcaaggcggacgggagagggcgtgc

SEQ ID NO: 105567 - DNA, 205 bp, Homo sapiens; identical to SEQ ID NO: 70981
  chr10:135124038-135124243
  Hypo

SEQ ID NO: 105568 - DNA, 40 bp, Homo sapiens; identical to SEQ ID NO: 70982
  chr10:135133094-135133134
  Hypo

SEQ ID NO: 105569 - DNA, 810 bp, Homo sapiens; identical to SEQ ID NO: 70983
  chr10:135138920-135139730
  Hyper

SEQ ID NO: 105570 - DNA, 319 bp, Homo sapiens; identical to SEQ ID NO: 70984
  chr10:135148783-135149102
  Hyper

SEQ ID NO: 105571 - DNA, 253 bp, Homo sapiens; identical to SEQ ID NO: 70985
  chr10:135150325-135150578
  Hyper

SEQ ID NO: 105572 - DNA, 79 bp, Homo sapiens; identical to SEQ ID NO: 70986
  chr10:135159573-135159652
  Hypo

SEQ ID NO: 105573 - DNA, 30 bp, Homo sapiens; identical to SEQ ID NO: 42836
  chr10:135162912-135162942
  Hypo

SEQ ID NO: 105574 - DNA, 115 bp, Homo sapiens; identical to SEQ ID NO: 70988
  chr10:135170721-135170836
  Hyper

SEQ ID NO: 105575 - DNA, 43 bp, Homo sapiens; identical to SEQ ID NO: 70989
  chr10:135208594-135208637
  Hypo

SEQ ID NO: 105576 - DNA, 345 bp, Homo sapiens; identical to SEQ ID NO: 33566
  chr10:135236927-135237272
  Hyper

SEQ ID NO: 105577 - DNA, 30 bp, Homo sapiens; identical to SEQ ID NO: 70991
  chr10:135269174-135269204
  Hypo

SEQ ID NO: 105578 - DNA, 30 bp, Homo sapiens; identical to SEQ ID NO: 42838
  chr11:197439-197469
  Hypo

SEQ ID NO: 105579 - DNA, 94 bp, Homo sapiens; identical to SEQ ID NO: 72602
  chr11:232918-233012
  Hypo

SEQ ID NO: 105580 - DNA, 114 bp, Homo sapiens; identical to SEQ ID NO: 72648
  chr11:279418-279532
  Hyper

SEQ ID NO: 105581 - DNA, 152 bp, Homo sapiens
  chr11:280108-280260
  Hyper
cgtgctgcagctgcacgctcgggtgaaggagaggaacgcccgctccgtgaagatcaccaagcgcttcaccaagctgctcatcgcgcccgagagcgccgccccggaggaggcgatggggcccgcggaagagcctgagccggggcgcgcgcggc

SEQ ID NO: 105582 - DNA, 39 bp, Homo sapiens; identical to SEQ ID NO: 72665
  chr11:299379-299418
  Hypo

SEQ ID NO: 105583 - DNA, 156 bp, Homo sapiens
  chr11:308110-308266
  Hyper
aaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggagga

SEQ ID NO: 105584 - DNA, 36 bp, Homo sapiens; identical to SEQ ID NO: 72680
  chr11:308326-308362
  Hyper

SEQ ID NO: 105585 - DNA, 195 bp, Homo sapiens; identical to SEQ ID NO: 72754
  chr11:327113-327308
  Hyper

SEQ ID NO: 105586 - DNA, 858 bp, Homo sapiens; identical to SEQ ID NO: 72809
  chr11:369415-370273
  Hyper

SEQ ID NO: 105587 - DNA, 30 bp, Homo sapiens; identical to SEQ ID NO: 72814
  chr11:392634-392664
  Hypo

SEQ ID NO: 105588 - DNA, 356 bp, Homo sapiens; identical to SEQ ID NO: 72815
  chr11:394701-395057
  Hypo

SEQ ID NO: 105589 - DNA, 448 bp, Homo sapiens; identical to SEQ ID NO: 72821
  chr11:406722-407170
  Hyper

SEQ ID NO: 105590 - DNA, 142 bp, Homo sapiens; identical to SEQ ID NO: 72822
  chr11:407389-407531
  Hyper

SEQ ID NO: 105591 - DNA, 47 bp, Homo sapiens
  chr11:416550-416597
  Hyper
ctcagacccagccagcgtcctcggtccgcggccgcccctgcccggtg

SEQ ID NO: 105592 - DNA, 293 bp, Homo sapiens; identical to SEQ ID NO: 72826
  chr11:429466-429759
  Hypo

SEQ ID NO: 105593 - DNA, 362 bp, Homo sapiens; identical to SEQ ID NO: 72870
  chr11:445925-446287
  Hypo

SEQ ID NO: 105594 - DNA, 120 bp, Homo sapiens; identical to SEQ ID NO: 72877
  chr11:447598-447718
  Hypo

SEQ ID NO: 105595 - DNA, 41 bp, Homo sapiens; identical to SEQ ID NO: 72883
  chr11:449336-449377
  Hypo

SEQ ID NO: 105596 - DNA, 85 bp, Homo sapiens; identical to SEQ ID NO: 72885
  chr11:449589-449674
  Hypo

SEQ ID NO: 105597 - DNA, 82 bp, Homo sapiens; identical to SEQ ID NO: 72936
  chr11:486013-486095
  Hypo

SEQ ID NO: 105598 - DNA, 245 bp, Homo sapiens; identical to SEQ ID NO: 42846
  chr11:487303-487548
  Hypo

SEQ ID NO: 105599 - DNA, 30 bp, Homo sapiens; identical to SEQ ID NO: 72938
  chr11:487827-487857
  Hypo

SEQ ID NO: 105600 - DNA, 54 bp, Homo sapiens; identical to SEQ ID NO: 42847
  chr11:493145-493199
  Hypo

SEQ ID NO: 105601 - DNA, 157 bp, Homo sapiens; identical to SEQ ID NO: 72946
  chr11:507665-507822
  Hyper

SEQ ID NO: 105602 - DNA, 39 bp, Homo sapiens; identical to SEQ ID NO: 72948
  chr11:518894-518933
  Hyper

SEQ ID NO: 105603 - DNA, 44 bp, Homo sapiens; identical to SEQ ID NO: 72951
  chr11:520975-521019
  Hypo

SEQ ID NO: 105604 - DNA, 30 bp, Homo sapiens; identical to SEQ ID NO: 72952
  chr11:528361-528391
  Hypo

SEQ ID NO: 105605 - DNA, 303 bp, Homo sapiens
  chr11:536871-537174
  Hyper
cggtcccgggggtcccgcctgccgtccgtccaccgcgcggtcgcagtcagagctcggctcggggcggacacgcatgaacgcgagtgagaagcggcgactggacggcgggcggcagcgtgtcccgcgggccgggcactcgggtgcgctccggcgtccggtgtgtgtttcctggtcctcgggggcgcttcccccggtgcttccttttgccgtcggcctcacttccaaccgaaggtcaggacggcaggcctcggccccaggggcgacccttccacctgggaaaggtgggcgcgagcctccagcaga

SEQ ID NO: 105606 - DNA, 30 bp, Homo sapiens; identical to SEQ ID NO: 72958
  chr11:548977-549007
  Hypo

SEQ ID NO: 105607 - DNA, 638 bp, Homo sapiens; identical to SEQ ID NO: 72965
  chr11:562246-562884
  Hypo

SEQ ID NO: 105608 - DNA, 30 bp, Homo sapiens; identical to SEQ ID NO: 72967
  chr11:567232-567262
  Hypo

SEQ ID NO: 105609 - DNA, 30 bp, Homo sapiens; identical to SEQ ID NO: 42849
  chr11:571791-571821
  Hypo

SEQ ID NO: 105610 - DNA, 30 bp, Homo sapiens; identical to SEQ ID NO: 73023
  chr11:605782-605812
  Hypo

SEQ ID NO: 105611 - DNA, 30 bp, Homo sapiens; identical to SEQ ID NO: 73027
  chr11:607280-607310
  Hypo

SEQ ID NO: 105612 - DNA, 285 bp, Homo sapiens
  chr11:615700-615985
  Hyper
aaacctaaacagtggcgcttcgcaccctcctcgatcccaccccgtccggttctcagctccgcggaaccccgcctccgcctccgcctccctccccgcccgaccctcatctctcaggctcccccagctcttggctctacccctccggggtcacggagcccccacggaggctctcgctcccggcctgcaccgcgtgggtctggggtccccagtacctgggtgccagagccgccgggacgggaagtttcgtctcgcggggaagcggagggccggcgcttttatggtggc

SEQ ID NO: 105613 - DNA, 105 bp, Homo sapiens; identical to SEQ ID NO: 73067
  chr11:616542-616647
  Hypo

SEQ ID NO: 105614 - DNA, 585 bp, Homo sapiens
  chr11:626863-627448
  Hyper
accccccaccccacccggcctcacctgcgcttccccaccaggccctgtagcagccgctggagccgcgcgccctcccgcaggcggctgagctcgctggtgaacgtcccgtctgagtgtcgccgggccctgcgggcggtcgggggtcggggtcagggcgcactgggggcgggtggggcccggggggcgggcgggcctggcgggcggctcacctggggggcgcggggcgcgcggcggagcccccgaggagcagcagcagcagcaggaggggccggggggccatggcggggtcggggcgcaggagctgagcgctgcggccacggccccgggcccccgcaaggcccctttatggcggcgcccggaaaggggacggcccggccgcgcccagcgatcccgggaaggtcagggccgcccccccagctgtcgccccggcccggcctcccgccccctccgccgcgctggcgcccctcggccggctgggggagggggacgtcccggcctggggggcgaacggagcgcgggcctgggacccgcagagggaaccgcaccgcgaagcctcggagcctgcgggggcggaggggccggagg

SEQ ID NO: 105615 - DNA, 30 bp, Homo sapiens
  chr11:636895-636925
  Hyper
actagggtgagcgcccgagggccgggacgc

SEQ ID NO: 105616 - DNA, 325 bp, Homo sapiens
  chr11:637176-637501
  Hyper
ggggcccccctgagccggggcgggtcgggggcgggaccagggtccggccggggcgtgcccgaggggagggactccccggcttgcgacccggcgttgtccgcggtgctcagcgcccgcccgggcgcgccatggggaaccgcagcaccgcggacgcggacgggctgctggctgggcgcgggccggccgcgggggcatctgcgggggcatctgcggggctggctgggcagggcgcggcggcgctggtggggggcgtgctgctcatcggcgcggtgctcgcggggaactcgctcgtgtgcgtgagcgtggccaccgagcgcgccctgca

SEQ ID NO: 105617 - DNA, 218 bp, Homo sapiens
  chr11:640069-640287
  Hyper
gcggccccgactgtgcgcccgccgcgcccagcctcccccaggacccctgcggccccgactgtgcgccccccgcgcccggcctccccccggacccctgcggctccaactgtgctccccccgacgccgtcagagccgccgcgctcccaccccagactccaccgcagacccgcaggaggcggcgtgccaagatcaccggccgggagcgcaaggccatgagg

SEQ ID NO: 105618 - DNA, 30 bp, Homo sapiens; identical to SEQ ID NO: 73358
  chr11:698834-698864
  Hypo

SEQ ID NO: 105619 - DNA, 66 bp, Homo sapiens; identical to SEQ ID NO: 73367
  chr11:707906-707972
  Hypo

SEQ ID NO: 105620 - DNA, 19 bp, Homo sapiens
  chr11:713388-713407
  Hypo
tttgtgtgtttgagacgga

SEQ ID NO: 105621 - DNA, 203 bp, Homo sapiens; identical to SEQ ID NO: 33582
  chr11:726307-726510
  Hyper

SEQ ID NO: 105622 - DNA, 266 bp, Homo sapiens; identical to SEQ ID NO: 73413
  chr11:736495-736761
  Hypo

SEQ ID NO: 105623 - DNA, 38 bp, Homo sapiens; identical to SEQ ID NO: 73455
  chr11:762939-762977
  Hypo

SEQ ID NO: 105624 - DNA, 716 bp, Homo sapiens; identical to SEQ ID NO: 73456
  chr11:763302-764018
  Hypo

SEQ ID NO: 105625 - DNA, 443 bp, Homo sapiens; identical to SEQ ID NO: 73468
  chr11:782133-782576
  Hypo

SEQ ID NO: 105626 - DNA, 181 bp, Homo sapiens; identical to SEQ ID NO: 73474
  chr11:787323-787504
  Hypo

SEQ ID NO: 105627 - DNA, 41 bp, Homo sapiens; identical to SEQ ID NO: 73485
  chr11:796141-796182
  Hyper

SEQ ID NO: 105628 - DNA, 30 bp, Homo sapiens; identical to SEQ ID NO: 73487
  chr11:804039-804069
  Hypo

SEQ ID NO: 105629 - DNA, 30 bp, Homo sapiens; identical to SEQ ID NO: 73497
  chr11:823464-823494
  Hypo

SEQ ID NO: 105630 - DNA, 481 bp, Homo sapiens
  chr11:823903-824384
  Hypo
agagagaggagaggacggtgagcaggggagggaagccgagcgggtcctgggccccgctgcctccactggccgccgacctcccgcccacccgcagccctgctggaggcctgcgtggagcccacggacctgctgaccaccctctccaacatgctgcctgtgcgtctggccacggccatgatggtgccctacacgctgccgctggagagcgctctgtccttcaccatccggtgtgagggctggggggtcgggagaggggcccaggggacggactttgggatcatccgcgagtgatggttaccagggaaggtggggtggggtgagcagtgccaagtcagggcacagacagggcccggcgggtgggcatgtgggtctggccaagtccctgaacgcgccgctcgccctgtccccagcttgctggagtggctgcccgacgttcccgaggacatccggtggatgaaggagcagacgggcagcatctgcc

SEQ ID NO: 105631 - DNA, 156 bp, Homo sapiens; identical to SEQ ID NO: 73501
  chr11:824828-824984
  Hypo

SEQ ID NO: 105632 - DNA, 1041 bp, Homo sapiens
  chr11:829531-830572
  Hyper
cctgggcaagtgagtcggcgctggccccgctcccactgcccgctctgctgtttctctgcctgcatgctgtctgcccttgtcacccgagtgctggttctgcacagggtctctaggccgggtcaggcccagcctagcgtcagctgcgattccctgggagggacccggcatgatttcccgcagaatttgcatttcatgaggcagcagccagggctgcagggaggaggggcagcgccgggcgcggggccacataccggcactgcccagggtacacacacctcaccgaccacgcacgccgggcaggggcgaaagcgctcacgggagggatgccctgcacgcagcaagtgctcctgtcctgcccaggggcgaagaagtctcctaagggtttgctgctggcggagggaagcctgcttcccgcttctgccagctccagcctcagttcccgcccgccctccaggcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggtgagggccggggtggggtatgggggccaatggagggcctcagggcagcagcagaggcggtgccagggggctgtagcgctggcaagttctcatccggggtcgcccggtcccccgaaggcgcgagagcgagcacgagagggaggtgcgcgctctgtacgaggagacggagcagcttcgggagcagagccggcgcccgccgagtcaggtgggcctcgggccccgcccctcccgccaggcccaatcccacctcgctggcctccctggctccgccttctctgaattaatccctccccgacggccccacctccgcgggtccaggctgccctcagcccgaggagatcccactgggcctcacgtatcacccccgtccggtcttctccacccgaccccgctccgcccgggcccactcccagcccctggccctccgtgtacctcttttg

SEQ ID NO: 105633 - DNA, 30 bp, Homo sapiens; identical to SEQ ID NO: 73515
  chr11:847531-847561
  Hypo

SEQ ID NO: 105634 - DNA, 561 bp, Homo sapiens; identical to SEQ ID NO: 73516
  chr11:850546-851107
  Hypo

SEQ ID NO: 105635 - DNA, 30 bp, Homo sapiens; identical to SEQ ID NO: 73520
  chr11:854103-854133
  Hypo

SEQ ID NO: 105636 - DNA, 199 bp, Homo sapiens; identical to SEQ ID NO: 73523
  chr11:858423-858622
  Hypo

SEQ ID NO: 105637 - DNA, 399 bp, Homo sapiens; identical to SEQ ID NO: 73524
  chr11:858987-859386
  Hypo

SEQ ID NO: 105638 - DNA, 33 bp, Homo sapiens; identical to SEQ ID NO: 42861
  chr11:860888-860921
  Hypo

SEQ ID NO: 105639 - DNA, 140 bp, Homo sapiens; identical to SEQ ID NO: 73530
  chr11:861908-862048
  Hypo

SEQ ID NO: 105640 - DNA, 476 bp, Homo sapiens; identical to SEQ ID NO: 42862
  chr11:862616-863092
  Hypo

SEQ ID NO: 105641 - DNA, 101 bp, Homo sapiens; identical to SEQ ID NO: 73534
  chr11:864732-864833
  Hypo

SEQ ID NO: 105642 - DNA, 470 bp, Homo sapiens; identical to SEQ ID NO: 42864
  chr11:865657-866127
  Hypo

SEQ ID NO: 105643 - DNA, 42 bp, Homo sapiens; identical to SEQ ID NO: 73537
  chr11:866956-866998
  Hypo

SEQ ID NO: 105644 - DNA, 30 bp, Homo sapiens; identical to SEQ ID NO: 73538
  chr11:868485-868515
  Hypo

SEQ ID NO: 105645 - DNA, 265 bp, Homo sapiens; identical to SEQ ID NO: 73539
  chr11:869823-870088
  Hypo

SEQ ID NO: 105646 - DNA, 141 bp, Homo sapiens; identical to SEQ ID NO: 73540
  chr11:875376-875517
  Hypo

SEQ ID NO: 105647 - DNA, 39 bp, Homo sapiens; identical to SEQ ID NO: 73549
  chr11:891173-891212
  Hypo

SEQ ID NO: 105648 - DNA, 35 bp, Homo sapiens; identical to SEQ ID NO: 73600
  chr11:971825-971860
  Hypo

SEQ ID NO: 105649 - DNA, 199 bp, Homo sapiens; identical to SEQ ID NO: 73604
  chr11:985267-985466
  Hypo

SEQ ID NO: 105650 - DNA, 146 bp, Homo sapiens; identical to SEQ ID NO: 73606
  chr11:986867-987013
  Hypo

SEQ ID NO: 105651 - DNA, 53 bp, Homo sapiens; identical to SEQ ID NO: 71882
  chr11:1001969-1002022
  Hypo

SEQ ID NO: 105652 - DNA, 50 bp, Homo sapiens; identical to SEQ ID NO: 71883
  chr11:1008075-1008125
  Hypo

SEQ ID NO: 105653 - DNA, 140 bp, Homo sapiens; identical to SEQ ID NO: 71884
  chr11:1008417-1008557
  Hypo

SEQ ID NO: 105654 - DNA, 43 bp, Homo sapiens; identical to SEQ ID NO: 71889
  chr11:1011399-1011442
  Hypo

SEQ ID NO: 105655 - DNA, 96 bp, Homo sapiens; identical to SEQ ID NO: 71897
  chr11:1024000-1024096
  Hypo

SEQ ID NO: 105656 - DNA, 344 bp, Homo sapiens; identical to SEQ ID NO: 42870
  chr11:1024866-1025210
  Hypo

SEQ ID NO: 105657 - DNA, 308 bp, Homo sapiens; identical to SEQ ID NO: 71899
  chr11:1025881-1026189
  Hypo

SEQ ID NO: 105658 - DNA, 305 bp, Homo sapiens; identical to SEQ ID NO: 71900
  chr11:1027283-1027588
  Hypo

SEQ ID NO: 105659 - DNA, 125 bp, Homo sapiens; identical to SEQ ID NO: 71901
  chr11:1028245-1028370
  Hypo

SEQ ID NO: 105660 - DNA, 447 bp, Homo sapiens; identical to SEQ ID NO: 71902
  chr11:1029178-1029625
  Hypo

SEQ ID NO: 105661 - DNA, 177 bp, Homo sapiens; identical to SEQ ID NO: 71905
  chr11:1030131-1030308
  Hypo

SEQ ID NO: 105662 - DNA, 30 bp, Homo sapiens; identical to SEQ ID NO: 71906
  chr11:1030716-1030746
  Hypo

SEQ ID NO: 105663 - DNA, 51 bp, Homo sapiens; identical to SEQ ID NO: 71914
  chr11:1043870-1043921
  Hypo

SEQ ID NO: 105664 - DNA, 39 bp, Homo sapiens; identical to SEQ ID NO: 71919
  chr11:1053231-1053270
  Hypo

SEQ ID NO: 105665 - DNA, 30 bp, Homo sapiens; identical to SEQ ID NO: 71925
  chr11:1055284-1055314
  Hypo

SEQ ID NO: 105666 - DNA, 30 bp, Homo sapiens; identical to SEQ ID NO: 71926
  chr11:1056507-1056537
  Hypo

SEQ ID NO: 105667 - DNA, 212 bp, Homo sapiens; identical to SEQ ID NO: 71931
  chr11:1075735-1075947
  Hypo

SEQ ID NO: 105668 - DNA, 203 bp, Homo sapiens; identical to SEQ ID NO: 71932
  chr11:1077565-1077768
  Hypo

SEQ ID NO: 105669 - DNA, 18 bp, Homo sapiens
  chr11:1078768-1078786
  Hypo
tggggggacactcaccgc

SEQ ID NO: 105670 - DNA, 102 bp, Homo sapiens; identical to SEQ ID NO: 71935
  chr11:1079561-1079663
  Hypo

SEQ ID NO: 105671 - DNA, 126 bp, Homo sapiens; identical to SEQ ID NO: 71936
  chr11:1080203-1080329
  Hypo

SEQ ID NO: 105672 - DNA, 208 bp, Homo sapiens; identical to SEQ ID NO: 71939
  chr11:1081640-1081848
  Hypo

SEQ ID NO: 105673 - DNA, 30 bp, Homo sapiens; identical to SEQ ID NO: 71940
  chr11:1082664-1082694
  Hypo

SEQ ID NO: 105674 - DNA, 68 bp, Homo sapiens; identical to SEQ ID NO: 71942
  chr11:1083440-1083508
  Hypo

SEQ ID NO: 105675 - DNA, 30 bp, Homo sapiens; identical to SEQ ID NO: 42882
  chr11:1085664-1085694
  Hypo

SEQ ID NO: 105676 - DNA, 44 bp, Homo sapiens; identical to SEQ ID NO: 71952
  chr11:1094014-1094058
  Hypo

SEQ ID NO: 105677 - DNA, 219 bp, Homo sapiens; identical to SEQ ID NO: 71953
  chr11:1094942-1095161
  Hypo

SEQ ID NO: 105678 - DNA, 118 bp, Homo sapiens; identical to SEQ ID NO: 71955
  chr11:1095551-1095669
  Hypo

SEQ ID NO: 105679 - DNA, 240 bp, Homo sapiens; identical to SEQ ID NO: 71960
  chr11:1103974-1104214
  Hypo

SEQ ID NO: 105680 - DNA, 133 bp, Homo sapiens; identical to SEQ ID NO: 71976
  chr11:1115098-1115231
  Hypo

SEQ ID NO: 105681 - DNA, 30 bp, Homo sapiens; identical to SEQ ID NO: 71977
  chr11:1120833-1120863
  Hypo

SEQ ID NO: 105682 - DNA, 112 bp, Homo sapiens; identical to SEQ ID NO: 71994
  chr11:1140450-1140562
  Hypo

SEQ ID NO: 105683 - DNA, 173 bp, Homo sapiens; identical to SEQ ID NO: 71999
  chr11:1142462-1142635
  Hypo

SEQ ID NO: 105684 - DNA, 81 bp, Homo sapiens; identical to SEQ ID NO: 72004
  chr11:1148113-1148194
  Hypo

SEQ ID NO: 105685 - DNA, 54 bp, Homo sapiens; identical to SEQ ID NO: 42890
  chr11:1151771-1151825
  Hypo

SEQ ID NO: 105686 - DNA, 249 bp, Homo sapiens; identical to SEQ ID NO: 72006
  chr11:1152416-1152665
  Hypo

SEQ ID NO: 105687 - DNA, 175 bp, Homo sapiens; identical to SEQ ID NO: 72010
  chr11:1155055-1155230
  Hypo

SEQ ID NO: 105688 - DNA, 203 bp, Homo sapiens; identical to SEQ ID NO: 72013
  chr11:1155596-1155799
  Hypo

SEQ ID NO: 105689 - DNA, 30 bp, Homo sapiens; identical to SEQ ID NO: 72022
  chr11:1157863-1157893
  Hypo

SEQ ID NO: 105690 - DNA, 319 bp, Homo sapiens; identical to SEQ ID NO: 72102
  chr11:1214648-1214967
  Hypo

SEQ ID NO: 105691 - DNA, 34 bp, Homo sapiens; identical to SEQ ID NO: 72103
  chr11:1215395-1215429
  Hypo

SEQ ID NO: 105692 - DNA, 329 bp, Homo sapiens; identical to SEQ ID NO: 72105
  chr11:1215733-1216062
  Hypo

SEQ ID NO: 105693 - DNA, 120 bp, Homo sapiens; identical to SEQ ID NO: 72107
  chr11:1216277-1216397
  Hypo

SEQ ID NO: 105694 - DNA, 50 bp, Homo sapiens; identical to SEQ ID NO: 72108
  chr11:1216937-1216987
  Hypo

SEQ ID NO: 105695 - DNA, 35 bp, Homo sapiens; identical to SEQ ID NO: 72109
  chr11:1217246-1217281
  Hypo

SEQ ID NO: 105696 - DNA, 30 bp, Homo sapiens; identical to SEQ ID NO: 72110
  chr11:1217534-1217564
  Hypo

SEQ ID NO: 105697 - DNA, 161 bp, Homo sapiens; identical to SEQ ID NO: 72112
  chr11:1219739-1219900
  Hypo

SEQ ID NO: 105698 - DNA, 173 bp, Homo sapiens; identical to SEQ ID NO: 72113
  chr11:1221703-1221876
  Hypo

SEQ ID NO: 105699 - DNA, 53 bp, Homo sapiens; identical to SEQ ID NO: 72132
  chr11:1228830-1228883
  Hypo

SEQ ID NO: 105700 - DNA, 36 bp, Homo sapiens; identical to SEQ ID NO: 72134
  chr11:1229945-1229981
  Hypo

SEQ ID NO: 105701 - DNA, 30 bp, Homo sapiens; identical to SEQ ID NO: 42898
  chr11:1241768-1241798
  Hypo

SEQ ID NO: 105702 - DNA, 30 bp, Homo sapiens; identical to SEQ ID NO: 72156
  chr11:1243139-1243169
  Hypo

SEQ ID NO: 105703 - DNA, 199 bp, Homo sapiens; identical to SEQ ID NO: 72157
  chr11:1244348-1244547
  Hypo

SEQ ID NO: 105704 - DNA, 337 bp, Homo sapiens; identical to SEQ ID NO: 72175
  chr11:1247782-1248119
  Hypo

SEQ ID NO: 105705 - DNA, 30 bp, Homo sapiens; identical to SEQ ID NO: 72178
  chr11:1249828-1249858
  Hypo

SEQ ID NO: 105706 - DNA, 571 bp, Homo sapiens; identical to SEQ ID NO: 72182
  chr11:1250780-1251351
  Hypo

SEQ ID NO: 105707 - DNA, 33 bp, Homo sapiens; identical to SEQ ID NO: 72184
  chr11:1251802-1251835
  Hypo

SEQ ID NO: 105708 - DNA, 255 bp, Homo sapiens; identical to SEQ ID NO: 72189
  chr11:1252832-1253087
  Hypo

SEQ ID NO: 105709 - DNA, 30 bp, Homo sapiens; identical to SEQ ID NO: 72192
  chr11:1253832-1253862
  Hypo

SEQ ID NO: 105710 - DNA, 84 bp, Homo sapiens; identical to SEQ ID NO: 72193
  chr11:1254339-1254423
  Hypo

SEQ ID NO: 105711 - DNA, 321 bp, Homo sapiens; identical to SEQ ID NO: 42904
  chr11:1254973-1255294
  Hypo

SEQ ID NO: 105712 - DNA, 164 bp, Homo sapiens; identical to SEQ ID NO: 72195
  chr11:1256353-1256517
  Hypo

SEQ ID NO: 105713 - DNA, 256 bp, Homo sapiens; identical to SEQ ID NO: 72199
  chr11:1257652-1257908
  Hypo

SEQ ID NO: 105714 - DNA, 30 bp, Homo sapiens; identical to SEQ ID NO: 72203
  chr11:1260620-1260650
  Hypo

SEQ ID NO: 105715 - DNA, 584 bp, Homo sapiens; identical to SEQ ID NO: 72211
  chr11:1263180-1263764
  Hypo

SEQ ID NO: 105716 - DNA, 44 bp, Homo sapiens; identical to SEQ ID NO: 72226
  chr11:1273678-1273722
  Hypo

SEQ ID NO: 105717 - DNA, 281 bp, Homo sapiens; identical to SEQ ID NO: 72227
  chr11:1274002-1274283
  Hypo

SEQ ID NO: 105718 - DNA, 152 bp, Homo sapiens; identical to SEQ ID NO: 72229
  chr11:1275246-1275398
  Hypo

SEQ ID NO: 105719 - DNA, 119 bp, Homo sapiens; identical to SEQ ID NO: 72230
  chr11:1275636-1275755
  Hypo

SEQ ID NO: 105720 - DNA, 509 bp, Homo sapiens; identical to SEQ ID NO: 72231
  chr11:1276280-1276789
  Hypo

SEQ ID NO: 105721 - DNA, 232 bp, Homo sapiens; identical to SEQ ID NO: 72232
  chr11:1278648-1278880
  Hypo

SEQ ID NO: 105722 - DNA, 30 bp, Homo sapiens; identical to SEQ ID NO: 72233
  chr11:1279716-1279746
  Hypo

SEQ ID NO: 105723 - DNA, 30 bp, Homo sapiens; identical to SEQ ID NO: 72355
  chr11:1357330-1357360
  Hyper

SEQ ID NO: 105724 - DNA, 38 bp, Homo sapiens
  chr11:1358384-1358422
  Hyper
gtccggcccccgcctcgcgctcccgcttctccaggaag

SEQ ID NO: 105725 - DNA, 37 bp, Homo sapiens; identical to SEQ ID NO: 72357
  chr11:1359722-1359759
  Hypo

SEQ ID NO: 105726 - DNA, 81 bp, Homo sapiens; identical to SEQ ID NO: 72358
  chr11:1368283-1368364
  Hypo

SEQ ID NO: 105727 - DNA, 30 bp, Homo sapiens; identical to SEQ ID NO: 72360
  chr11:1371601-1371631
  Hypo

SEQ ID NO: 105728 - DNA, 155 bp, Homo sapiens; identical to SEQ ID NO: 72361
  chr11:1374898-1375053
  Hypo

SEQ ID NO: 105729 - DNA, 30 bp, Homo sapiens; identical to SEQ ID NO: 72362
  chr11:1375352-1375382
  Hypo

SEQ ID NO: 105730 - DNA, 183 bp, Homo sapiens; identical to SEQ ID NO: 42915
  chr11:1382225-1382408
  Hypo

SEQ ID NO: 105731 - DNA, 30 bp, Homo sapiens; identical to SEQ ID NO: 72364
  chr11:1392807-1392837
  Hypo

SEQ ID NO: 105732 - DNA, 120 bp, Homo sapiens; identical to SEQ ID NO: 42916
  chr11:1393300-1393420
  Hypo

SEQ ID NO: 105733 - DNA, 250 bp, Homo sapiens; identical to SEQ ID NO: 33583
  chr11:1410104-1410354
  Hyper

SEQ ID NO: 105734 - DNA, 917 bp, Homo sapiens
  chr11:1411442-1412359
  Hyper
cgggcggacgctgggcggcccctccctgcccgcgcgcccgggcgcccctggccggcgccgggccccagagcgatgacatcgacggggaaggacggcggcgcgcagcacgcgcagtatgttgggccctaccggctggagaagacgctgggcaaggggcagacaggtgcgtgcggccggggcggggaccggggccggggaggccgcgctggcagcgcgctgggtggggggcgcccgagggaggccccggccgcgaagccgcaggcccggcccgggccccggccgcgaacaatgggcggcccgtgcgcccccgtccgctcgtgcgccccggttccgccgcggatcccgcaggccgcttggctgcggtcggccgggcgcggcccaaggacacgcggcgcggcgcggggcgcgcaggcggacaggggcgcacgggacggcgcccctcgggccccgctgcaggtgcgcggcccgggccgcattgtgcgccccagcgaccgggcccattgtgccgcgggaggagggggccgcgcgggcgcccatctgccgtctgccgcggccgcgctaataggcgtgctgcccgagcagctgcgcccccggcgggactcccacctccgcgcgccggccaccggggcctccgggcaggcccgatctccctccgcggtgggggcgggagagtgcggggacctgcagagggctggacagcgccttgcgctgctccggctcgggctcgggcgggcggagcgtctgtgacctgcattcccacggggcagggagaggccattggtgctgggaccagaagtgcgtgggacctgacccgtggagcagccccgcggcctgccggtggagggggcttcccggtggggcctggctgtcattctagggaacaggccgggtccctgcggggccgaacccaggccaga

SEQ ID NO: 105735 - DNA, 30 bp, Homo sapiens; identical to SEQ ID NO: 42917
  chr11:1420766-1420796
  Hypo

SEQ ID NO: 105736 - DNA, 78 bp, Homo sapiens; identical to SEQ ID NO: 72371
  chr11:1422084-1422162
  Hypo

SEQ ID NO: 105737 - DNA, 512 bp, Homo sapiens; identical to SEQ ID NO: 72372
  chr11:1430689-1431201
  Hypo

SEQ ID NO: 105738 - DNA, 110 bp, Homo sapiens
  chr11:1431728-1431838
  Hypo
tgggcccgcagacttcggtgcttcaaaggcctcactgctgagcacgagacgccgcttttgatgtcgtcaggctctctggtccccgggagtggactcgggggctccgagtg

SEQ ID NO: 105739 - DNA, 288 bp, Homo sapiens; identical to SEQ ID NO: 72373
  chr11:1432883-1433171
  Hypo

SEQ ID NO: 105740 - DNA, 193 bp, Homo sapiens; identical to SEQ ID NO: 72374
  chr11:1433665-1433858
  Hypo

SEQ ID NO: 105741 - DNA, 41 bp, Homo sapiens; identical to SEQ ID NO: 72375
  chr11:1434266-1434307
  Hypo

SEQ ID NO: 105742 - DNA, 160 bp, Homo sapiens; identical to SEQ ID NO: 72376
  chr11:1442699-1442859
  Hypo

SEQ ID NO: 105743 - DNA, 373 bp, Homo sapiens; identical to SEQ ID NO: 42923
  chr11:1444579-1444952
  Hypo

SEQ ID NO: 105744 - DNA, 70 bp, Homo sapiens; identical to SEQ ID NO: 72378
  chr11:1446330-1446400
  Hypo

SEQ ID NO: 105745 - DNA, 135 bp, Homo sapiens; identical to SEQ ID NO: 72379
  chr11:1447374-1447509
  Hypo

SEQ ID NO: 105746 - DNA, 24 bp, Homo sapiens
  chr11:1450725-1450749
  Hypo
gccctgctgctctgtcgccagcat

SEQ ID NO: 105747 - DNA, 87 bp, Homo sapiens; identical to SEQ ID NO: 72383
  chr11:1455198-1455285
  Hypo

SEQ ID NO: 105748 - DNA, 75 bp, Homo sapiens; identical to SEQ ID NO: 72384
  chr11:1455520-1455595
  Hypo

SEQ ID NO: 105749 - DNA, 124 bp, Homo sapiens; identical to SEQ ID NO: 72386
  chr11:1456146-1456270
  Hypo

SEQ ID NO: 105750 - DNA, 54 bp, Homo sapiens; identical to SEQ ID NO: 72388
  chr11:1459467-1459521
  Hypo

SEQ ID NO: 105751 - DNA, 65 bp, Homo sapiens; identical to SEQ ID NO: 42929
  chr11:1461955-1462020
  Hypo

SEQ ID NO: 105752 - DNA, 35 bp, Homo sapiens; identical to SEQ ID NO: 72390
  chr11:1463756-1463791
  Hypo

SEQ ID NO: 105753 - DNA, 794 bp, Homo sapiens; identical to SEQ ID NO: 72391
  chr11:1464177-1464971
  Hypo

SEQ ID NO: 105754 - DNA, 508 bp, Homo sapiens; identical to SEQ ID NO: 72396
  chr11:1466703-1467211
  Hypo

SEQ ID NO: 105755 - DNA, 510 bp, Homo sapiens; identical to SEQ ID NO: 42933
  chr11:1469123-1469633
  Hypo

SEQ ID NO: 105756 - DNA, 136 bp, Homo sapiens; identical to SEQ ID NO: 72398
  chr11:1471324-1471460
  Hypo

SEQ ID NO: 105757 - DNA, 193 bp, Homo sapiens; identical to SEQ ID NO: 42935
  chr11:1471865-1472058
  Hypo

SEQ ID NO: 105758 - DNA, 150 bp, Homo sapiens; identical to SEQ ID NO: 72400
  chr11:1473510-1473660
  Hypo

SEQ ID NO: 105759 - DNA, 108 bp, Homo sapiens; identical to SEQ ID NO: 72401
  chr11:1475964-1476072
  Hypo

SEQ ID NO: 105760 - DNA, 595 bp, Homo sapiens; identical to SEQ ID NO: 72402
  chr11:1477752-1478347
  Hypo

SEQ ID NO: 105761 - DNA, 47 bp, Homo sapiens; identical to SEQ ID NO: 72403
  chr11:1482019-1482066
  Hypo

SEQ ID NO: 105762 - DNA, 432 bp, Homo sapiens; identical to SEQ ID NO: 72404
  chr11:1483506-1483938
  Hypo

SEQ ID NO: 105763 - DNA, 30 bp, Homo sapiens; identical to SEQ ID NO: 42940
  chr11:1517598-1517628
  Hypo

SEQ ID NO: 105764 - DNA, 36 bp, Homo sapiens; identical to SEQ ID NO: 72409
  chr11:1536547-1536583
  Hypo

SEQ ID NO: 105765 - DNA, 154 bp, Homo sapiens; identical to SEQ ID NO: 72410
  chr11:1553679-1553833
  Hypo

SEQ ID NO: 105766 - DNA, 35 bp, Homo sapiens; identical to SEQ ID NO: 42942
  chr11:1560806-1560841
  Hypo

SEQ ID NO: 105767 - DNA, 148 bp, Homo sapiens; identical to SEQ ID NO: 72412
  chr11:1585143-1585291
  Hypo

SEQ ID NO: 105768 - DNA, 222 bp, Homo sapiens; identical to SEQ ID NO: 72424
  chr11:1669519-1669741
  Hypo

SEQ ID NO: 105769 - DNA, 30 bp, Homo sapiens; identical to SEQ ID NO: 72432
  chr11:1742866-1742896
  Hypo

SEQ ID NO: 105770 - DNA, 84 bp, Homo sapiens; identical to SEQ ID NO: 42944
  chr11:1760346-1760430
  Hypo

SEQ ID NO: 105771 - DNA, 851 bp, Homo sapiens
  chr11:1769868-1770719
  Hyper
gcgcacccgcgggcgcgctcagagccattgacgagtaaacaactccccacacaaggcgatgcaggctcagccacgagcaccaagaaccggcacaggtgcggggtctccaactcgtgcgcaccgccccccacctccaacctggggaccccaagcgcgcacacttgcccggagccacgcacccccgggccatacatagacgcacaataacaggctgtgaaatgaacacttctccaacgaggcaccaagtcgctcgcgctctgcgccaccccgcgttcccagctcccgtgcggcgctcgccggggggtctgcggccgaggctctgcagcccccagccccatccgggtctgccgcagccccccggacggcgcctcctcacctacaagcgactcctcggcgcgcggccggaccccctgagcctcggtgcgcgcgtccttccgccgtcccgcgggccgctgtctgtccactgatccgcctcccagcggcccaaccttgagggggtggggagcgcgcggggctcggcggcggcgccgctgcctcccccgccgcctgcgctccctccgcagcgccagaccggccgcgcggctgcagcccagagcctgactcacggcggcagcgggcacagccacctccccgcctccgcctcctcctgccaggagggtgggggcctcggaagccgcgaccctggggagttgcaaggtcccgcagggatgggacccctacagcccccgaccagggtgtccgcgccacctccatctccccggacccactgcgtcttcctccccaccccacccggccccatccctctcgcggagcccccagccccgtggaagactggacgctcccggaaccct

SEQ ID NO: 105772 - DNA, 30 bp, Homo sapiens; identical to SEQ ID NO: 72458
  chr11:1788149-1788179
  Hypo

SEQ ID NO: 105773 - DNA, 59 bp, Homo sapiens; identical to SEQ ID NO: 72459
  chr11:1788433-1788492
  Hypo

SEQ ID NO: 105774 - DNA, 62 bp, Homo sapiens; identical to SEQ ID NO: 72460
  chr11:1790206-1790268
  Hypo

SEQ ID NO: 105775 - DNA, 91 bp, Homo sapiens; identical to SEQ ID NO: 42946
  chr11:1795195-1795286
  Hypo

SEQ ID NO: 105776 - DNA, 30 bp, Homo sapiens; identical to SEQ ID NO: 42947
  chr11:1801108-1801138
  Hypo

SEQ ID NO: 105777 - DNA, 141 bp, Homo sapiens; identical to SEQ ID NO: 72465
  chr11:1824116-1824257
  Hypo

SEQ ID NO: 105778 - DNA, 102 bp, Homo sapiens; identical to SEQ ID NO: 72466
  chr11:1825171-1825273
  Hypo

SEQ ID NO: 105779 - DNA, 30 bp, Homo sapiens; identical to SEQ ID NO: 72467
  chr11:1826914-1826944
  Hypo

SEQ ID NO: 105780 - DNA, 36 bp, Homo sapiens; identical to SEQ ID NO: 72468
  chr11:1829914-1829950
  Hypo

SEQ ID NO: 105781 - DNA, 62 bp, Homo sapiens; identical to SEQ ID NO: 72469
  chr11:1847259-1847321
  Hypo

SEQ ID NO: 105782 - DNA, 57 bp, Homo sapiens; identical to SEQ ID NO: 42949
  chr11:1856532-1856589
  Hypo

SEQ ID NO: 105783 - DNA, 335 bp, Homo sapiens; identical to SEQ ID NO: 72472
  chr11:1857210-1857545
  Hypo

SEQ ID NO: 105784 - DNA, 60 bp, Homo sapiens; identical to SEQ ID NO: 72473
  chr11:1857873-1857933
  Hypo

SEQ ID NO: 105785 - DNA, 63 bp, Homo sapiens; identical to SEQ ID NO: 72474
  chr11:1858589-1858652
  Hypo

SEQ ID NO: 105786 - DNA, 30 bp, Homo sapiens; identical to SEQ ID NO: 72475
  chr11:1862756-1862786
  Hypo

SEQ ID NO: 105787 - DNA, 30 bp, Homo sapiens; identical to SEQ ID NO: 42952
  chr11:1863098-1863128
  Hypo

SEQ ID NO: 105788 - DNA, 30 bp, Homo sapiens; identical to SEQ ID NO: 72477
  chr11:1864366-1864396
  Hypo

SEQ ID NO: 105789 - DNA, 30 bp, Homo sapiens; identical to SEQ ID NO: 72478
  chr11:1864932-1864962
  Hypo

SEQ ID NO: 105790 - DNA, 123 bp, Homo sapiens; identical to SEQ ID NO: 72480
  chr11:1867693-1867816
  Hypo

SEQ ID NO: 105791 - DNA, 271 bp, Homo sapiens; identical to SEQ ID NO: 72481
  chr11:1868053-1868324
  Hypo

SEQ ID NO: 105792 - DNA, 81 bp, Homo sapiens; identical to SEQ ID NO: 72482
  chr11:1868863-1868944
  Hypo

SEQ ID NO: 105793 - DNA, 30 bp, Homo sapiens; identical to SEQ ID NO: 72483
  chr11:1869458-1869488
  Hypo

SEQ ID NO: 105794 - DNA, 30 bp, Homo sapiens; identical to SEQ ID NO: 72486
  chr11:1878638-1878668
  Hypo

SEQ ID NO: 105795 - DNA, 80 bp, Homo sapiens; identical to SEQ ID NO: 72489
  chr11:1884451-1884531
  Hypo

SEQ ID NO: 105796 - DNA, 51 bp, Homo sapiens; identical to SEQ ID NO: 72490
  chr11:1889039-1889090
  Hypo

SEQ ID NO: 105797 - DNA, 30 bp, Homo sapiens; identical to SEQ ID NO: 72491
  chr11:1891550-1891580
  Hypo

SEQ ID NO: 105798 - DNA, 152 bp, Homo sapiens; identical to SEQ ID NO: 72493
  chr11:1907948-1908100
  Hypo

SEQ ID NO: 105799 - DNA, 30 bp, Homo sapiens; identical to SEQ ID NO: 72496
  chr11:1934662-1934692
  Hypo

SEQ ID NO: 105800 - DNA, 78 bp, Homo sapiens; identical to SEQ ID NO: 72497
  chr11:1935022-1935100
  Hypo

SEQ ID NO: 105801 - DNA, 88 bp, Homo sapiens; identical to SEQ ID NO: 72503
  chr11:1940385-1940473
  Hypo

SEQ ID NO: 105802 - DNA, 298 bp, Homo sapiens; identical to SEQ ID NO: 72504
  chr11:1945862-1946160
  Hypo

SEQ ID NO: 105803 - DNA, 34 bp, Homo sapiens; identical to SEQ ID NO: 72505
  chr11:1947562-1947596
  Hypo

SEQ ID NO: 105804 - DNA, 39 bp, Homo sapiens; identical to SEQ ID NO: 72506
  chr11:1949943-1949982
  Hypo

SEQ ID NO: 105805 - DNA, 284 bp, Homo sapiens; identical to SEQ ID NO: 72507
  chr11:1950350-1950634
  Hypo

SEQ ID NO: 105806 - DNA, 240 bp, Homo sapiens; identical to SEQ ID NO: 72508
  chr11:1955151-1955391
  Hypo

SEQ ID NO: 105807 - DNA, 1139 bp, Homo sapiens; identical to SEQ ID NO: 72510
  chr11:1957221-1958360
  Hypo

SEQ ID NO: 105808 - DNA, 605 bp, Homo sapiens; identical to SEQ ID NO: 72511
  chr11:1958714-1959319
  Hypo

SEQ ID NO: 105809 - DNA, 123 bp, Homo sapiens; identical to SEQ ID NO: 72512
  chr11:1959951-1960074
  Hypo

SEQ ID NO: 105810 - DNA, 30 bp, Homo sapiens; identical to SEQ ID NO: 72513
  chr11:1963030-1963060
  Hypo

SEQ ID NO: 105811 - DNA, 105 bp, Homo sapiens; identical to SEQ ID NO: 72518
  chr11:1975964-1976069
  Hypo

SEQ ID NO: 105812 - DNA, 30 bp, Homo sapiens; identical to SEQ ID NO: 72519
  chr11:1977320-1977350
  Hypo

SEQ ID NO: 105813 - DNA, 35 bp, Homo sapiens; identical to SEQ ID NO: 72520
  chr11:1980528-1980563
  Hypo

SEQ ID NO: 105814 - DNA, 335 bp, Homo sapiens; identical to SEQ ID NO: 42963
  chr11:1981002-1981337
  Hypo

SEQ ID NO: 105815 - DNA, 30 bp, Homo sapiens; identical to SEQ ID NO: 72522
  chr11:1981581-1981611
  Hypo

SEQ ID NO: 105816 - DNA, 30 bp, Homo sapiens; identical to SEQ ID NO: 72523
  chr11:1983138-1983168
  Hypo

SEQ ID NO: 105817 - DNA, 61 bp, Homo sapiens; identical to SEQ ID NO: 72524
  chr11:1983778-1983839
  Hypo

SEQ ID NO: 105818 - DNA, 30 bp, Homo sapiens; identical to SEQ ID NO: 72525
  chr11:1984105-1984135
  Hypo

SEQ ID NO: 105819 - DNA, 76 bp, Homo sapiens; identical to SEQ ID NO: 72526
  chr11:1986000-1986076
  Hypo

SEQ ID NO: 105820 - DNA, 30 bp, Homo sapiens; identical to SEQ ID NO: 72527
  chr11:1992236-1992266
  Hypo

SEQ ID NO: 105821 - DNA, 35 bp, Homo sapiens; identical to SEQ ID NO: 72528
  chr11:1993637-1993672
  Hypo

SEQ ID NO: 105822 - DNA, 116 bp, Homo sapiens; identical to SEQ ID NO: 72529
  chr11:1996568-1996684
  Hypo

SEQ ID NO: 105823 - DNA, 30 bp, Homo sapiens; identical to SEQ ID NO: 72530
  chr11:2000619-2000649
  Hypo

SEQ ID NO: 105824 - DNA, 30 bp, Homo sapiens; identical to SEQ ID NO: 72531
  chr11:2011824-2011854
  Hypo

SEQ ID NO: 105825 - DNA, 205 bp, Homo sapiens; identical to SEQ ID NO: 72547
  chr11:2036933-2037138
  Hypo

SEQ ID NO: 105826 - DNA, 182 bp, Homo sapiens; identical to SEQ ID NO: 72549
  chr11:2040029-2040211
  Hypo

SEQ ID NO: 105827 - DNA, 249 bp, Homo sapiens; identical to SEQ ID NO: 72550
  chr11:2042252-2042501
  Hypo

SEQ ID NO: 105828 - DNA, 83 bp, Homo sapiens; identical to SEQ ID NO: 72552
  chr11:2048975-2049058
  Hypo

SEQ ID NO: 105829 - DNA, 55 bp, Homo sapiens; identical to SEQ ID NO: 72569
  chr11:2108054-2108109
  Hypo

SEQ ID NO: 105830 - DNA, 30 bp, Homo sapiens; identical to SEQ ID NO: 72570
  chr11:2109282-2109312
  Hypo

SEQ ID NO: 105831 - DNA, 132 bp, Homo sapiens; identical to SEQ ID NO: 72571
  chr11:2109525-2109657
  Hypo

SEQ ID NO: 105832 - DNA, 30 bp, Homo sapiens; identical to SEQ ID NO: 42969
  chr11:2110642-2110672
  Hypo

SEQ ID NO: 105833 - DNA, 132 bp, Homo sapiens; identical to SEQ ID NO: 72573
  chr11:2122361-2122493
  Hypo

SEQ ID NO: 105834 - DNA, 153 bp, Homo sapiens; identical to SEQ ID NO: 72574
  chr11:2131777-2131930
  Hypo

SEQ ID NO: 105835 - DNA, 61 bp, Homo sapiens; identical to SEQ ID NO: 72575
  chr11:2133266-2133327
  Hypo

SEQ ID NO: 105836 - DNA, 58 bp, Homo sapiens; identical to SEQ ID NO: 72576
  chr11:2150685-2150743
  Hypo

SEQ ID NO: 105837 - DNA, 170 bp, Homo sapiens; identical to SEQ ID NO: 72577
  chr11:2151064-2151234
  Hypo

SEQ ID NO: 105838 - DNA, 322 bp, Homo sapiens; identical to SEQ ID NO: 72578
  chr11:2152269-2152591
  Hypo

SEQ ID NO: 105839 - DNA, 95 bp, Homo sapiens; identical to SEQ ID NO: 72579
  chr11:2156024-2156119
  Hypo

SEQ ID NO: 105840 - DNA, 82 bp, Homo sapiens; identical to SEQ ID NO: 72580
  chr11:2187516-2187598
  Hyper

SEQ ID NO: 105841 - DNA, 572 bp, Homo sapiens; identical to SEQ ID NO: 72581
  chr11:2209843-2210415
  Hypo

SEQ ID NO: 105842 - DNA, 139 bp, Homo sapiens; identical to SEQ ID NO: 72583
  chr11:2224689-2224828
  Hypo

SEQ ID NO: 105843 - DNA, 30 bp, Homo sapiens; identical to SEQ ID NO: 42976
  chr11:2226048-2226078
  Hypo

SEQ ID NO: 105844 - DNA, 517 bp, Homo sapiens; identical to SEQ ID NO: 72593
  chr11:2278322-2278839
  Hypo

SEQ ID NO: 105845 - DNA, 30 bp, Homo sapiens; identical to SEQ ID NO: 72594
  chr11:2287971-2288001
  Hypo

SEQ ID NO: 105846 - DNA, 96 bp, Homo sapiens; identical to SEQ ID NO: 72595
  chr11:2289204-2289300
  Hypo

SEQ ID NO: 105847 - DNA, 1841 bp, Homo sapiens
  chr11:2290937-2292778
  Hyper
ctcctccctgcctcccggctgttacctcataggtcgagggcgctcagtagccccctaaccagctggagaagtcgagtagctcgcgctccgcaggactcagcgcgccttcgcagccgctgtcgtccgacgagtaggcggaacgcggggagccgggctccgagctgcccccgcggcccggggacgaagaagcgcgggagggcgaggcggcgaccggggtggtccctggcggcccgcggggcgcagacggccgcacggcctgcggcctcagccctcccgccagcgcgttgcgcacggcgtcgtgctcggccagcaggcgctgcagcgcgcggatgtactccacggctgagcgcagcgtctccaccttgctcagcttcttgctggcgccgccgtgcggcacgtgctgccgcagcgcctggaagcccaagttcaccagcttcacgcggttgcgctcgcgctcattgcgccgcgctacggccgctgcgccgcctccggtctctgcggtggccggtcgccgccgccggctgcagcgcaacagttccggggacgcgggtctccgccgggcagcgcagccgacagggacggggggcgcagggggcgcggacctgggcagtgtgccgccgtccatcgcgcctgcatccacccgcccgctccaggtcccggcgcgccgcaggaaggtgcaggcagaggaaccggaggcgacggggaaaactgtggcgccccaagggggcttctggcacggcgccgccaggcaactccccagggcacgcgtcctaggtcgtctggagcccggggataggaggcctagtggtggcaggccgtacgcgccagggagcgtgggacgctcgtgtcccgcgcgtgcggccggactctcccaggtctccgcaggcgcggcgcaggcggctggtttttaaatgtatagataaccctcctccgcgccgccgccgtcgcctttctcacgccctccttccttcgcctcgccctcccgccacgcttcgccctccccctcgcgcgatcacattctgtaaggcccaaagcgtgcgcatgtccccctagcccatcccccggacgcagtccacagatccccagtgcgcccaactggcgaaatctgcgagttcccggtgcgccccctgctcccggcaggtgcttagtgcgcccccaaagcaaggtacgcaggtcctgggttgagccttcccgtacccccaccctaaccccgcgcgcagccccgccagtcccaagagccgccagaccttcgcacgcgcagcgcgcgctgtgggagggaaggcgcggccctggcgacaacacggctgttcgggaggcgcgcaagatccccgggggcagcacgcgccgcgcagcccacacccacgccccaccctcctggggccgaggaggcgggggccagggtctcagccaatcgtgggccacccgtttggccaatcgcgcagggcgcggctccacgcccggccccattgaggaagcgcgtacgcgtggcgcgtggctcacggggagcatcgctaacaaagctgggttcctgctgggccccgccctgctcctcgcccccgcgactgggctgggcgcgctgtcccctagcgcagctatgtcccgagcgcgcccccacctgtgcgttaatctactgggaatgggggtggactgcgccttacctggggcggggtggggcttaaggagtggtcgagactgaggcggggtgggaggttcaggttcccggggcgccttccccaacccgccccgctttccccgtccctccacgcgcaccctgcctgtggtttccgtgcgcccccggcctgagggctctgggcggcaccttaacccggagggcctggagg

SEQ ID NO: 105848 - DNA, 30 bp, Homo sapiens; identical to SEQ ID NO: 72603
  chr11:2329497-2329527
  Hypo

SEQ ID NO: 105849 - DNA, 30 bp, Homo sapiens; identical to SEQ ID NO: 72604
  chr11:2329892-2329922
  Hypo

SEQ ID NO: 105850 - DNA, 137 bp, Homo sapiens; identical to SEQ ID NO: 72606
  chr11:2398257-2398394
  Hyper

SEQ ID NO: 105851 - DNA, 30 bp, Homo sapiens; identical to SEQ ID NO: 72607
  chr11:2425909-2425939
  Hypo

SEQ ID NO: 105852 - DNA, 35 bp, Homo sapiens; identical to SEQ ID NO: 42979
  chr11:2428079-2428114
  Hypo

SEQ ID NO: 105853 - DNA, 192 bp, Homo sapiens; identical to SEQ ID NO: 72609
  chr11:2435222-2435414
  Hypo

SEQ ID NO: 105854 - DNA, 42 bp, Homo sapiens; identical to SEQ ID NO: 72610
  chr11:2435972-2436014
  Hypo

SEQ ID NO: 105855 - DNA, 190 bp, Homo sapiens; identical to SEQ ID NO: 72611
  chr11:2436421-2436611
  Hypo

SEQ ID NO: 105856 - DNA, 291 bp, Homo sapiens; identical to SEQ ID NO: 72612
  chr11:2437920-2438211
  Hypo

SEQ ID NO: 105857 - DNA, 119 bp, Homo sapiens; identical to SEQ ID NO: 72613
  chr11:2439088-2439207
  Hypo

SEQ ID NO: 105858 - DNA, 96 bp, Homo sapiens
  chr11:2465424-2465520
  Hyper
ggccctggtgggaagcgacccgagcgtattcgccgcccgcagctcgcgcgcctgggcacccgggggcgctcacagtgatcgcggggccagcacacc

SEQ ID NO: 105859 - DNA, 390 bp, Homo sapiens; identical to SEQ ID NO: 72619
  chr11:2466441-2466831
  Hyper

SEQ ID NO: 105860 - DNA, 140 bp, Homo sapiens; identical to SEQ ID NO: 72620
  chr11:2491342-2491482
  Hypo

SEQ ID NO: 105861 - DNA, 161 bp, Homo sapiens; identical to SEQ ID NO: 72622
  chr11:2541198-2541359
  Hypo

SEQ ID NO: 105862 - DNA, 202 bp, Homo sapiens; identical to SEQ ID NO: 72623
  chr11:2543263-2543465
  Hypo

SEQ ID NO: 105863 - DNA, 30 bp, Homo sapiens; identical to SEQ ID NO: 72624
  chr11:2547325-2547355
  Hypo

SEQ ID NO: 105864 - DNA, 79 bp, Homo sapiens; identical to SEQ ID NO: 72625
  chr11:2554518-2554597
  Hyper

SEQ ID NO: 105865 - DNA, 145 bp, Homo sapiens; identical to SEQ ID NO: 72626
  chr11:2569001-2569146
  Hypo

SEQ ID NO: 105866 - DNA, 313 bp, Homo sapiens; identical to SEQ ID NO: 72627
  chr11:2596433-2596746
  Hypo

SEQ ID NO: 105867 - DNA, 32 bp, Homo sapiens; identical to SEQ ID NO: 72628
  chr11:2603413-2603445
  Hypo

SEQ ID NO: 105868 - DNA, 36 bp, Homo sapiens; identical to SEQ ID NO: 72629
  chr11:2612777-2612813
  Hypo

SEQ ID NO: 105869 - DNA, 32 bp, Homo sapiens; identical to SEQ ID NO: 72632
  chr11:2745363-2745395
  Hypo

SEQ ID NO: 105870 - DNA, 276 bp, Homo sapiens; identical to SEQ ID NO: 72635
  chr11:2753764-2754040
  Hypo

SEQ ID NO: 105871 - DNA, 39 bp, Homo sapiens; identical to SEQ ID NO: 72636
  chr11:2758828-2758867
  Hypo

SEQ ID NO: 105872 - DNA, 30 bp, Homo sapiens; identical to SEQ ID NO: 42988
  chr11:2770653-2770683
  Hypo

SEQ ID NO: 105873 - DNA, 35 bp, Homo sapiens; identical to SEQ ID NO: 72650
  chr11:2812777-2812812
  Hyper

SEQ ID NO: 105874 - DNA, 199 bp, Homo sapiens; identical to SEQ ID NO: 72651
  chr11:2818195-2818394
  Hypo

SEQ ID NO: 105875 - DNA, 30 bp, Homo sapiens; identical to SEQ ID NO: 15520
  chr11:2829204-2829234
  Hypo

SEQ ID NO: 105876 - DNA, 50 bp, Homo sapiens; identical to SEQ ID NO: 72653
  chr11:2868750-2868800
  Hypo

SEQ ID NO: 105877 - DNA, 430 bp, Homo sapiens; identical to SEQ ID NO: 72654
  chr11:2883606-2884036
  Hyper

SEQ ID NO: 105878 - DNA, 47 bp, Homo sapiens; identical to SEQ ID NO: 72655
  chr11:2884253-2884300
  Hyper

SEQ ID NO: 105879 - DNA, 118 bp, Homo sapiens; identical to SEQ ID NO: 72656
  chr11:2905392-2905510
  Hyper

SEQ ID NO: 105880 - DNA, 177 bp, Homo sapiens; identical to SEQ ID NO: 72657
  chr11:2905859-2906036
  Hyper

SEQ ID NO: 105881 - DNA, 275 bp, Homo sapiens; identical to SEQ ID NO: 72658
  chr11:2906305-2906580
  Hyper

SEQ ID NO: 105882 - DNA, 190 bp, Homo sapiens; identical to SEQ ID NO: 72659
  chr11:2906781-2906971
  Hyper

SEQ ID NO: 105883 - DNA, 235 bp, Homo sapiens; identical to SEQ ID NO: 72660
  chr11:2932722-2932957
  Hypo

SEQ ID NO: 105884 - DNA, 135 bp, Homo sapiens; identical to SEQ ID NO: 72661
  chr11:2933495-2933630
  Hypo

SEQ ID NO: 105885 - DNA, 30 bp, Homo sapiens; identical to SEQ ID NO: 72662
  chr11:2948107-2948137
  Hypo

SEQ ID NO: 105886 - DNA, 460 bp, Homo sapiens; identical to SEQ ID NO: 72663
  chr11:2949947-2950407
  Hyper

SEQ ID NO: 105887 - DNA, 100 bp, Homo sapiens; identical to SEQ ID NO: 72681
  chr11:3102365-3102465
  Hypo

SEQ ID NO: 105888 - DNA, 32 bp, Homo sapiens; identical to SEQ ID NO: 72682
  chr11:3110963-3110995
  Hypo

SEQ ID NO: 105889 - DNA, 30 bp, Homo sapiens; identical to SEQ ID NO: 72683
  chr11:3114134-3114164
  Hypo

SEQ ID NO: 105890 - DNA, 30 bp, Homo sapiens; identical to SEQ ID NO: 42992
  chr11:3150813-3150843
  Hypo

SEQ ID NO: 105891 - DNA, 402 bp, Homo sapiens; identical to SEQ ID NO: 72686
  chr11:3164552-3164954
  Hypo

SEQ ID NO: 105892 - DNA, 99 bp, Homo sapiens; identical to SEQ ID NO: 72687
  chr11:3169788-3169887
  Hypo

SEQ ID NO: 105893 - DNA, 83 bp, Homo sapiens; identical to SEQ ID NO: 72727
  chr11:3186228-3186311
  Hyper

SEQ ID NO: 105894 - DNA, 170 bp, Homo sapiens; identical to SEQ ID NO: 72728
  chr11:3186601-3186771
  Hyper

SEQ ID NO: 105895 - DNA, 48 bp, Homo sapiens; identical to SEQ ID NO: 42995
  chr11:3187905-3187953
  Hypo

SEQ ID NO: 105896 - DNA, 100 bp, Homo sapiens; identical to SEQ ID NO: 72732
  chr11:3209774-3209874
  Hypo

SEQ ID NO: 105897 - DNA, 67 bp, Homo sapiens; identical to SEQ ID NO: 72733
  chr11:3224699-3224766
  Hyper

SEQ ID NO: 105898 - DNA, 265 bp, Homo sapiens; identical to SEQ ID NO: 72750
  chr11:3249604-3249869
  Hypo

SEQ ID NO: 105899 - DNA, 153 bp, Homo sapiens; identical to SEQ ID NO: 72751
  chr11:3251585-3251738
  Hypo

SEQ ID NO: 105900 - DNA, 82 bp, Homo sapiens; identical to SEQ ID NO: 72752
  chr11:3254436-3254518
  Hypo

SEQ ID NO: 105901 - DNA, 30 bp, Homo sapiens; identical to SEQ ID NO: 72756
  chr11:3277135-3277165
  Hypo

SEQ ID NO: 105902 - DNA, 30 bp, Homo sapiens; identical to SEQ ID NO: 42997
  chr11:3398724-3398754
  Hypo

SEQ ID NO: 105903 - DNA, 30 bp, Homo sapiens; identical to SEQ ID NO: 72784
  chr11:3429178-3429208
  Hypo

SEQ ID NO: 105904 - DNA, 30 bp, Homo sapiens; identical to SEQ ID NO: 72786
  chr11:3446939-3446969
  Hypo

SEQ ID NO: 105905 - DNA, 30 bp, Homo sapiens; identical to SEQ ID NO: 72803
  chr11:3638442-3638472
  Hypo

SEQ ID NO: 105906 - DNA, 110 bp, Homo sapiens; identical to SEQ ID NO: 72806
  chr11:3663415-3663525
  Hyper

SEQ ID NO: 105907 - DNA, 93 bp, Homo sapiens; identical to SEQ ID NO: 42998
  chr11:3697398-3697491
  Hypo

SEQ ID NO: 105908 - DNA, 30 bp, Homo sapiens; identical to SEQ ID NO: 42999
  chr11:3766731-3766761
  Hypo

SEQ ID NO: 105909 - DNA, 159 bp, Homo sapiens; identical to SEQ ID NO: 43000
  chr11:3828803-3828962
  Hypo

SEQ ID NO: 105910 - DNA, 29 bp, Homo sapiens
  chr11:4209105-4209134
  Hyper
tgcaagttagtgggcggggagccagtagg

SEQ ID NO: 105911 - DNA, 44 bp, Homo sapiens; identical to SEQ ID NO: 72827
  chr11:4298908-4298952
  Hypo

SEQ ID NO: 105912 - DNA, 30 bp, Homo sapiens; identical to SEQ ID NO: 72845
  chr11:4361455-4361485
  Hypo

SEQ ID NO: 105913 - DNA, 30 bp, Homo sapiens; identical to SEQ ID NO: 72852
  chr11:4399994-4400024
  Hypo

SEQ ID NO: 105914 - DNA, 21 bp, Homo sapiens
  chr11:4785810-4785831
  Hypo
gaatactgggcagggcgcagt

SEQ ID NO: 105915 - DNA, 30 bp, Homo sapiens; identical to SEQ ID NO: 72935
  chr11:4792115-4792145
  Hypo

SEQ ID NO: 105916 - DNA, 26 bp, Homo sapiens
  chr11:5169023-5169049
  Hypo
tttttttttttttttcggagacagag

SEQ ID NO: 105917 - DNA, 159 bp, Homo sapiens; identical to SEQ ID NO: 15524
  chr11:5192016-5192175
  Hypo

SEQ ID NO: 105918 - DNA, 41 bp, Homo sapiens; identical to SEQ ID NO: 72950
  chr11:5192457-5192498
  Hypo

SEQ ID NO: 105919 - DNA, 136 bp, Homo sapiens; identical to SEQ ID NO: 72953
  chr11:5330681-5330817
  Hypo

SEQ ID NO: 105920 - DNA, 95 bp, Homo sapiens; identical to SEQ ID NO: 72956
  chr11:5394464-5394559
  Hypo

SEQ ID NO: 105921 - DNA, 30 bp, Homo sapiens; identical to SEQ ID NO: 72957
  chr11:5411435-5411465
  Hypo

SEQ ID NO: 105922 - DNA, 16 bp, Homo sapiens
  chr11:5580873-5580889
  Hypo
ccgtctcaaaaaaaaa

SEQ ID NO: 105923 - DNA, 27 bp, Homo sapiens
  chr11:5609308-5609335
  Hypo
catgagcctccgcgactgacctaaaat

SEQ ID NO: 105924 - DNA, 30 bp, Homo sapiens; identical to SEQ ID NO: 72966
  chr11:5624731-5624761
  Hypo

SEQ ID NO: 105925 - DNA, 19 bp, Homo sapiens
  chr11:5784549-5784568
  Hypo
aatttatttttgagacgga

SEQ ID NO: 105926 - DNA, 196 bp, Homo sapiens; identical to SEQ ID NO: 73011
  chr11:5949707-5949903
  Hypo

SEQ ID NO: 105927 - DNA, 15 bp, Homo sapiens
  chr11:5949963-5949978
  Hypo
cggccttattgatcc

SEQ ID NO: 105928 - DNA, 30 bp, Homo sapiens; identical to SEQ ID NO: 73013
  chr11:5951371-5951401
  Hypo

SEQ ID NO: 105929 - DNA, 34 bp, Homo sapiens; identical to SEQ ID NO: 73015
  chr11:5957970-5958004
  Hypo

SEQ ID NO: 105930 - DNA, 104 bp, Homo sapiens; identical to SEQ ID NO: 43007
  chr11:6257172-6257276
  Hypo

SEQ ID NO: 105931 - DNA, 307 bp, Homo sapiens; identical to SEQ ID NO: 73096
  chr11:6280415-6280722
  Hyper

SEQ ID NO: 105932 - DNA, 156 bp, Homo sapiens; identical to SEQ ID NO: 73097
  chr11:6281164-6281320
  Hyper

SEQ ID NO: 105933 - DNA, 90 bp, Homo sapiens; identical to SEQ ID NO: 73101
  chr11:6341394-6341484
  Hyper

SEQ ID NO: 105934 - DNA, 96 bp, Homo sapiens; identical to SEQ ID NO: 73190
  chr11:6497213-6497309
  Hypo

SEQ ID NO: 105935 - DNA, 555 bp, Homo sapiens
  chr11:6676451-6677006
  Hyper
acacagccagagagacgcccagggacacacaacctcccagtgacacgcactgacacactccgacgatgcactggaacacaacgctgtcgcaccccacacccccggcgcacgctcccgccgccaccctccccgactcgatgacacacgcacacaaagacccccaggccctgcccccacgctcacgttcacgcccgcccgggtcccgcaggcccaggccccccctcccccattgtctccggctcagaacaaagcccccggctccgccgccgctgccgcagcccaggggaggccggcgggcagggcgggcgcggccagacgggccgggcgggcgcgggcactgacctccgcgcgacgcgggctccctcgcccggtgctggggcgccgtccggccgcggtcagccccccgggcagcgcccgctcgcgcggggcctgaggccgcgcatcgtccgcagtcgctgtctccgaggcccgcgatcccctccgggcagccgccgtcggtccgcgcgcccttggccgtcgatcggtccgtccgctgacgcccgggcgccgcctcct

SEQ ID NO: 105936 - DNA, 133 bp, Homo sapiens; identical to SEQ ID NO: 73273
  chr11:6677213-6677346
  Hyper

SEQ ID NO: 105937 - DNA, 199 bp, Homo sapiens; identical to SEQ ID NO: 73286
  chr11:6731043-6731242
  Hypo

SEQ ID NO: 105938 - DNA, 714 bp, Homo sapiens; identical to SEQ ID NO: 73346
  chr11:6947603-6948317
  Hyper

SEQ ID NO: 105939 - DNA, 38 bp, Homo sapiens; identical to SEQ ID NO: 73366
  chr11:7041865-7041903
  Hyper

SEQ ID NO: 105940 - DNA, 1388 bp, Homo sapiens
  chr11:7272860-7274248
  Hyper
actcggcggtgggagcgggtgcttggtttgcatcagggatgaggggtggagtagcgaaagcgcccggagcgcgcactcactcacactccccaagccagggcgcggccgctctgggcgcgaggtcccaagccaagtctcgcgctcggccaggagccggggagtaccccaggtccccggtctggggccgccgctatcctaccctgcggcgcgcactcctgacctggccccgccccccggcggccgcgagtagcgggcggagcgcaagcagagaggcgctctgggctgtgcggcaccgcctctcctcggtgtctggggagggacggagggaccgggcgggagagagagaaagcctgaccgaccggctggcgaagagctgcatgcaaccggtgggaggccgggccggctgggtctggggctcgggctcaggctcgcaccgtttctcggcaggtccctggcggtgagcgcggacggcccggaggcggcggctctgagctggcaggcggagggctgtctcctgcgcccgcctgcccggcgcggtccgaggatgcgggggggcgatgcccggggccagggacgcgctctgtcaccaggcgctgcagctgctggccgagctctgtgcccgtggggccctggagcacgacagctgccaggatttcatttaccacctgcgggaccgtgccagaccccggctccgcgacccaggtgagtgccgccaccgccgcctggagggacctaagggccctgggctgggacttggggccgcaccggggcctgaggcagaacagcgacgcggactgggagagggcggggggcggccaccgagccaggagagtgatcaagaaccagcgcactgtggcctgatgctgtaaccaggcggggacccgggcggtggctactgcacggaggccgactccgggtcggctagggcagggttggagggaccacgcccgccacctgcgctcccatcgccaaggctcctgggggcggctccctagctccgagctacgctctccacttcccgggctatctgcactcagagcgaggggaggccgcggcggcctcggagccgtgggaagggggacgaggccgaaggaaactctgggaagttgggagttggggacggccccgggttggggccgaatcccaccgggtgctgctcatcctttctcccaagcgtctagttcctttccttggtatggggtgagaagggcgggacgcgatccggcgttgggccggggacagggtgcttctggccttgggcagacgggcctgaacccgttcccggcgggtcgcacggcatggaggtggcctgggcctgggcgctaggctcgaccagcgactaccgccggccacgatggggttcgtagactcgtcggtcctggcttgtg

SEQ ID NO: 105941 - DNA, 28 bp, Homo sapiens
  chr11:7388589-7388617
  Hypo
gcgtgagccaccgcgcccggccttccag

SEQ ID NO: 105942 - DNA, 30 bp, Homo sapiens; identical to SEQ ID NO: 43010
  chr11:7439190-7439220
  Hypo

SEQ ID NO: 105943 - DNA, 188 bp, Homo sapiens; identical to SEQ ID NO: 73476
  chr11:7905970-7906158
  Hypo

SEQ ID NO: 105944 - DNA, 33 bp, Homo sapiens; identical to SEQ ID NO: 73477
  chr11:7909927-7909960
  Hypo

SEQ ID NO: 105945 - DNA, 888 bp, Homo sapiens
  chr11:8040261-8041149
  Hyper
gaagagaggaggggacggtggtttcaagacttccaccctggggaagaagggacggggagacggcgggaatctaggaaattgggggatggctatttccattcctgagaaggggggaacttgattgtgggaggttggctgaagactcccacgccggaaaggagggcgcctctgcggaagggccccgagtggcgacagcggatccgggactcccaagcaagcaggagccggagcagcctcttagcaacccctgtcccgggaaggtttgaaagcagcggtgccctagtgacgccggaaaagatggagcggttgtcatggcgacgcggagcacacctcggaaataaataaataagcgcccaggctgccgcagccgcgcccccgcgggacccgagcgagggggagggggcctcacgggcccgggtccccgcagtcgcgcgtccccgccattggcagagccggagggggtcaccccccggggggcgaatggtacagtcctccgcccgcgcctcggccgggcccgcagcctgcgagccagccccaagcccagcgccgccgccgcccgcggagccccgagcggagccggaggcggcgatggagggagtcagcagccaccggaccctgtcttacagccgctggagctatgacaggtagggcgcccgaagggtggccctgcgtgagcgcctgctgaccctcgatctcctgcgggagaagcgggcctccgggggctaggactggcgcgagcgcccgacccccagggtgggcttgggcacccggaccctcgggcatccgggacccagagcctcgggtacggcgcagcggagctccagcgagggtagtgtccccacacccacggggcagagctgtcggaggagggcacgcggccactgggac

SEQ ID NO: 105946 - DNA, 108 bp, Homo sapiens; identical to SEQ ID NO: 73491
  chr11:8041493-8041601
  Hyper

SEQ ID NO: 105947 - DNA, 594 bp, Homo sapiens; identical to SEQ ID NO: 73492
  chr11:8102561-8103155
  Hyper

SEQ ID NO: 105948 - DNA, 820 bp, Homo sapiens; identical to SEQ ID NO: 73494
  chr11:8189946-8190766
  Hyper

SEQ ID NO: 105949 - DNA, 30 bp, Homo sapiens; identical to SEQ ID NO: 73495
  chr11:8213825-8213855
  Hypo

SEQ ID NO: 105950 - DNA, 120 bp, Homo sapiens
  chr11:8284225-8284345
  Hyper
tctgggccaaactcccgcctccgcgctcagagagacagggagctagcgggccggcacaagaggcggctctctttctcaccgagtcacgctcatgcagatgtcccccggagggtccaaccc

SEQ ID NO: 105951 - DNA, 393 bp, Homo sapiens; identical to SEQ ID NO: 73504
  chr11:8284568-8284961
  Hyper

SEQ ID NO: 105952 - DNA, 896 bp, Homo sapiens
  chr11:8289527-8290423
  Hyper
caccccgctgggatccgttccgcagtagggtgcggaaggggaacgtgcagacacccagagaggctgggagactggctggcagtgggcactgccgggaagcccgcggtgcgggtcgcagaggcgctccggatgcccgcaaggcggcaagagtccgtgagaaagttcccagccggagcgcgcagggctggcggcctcgttgggaccgggagacttcctaatcccgccgccgccgaagcccgggcgctgagcctggcaccgccgaccccggcaccggcgcacacatcagccgccgcgcttccgggaagccacccatcagccggaggaggcccgcgggtgctgagggctctgccgccgctagcggggtggactccgcagggccagcgccgcagtctccgccccacgtcccgcgtgcccccgggcaccggcaccgggcgccgggcacctaccgtcctcctggtccaacaccatggtcccgacggctccagccggactagcgccgaggatacggaggggcgcgtggctccgactcccgccgccggccgcctgcgctgctcccgccggccccgcgcgggcgccgagtccggagagccgcgaccgccgacgggggcagacggaccggagtccggagcgcagccccgcgggcagggagcgcaggaggagggactggggggaaggcgcgggggcgagacggccaggccgggatcgcgggagcctcgcgagcagcagctgcccgggccgggccgcagccggagcctgagccgcgcgcgcgtccttcctccgcgccggccgtactcgcctcagcagagtgaaggctgcatttcccagggcccctcagattcccctgttaattaaatcaattcattatgctcagatctgattagcggcccttccccccc

SEQ ID NO: 105953 - DNA, 599 bp, Homo sapiens; identical to SEQ ID NO: 73529
  chr11:8615288-8615887
  Hyper

SEQ ID NO: 105954 - DNA, 73 bp, Homo sapiens; identical to SEQ ID NO: 73545
  chr11:8832710-8832783
  Hypo

SEQ ID NO: 105955 - DNA, 1338 bp, Homo sapiens; identical to SEQ ID NO: 73555
  chr11:9025010-9026348
  Hyper

SEQ ID NO: 105956 - DNA, 525 bp, Homo sapiens
  chr11:9112446-9112971
  Hyper
gggtaattcccagatcggaacaggcgctgttccgctgacagaaaagtctctggagcccaccccgaagccatcagcagaacttgccggcccccaaagaaagaaacggcaaagctgccaccgcctcgcggatgtgcccggcccggccctcagtttccccgcctacgctgaggcgcgggaccccaaggccagggtccgcaccctcctgcctgctcgccggcgacggtctgactagcaggcgctctggaggcatccggaccggggcgggaaccgtcagcagctccgggtccgaggccgggccgaaggactcagggccccagcggtcgtggcgccttggcccggccggcgggtgaggtcccggggggagcagaggcccccgcggagctgcagccgccagccccgagccccgcgcgcccggctctggactccgccggggacctaaacactcttcctggccctgcctgctgtgccaggtgcgcccccgcggccggacactcaccctcctgcggccccgcggcacggccccga

SEQ ID NO: 105957 - DNA, 465 bp, Homo sapiens; identical to SEQ ID NO: 73559
  chr11:9113031-9113496
  Hyper

SEQ ID NO: 105958 - DNA, 30 bp, Homo sapiens; identical to SEQ ID NO: 73566
  chr11:9285492-9285522
  Hyper

SEQ ID NO: 105959 - DNA, 157 bp, Homo sapiens; identical to SEQ ID NO: 43011
  chr11:9405392-9405549
  Hypo

SEQ ID NO: 105960 - DNA, 37 bp, Homo sapiens; identical to SEQ ID NO: 43012
  chr11:9405789-9405826
  Hypo

SEQ ID NO: 105961 - DNA, 26 bp, Homo sapiens
  chr11:9567879-9567905
  Hypo
ctgttcctattcggccatcttggctc

SEQ ID NO: 105962 - DNA, 30 bp, Homo sapiens; identical to SEQ ID NO: 73599
  chr11:9593400-9593430
  Hypo

SEQ ID NO: 105963 - DNA, 46 bp, Homo sapiens; identical to SEQ ID NO: 73601
  chr11:9830623-9830669
  Hypo

SEQ ID NO: 105964 - DNA, 30 bp, Homo sapiens; identical to SEQ ID NO: 71907
  chr11:10326950-10326980
  Hyper

SEQ ID NO: 105965 - DNA, 25 bp, Homo sapiens
  chr11:10405168-10405193
  Hypo
tctctctctaggagtcgtcatttat

SEQ ID NO: 105966 - DNA, 84 bp, Homo sapiens; identical to SEQ ID NO: 71915
  chr11:10468369-10468453
  Hypo

SEQ ID NO: 105967 - DNA, 576 bp, Homo sapiens
  chr11:10472027-10472603
  Hyper
ctgggaaaagttgtgcggggaggggaggacgtcgggcaagcccgggcggcacggggagcggtgtggaagcccggcggggccagcgcagttgaggtctggggagcccggctggcatctgctccgggctgcggcgcgggccccgcggagcccaggaggcggcgggtgcttccggccaagggccctggcggccgccgcgcccctgctgctctcaagtttcccgttggcggcgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcgcggcctggccgggccctggccccggctggcctcagtgcccagcagccccgctccgctctgcccagcgcgtcccctttgctccagccctgcggccgtccctttcggccggcggcatggccctgtcgtccgaacccggtgagtgcgcgcg

SEQ ID NO: 105968 - DNA, 214 bp, Homo sapiens; identical to SEQ ID NO: 71918
  chr11:10509593-10509807
  Hypo

SEQ ID NO: 105969 - DNA, 37 bp, Homo sapiens; identical to SEQ ID NO: 71937
  chr11:10811151-10811188
  Hypo

SEQ ID NO: 105970 - DNA, 29 bp, Homo sapiens
  chr11:10815867-10815896
  Hypo
acatttgaagctgggcgcggtagctcacg

SEQ ID NO: 105971 - DNA, 30 bp, Homo sapiens; identical to SEQ ID NO: 71941
  chr11:10828053-10828083
  Hypo

SEQ ID NO: 105972 - DNA, 100 bp, Homo sapiens; identical to SEQ ID NO: 43016
  chr11:10865202-10865302
  Hypo

SEQ ID NO: 105973 - DNA, 116 bp, Homo sapiens; identical to SEQ ID NO: 71954
  chr11:10952367-10952483
  Hyper

SEQ ID NO: 105974 - DNA, 30 bp, Homo sapiens; identical to SEQ ID NO: 71987
  chr11:11373606-11373636
  Hypo

SEQ ID NO: 105975 - DNA, 30 bp, Homo sapiens; identical to SEQ ID NO: 72002
  chr11:11465873-11465903
  Hypo

SEQ ID NO: 105976 - DNA, 66 bp, Homo sapiens; identical to SEQ ID NO: 33631
  chr11:11642602-11642668
  Hyper

SEQ ID NO: 105977 - DNA, 288 bp, Homo sapiens; identical to SEQ ID NO: 72025
  chr11:11643016-11643304
  Hyper

SEQ ID NO: 105978 - DNA, 669 bp, Homo sapiens
  chr11:12029892-12030561
  Hyper
cccgcgccgccagggcgcacccacctcttccaccgcgctgcgcaatttgtgctgcgtgtcctccatcagttcctcaacctcgcggaacatctcattgagggtggcctcctcctgcgggtagctgagagccgggccgggcttgactggagccgaggtcgccgtcggagcgggcgcgggggccgtggggaccgccgccgccagcagcaggcacagcagggtggccccaagccgctgcatctccgctctgcgcccgcagccgccgcctgtgtgtcccggaacgcgatcagaggcgcgcggaccacccccctcgctgggcccgccgccccgccccgttccgccccgccgcccgcccctggcgcccctctttcccgcacccgcccggagacgggaggaaaccgaggcccctgaaaacgcagctcccctacacccgaaaagacgcgaccccacccgctccagcccgagccccgatcgccccaggaccccgcacccccatcctcgagcacaagctgagctctgctcctcacctgtgatgctggagccctcgccagagcaaccgaacccggatcctctacgctaatagctcccaagccccagctcacctagactctgtccccggttcaaaccctagcccctcctcgaccaggtcagagtgcccgacccccacttcca

SEQ ID NO: 105979 - DNA, 172 bp, Homo sapiens; identical to SEQ ID NO: 72080
  chr11:12030834-12031006
  Hyper

SEQ ID NO: 105980 - DNA, 350 bp, Homo sapiens; identical to SEQ ID NO: 72100
  chr11:12131862-12132212
  Hyper

SEQ ID NO: 105981 - DNA, 112 bp, Homo sapiens; identical to SEQ ID NO: 72101
  chr11:12132499-12132611
  Hyper

SEQ ID NO: 105982 - DNA, 30 bp, Homo sapiens; identical to SEQ ID NO: 72114
  chr11:12231039-12231069
  Hypo

SEQ ID NO: 105983 - DNA, 30 bp, Homo sapiens; identical to SEQ ID NO: 43017
  chr11:12288561-12288591
  Hypo

SEQ ID NO: 105984 - DNA, 59 bp, Homo sapiens; identical to SEQ ID NO: 72153
  chr11:12398995-12399054
  Hyper

SEQ ID NO: 105985 - DNA, 106 bp, Homo sapiens; identical to SEQ ID NO: 72154
  chr11:12399277-12399383
  Hyper

SEQ ID NO: 105986 - DNA, 1289 bp, Homo sapiens
  chr11:12695399-12696688
  Hyper
gctgggaatctggcccggagacggcgtccaccgcgctcgagagcaacaatctgcatcaccagaaaggcaacttctctaccctacacttgcagacttccgcgagtccgggagcactcaacgcagtcacccgcgcttccgcgtcccggactagggaaactgaggcacggtaggcgcgtcgcgcgcaactcccgcctcggcgcctgccccctggaagaaacccaggcttccagagttcttcgcgcgagcgcagggacttccaagccgcgcagctcccgtccgccccgccccgccccgccccggctcgggacaaagcccggagcccgcgccgggagacggagggcggctcccgcgcgagccacgctcccccgtgggcgcgagactccgcccagctgccgaaagcccgcgccccaacggcgaagcagccgcgccggtccgccccgattccccatgacgtcaccggcggcggcaggccccgcctccagccccgggcggcaggccgcatgacgtcaccgaggccccacccctccggagcgagttcggtcctggcgttcatttcattcctgtcctcattccgaacattcttagcatcgctcgcgccgcgccgcgccgcctgagccgagccgagcctctgctgccgccgccgcggccccgccgcccgccgcgggcgcccaccaagcactttgcagactcgcttccaccctgcgggccattccgcgcggcggggcccgggcccggggcggccgcgtccaggcacaggccatgcagtgacgcccccccacccctccacctttgcccggagcgcgggcagcagcccagcgcgccagccggccccggggcaggagcggtgctaggcaggggtggggtggccgggcccagggaccgggagccggggagggagccgggcaccgagcagagggcgggggaagcggcgccgaagtttgcctcggactcgccgggcgctgcggtggctccctgggccgaggtaagttggcgcgcggggcggatgctggggtgcggggggcgcacggggcagcggggggccggcggcgcgtccctcgcgggccgctctttctttgcgggctctgctttgtgtgcgacggcgggcgggcacgcggagggccgcggccgggcccccacacccgcctccccgcgccccctccgaggtgagcggccgggcgccgccgcgcgacttgccaggacgccaagttgggccgcgcgctgggagcccgcgcggcaacaggcggcccccggccggccgcgccgcgccccccgcgcgccccctctcccgc

SEQ ID NO: 105987 - DNA, 30 bp, Homo sapiens; identical to SEQ ID NO: 33642
  chr11:12715647-12715677
  Hyper

SEQ ID NO: 105988 - DNA, 30 bp, Homo sapiens; identical to SEQ ID NO: 72228
  chr11:12745696-12745726
  Hypo

SEQ ID NO: 105989 - DNA, 397 bp, Homo sapiens; identical to SEQ ID NO: 72271
  chr11:13030293-13030690
  Hyper

SEQ ID NO: 105990 - DNA, 687 bp, Homo sapiens
  chr11:13030937-13031624
  Hyper
aaccgcgaccacagccgcagtcgctttccagcctgccttcggtgcgcagcgggggaacagggctagtgcagccgccggaggggggcacgggctcctctcccatcccagagctactgggctgcccttgctgtcctcgccgccccagcagaccccggccggacctgccacctgcgccctggttgcgccatggatccttcggaaaagaagatatcggtgtggatctgccaggaagagaagctggtgtccggcctctcccgccgcaccacttgctccgacgttgtgcgagtgcttttggaggacggctgccggcggcgacggagacagcggcggagccggcggctggggtcggccggcgacccgcatggcccgggagagctgcccgaacccccgaacgaggacgacgaggacgacgacgaggcgctgccgcagggcatgctgtgcgggcccccgcagtgctattgcatcgtggagaagtggcgcggctttgagcgcatcctccccaacaagacgcgcatcttgcgcctctgggctgcctggggcgaagagcaagagaatgtgcgcttcgtgctagtgcgcagcgaggcatcgctgcctaacgccggcccccgcagcgccgaggcgcgcgtagtgctgagccgagagcgcccctgtccggcccgcggggccccggcgcggcccagcctggcc

SEQ ID NO: 105991 - DNA, 356 bp, Homo sapiens
  chr11:13031956-13032312
  Hyper
ggttggggcaggcatcgagctcgacgggtccagaccgggagaggagccagaagaggtggcggcggaggcggaggaggcggcggcggcgccccctctagccggcgaggcgcaggcggcggcgctggaggagctggcccggcgctgcgacgacttgctgcggcttcaggagcaacgggttcagcaggaggagttgctggagcgcctttcagccgagattcaggaggaactcaaccagaggtggatgcgacggcgccaggaggagctggcggcgcgggaggagcccctggagcccgacggtggccccgacggcgagctgctgctggagcaggaacgggtcaggacgcagctcagtacca

SEQ ID NO: 105992 - DNA, 150 bp, Homo sapiens
  chr11:13032656-13032806
  Hyper
gcggggggcggggggcgggaacagggggattcttttttcttgcagaatgcagtgggccagccggctcgcggacttgaaaccaggctgttgcgagcccagagctccggctgggcagcagcgctctgcgcagcctcgcgctcatctggctcc

SEQ ID NO: 105993 - DNA, 281 bp, Homo sapiens; identical to SEQ ID NO: 72308
  chr11:13300434-13300715
  Hyper

SEQ ID NO: 105994 - DNA, 19 bp, Homo sapiens
  chr11:13687132-13687151
  Hypo
agtacgagactccttctca

SEQ ID NO: 105995 - DNA, 33 bp, Homo sapiens; identical to SEQ ID NO: 72381
  chr11:14520450-14520483
  Hypo

SEQ ID NO: 105996 - DNA, 18 bp, Homo sapiens
  chr11:14542771-14542789
  Hypo
gggcggaggatcgcttga

SEQ ID NO: 105997 - DNA, 23 bp, Homo sapiens
  chr11:14558164-14558187
  Hypo
tttttatttttgagacggagtct

SEQ ID NO: 105998 - DNA, 79 bp, Homo sapiens; identical to SEQ ID NO: 72387
  chr11:14564357-14564436
  Hypo

SEQ ID NO: 105999 - DNA, 198 bp, Homo sapiens; identical to SEQ ID NO: 72392
  chr11:14665073-14665271
  Hyper

SEQ ID NO: 106000 - DNA, 34 bp, Homo sapiens; identical to SEQ ID NO: 72393
  chr11:14665617-14665651
  Hyper

SEQ ID NO: 106001 - DNA, 30 bp, Homo sapiens; identical to SEQ ID NO: 72394
  chr11:14666026-14666056
  Hyper

SEQ ID NO: 106002 - DNA, 35 bp, Homo sapiens; identical to SEQ ID NO: 72395
  chr11:14666496-14666531
  Hyper

SEQ ID NO: 106003 - DNA, 84 bp, Homo sapiens; identical to SEQ ID NO: 43021
  chr11:15084438-15084522
  Hypo

SEQ ID NO: 106004 - DNA, 515 bp, Homo sapiens
  chr11:15136043-15136558
  Hyper
cagctccaagggaaacgatcgcggcacattcccttcccctctccagatgttggcatgcggggcaccttgtgggcgaccccgcctggacggcttcgcggctcccgggcgatcaccctggtgcctgccgcctggcccgggggagcccggtctctaattaggcctgaccgcgtccccattccagcgctcctgcagatgggagggagggccatgtttccccccccaggggcaccgaaatagcctcgtagtcccgcggagacagcaggcagccgtggctgacgcgggaccaaggcttggcagggagcgcgctgctgtggaaggtccttgggaggctgcgaccgcctcggagagggcgggcgggggagaacggggcggggggtggggcgggggccaggggcggcctctcgggctgggccggcagagcggccactttgcgcgcggcctctggagctccagctgcgccccgccaccactggccgctcgcactaccagcctgtctcgcacgctaagtaagtaga

SEQ ID NO: 106005 - DNA, 23 bp, Homo sapiens
  chr11:16255262-16255285
  Hypo
aacataaaacaggcccggtgcgg

SEQ ID NO: 106006 - DNA, 214 bp, Homo sapiens; identical to SEQ ID NO: 72414
  chr11:16625964-16626178
  Hyper

SEQ ID NO: 106007 - DNA, 57 bp, Homo sapiens; identical to SEQ ID NO: 72415
  chr11:16626439-16626496
  Hyper

SEQ ID NO: 106008 - DNA, 46 bp, Homo sapiens; identical to SEQ ID NO: 72416
  chr11:16627364-16627410
  Hyper

SEQ ID NO: 106009 - DNA, 606 bp, Homo sapiens; identical to SEQ ID NO: 72417
  chr11:16628305-16628911
  Hyper

SEQ ID NO: 106010 - DNA, 156 bp, Homo sapiens; identical to SEQ ID NO: 33655
  chr11:16629373-16629529
  Hyper

SEQ ID NO: 106011 - DNA, 257 bp, Homo sapiens
  chr11:16632413-16632670
  Hyper
gctcggagaagttcccggaggagcagagggcacccaggcacggtggccagatccaggaactcataagctcacatcccctgggggttggagccccacgcggcgcaagaaccccgggcgctgagctccggggaacctgggagggaaggaggggcgagcgggtggggctgacttacctgcccgcagcagtcgctgcctctgtgttgtccgaatgtccctgcgcaccgcaaccagcaaaggcaattcggctttgctaactt

SEQ ID NO: 106012 - DNA, 313 bp, Homo sapiens; identical to SEQ ID NO: 72421
  chr11:16634139-16634452
  Hyper

SEQ ID NO: 106013 - DNA, 30 bp, Homo sapiens; identical to SEQ ID NO: 72422
  chr11:16635126-16635156
  Hyper

SEQ ID NO: 106014 - DNA, 132 bp, Homo sapiens; identical to SEQ ID NO: 33658
  chr11:16635795-16635927
  Hyper

SEQ ID NO: 106015 - DNA, 21 bp, Homo sapiens
  chr11:16762253-16762274
  Hypo
ccacctcgcccagccagtact

SEQ ID NO: 106016 - DNA, 30 bp, Homo sapiens; identical to SEQ ID NO: 72426
  chr11:16935834-16935864
  Hypo

SEQ ID NO: 106017 - DNA, 219 bp, Homo sapiens; identical to SEQ ID NO: 72427
  chr11:16978351-16978570
  Hypo

SEQ ID NO: 106018 - DNA, 108 bp, Homo sapiens; identical to SEQ ID NO: 43023
  chr11:16988399-16988507
  Hypo

SEQ ID NO: 106019 - DNA, 21 bp, Homo sapiens
  chr11:17037323-17037344
  Hypo
tcgcgccgctgccctgcaacc

SEQ ID NO: 106020 - DNA, 154 bp, Homo sapiens; identical to SEQ ID NO: 43025
  chr11:17100671-17100825
  Hypo

SEQ ID NO: 106021 - DNA, 279 bp, Homo sapiens; identical to SEQ ID NO: 72431
  chr11:17373126-17373405
  Hyper

SEQ ID NO: 106022 - DNA, 249 bp, Homo sapiens
  chr11:17497448-17497697
  Hyper
ctcagtggagaggcacgcacgattgtcccggccgtggcgcccaactttgcaagcaagggcgccggggtcgctgcgtcggcgagtcggagctactttgcgcagagcctgagaagttgcgctctggagacacatgcccgggtggggtggcgggggaagggaatccaagtccctagctctcgcctctcctcgcccagggcgcgggcctgggactgtcagagatcacggaccactgcgcggctcagcccggtg

SEQ ID NO: 106023 - DNA, 314 bp, Homo sapiens; identical to SEQ ID NO: 72435
  chr11:17497951-17498265
  Hyper

SEQ ID NO: 106024 - DNA, 218 bp, Homo sapiens; identical to SEQ ID NO: 72436
  chr11:17565786-17566004
  Hyper

SEQ ID NO: 106025 - DNA, 98 bp, Homo sapiens; identical to SEQ ID NO: 72437
  chr11:17566237-17566335
  Hypo

SEQ ID NO: 106026 - DNA, 46 bp, Homo sapiens; identical to SEQ ID NO: 72438
  chr11:17591817-17591863
  Hypo

SEQ ID NO: 106027 - DNA, 117 bp, Homo sapiens; identical to SEQ ID NO: 72440
  chr11:17633792-17633909
  Hypo

SEQ ID NO: 106028 - DNA, 30 bp, Homo sapiens; identical to SEQ ID NO: 72441
  chr11:17653699-17653729
  Hypo

SEQ ID NO: 106029 - DNA, 465 bp, Homo sapiens; identical to SEQ ID NO: 72443
  chr11:17717315-17717780
  Hyper

SEQ ID NO: 106030 - DNA, 806 bp, Homo sapiens; identical to SEQ ID NO: 72444
  chr11:17740381-17741187
  Hyper

SEQ ID NO: 106031 - DNA, 187 bp, Homo sapiens
  chr11:17741411-17741598
  Hyper
acttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggc

SEQ ID NO: 106032 - DNA, 722 bp, Homo sapiens
  chr11:17741806-17742528
  Hyper
ctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatggtaaggccgggaccccaggaagtgaggaagttagggcggcgctcgggatatcagggacgcgtttccgagggcggggagctggccttgcgggaggtttgggccaggatccttcccgagagagaggacccccttgtcctgggcagctgtcactggggtagcctgttttggaagtgtgcgggcaagcgttcgagctgccccattgggggcgctattagaacactgcagcgcgaacgtgaagatctttttctctacttatccctacttccaaaatgtaaatttgcgccccttggtgactgtccgcccttggtttggccctgcatgttgcagacctcatctcctacccacccgtaattacccccccaaccaggacaggtctgggcccggaactagagccttaggctagagttagggagggggcggctacaggaattggtgttcgggcctcgagccgtcccgcgggcctgactcagtcgcccttgctgtttgcagatggactacagcggccccccgagcggcgcccggcggcggaactgctacgaaggcgcctactacaacgaggcgcccagcgg

SEQ ID NO: 106033 - DNA, 32 bp, Homo sapiens; identical to SEQ ID NO: 72449
  chr11:17742779-17742811
  Hyper

SEQ ID NO: 106034 - DNA, 32 bp, Homo sapiens; identical to SEQ ID NO: 72450
  chr11:17743213-17743245
  Hyper

SEQ ID NO: 106035 - DNA, 76 bp, Homo sapiens; identical to SEQ ID NO: 72451
  chr11:17743716-17743792
  Hyper

SEQ ID NO: 106036 - DNA, 431 bp, Homo sapiens; identical to SEQ ID NO: 72452
  chr11:17756235-17756666
  Hyper

SEQ ID NO: 106037 - DNA, 257 bp, Homo sapiens
  chr11:17756886-17757143
  Hyper
agagagggagggggccggagcccgccctgcgtcccgagctgcagcccggccacgcagggaggaaggcaggcggcatccatctcccccgcgccgagagcgcgccgcggcgaccacctcacagaggagcgcgaatttcccggccctgtctcctcccctccccctcctgggggctggcctctagtccggccccgggagcggctgacctttcccccaaaagctttgtgccgatttctccattttcccgcggagatggggac

SEQ ID NO: 106038 - DNA, 77 bp, Homo sapiens; identical to SEQ ID NO: 33673
  chr11:17757704-17757781
  Hyper

SEQ ID NO: 106039 - DNA, 45 bp, Homo sapiens
  chr11:17758041-17758086
  Hyper
cctggcggcttttggcgccgctggcagccgcgcatctgggcgctc

SEQ ID NO: 106040 - DNA, 44 bp, Homo sapiens; identical to SEQ ID NO: 43028
  chr11:17784927-17784971
  Hypo

SEQ ID NO: 106041 - DNA, 39 bp, Homo sapiens; identical to SEQ ID NO: 72463
  chr11:18033384-18033423
  Hypo

SEQ ID NO: 106042 - DNA, 30 bp, Homo sapiens; identical to SEQ ID NO: 72464
  chr11:18231515-18231545
  Hypo

SEQ ID NO: 106043 - DNA, 47 bp, Homo sapiens; identical to SEQ ID NO: 72470
  chr11:18512392-18512439
  Hypo

SEQ ID NO: 106044 - DNA, 43 bp, Homo sapiens; identical to SEQ ID NO: 43029
  chr11:18656839-18656882
  Hypo

SEQ ID NO: 106045 - DNA, 515 bp, Homo sapiens; identical to SEQ ID NO: 72484
  chr11:18742646-18743161
  Hyper

SEQ ID NO: 106046 - DNA, 103 bp, Homo sapiens; identical to SEQ ID NO: 72485
  chr11:18743474-18743577
  Hyper

SEQ ID NO: 106047 - DNA, 1494 bp, Homo sapiens
  chr11:18812557-18814051
  Hyper
gctgggggaggggagcgcgctaagcttgtattctaggggagggtgggacgcgggaggctaaagctaaagggtcggtggaggcgaagcaatgggaaggctgggagccgcgctttagaggccagaaggctagcggcgatttccaatctccctcaggggcttcaggctccggagaggcgatgcagcccagagccgcgcaccagcctccgccggccgcagaggctcagaccccaaaccactatcccgattcctccccggaaccgcgcacgggcttcgtggggagtggctgccgctccctcccggctaccaagcgacaagccccctcctctgcatgggggacccctcccccagcatgcgggcgcccagagccccacgggggcgtggcgggggcgggcgccggctcctcggccgggagggctggagaaggtgtcagttgcggggccgcccgaaggagggacccgcgccctccaccttccggctccgcacacaaaggcgcagacggaggcgccgcacttaccggccagagcgggctccgggcgccggcgagcaggcgggcaggctggcgggaggatgcgcgcgcgagtgtgcgtgtgtctgcgtgtgtccctgcttgtgtctgtgccagtgtgtatgcgacgggggccgcgccgagctctgtgcgtctgcgtgtgcgggggcgtccgtccttcggtgcctccgtccttcggtccgtccgcctggcgctccgtcccgcgctccgtgcgcgctccctcgcccgaccgcctcaccaaatgcgcttcagctgcagagtcgctggcgcagccgccgggtgggtttggcaccccccagccccggctccgccccgcccccgggcgggcttccgccgctcgccgggaattgcgcagggctggcggggcgggggaccgggagagcggcctgctcccggggcacgaagggggccggatcacagacccttaacccctgacctcatctcaggtgcctccctctcccgagcaactctgcgcggagtctccgcagtcgtcgcccccatgccaaggttgcttggacaaggagggcggaggagtgggagcagcgcatccatttcattcatgattttttctcctcttgggagccccgggtcgggccgcgcggctacggcaactgccagagggaccccggcagggccgtgcgcgctgaacctgggacgggacagacaggcagacagaaggagtaggggccagcgagacaaagggggcagagttgggggagggagtcggctcattgggggcatgccgtggcgctccccgcatgttgccaacacctgcgcaagtggagcggccccatactagggcgcatgcaataccaggtgccgaggactcgttctaggacgctgaggaggcgtcctttttcccagttctccctgttcagcctctggggagctagagcgagtggacagcccctccctccactgagtcttgccctcctgacgtgcggcgcggggcacgcacctgttttggt

SEQ ID NO: 106048 - DNA, 214 bp, Homo sapiens; identical to SEQ ID NO: 72492
  chr11:18950386-18950600
  Hypo

SEQ ID NO: 106049 - DNA, 22 bp, Homo sapiens
  chr11:19137286-19137308
  Hypo
ccacgcccggccagaaagctct

SEQ ID NO: 106050 - DNA, 632 bp, Homo sapiens; identical to SEQ ID NO: 72495
  chr11:19263417-19264049
  Hyper

SEQ ID NO: 106051 - DNA, 707 bp, Homo sapiens
  chr11:19366652-19367359
  Hyper
ccggggtggcgaggccgccgattggcagcgaggcgccatgtgaactgcactggttggctggcgggagggaggaggaggcggtttcccgggtaacgggagggcaaggagcggctgcagcggcagcggccgcggctgagaagcgcgggccggagtgcagtgcgagaccggctggaggaggcggctccgcgaagccggtgtgggcgcaggtaggaaccccctatgctgcctcccccaggtcgggtctggctggactgcccggcggcgggaccggcctgggaaagtttgcggtgcaactgggtgggcaaggaggagaggacttggggatgctctgtgctgagctccggggtccagagcagggtggggactgccgttggggagagggccggcccctcattgagaggctcgggggccacacctctgctgcgggactctgaccgagggccagggcctctcaagccacccggccgcagcatagataccgggcgagcggacgcatagccacccgtgcgcgatgacggccggcgggcccttgttcacagatgcgctgggaaactcttccccagcagatgcggggctgggcgcccggcgcagtgctccgaggctgctctgcgagctcgggggcgcactttcccggcctccagcgacactgcgcacgcccctatccggagtgggtgtgtgtccctctgggcgtacgtgcctgaggctgt

SEQ ID NO: 106052 - DNA, 321 bp, Homo sapiens
  chr11:19367810-19368131
  Hyper
ctgctgtgcttgtgtcggtctgtgcctctttgctgtgcctgtctgtccatacgtgtgtatgtgttggtgggggtggtgtaggtggatcggatccgagccaagccgggggcaactaggccaggcctgcggttcccctggctctcgctctcccacgctccggttagctgcgggcggcgggctagggcgcgggcggggagggggcgcccgagcactgggagccgcggtgcctcccgggtgtgcgctccgctgagccggctcctttcttgcctgcaaagggactcaggcggcggcggtggcagcccgcgtcgcccagctggggcc

SEQ ID NO: 106053 - DNA, 179 bp, Homo sapiens; identical to SEQ ID NO: 43031
  chr11:19567961-19568140
  Hypo

SEQ ID NO: 106054 - DNA, 93 bp, Homo sapiens; identical to SEQ ID NO: 72514
  chr11:19734973-19735066
  Hyper

SEQ ID NO: 106055 - DNA, 80 bp, Homo sapiens; identical to SEQ ID NO: 72515
  chr11:19735404-19735484
  Hyper

SEQ ID NO: 106056 - DNA, 51 bp, Homo sapiens; identical to SEQ ID NO: 72516
  chr11:19735709-19735760
  Hyper

SEQ ID NO: 106057 - DNA, 673 bp, Homo sapiens; identical to SEQ ID NO: 72532
  chr11:20153534-20154207
  Hyper

SEQ ID NO: 106058 - DNA, 1410 bp, Homo sapiens
  chr11:20177593-20179003
  Hyper
tctctttggggctaccgcagggccggtggcgccctcaatgaggtgatggtttctaccgtcgggagaggcagcatctgggcacggggacaaagtgaatgcgcagactggaccccacctcttcgatttcaaagcacttaaaaatagtactctggcgtgcgagcggcttctaggacacggtgatttcctcctgttcctcgccctcctcttcctcctcggaatctgagaagtccgaaggtttcccgggactgctcgagtgcgcgggcgaggggggcagcggccctggcagccgcgggtcccgcaggtgctgggggtcggaggacgcgtggtaggccaggcggtggctggggctgcccgggccctcctcctcctcttcgttcccagggcccttctggcccacgtcgctgaggtccgggtgcggattgagcttggtgggcagggtctgctcgcgacagcccccgctagacaggagttcgcgctccttggagttccgccatttcatgcgtcggttctggaaccagattttcacctggaatgtcccggccggcgagaagaagggagaagcagaggtcagatcaggggctccgggggacgcacgggggcggggagtggagtcgggtgcaggctctgtccttcgggctgtgtcctctccccacccccagaaatgagttccggtggattcccgcattgactccgcccccgcctcagctcgcggttccgtttgcctcatccgctgccaccctgccccgaagggcggggttgggggccggtgaggccgggagagaaggcggggagtcggggtggggagagaagagggctatcctgcggagcttcgagggtagtggcccgtgtactcactccctctctaggcctcggttttcccatctgtacagtgggacctaagccgtttccgaacccttgcaattgacgggtgcgccggggaggggtgaagggcgggggcggggggggtgctgtggaggaaatgcgctcacctgcgagtctttcaggcccagcttggccgccagcttcttgcggtcgggcttgctgatgtacttctgcttctggaacatcttctccagcgccttccgctgcacgtcggagaagactgctcgacgcagcatgccccgccgaggcttcccgcgcgcggccagcggccaggagaaggtcccggggatgggcaccacgctggaggaagctgcagggtggggggaggtggcgagtgagtgggcgtacgccccccagtcccaacacggctctccctggctttttgctctgatcccttcatctctttaaaacgctcctttttctccccctggagaataggccacgaacctacaaacctgcgagagtgaaaggcgctttccgcccaaacaactttccctttcaaccgtgcaaacccggattaggtaaaac

SEQ ID NO: 106059 - DNA, 30 bp, Homo sapiens; identical to SEQ ID NO: 72535
  chr11:20179512-20179542
  Hyper

SEQ ID NO: 106060 - DNA, 506 bp, Homo sapiens; identical to SEQ ID NO: 72536
  chr11:20180320-20180826
  Hyper

SEQ ID NO: 106061 - DNA, 892 bp, Homo sapiens
  chr11:20181185-20182077
  Hyper
tgtctcctagaagctcgaaggcagaaacgcagacgtccaggagcgtgcgctcagcgttactgcaccagatgactgcgcacagtctccgactgcgtgtgctcaagttcactccgaggatggggcgagcctggaggcttttcttccccggaattgactggactattctcacattgcctgacgtagggtctcagagttcgtgcgtattgtgtgtgcaccgatgtgtgtgtgggggcccgctcgctagaggaaactgaggccaggatgactccgcgcatgcctagtacctgaatgggcccttagggttctgacctcgcttacctgttctgggccccgaggagaggatggcgttcactccaaacttcagaaacgtcgtctcgctggcaggggagaaggcagtcggcggagagccgccccgtcggctgccgggacccggggagcccaggtccgaggcccccgtgtcggtgagggccgtgggggccccctgcctgggcggcgacatgctggcggtgggcacgctgcggggcaggtaggcggggggtcggctgatgcggatcagatcctccaccaggaagctggagtggccggaaaatgccgactgcaaggactggggcagcgtcaaggtgggcgtgggccgcaggaggctagggtacccggcggggggcgcgaggaggccggggaacatcatggtaggcgcgggcgggcgaaataacccttctttcagtggccggagggtaaacgcctcgcttcccgcccctcccgcccccacagtgtcctctctcttgggcttagcaaacgtctccaagtaacaatcccacttgggcgtctgcgagtcctccgtggtcctctcgtcgaggtgatggttttatagtggcccgcccgctaaagcactttg

SEQ ID NO: 106062 - DNA, 280 bp, Homo sapiens; identical to SEQ ID NO: 72539
  chr11:20182831-20183111
  Hyper

SEQ ID NO: 106063 - DNA, 382 bp, Homo sapiens; identical to SEQ ID NO: 72540
  chr11:20183391-20183773
  Hyper

SEQ ID NO: 106064 - DNA, 35 bp, Homo sapiens; identical to SEQ ID NO: 72541
  chr11:20184112-20184147
  Hyper

SEQ ID NO: 106065 - DNA, 987 bp, Homo sapiens; identical to SEQ ID NO: 33700
  chr11:20184500-20185487
  Hyper

SEQ ID NO: 106066 - DNA, 30 bp, Homo sapiens; identical to SEQ ID NO: 72543
  chr11:20185714-20185744
  Hyper

SEQ ID NO: 106067 - DNA, 379 bp, Homo sapiens; identical to SEQ ID NO: 72544
  chr11:20229217-20229596
  Hyper

SEQ ID NO: 106068 - DNA, 120 bp, Homo sapiens; identical to SEQ ID NO: 72545
  chr11:20229900-20230020
  Hyper

SEQ ID NO: 106069 - DNA, 112 bp, Homo sapiens; identical to SEQ ID NO: 33702
  chr11:20230398-20230510
  Hyper

SEQ ID NO: 106070 - DNA, 81 bp, Homo sapiens; identical to SEQ ID NO: 72548
  chr11:20386484-20386565
  Hypo

SEQ ID NO: 106071 - DNA, 30 bp, Homo sapiens; identical to SEQ ID NO: 72551
  chr11:20486737-20486767
  Hypo

SEQ ID NO: 106072 - DNA, 36 bp, Homo sapiens; identical to SEQ ID NO: 72553
  chr11:20595699-20595735
  Hypo

SEQ ID NO: 106073 - DNA, 1792 bp, Homo sapiens
  chr11:20618182-20619974
  Hyper
ctggctaattcagaccgaatggctgcgcggtgatggatgcggatttacggcctccttggctgcggcgcgctgggcctgattatcactataaacaggcgtccgcggagggcgggggcggaggcccgcgtctagaggacgtgcggctggtcttcttcttcttcttcttctttttttttgtttttgttttttaatactgcggttccatcctctgcgcttcgtaggcgctgacacacacccatacgcacgacctgctgccccagggcctggcttcctgcctccgcatgctctctcccgcccctgaagcccaaccttcaagccctgctgatgcccgcccctccgtcccagcgttggcctcatagcgaaccctcttaggcctctccgttccagaccctccctccattctccacgtagcccctcccttctagaatcttgcggctgaaagtgggggcaggcggggagcccgaatagcgcctcagccaaaccccgcagccgttcctgcgcgtcacccgcctctgcagagcctgacgcgcggcagtctccacgccggaacccaagtgctcactgggccggggagggccagcgggcgaaatatcaggcctgggggctgagcgggggcgctgggcgtcactcaggcccagggccgcagctgggggaagtgagaaggccggcaggattctgcccactctgcgcagttctcccttcctcccggggcagccaagtctgtgcgccctggaacgtccgggcgccgcgtagactctccattcgcacctggccctttgcgggggctgctcaaatgcaaattgggaaactggccagaaccttccaaagtcgtgactgtccctcggggaagtcggccggggaaccgcagagggaggcctacaccgatctttgggcccgcctcgtggtaccgctccggccgatcgctctctgagcccgagcctgcctgccaggcctgccttctacagttctcgcattcgtcttgagccctctcggaaactggggactgtttaggcagaaacactcgtaggtccccttggcgtcccccaagatgccaagagcctgcggggtgcttctcagcgccagccggaacttgagcaggcacccctgcggaattctcagtcccacccactcagacgaccctcctccagccagagtccaccacagcccaccctaccctcttaaccctcgttcccgacctctccctacgagcgggccccggggagagagcgactgaccctagcgacagcccggcgggaggtggttgggatcttctccagggttcaaaagcgactttctgagccccaatttcctcagctttgcaattggtatagtttctgaaaggccattgctaaatctaaccgagataattcatggatatcccttgcacaatggttgagtattgagatctcaatagacgttagctcaaaactgcaataaaaagcgacctgaaatcctcaaggcgtctcaaaagaaagatctcctcctcctgcccccaccaaaggcaatgcagaccgtgtgtccccagccagctgccctttagaggggctaggcgggaaagccaaccagcggaggcatccaaacactctcgggctctccagaggagcaggagggtgccccttagtgcccccggcgcccgccgcaatctgccactgcagcctacgcctgcggccgcggccgccgcggcattgtcctcccgccgcgtgggacggcccagccgctggcgacggcgcgcaccccgaggcagtgggctgggctgttggcagtagggaagggaaaacgtgctgtctgtggc

SEQ ID NO: 106074 - DNA, 54 bp, Homo sapiens; identical to SEQ ID NO: 72557
  chr11:20620247-20620301
  Hyper

SEQ ID NO: 106075 - DNA, 260 bp, Homo sapiens; identical to SEQ ID NO: 72558
  chr11:20621539-20621799
  Hyper

SEQ ID NO: 106076 - DNA, 1050 bp, Homo sapiens
  chr11:20622578-20623628
  Hyper
tctggacctgagttgcgaacgtctccatatctagatacaggtattttaaaagctgttgtgactttgttttgcacgaacttgacattgtgtttgcaggattgcagtgctcccaaggaaatgaataaactgccagccaacagcccggaggcggcggcggcgcagggccacccggatggcccatgcgctcccaggacgagcccggagcaggagcttcccgcggctgccgccccgccgccgccacgtgtgcccaggtccgcttccaccggcgcccaaactttccagtcagcggacgcgcgagcctgcgaggctgagcggccaggagtggggtcttgcaaactcagtagcccgcgggcgcaggcggcctctgcagctctgcgggacttgagagaggcgcaaggcgcgcaggcctcgccccctcccgggagctccgggcccggcaacgcgctgcactgtaagatcccttttctgcgaggcccggagggggatgcgaacgtgagtgtgggcaagggcaccctggagcggaacaatacccctgttgtgggctgggtgaacatgagccagagcaccgtggtgctggccacggatggaatcacgtccgtgctcccgggcagcgtggccaccgttgccacccaggtaagcaggttgcattacggcccgcacagtgtcctgctctccagctgcgcgagagaggccagccgggccgtggcgggtgcacgtatgctgatggggaaaccggttggcagtgccaggtgatggatgcgggaggcggctttggggcttcggaagctcgcactgcgctggggtcggcagttcagggcgcgagggctgcagtgaccctgccagaggggccacgacctgccccttcccagccttggcggtagcgggaatacaggtccagatccacgaaagagttgaggaagatagattccacccttttatgcagacagactccctctcctgccaatgactgtcttttcttttcaaaaataatttcttaattaaacaaaaagagggttaaaattcagaacaaagccacgtggtggtggctgg

SEQ ID NO: 106077 - DNA, 19 bp, Homo sapiens
  chr11:20672510-20672529
  Hypo
cagacgcctgttcttattg

SEQ ID NO: 106078 - DNA, 2569 bp, Homo sapiens
  chr11:20690388-20692957
  Hyper
accccaaccacagctcgctccgcctcgaggaccccttttctgcacccccacctcagcgccctcttcctgcacccacaaagagagtactcagtcataggggttcaacaggagagaggagacagaaggtacaggcggtgagcagggactcagccatcatccccctcaggtccctccccacccagttgacagagcgaatcccgagtaattgttttccgagggggtccgtgcgcgctcggtggcgccgcctcggtctgggttcccccgaggaaaaatacccacccgcgagggctcggcggcttttcgactcggcggggatgaactgtggcaacttcggcagcccccaccgcggtgcggaagtaaagagggcaacattggcgactgcggctcggaggggctggagcgcgtgaagccgtgggggcgccgtgcgcctcccgctctctcgtttcggccgcaggtcctgggactccgacttcggtgctccgggtgatagcggctgcggcgcctgcagtccagatcctcgcagttctgcgggcgaaggaggcgaacggaatcggcccccagtggggagcgcaacaagccacagtagccaaaccccgcgctcctgcccgggctcccagacgaacgcagccgcagcggggggccgggccccgagccccacgccgccgccgccgcgccagcggtggggggcgggctgggggcggggcggccggggctgccttcccgggcgcatatgcgagcgcagcacccggcgctgccgagccacctcccccgccgcccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacaggtaagcatgactgtggcggttagagggatccgggaaatgggggtgcccacagaccacggcggcgtggggagacctggagccgagctttgcgctggtctggggaacggcggtagcgtggaccggttcctgggatctctttgccctgctcggagtgacagggtgaaaatagggactcacgggcttgaagatgtccccgttgagtgccccttctcaggggacccggcctcaggggcgcaggagtgaggggcgcggccgagtaggcgcaccctcttgctgctagtaaccggctttccgtcccagggagtcgaaacccgcagcagggcgggcccgcgtgccccgagttcccgaacttgtaaggtgctgtggaaaccactctcgccgacccccgccaggctgggaaggggtagctgcgggagtcgcacccgcagagggagcgcttccggctggcgggcgcggccggggcccgggagggcgcggtgcggcgagggcagagagctgcgggagaaccctgggatcccgcgatctcctcctgtgccttcctgactacccaggagaactccaggagtattctcctccgcctgtctttgctcccaagggctgggcgaacaattatctgagggaaatagagcagtggagacaatctggggaaattttctcaagctcaaaccagttttctcttgccataatcgcagggttccgtgtggggaggggggagcaaggatgacgcttgattgtctgaagtccccacttcgttctgcctccggagacgcagttgtgaggactctcagcgcatcttcttccttctgcttccaccggctcccttgcccaaaagtcccctggggttcggagactggcttgcagccgccttcttcaaagagctagtagtagatgcggggagactggggtgaggtgaggtggggtgagatgtaggaaattggcaaaaatagggcctgtcaactggggggagtgtcggaggtttgcaatcctacccagccatcctccgtacgcgctgcaccccagaatctgtgtggtcattccctttccctttattctcccccctttaccatccttatttccttctttagaggcgtggccttctctctaggccaaagagcaagttcatctggagagggctaagaaggggcgtctgcacttggttggctcaaaagttccctccgcttgcgcccaggcgcccctctttggcagttagcccgctggaagatctagcgtctaggagctttcagagggcccttcccacttccccaggactgagcaggcagcggctttcgtctggttaagaatgttgaatatggatttctcaagggacaaaagaaacctcccattccgttccttacctctatccgagcttcccaggctgcggagacgccaaggctcagtctagcttagaatagttgcttcttgagttcaggcccatccggatgggttagtcttttaaaaccaggacacgctgaaggagtgcgcgcaccccaggaagatcaggacaggcaagactagtgcagagcgtgggctactggctctgagcgcgagagtctggtgctcgtggacatcttacagaggaaccgcagacaggaagaagctaggtagggagggggcaacccgttagtgagttcac

SEQ ID NO: 106079 - DNA, 27 bp, Homo sapiens
  chr11:21017124-21017151
  Hypo
aaaaaaaatcagcgtctataaattgct

SEQ ID NO: 106080 - DNA, 1061 bp, Homo sapiens; identical to SEQ ID NO: 72582
  chr11:22214360-22215421
  Hyper

SEQ ID NO: 106081 - DNA, 328 bp, Homo sapiens
  chr11:22359172-22359500
  Hyper
ggtttccatagcatccgttcctgaagagcccccgtatggtccttggtcagggcgatccgcccagctcccctagaaagttggcaacctagctagccaaaagaagagtcccctattcctgaaacttactctgtccgtggtgctgaaacattgtaccgagacccgcccagacgggcgctgtcagccgctgaaaaaaaaaatcttccccgaggctgcccaaatcagaactgtgtatcttttatttactcacgtcctcaaagagcagcaagccttctccatcttaatttgactctaccgcagagcagacttacgctggcgtgatgggaggaga

SEQ ID NO: 106082 - DNA, 136 bp, Homo sapiens; identical to SEQ ID NO: 33720
  chr11:22359746-22359882
  Hyper

SEQ ID NO: 106083 - DNA, 92 bp, Homo sapiens; identical to SEQ ID NO: 72588
  chr11:22361451-22361543
  Hyper

SEQ ID NO: 106084 - DNA, 30 bp, Homo sapiens; identical to SEQ ID NO: 72589
  chr11:22361815-22361845
  Hyper

SEQ ID NO: 106085 - DNA, 708 bp, Homo sapiens; identical to SEQ ID NO: 72590
  chr11:22362501-22363209
  Hyper

SEQ ID NO: 106086 - DNA, 815 bp, Homo sapiens; identical to SEQ ID NO: 72591
  chr11:22364799-22365614
  Hyper

SEQ ID NO: 106087 - DNA, 482 bp, Homo sapiens; identical to SEQ ID NO: 72592
  chr11:22688123-22688605
  Hyper

SEQ ID NO: 106088 - DNA, 50 bp, Homo sapiens; identical to SEQ ID NO: 72605
  chr11:23326514-23326564
  Hypo

SEQ ID NO: 106089 - DNA, 45 bp, Homo sapiens; identical to SEQ ID NO: 72614
  chr11:24518383-24518428
  Hyper

SEQ ID NO: 106090 - DNA, 57 bp, Homo sapiens
  chr11:24518643-24518700
  Hyper
gtccgttcgtgtgcccgtctccgcctttccgcctcggaagagcgctcatcactggct

SEQ ID NO: 106091 - DNA, 24 bp, Homo sapiens
  chr11:24945189-24945213
  Hypo
ccaagatcgcgccactgcactcca

SEQ ID NO: 106092 - DNA, 30 bp, Homo sapiens; identical to SEQ ID NO: 33725
  chr11:26353691-26353721
  Hyper

SEQ ID NO: 106093 - DNA, 30 bp, Homo sapiens; identical to SEQ ID NO: 72631
  chr11:26472646-26472676
  Hypo

SEQ ID NO: 106094 - DNA, 136 bp, Homo sapiens; identical to SEQ ID NO: 72633
  chr11:27495243-27495379
  Hypo

SEQ ID NO: 106095 - DNA, 75 bp, Homo sapiens; identical to SEQ ID NO: 72634
  chr11:27495679-27495754
  Hypo

SEQ ID NO: 106096 - DNA, 50 bp, Homo sapiens; identical to SEQ ID NO: 72638
  chr11:27720970-27721020
  Hyper

SEQ ID NO: 106097 - DNA, 115 bp, Homo sapiens; identical to SEQ ID NO: 72639
  chr11:27722537-27722652
  Hyper

SEQ ID NO: 106098 - DNA, 251 bp, Homo sapiens
  chr11:27739988-27740239
  Hyper
gggaagggtgggtggcgatggtgatgcgggcgccttggagttcctttgcagcacgcttggaattgcatcagactgatcagaaatccccccgcccccaagctcagcccctcccgccacgctcccctgcccgcccctcccctcccctcccttcgcgtagatctgactgagaaaacgactggatctcggaacaatctgtgccccattcgctgcaggcttgctccgtaaaccctgccctacgctccctttgtgtg

SEQ ID NO: 106099 - DNA, 30 bp, Homo sapiens; identical to SEQ ID NO: 72641
  chr11:27740463-27740493
  Hyper

SEQ ID NO: 106100 - DNA, 88 bp, Homo sapiens; identical to SEQ ID NO: 72642
  chr11:27740898-27740986
  Hyper

SEQ ID NO: 106101 - DNA, 30 bp, Homo sapiens; identical to SEQ ID NO: 72643
  chr11:27741900-27741930
  Hyper

SEQ ID NO: 106102 - DNA, 30 bp, Homo sapiens; identical to SEQ ID NO: 72644
  chr11:27742185-27742215
  Hyper

SEQ ID NO: 106103 - DNA, 125 bp, Homo sapiens; identical to SEQ ID NO: 72645
  chr11:27743048-27743173
  Hyper

SEQ ID NO: 106104 - DNA, 1325 bp, Homo sapiens
  chr11:27743419-27744744
  Hyper
actcagcctgcacaccgctcccttgcccactacgcaggtcacacctggggctccggcgaagctgaattcggctcgggagatttccctgtcgccaggtaagaaaaccttcgccttgtcaggctagggcgggaagaccgctggggaacttgttgcttatcagcgccggcagactaccgctttaataataataccagaaaagcgcagcagggagggggtggggggcggcaacggcgacgactaacctcgctgtttacgtgaccgactcactgtgactctctgggtaaaaaaaggaaacttcttagaaaagttcgtgcccctccccctcccccatcatgactaagggtctccagccgatgaggtcgtgagtgatgatcaaatggggactggggggaggggggcgagtaagtgacttgtccttgggaacatctgcatgcgtcgaagcgcgaaccagcccaacaactttcccttttcctcttaggtactgatgactaggcgagaggcaccaaggcgagccactagttgcccacaggaacctgtgtaagccgagctctcgagcggctgagttgaatgaagttatgactgcgtttgctctaatgggttatggcttcccaaatgtgagttaacagccccggtgcgcagctaggtcggaaggcgagccgcggagagcggagccgcgggccaaggcagggacgggaggggaggcggcaggttgggcgctccgctgctgctcggtgctgcttccccggagccgcttcctcatcctgcgggggctgccccgccgccggggtgccggggtgagcgcggcgggagccagggctggggtggcgaacctcggagggggctctcccaggaagccctgcggttagcgcccgcgcttccccaccagtggctgcgcaagctgggaagcgaagaggtcacgtgttggcggaaagtaacttggaggcgaaaggatgaactttgagaagaggaaaaaaagcacaatgaaacaaactacccccttggagtgtctaatagagggggaggcgggagggggggcggaggggcgccgctctccgcgggagatgtggggacgactccggaaatctcgggaaataggcaataactcgagctttggcaacgtcccccagcctagggaggcgctaacgcaaggtatctttccactgaagctgccctttgcctaccctcagccatcgctagcacagcagagcagaagaaccagggatgaatgtagaccagttgttatggagatgtccgtcgctctgaggagcgctagtgccctgggaagtccccagacgcatttcaggtttcgtcgttttggcactgac

SEQ ID NO: 106105 - DNA, 81 bp, Homo sapiens; identical to SEQ ID NO: 72664
  chr11:29581595-29581676
  Hypo

SEQ ID NO: 106106 - DNA, 381 bp, Homo sapiens
  chr11:30037614-30037995
  Hyper
aaatatacacttcaacgcacgccatttatgcagcccctatgtatgttgctcaaatgctcggaaaatgcacgcaaatccaaacgttggaagaggcagcaattcagacccgttcaccggctgttcccaaaagaagggaaccggtgcggctgggaggaggcgaaacgatgctaaatcttaacccccctctcgttgggaaacgacatctttaatcgcgccctcgcctccagacctcggttcccgctccagcacgttaagcagggcgcactcaccgcatccccgggtttgggaaaataacaactgttggccccccggagcgccgcgcagcatccgcacctcccttctcccacctcctggtttatttttaaccgccttccattcatg

SEQ ID NO: 106107 - DNA, 1239 bp, Homo sapiens; identical to SEQ ID NO: 72668
  chr11:30038294-30039533
  Hyper

SEQ ID NO: 106108 - DNA, 152 bp, Homo sapiens; identical to SEQ ID NO: 72669
  chr11:30040150-30040302
  Hyper

SEQ ID NO: 106109 - DNA, 40 bp, Homo sapiens; identical to SEQ ID NO: 72670
  chr11:30409640-30409680
  Hypo

SEQ ID NO: 106110 - DNA, 44 bp, Homo sapiens; identical to SEQ ID NO: 72671
  chr11:30605841-30605885
  Hyper

SEQ ID NO: 106111 - DNA, 464 bp, Homo sapiens
  chr11:30605945-30606409
  Hyper
tctaggctcacggctggctcttcccggctacaacttccccttccttcctgaaacaccagcgccttactcgctcagtcccccgttgccacctccgtcacctcctcggccgccgctcctgctggcactgctggcgctagcgctggcggccccgggctccgctggacgcctatcttttttctctccctcttccctagctctggattgattgatgaccaccggcggccaatggctctgacaccacgccatcctcggtcgggcatcacagccccacgtccccgacctcagcctcccgggcgcgttggcatccccgaacccacagcgctgagcccgagcccggggccgccgcctcctccctgctctacgcctgggcgctgccaggttccttccctggaacggcggagaaaggaagggagggagccagcgagcgttggaagggggtgtggaggccacgggatctccccctc

SEQ ID NO: 106112 - DNA, 1111 bp, Homo sapiens
  chr11:30606651-30607762
  Hyper
cttcacctcctaggccgcaaaaccccggaattcaaaggctttacaaagataaccttgttatacgtaaatagcaaagaaactcctgcctctgtagagaagaaatccggcggcaacggttacttttcctcggtactcgtcccccgtcgcctagcctcgaccccagcttgggtcgccgggtcgctccgcaggctgcgagcgcggagacccaggcagcggcggagagtgaggttggggcgcggggacggggtgagaaagagccccgagcgagagcggcgcgcgcgggcggccccgggggcggccgcggggcgcagccggagcacaaagctgcgcggtgccttcccctcgtcactgcacctggcctcgggccgccgcgggagcccggggatcgggccaacacaatgcacccaggcctaggccggggcggctcgaacacatcaccccgggactttctagtaaacagctcgctgagccctcgtccccacccccatccccgccgcccggcttccccagcttctcgccgataccccctcctctcctcctaagaaatcctggcggaggagggagcgaagaggtggggacccccagaggtcgggggactgatggctggagggggtggagaagagaagaggcgcaggatggggagtcggagggaagacacctcctaaaaaagaatttgctttcgctcaggggttgaaaatcagccctccccgagcgccgaattgcccgggaggcgcccgctcgtgcggatgtcaggggcaccggggcagcccgggtccgcagcctccgagcccctcgcacgcgcctctgacaaggcacctctcacccgggctccgctttgtgtgtgcatttttttcccttcctctagtgctcggcaccgggctcccggccgcctcctccccctcccccgccctccgcctcccttcccggggcggattacctttcccgggctgcgctccggatcccggggatgccttcagcgcccggcgagcaggcgatccatagccgagcggcccgagccggctggaggagcgctgggggcgcgcgggggcggcgaggggcgcgagcgggccagaaccttcgaccccggaggtcccgccgcaggctggggctg

SEQ ID NO: 106113 - DNA, 121 bp, Homo sapiens; identical to SEQ ID NO: 72677
  chr11:30608098-30608219
  Hyper

SEQ ID NO: 106114 - DNA, 177 bp, Homo sapiens; identical to SEQ ID NO: 72685
  chr11:31533680-31533857
  Hypo

SEQ ID NO: 106115 - DNA, 144 bp, Homo sapiens
  chr11:31818452-31818596
  Hyper
gacgcgctccgctcacgtgtgcgggcacaagcgtctgtgctaatttactgccccaagtttccggggacttttcaaagcgtttttcaagggaagaaatgaagcgaccacccccacccctcgctttattttcgggtttggtgaaga

SEQ ID NO: 106116 - DNA, 2476 bp, Homo sapiens
  chr11:31819302-31821778
  Hyper
ctagaagttggatctcgactcccccacccccacgataaacctaagtggtggacaattaagatatcttcttcaaaaggcgccccctcggagccgcgcaaagcaggggccttcagtgggtgccgttcaccttccagcctaatccgtgagaaagcgagtgaaagcgcctcccattatcccagccccaggaccatctgacgatgggaataggatttgtttcctggaaggaggtgagagagagagagagagagagagacagagagagagttgctgggaaataaaatcattccttagtttcttagtgtcttaatcagtgaggcggaaaacaagcaagaaaagatagcaacccggttgcggcaccttttcagctctggagcgcggatcaaaacattgtagcatctgttgaaagagaggctgactaaatcctatagagggcttgggtattatggggggtgggggtggggtgaggggaggagataagaaaaagtgtctccgtgatccctaaaaccaccaaatcgccggagaattggggctggatagagttgtctcttgttgttgtcagcccacgtcgtcgcgattttattcaccgccgcatggcgttgatcagatggaaaccatatttgtctccctctgagacctaacccccgccttatgcttttggagtatggactctttaaaacccaagaaaggcttcctgggctgggaaagggggctagggagggagggggaccctcttagcaccaaaaagtctgaggattccccgggaacgtgaagcgaagctcaccaccggtgcccgctacccccacgccggcaactctgtgcttcgtttggcccacgtgtcctccccacgcaactaggggcgacggtcctgtgcctgaggtgacaatcaccccccaaaaacctcacttgcgggtgggggggtggtgattgccagttgacccagaattttctagcaactaggcgcgttaaagtgaaaagcccctggactagctccacctccggccccaaccatcacaggcggaccctagctgatttgactctcacttcccgccctcagactgccggcgacgaaaatccgcccgaatcgggcgccacctctggtggaagctgctgtcctcggcttctgcccaactccaagaagcggaaggggggtgtatcctgcgccccaagctcatgggagcccacgcaccggggagagcccggagtggaggctctgggctcagccctcccaggcctaggccaccgtgccctgagtccctccccaagacttctcggactaagtgggccagactcttgtcaggggagggatcaccaggacctcagattgctgggggcggaggggtggacgctcgtgagtgcgaagttcgggtgtcacttgggtgtgtccagtgtctacaagtgggaatcctacggtttcaaaagtcaggcagggatggggttgcctacactcggtggggtcaatcgctagtctcaccagaggcgggagcgggcctgggggccctctgagctcgcggaggcggcgggttcggggcccgtgcgggcggggtcgcccaggggagcccgggccccgcgcgtcaggaggcctccgccggccgagcggccgcgctgggaaacaagaagcgagcgctttgctccctatcttcccagtgtccgtcctatattgttttctgctcttaaaactgacatgtctaattggcaattggtgccgaatcgtgtccagaggtctcttgtggaacatttctacagctgtctccttcaactagacgcttattcatgtcgccttaatgagaaacaaaacgttctctaatgagcaattacagagcgacaggattgttcccataacaaattcttgcgagtgacagaagcatcctttgtaccagatatttcgcatactgttaccgattttcccttccctcgcccgactccatggaggcgccgggcatccggagccggtccgagagctcacggatgcgccggcagcctcctcgcagtcccgcgcgccgcccctggccccgagcccctcggctccgttgtgctcctgggagtgagacgccacgtcccattatcccgcatattatctccttgtcacgaggacaacaaataccgattaatcttcggagtaaactgtttcctattcttgaccaagctacctcggggtgtggaggggagcggaggggagccaactgaccctcccctccgccccaccccccccatcccccgctcttcttcctccagcccttctcacagaacctggggtgtttcaggtcccatctctcctcccagaccagagcggctcccggcatcccgccgtcctgctcacagtatcttcacctcaccacttccacatagtcgccacccacagagagtgagaaagtgggacccagaggggcgaacgggggaggggcaaggatagtggggtggttttagttgggagaccaccacttccaatgccccatccccgactcgccctgcatctccc

SEQ ID NO: 106117 - DNA, 706 bp, Homo sapiens; identical to SEQ ID NO: 72693
  chr11:31822002-31822708
  Hyper

SEQ ID NO: 106118 - DNA, 87 bp, Homo sapiens; identical to SEQ ID NO: 72694
  chr11:31823165-31823252
  Hyper

SEQ ID NO: 106119 - DNA, 1126 bp, Homo sapiens
  chr11:31824154-31825280
  Hyper
gtccataattagcatcgtttacagtaagaaatgaagagagggcgttgagagtggagggccgcgggggcggcgagtggggcggcgccgggaggatcacctgcagaattcgggaaatgtcgcacggccgggccccgctgtgagctagctctacaatcttctgccgggtggagtccggcagtggccgcccgttgacaaagacaccaccgagctgattcactccgctgtgacctgaggaaagggagaggagaggaaaggggaaaagaagagaagagagcagagtgaagaggaagaagagggagaagaaggaagaggaagatgagggagaacaagaacagaaaggagaggaggaaggggaagaggaagaaggagaggaggaggagacaaccacaatgcatcctcatccccctgccaacctgtgccaacctcggcggtcagttccctgctatcgatcaaataaaggacaacaggaccaccagccatgccagacatcgggcagcccagtccaagcaaccgtgcccctgcccactgtactgcagcagcaacacagagtcagacacatgccaaggaacaagtacacatggacctcactacagccataaccccagcagtgtccccagcccactgcccctcttcataaacactgcagccagcctctgaacccacaaagcgctaagaaccggctctataaatctcccaaagatcccctctgagtgtcaccgcaaaccatgggttctacagatcccacactgaaccttcaaggtctctgcagtgttgggacagtgatagcaaaccttacagcccttgagtgctcccttagacgctaaaatccagaaatgtttccatcaccgtccaaactggccaaggcctggcacaagcatcgagttgggttttgtttggttagaatagaagaaggaagaggagagaacaaccagagcagccagtatgtggctggtgaaccccagtccaggtttccgcacctccagtgcagacgtgagagtcagagcccgggctcggcttcagccacagacaagtccggccaccgcaagtaaggcttagagccgggagtcggttcgcaccagccactgctcgctttatttccgccgctgaactccgccctccccttagc

SEQ ID NO: 106120 - DNA, 2464 bp, Homo sapiens
  chr11:31825590-31828054
  Hyper
tactgataaattgacgccaggagcctgagcttcttagcaataaataagctccaaatatagaagaggggggaaaatatgatgagcctctctgacatttgtctttaaaataaaactagctgcacgtcaagtttgagcttaatttctggaaataggcggaagtcgctccggatcatgcatggaaggctaattgaaaagatcagtcggggcgcttgtggcagccttgtcactttgtgacagtgctccgctccgggaaattgcatcgtcacgacaaacgggaccgtgataaaacgaccctttccgtccttatttgtagatcactcagacgagattgaactgcacttgtttccccttcgaggggagccgcgttttcagggtagccgaaggcttggggctgagggggggccctcaccaaggcgcgggtgggggccggagcctcaactcgatgagaagtgacaggcgtttgggggatctgggctccggccgggaccagcgcaagcagggactttgcggggacaccgcttctccaacagagcaaggcctggcccacgtttccggtttctcctaacttccttttattgccttcctttgcttcgcaagttccatctacccctccagctacagagccccacctctaggcacaggaagcttcccggaaaaagaaaggctgtcccagaaagagaccgagagagactttccaaacttcgggcatagccacggcaattcccagtctgctaatgccaaggcgggcgcgtaaggccgcctaaatctagacctccctcctcactcatttcaaaaaataacaacgtgccagccacctccgcagataccgccggctggtgcttgcccaggagacgccagggccagagcgccactcccagcatcgaaatggcagagagaaagcgcagctccaaattccccttcagaggttaagcctcaatcattgtgtcccttccctagggactgctggcgctctcgcccactggcgatgattatgcgcctagaactcgaccgcgaagcaactaataggaaaacatatggtgtcaatttggatgctccgcgcctcgcgcacacccgggaacgagcggcacaaagccctgccggccggcccgcgaccccgcgcccctcggggcctgccagccgggccgcagcgacaaacgctcagggctgcgcgccctggctggggcccgcccgagagacagcctgcggctggggagtctgagctccaaggggagagcccagccgccgaaggcgagcctaccggccaagccctggggtccggcaggttctgcacaactactcccgcaaagctcgccacctttgtgccctttcctcagctacgcgcttaccagccccggaagcaccagggggcgaccggcgtttccaaaacagatggataaggtgctggggaccctccttaagcctgtgtggttcggccagggcaggctgctggaagacccgggcctttccacactttgagttcagttgagccccgacgccgtgtgcctcaaccgtaacctcaaaccgggcctggtttcgctgggcctccaggctcccaggtcggagctctagactagccctgccgcgtaccagcacccaccacgaacaggaaggtgggtgggaccccacggggtctgggcagaggaaagcagggaggtacaagggccataagtatcaaaagcgctctgggcctgggactatcaggacccaagcaattgcagttgccagggcagggattttccaattcctgggcacctccttaccagacccagtaaaccgtgctctctcccgcgccctgtaacagcgagtttaccacccctaccctgctgcaggcctgggggctcctctccccatcccttctaggcccgtagtggggtgaggaggggaggagctgccctgagagtgacttggggagagaagcccccaaccccgccgggttggtggagactttcagtcttggctaagcccaaaggggcctccttctcgctcaactaggagaagacttcgccccgccctgatcagcccagcccctctctccggggtcagagcccgggcaggggcgagagggggtgtgagttacaggatttgggggggatggggtttctctaccgcagcttcgaaaactcgggcgggctgttcttaagggcccagcccctgcttctccagtatcgagaagagccaagcaaacgccctcccctcccgggctgccgggcgcggagcggggagcagccgccgcaggtccccgggcctcagtcggtcggcggccgggccagcgcgggcgtcgcgagtccctgtgtcctcccctgaccctcgggtccgcgcaccccgagcccgaagtcccagaaagaccagaggcacttactgttctgcatgctggctctggctgggggccgcgggattccacggggctcgaatatggggctctgttagcaagaaaataggagttaatcctcgggcagctgcatca

SEQ ID NO: 106121 - DNA, 480 bp, Homo sapiens; identical to SEQ ID NO: 72701
  chr11:31829116-31829596
  Hyper

SEQ ID NO: 106122 - DNA, 99 bp, Homo sapiens; identical to SEQ ID NO: 72702
  chr11:31830319-31830418
  Hyper

SEQ ID NO: 106123 - DNA, 660 bp, Homo sapiens; identical to SEQ ID NO: 72703
  chr11:31831479-31832139
  Hyper

SEQ ID NO: 106124 - DNA, 566 bp, Homo sapiens; identical to SEQ ID NO: 72704
  chr11:31832589-31833155
  Hyper

SEQ ID NO: 106125 - DNA, 248 bp, Homo sapiens; identical to SEQ ID NO: 72705
  chr11:31833517-31833765
  Hyper

SEQ ID NO: 106126 - DNA, 156 bp, Homo sapiens; identical to SEQ ID NO: 72706
  chr11:31834086-31834242
  Hyper

SEQ ID NO: 106127 - DNA, 375 bp, Homo sapiens; identical to SEQ ID NO: 72707
  chr11:31834473-31834848
  Hyper

SEQ ID NO: 106128 - DNA, 1337 bp, Homo sapiens; identical to SEQ ID NO: 72708
  chr11:31835180-31836517
  Hyper

SEQ ID NO: 106129 - DNA, 3349 bp, Homo sapiens
  chr11:31836824-31840173
  Hyper
ttcatcaccctgtgacgatccccccatctctcttttccctgtaacctctgcccccaagaggcaagagttcagcttcaaaggaaaagcaagcaagtcaaggccacctcagtcccttctccctggatatcccctctctaaaccgctgcctattctaaaggccaacgacccggtcctgcgatttgtcccgttgtagacctgggaacaggcaggcgggaactgggggctttactgggggatttgaggctggggagggggagggagcaaatgtcatggctggctcgctcaagcatccagggaaccgaagctaagcgcatcctgacgggcttttaaaatgacattgattaggacaagctgttcccaaccccagtaagagttaatctgcctgttaatcaaggcactaaggggctcaatgcgagttttattagcgacaggagaacagaggcggcagccagggatcaaaagccgggatcccatatatttgtcagcgctatctccaaaaaaaaaaaaaaaagtattttcaatttgaaaacaattcggcgcttttcgtcacttcctaacccagtctcacagagggtgacttccaaacctggctagcggggaaaaccgctgcccgggggacagaggggctgacaggaactgcgggttggctcagccgaatgcggccggggagaatttaagaattctcagcccgcgcggcccgatgcctctgattcctcacgagaggaaagggaatgaaaaatgaagcaacaaatgacaccacccaggctggcagccctcgttcccggccagaccccgctcctcaggcccggctctggcgccgggtggcgtccagcccctgcacgcgcggcgcggcccgcgggaaagtttgtgcagcgagagtgactgtccttccgcctcgcgcgcgctgcccccttctgccccggaggggcgttgggttcccttcggttttcctttccaattctaaaataaataaataaactccgggccctggggaaatctgaatagtaattccagtcatccaaattctatgagagggtctgaggaaaaaaagacaagcctatcacgggcgccctccgatcacgaagggcacgggcatgagaaggcgacagaggaggtcctcggctcgccctgggcgcggagcgaggactctggtcagaggtaattatgtcaccgcgttttctcgccgtgacagccgaataaacacgatctccaataaacatctctaatgagggaggaggcccgaggatggctgggtttgatttatgactggaggagaaggtccacttcccactgcgaagcaggcgacctgctcgccgcccagctccagggagaggaacccgcggaggagaggatcccggcccaggtaaggcgtgcggccggactgccactgcgctcgtcccccgtttccaggtgaggtgagcagggggcgccaccgctcggagtcgggcggaggtcccaacacctgtcacaggtgactgagctccgaaggtgctcccagaagacctagaaagggggcgcaggagcgcgagtgggagtgggggttgggggctagccggggcctggcccagaggccgccccaaactcccgggcggggttcttgggtgccccgcctaagccggcctgggcgtctccagctgcttttagggccgggctcccaggactttcgcccggctgaaccacaagttagtctaagtttgggtcgtcccttccctgactcactaaggggacacttccgggccccggctctggccctccaagggccgcagggtggtgggcgcttctctttcccgggcttggcggcccggctcccatggcgcccgcgcgcttcccgccgaggcagccagcgcagcgcccgcagtaaccggagcccgcgttctagctcagtgagaatcgctaattattaggtcttccgaagtgaagctcaaatcacacgctgggagctttacgcgctgcccagctctgtcggccgcattctttcgtactccgcgtctttctgagaaacgaaccccatctctagactttgttgcggtccagccatctgcactttgcaaccgcgggaaacttctgctgcacctcgcccgacccgcggcagggtgtctttaagcgctccaggcgcgggtacggactttcccaagcgtggatgtcgtgaactgcgatgcagaggaggtctggatgcaaagtgcgtccccacctcctgcatttttcgcggtcgcgagtggctttagcagacagcagcagcagactcccgccccctactcccagctcagggccggactggaagtccactcttaggagtggaacattttgctacttttgcagaagagcacactcggcaaagacaagtccctcctccaccccccttcctatccctccctcagtaactcgcttccatctttgtatgcctccttttaaaagcaaaaatcaagccccggggccacttggggcgggctttgatttggggacagcagtcgctggcagcggagaggccccgcgggccccgagccgggccggggccggagcccgggcggttacctgggagcggagggcggggaggcaggtgagcctggcagcgccggttcccacacttctcaccgccgctcggcaggggaagtggcagatctgacagccgcgttctacgcgaggacctgccccagagtttaaatgtcaatgataagaaaagagggtgctcaggcaggcgctaactttccttaatatccacgccagcgccgtcctcattggctgcccggcccgcgtgacgtcatggcggctagagttgggcacagctctgcgccgactagttttccggccgggcgggagcctgcttctccccacccagggtccggccggctccaacccctgctttggccttccttggcccggcctgtgactgctctagcccggcccggtccagcctgggccgccgtcctgtatggcgtagagtcgatccccaggaaactagtcttgccgagtgcgctcctccgcaccttcgggcactagggccccaagatctctgcccttaggctggccagctacctctctgggtaatcaccctgtcccctcctccgatccccaagggagtcccttcatcggagagacccgaaggccgcgccgggatggagaggcgcttttggcaggaatcatttttaggaggagttcgaggctcgatgagtaccctcaacctggccctcgagcccgcaagtcactagctgggcacagacgggggctccgggaagaggacatgcgacccctttttcagggcctaggccaaaggtctctccaggcctgctgggttctcaagagggaagccctaaagggggcctacccgggcttccctcgccctctggctgaa

SEQ ID NO: 106130 - DNA, 436 bp, Homo sapiens
  chr11:31840544-31840980
  Hyper
cacttgaggagtttgcgggagaggaaggggcggggcgtggaatttcctttaggcagctcgtggagacccagcctgggtggacccgggagtgtgtgtgtagaagcagggagggggacgcctgggccggagagggtcctagggccagtccctgcgcgccttgatccgggcggcggctaagggagagccgagcacagatggcgccgaggcggaggtctagtgattcccgctcccgcccctggcacacctggacaggtgccgggcctcgcaaccggccaggaggcagctccaggcagcccgtctgcccactcctcttagcccggacagctcctagctggacttgattttttgtcttgctcagcccgtcgaggactggagggcagagtaggggtgggagtgggggtaggggtagaggtgggggtggcggtgaaggtgggga

SEQ ID NO: 106131 - DNA, 939 bp, Homo sapiens
  chr11:31841337-31842276
  Hyper
gctgcggataggcctcggacctgtgtaggccttcctagctggccagtttctgtccgggtctcgctccccacactgtaccaaccctaggccgccgagagggctgttatgggcttgtttggagtccaggccattaagtgtgcgcaaatccctgcaacccagcagggtgctcgagagcgactctggaaacgccacggcccccgcctgcttatctgcctgtcaataaagggcgcgttcgggctgcgcgggagcgccggtggtgcaggcgaggcccgaactaggcccttccgagctccgggccaacgcacgagccgctctccatttgtcccgggcaaggaggctgggagggagggagccggctctggggtcgccgagggagaaggtgcgggtttagccgctgcctcagctggattcttggagaagcgctcgacctcggagcactctggagaccctaccagaaatctagtgctgggggctcctctccgcgcctgccaccagccttggaggaagctgggcagggccccgtgtggtgcccagcctacgaggtcccacctcgcctctccctggcagaggcatcctctctaggccacactggctcgcattgcgggaagaagggcaccgcgggcggcccgggggcatcatcgacgactcgtagagccccaaatgccgagtgctacctgaggcaggctgtagctggggtgaaaaggaccggaagcgggaaagaaacctcttttctttcaggcctcccttcagcccggggtagcacagactgcaaatttccgacacctagggcagctccaggctctgattctccaccgcacagtgagcgagctcggcagccgcccagtctgcgtaggctcccaggccagccccggccccagagcttccccatcagccagcagaggctgggtggagagcctggatgggcgtgagaggccttga

SEQ ID NO: 106132 - DNA, 62 bp, Homo sapiens; identical to SEQ ID NO: 72716
  chr11:31843422-31843484
  Hyper

SEQ ID NO: 106133 - DNA, 280 bp, Homo sapiens; identical to SEQ ID NO: 72717
  chr11:31845075-31845355
  Hyper

SEQ ID NO: 106134 - DNA, 30 bp, Homo sapiens; identical to SEQ ID NO: 72718
  chr11:31845607-31845637
  Hyper

SEQ ID NO: 106135 - DNA, 58 bp, Homo sapiens; identical to SEQ ID NO: 33775
  chr11:31845842-31845900
  Hyper

SEQ ID NO: 106136 - DNA, 1809 bp, Homo sapiens
  chr11:31846162-31847971
  Hyper
tcacaaatataatatcggcagctcccggattgcctgcggggttgttcaggccccgggcctgcacagctatgagaagtggggtgcagggtgctatttgcccagcaaaagctcatttcctcccaaatgagtataatgaaaacccgagaggcgatattagtgtaaagatcgggattagtccaaataggagccgcggacttgggcttcaaaggcgacccctactctttttgcccagtctgggggcggagggcgctcgaagggatacttcaaggacaccacatccaacttgtcgcagccccacgttcaggcacaggagggagcgaacattgggcagagggtaatttcaacaaaggacggcaggctccggggatcccggcttttccctgagttctctgggttggaaggagagggtccgggctctgtcggaggagtgggtacagcccagcacatgcttttctgacgcgcagcgctggcctggggagtgggtgcagctgctgcagccagcccccaccccgccccaggctgggaaggacgcagagtataatacgacggcccccttccccaaggggacactagatccagagctccaggcatatttgttgttcaaagttaattatacctgaaagcaaccaaaatgcgcacgccaggcccacggaggccgattgccgaccagcgtagccggcccgcagcgccagagaagccgctcactccggcggagtctctgcaagagaatctgaggctggggaataaaagccgaaactaaatcaggcagcaagagtaacaaaccatctggaaaatggacccacggagccgcaagaatgtactttttttttttatccttgacaacttgtgtcctaaagaaagtgtattgaagataattgaaatgattacaattcattgctgcctgactttgaatatgaacagtcacataatgacatccccgccacacaacaacagtttaatttccattatccgacttcgggatcctagcgccagccgccggggcaacgtggcgctaatgcagaaatcttggctcctgcctgcattattcatttcggggacgtggggatgggataggagtggagagtgggtttcttcccctcccccgaacttattctgaaaatcccggggaccaatggacaccgaggaaccgaaagccgagagaatagctgtcaaggggccactttgaccgacggggctgcggtcgacggcgctccccggctgtctttttgtcccaggggttcccaggcccgcagggctaggatcccccagctcccaccctagtcagtcccagtcagggaggacctaggccagggcctcctcccaaggctgtcatctggcggggcaaacgctcttctctcattccttcgtctcccttccagccctcgcatcctttccttctttctgcttcagagctctcaggctcgcgtgcagggcgggatgggcccggatcgggggccccttcgcagatttgaaagttgcctcggccttgatcttctcccagcctccctgctggggactcacccccacatcccgctaccccccggggaaaagcgaagaaagccagagtctctttgcacggcggggacgctggcgctcacctctgggcgcggcctcggtggagcctcagggccagggcggggtgtggcggggtgtggcccggtggggtgagggagggacccggggtgcaagccaggccaaggcctcctcagtgcgcaggcgccgttcgggcccgccgccccctcccaaggcgtggggtcccggggacagaccccgagcccctctctgcgcaactaccgcctctaaaaaaaa

SEQ ID NO: 106137 - DNA, 757 bp, Homo sapiens
  chr11:31848318-31849075
  Hyper
cttgatggcataactcgaaccggagaagcgaggggagcctgagtgactggggcgcacatgacccccctcctggggcctttgggctcaacccttacttttaacttgttctaacaggaataatggagtagtactactaatgcatggtcagaaggggcttttctgtctagaacgcaggcggcgggagttgcaccgccacagcccgggagaccaaagagtctccactccccgctcccggcgcctcctcgccgaccggagccccgagcccagtgagcccagccggtcccacgtcgagaggcgctgggttgggagaagttctgctggtcgtgggctcggcccccaggcgccaggccgagtgcccacctcggcttctttagggggcctacagcgggcagccgagcggctggcggacccggagcttgggaggcgaccgccaggctggtgcccggcctgacccggcgttcgcggccgcccgctcgcccgccgcgggccgggagcgtacaggagtgtgacgcagattgtgaaaacagaagggagggagttgggtcatttccttcgctaatcatcgccccctcctgctcctcctccccacccccatcccatcctcgccgccacccagcctcgaactctcttccttgccagagtctgcctcactttgagccagtggctgcactttatggagaaaatatatgtgcccatcactcacccatctatttgcagcgtccatggagcgcctcggggaacacgcatggacaattaa

SEQ ID NO: 106138 - DNA, 30 bp, Homo sapiens; identical to SEQ ID NO: 72726
  chr11:31849540-31849570
  Hyper

SEQ ID NO: 106139 - DNA, 288 bp, Homo sapiens
  chr11:32008982-32009270
  Hyper
caaatggccgccccccgccgacgccatctgctctgcgaagcagaaacggcggcagctgcgcgcccagtccctccgcccgcgccccgcgcgccgagtccggatccgccgcccggcggcaccgcggacagcgccagccccggggtggcgggcgcggggctgggggcgctgggaagaggggtccgctgtaaggccctcccgccgcctcggggccagtctgggtctagccacttcacctgtgtgcttgaaatgtcagttctttaccagccaggctgccgtttgtttggctcc

SEQ ID NO: 106140 - DNA, 23 bp, Homo sapiens
  chr11:32269881-32269904
  Hypo
actgcacccggcccacatctaca

SEQ ID NO: 106141 - DNA, 23 bp, Homo sapiens
  chr11:32281902-32281925
  Hypo
accgcgcccggccagtgctgcat

SEQ ID NO: 106142 - DNA, 446 bp, Homo sapiens
  chr11:32354892-32355338
  Hyper
caggtgcacggaaggcggcccattctggacagaaaagctttcgtttgacccaaagctcccccttccggcgtgttttctagagggaattcgtgagctgagccgaggagcgagcaggcggcttctcctgaccggggagacgcgggaggtttgcaaacagaccttggcctgggctgcgcagggacaaagtgttcaagggcagcaggggaggctgagggagtacacggctgggaacaagggacactgccgcccccagccacgcaggagcggtgtctgcaccactgaaagtcccccggggcccacagctctatccaggcggaagggaagcagccaggccgccgcggatctgaacttgaatcccgggtggaccggacgccccggccggcgctcctgacgcgcggaggagctggcgagaacctgcagatctcagggctcgcccgcggtccggc

SEQ ID NO: 106143 - DNA, 566 bp, Homo sapiens
  chr11:32448447-32449013
  Hyper
ggacagtcccccaggcgcggccactcccccacccaatctcccagggcaggcgcttttccttccttcatgacctcactacctccttcccttgacgtcagccccgggtccccgcgcggaggggagggaggatggggatgggtttgggggcagccggtgtcaggatccccgagcaccagggaggagggggctatgaggtcatgcgcgcccaatcccgggccgcacaggcctcgcgctgctgctccccggcccccgccccaacttccagccccgtgcgggctggtgtgcgccgcagttactaggcaaccctatcgcagacgcgggcggccggccaagttcacccaaagttgaagaaaaaatttgggggagagaaggtggagcgagaggcgagaagaggaagcacggagcggggaaaagcttggaagggaatgaagctggccttgggcctcccgctcacaggaagaaggtcccacgcgggccagagcagcctccccgcagggccctgttgcgacccgatctccgtcctgcaccccggccgggggcccaccccagagcgtagcaggggcgct

SEQ ID NO: 106144 - DNA, 131 bp, Homo sapiens; identical to SEQ ID NO: 72739
  chr11:32449434-32449565
  Hyper

SEQ ID NO: 106145 - DNA, 3507 bp, Homo sapiens
  chr11:32455276-32458783
  Hyper
gtgggcgggcatcggcgcgggatgagaaaccaacctgatacttatcgtgtgccgagttccctccttgtatcctgactaagcacagcgaataaccctgtccttgttctaaccccaggtcttgaagaaatactgtcccagctgagccccgcgtttacaagatgaagaggcgccccagatgcgctgaaagaaaggccaaagctcgtgcctccttccactgcctgcggtagaacctggtcccgcatagcttggactcggataagtcaagttctcttccatccccagaacctgcgtggccgccgcctgagcgaagcccagtgaagatccacttctgtattaccatacgcgggagctatccacggacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaatccagagtccagacgtctgaaaagcgctacgcttggtgacaatttggcgtttccttaattaacaaaactctccccaaggcagagccagacactgcgccggtctcctggttccactcccgtggggactagcagtcccggaatctctcggactctaaggggccccagacgccctcccggctcttgcgaacagtcaggctcctagctctgcctggctttggaggatgtcgggggccagtgcctgcgtgcactcccactctccggcctcctccccagccgccgcttccgctatcctcacggcccttgggaagcagctgggtaagagctgcggtcaaaaggggtaggagaggggggtgtcctagagcggagagtccctggcgccactgccccgcgcgtagggggcgctccccggcctacttaccctgattgcgaatagcgggctggctctcgaggcagctgggcaggtagggcgcgttaggaaacatcctggcctggccggatgacgcctggctgggcggaggaggaccgaagggcccgtagcgacaggctccggctgtgccagtgaactggccggaaaagtggacagtgaaggcgctcaggcactgctcctcgtgcggctccgcgccgccccagctcggctcctgtttgatgaaggagtgaggcggcggcggcgggggtggcggcggagccggtggcggcgcggggccgcccaacgacccgtaagccgaagcgcccgggggcgcaaagtccagcaccggcgcccactgcgccgcgccgctcacaggcagggcacagccgccgccgccacccagggaggggacggcgggcagcagcgcgttcaggtcccgcacgtcggagcccatttgctgcggctcagacccggacgccccgcggctcctccggccctggagacgttcagcgctggcctcggcggcgcctaacttggcccagatgccgcccgggtcccggactccctgctgctctggctgctgtaggcacccaggcccggagcggagcgtgtgctgagacgccggctccgggacacacgtggaagccgggtcctgcagcaagaggaagtccaggatcgcggcgaggagacggcggggcccgggcgcctgggctgccgtcccggctctgggtgggtgggtgggtgaatgagtaggtgggagggagggcgggaagtgggggagcggacaggcggtcgggttgcggagagcccccgggtgtgggcgctgccttgaactccttaccccagctgcctggctgccctcagcttcccaaagctcaaataagaggggccggcggcgcggggaagaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcaggtaagcagtgagtccgggcagggtcgaatgcggtgggagtagagatggggttgttaatctaaaagagtggtttggagggaggggcaggtaggctccaagagggcgggaacttcaggaaagcgcagaaagaactcagtcaagcttcaaagaagcgtatacccttgctttgcacccttgagtctggctcttgcttctagaactgtcgggtaggggagtggccatgatcttggggtcactggggaaagaggtggccctttgtgggttccagaggtcgggactgaaagcgaacgtccctcagttgggtggccgggagttgcaccagttataagccgggcgtatttcgatcggctagtagttgtttacttggtgaggtttgcgccaggcggaaggcggttgccgcctacctaaaattggagtcagcagcacttagtttccctttccagtgaggaatatctaattcttctacggttaagccgggaaaacagcggctagtttaggagggaagaaaacccttgggcaaacgcccaaagcctgcgtatattccggccggagcatcctggcgcccagtttggggaggaggggtgaaggggagggtttggatacgaagcccggcagggagcgggtaactcctggagccactccgccgagcactgcctgtggccctggtcgaggataccattctggttgctcagtgattgaccaggaggcggaagccagttaaggggaccaaggagtggagtagggagaacctccatcggcccacgggcgcgagttagtgttcgaatctttgggagctcgaagagcttcgctaaatctgactcccttcgtctagtctctgtttggcagcccccgcgccccagagcaggtgtttggggcgggtagggggtgttttggtttggtttttggatcttctaaaggagtcagtatctattgggaaacaacccctaggcaaggagaagaaccgggggccggagcggagcgtgtttcagaggtgcgtataaaatcccaggggcgccaggaggcagcagcgacggcgcagcgtgggacggccaggcgcgacgggagggaagcaaccggttgcagtccggcctcctgtacctggctggcccgggctggggctgcaagctttccagccaaacttatgtgaagcaaagtagttgcagtttgacaaagaatggcgtttcaataaatgacatagtaattttttacgctttggtttttagcttgcattgcataaacgttgtcgccattaaattctggctgcggacccgaagtgtgtgcgggcccaggacttactcgaagggcgcacttcttgggaatgcgcatcccgtaggcgcaggagaccctgagggtaaagatgcggcacttgagccctccgcttgcctcccagg

SEQ ID NO: 106146 - DNA, 468 bp, Homo sapiens
  chr11:32459407-32459875
  Hyper
ggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttc

SEQ ID NO: 106147 - DNA, 30 bp, Homo sapiens; identical to SEQ ID NO: 33793
  chr11:32460192-32460222
  Hyper

SEQ ID NO: 106148 - DNA, 47 bp, Homo sapiens; identical to SEQ ID NO: 33794
  chr11:32460468-32460515
  Hyper

SEQ ID NO: 106149 - DNA, 196 bp, Homo sapiens
  chr11:32460744-32460940
  Hyper
gacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccact

SEQ ID NO: 106150 - DNA, 32 bp, Homo sapiens; identical to SEQ ID NO: 72749
  chr11:32461289-32461321
  Hyper

SEQ ID NO: 106151 - DNA, 22 bp, Homo sapiens
  chr11:32604850-32604872
  Hypo
tccactgcgcccagccaaagct

SEQ ID NO: 106152 - DNA, 210 bp, Homo sapiens; identical to SEQ ID NO: 43034
  chr11:32728943-32729153
  Hypo

SEQ ID NO: 106153 - DNA, 17 bp, Homo sapiens
  chr11:32859995-32860012
  Hypo
tccggaaaaaaaaaaaa

SEQ ID NO: 106154 - DNA, 37 bp, Homo sapiens; identical to SEQ ID NO: 43036
  chr11:32935022-32935059
  Hypo

SEQ ID NO: 106155 - DNA, 173 bp, Homo sapiens; identical to SEQ ID NO: 33796
  chr11:33037467-33037640
  Hyper

SEQ ID NO: 106156 - DNA, 104 bp, Homo sapiens; identical to SEQ ID NO: 43037
  chr11:33181185-33181289
  Hypo

SEQ ID NO: 106157 - DNA, 18 bp, Homo sapiens
  chr11:33184321-33184339
  Hypo
ctccgtctcaaaaaaaat

SEQ ID NO: 106158 - DNA, 137 bp, Homo sapiens; identical to SEQ ID NO: 72762
  chr11:33202679-33202816
  Hypo

SEQ ID NO: 106159 - DNA, 15 bp, Homo sapiens
  chr11:33262877-33262892
  Hypo
cgcaaagaaattaat

SEQ ID NO: 106160 - DNA, 224 bp, Homo sapiens; identical to SEQ ID NO: 43040
  chr11:33269863-33270087
  Hypo

SEQ ID NO: 106161 - DNA, 23 bp, Homo sapiens
  chr11:33277687-33277710
  Hypo
agccaccgcgcccggcctccttt

SEQ ID NO: 106162 - DNA, 107 bp, Homo sapiens; identical to SEQ ID NO: 72766
  chr11:33397535-33397642
  Hyper

SEQ ID NO: 106163 - DNA, 16 bp, Homo sapiens
  chr11:33430482-33430498
  Hypo
gcgactccatctcaaa

SEQ ID NO: 106164 - DNA, 18 bp, Homo sapiens
  chr11:33655887-33655905
  Hypo
ctgcgcttactgctctga

SEQ ID NO: 106165 - DNA, 104 bp, Homo sapiens
  chr11:33721908-33722012
  Hyper
gcaggggaccaggggcgaggcaaccacctcaggccccggcggcggtgagtagaagaagcgcagaggctcgtaggggatggaggccaggccggagggccagggcg

SEQ ID NO: 106166 - DNA, 198 bp, Homo sapiens; identical to SEQ ID NO: 72771
  chr11:33801487-33801685
  Hypo

SEQ ID NO: 106167 - DNA, 44 bp, Homo sapiens; identical to SEQ ID NO: 72772
  chr11:33850913-33850957
  Hyper

SEQ ID NO: 106168 - DNA, 25 bp, Homo sapiens
  chr11:33858438-33858463
  Hypo
aaaccgaccacgccccttattattc

SEQ ID NO: 106169 - DNA, 39 bp, Homo sapiens; identical to SEQ ID NO: 72774
  chr11:33874033-33874072
  Hypo

SEQ ID NO: 106170 - DNA, 180 bp, Homo sapiens; identical to SEQ ID NO: 72775
  chr11:33874405-33874585
  Hypo

SEQ ID NO: 106171 - DNA, 186 bp, Homo sapiens; identical to SEQ ID NO: 72776
  chr11:33880881-33881067
  Hypo

SEQ ID NO: 106172 - DNA, 452 bp, Homo sapiens; identical to SEQ ID NO: 72777
  chr11:33890181-33890633
  Hyper

SEQ ID NO: 106173 - DNA, 168 bp, Homo sapiens; identical to SEQ ID NO: 72778
  chr11:33891959-33892127
  Hyper

SEQ ID NO: 106174 - DNA, 48 bp, Homo sapiens; identical to SEQ ID NO: 72779
  chr11:33928255-33928303
  Hypo

SEQ ID NO: 106175 - DNA, 31 bp, Homo sapiens; identical to SEQ ID NO: 72780
  chr11:33951209-33951240
  Hypo

SEQ ID NO: 106176 - DNA, 52 bp, Homo sapiens; identical to SEQ ID NO: 72781
  chr11:33976639-33976691
  Hypo

SEQ ID NO: 106177 - DNA, 35 bp, Homo sapiens; identical to SEQ ID NO: 72783
  chr11:33993944-33993979
  Hypo

SEQ ID NO: 106178 - DNA, 45 bp, Homo sapiens; identical to SEQ ID NO: 72785
  chr11:34378277-34378322
  Hyper

SEQ ID NO: 106179 - DNA, 46 bp, Homo sapiens; identical to SEQ ID NO: 72787
  chr11:34517683-34517729
  Hypo

SEQ ID NO: 106180 - DNA, 35 bp, Homo sapiens; identical to SEQ ID NO: 72788
  chr11:34534277-34534312
  Hypo

SEQ ID NO: 106181 - DNA, 204 bp, Homo sapiens; identical to SEQ ID NO: 72789
  chr11:34535044-34535248
  Hypo

SEQ ID NO: 106182 - DNA, 30 bp, Homo sapiens; identical to SEQ ID NO: 43050
  chr11:34536053-34536083
  Hypo

SEQ ID NO: 106183 - DNA, 26 bp, Homo sapiens
  chr11:34577250-34577276
  Hypo
aactcaaatctgaagcgtcctggctg

SEQ ID NO: 106184 - DNA, 163 bp, Homo sapiens; identical to SEQ ID NO: 72792
  chr11:34847311-34847474
  Hypo

SEQ ID NO: 106185 - DNA, 28 bp, Homo sapiens
  chr11:34920681-34920709
  Hypo
ctgggattacaggcgtgagccactgagc

SEQ ID NO: 106186 - DNA, 166 bp, Homo sapiens; identical to SEQ ID NO: 43052
  chr11:35134173-35134339
  Hypo

SEQ ID NO: 106187 - DNA, 1272 bp, Homo sapiens
  chr11:35440486-35441758
  Hyper
atcccctcacccttccgtagatgccatggtctggggaacgccccctcctcttcagcactatccggcagctgtgggcgagggagaaagcggacgccggggtgagcgcgaagtgcggccgggagcggtatttaagaggagcctctgcccgcccttccacccgcctccggggtaagccctttagcgcctcaacgggcgcaggaggctcctgcgggcgctaatccgcgtcccggctctccacggcgcgcgacccgcgctcccctccgcccgcggggatggcgcttggcggggagctccgggggctccgagggtggcttccccgagagagcgatgcgcccagggctgcaggagggcgcacgccggcgatgcgcccctgcagccgctgccacctgtgctttgctgcggggctcgcgggcgcggcgagtggcgggagcagagagtggtggcagaggacggtgagcgtgcgtgcgcgtgtgcgggtgtgtgcgcgcctggggaggcggtggaggccgctgcgctctggctcggcgccggccagggagggattgcaaggtttagccccgccggagctggggatttgcaggcgatccctctctattttcgtcgagagctgacatcacccgcgccgccgcctcgggcaactcctttaaccgccgccccccgcccccatctccagtcgcggtccctcctctgccatccctccccccagcctctcgccataaattagccaaataagaaaagaggccccgccgctcgtccgggaaggcttgggcagccggtggcaggagcccaggatctaaggagtagctattgtttcccctgaagcccgcgtggccccaggtcaccccgtgcggggtgaagcgcaggcgaccgcgcggagacccgggatgcccctccgtctccgcctccctggagcagcccctggcgctccctcctcactccccggagcacccgcttcagctcacactcacccccaaactcacaggcaggcacacccaccccatcctcccacgtctgggggtcccaggtccagcggagtcgagcggctgaaacacgcgggtggtgcagcctaaacgcggcccagctgcgctccctcccccgccgaagctcgaataaatctctggccttcaattattcagcgagattaatattaatgcagctccctgggggcggcgggcggggtgcaggggaggccgggattttttttttttttttttaggccgagagaggtcggcctcgtgggtgccggctgagaaggcgcggagagttggccga

SEQ ID NO: 106188 - DNA, 30 bp, Homo sapiens; identical to SEQ ID NO: 72797
  chr11:35547097-35547127
  Hyper

SEQ ID NO: 106189 - DNA, 240 bp, Homo sapiens; identical to SEQ ID NO: 72798
  chr11:35547335-35547575
  Hyper

SEQ ID NO: 106190 - DNA, 239 bp, Homo sapiens
  chr11:35639567-35639806
  Hyper
ctgatcctagcctggcggagctcggaaagaggtggaaatctgtctgaagtttgcaggagacccgcgctgcctaggcaaagggacccggcgaccaagacacccccgcgagggcccagggcgcgtccctcccgccaggccccagactccggctctgcgccaccccctcctacgccccggcgcgggcgcagccagtccggcttcctccaggcccccaagtcccggaccgagtgtggggccgc

SEQ ID NO: 106191 - DNA, 1118 bp, Homo sapiens; identical to SEQ ID NO: 72801
  chr11:35640499-35641617
  Hyper

SEQ ID NO: 106192 - DNA, 290 bp, Homo sapiens; identical to SEQ ID NO: 43053
  chr11:35684922-35685212
  Hypo

SEQ ID NO: 106193 - DNA, 420 bp, Homo sapiens; identical to SEQ ID NO: 72804
  chr11:36398057-36398477
  Hyper

SEQ ID NO: 106194 - DNA, 787 bp, Homo sapiens; identical to SEQ ID NO: 72805
  chr11:36398700-36399487
  Hyper

SEQ ID NO: 106195 - DNA, 98 bp, Homo sapiens; identical to SEQ ID NO: 43054
  chr11:36687119-36687217
  Hypo

SEQ ID NO: 106196 - DNA, 22 bp, Homo sapiens
  chr11:36935607-36935629
  Hypo
ataaaggaaggtggccgggtgt

SEQ ID NO: 106197 - DNA, 33 bp, Homo sapiens; identical to SEQ ID NO: 72813
  chr11:38503116-38503149
  Hypo

SEQ ID NO: 106198 - DNA, 43 bp, Homo sapiens; identical to SEQ ID NO: 72816
  chr11:39673547-39673590
  Hypo

SEQ ID NO: 106199 - DNA, 30 bp, Homo sapiens; identical to SEQ ID NO: 72817
  chr11:39808437-39808467
  Hypo

SEQ ID NO: 106200 - DNA, 231 bp, Homo sapiens; identical to SEQ ID NO: 72818
  chr11:40314692-40314923
  Hyper

SEQ ID NO: 106201 - DNA, 192 bp, Homo sapiens
  chr11:40315416-40315608
  Hyper
gctcacggctccctgcgcggcagaaaccccagtccccttccatccacttcggtttgaactctcttcctccccctccctctgctctctcccctctttttctcccaaataaatgctctcccagcaccggcggcagctcttgccagcccaggctttctctcgaccaatgccacgtcctgacgcttagggtcctag

SEQ ID NO: 106202 - DNA, 37 bp, Homo sapiens; identical to SEQ ID NO: 72824
  chr11:41989424-41989461
  Hypo

SEQ ID NO: 106203 - DNA, 120 bp, Homo sapiens; identical to SEQ ID NO: 72825
  chr11:42366142-42366262
  Hypo

SEQ ID NO: 106204 - DNA, 18 bp, Homo sapiens
  chr11:43402096-43402114
  Hypo
gcccggccaaaagctggc

SEQ ID NO: 106205 - DNA, 126 bp, Homo sapiens; identical to SEQ ID NO: 72829
  chr11:43543226-43543352
  Hypo

SEQ ID NO: 106206 - DNA, 46 bp, Homo sapiens; identical to SEQ ID NO: 72830
  chr11:43544024-43544070
  Hypo

SEQ ID NO: 106207 - DNA, 373 bp, Homo sapiens
  chr11:43568942-43569315
  Hyper
gcacagcgactgggccgggagcgacctggctctcggaagccgggcagggtgggggagggggcaggtaagtgggttgcctggcaacccggcagacccgcgggtggacaagctcaaggggcagccaggtgccacccgccccacccccgagcacacgctgcggaattctgacggcacgaagcagagtcacgagcgcagccggagcagtcgagcgggcaggacaccgtcagtgccgggagaacacgcgcgcgtgggtggatggcgggagggtcctcacagccagccgcaccacccccctcccccccacatcccgcaacctggcttctcctcgctctaaatctaggggaacaaaaacccggcgcgtctgggacagcct

SEQ ID NO: 106208 - DNA, 51 bp, Homo sapiens; identical to SEQ ID NO: 72833
  chr11:43569569-43569620
  Hyper

SEQ ID NO: 106209 - DNA, 107 bp, Homo sapiens; identical to SEQ ID NO: 33815
  chr11:43596489-43596596
  Hyper

SEQ ID NO: 106210 - DNA, 462 bp, Homo sapiens; identical to SEQ ID NO: 72835
  chr11:43596850-43597312
  Hyper

SEQ ID NO: 106211 - DNA, 66 bp, Homo sapiens; identical to SEQ ID NO: 72836
  chr11:43598418-43598484
  Hyper

SEQ ID NO: 106212 - DNA, 30 bp, Homo sapiens; identical to SEQ ID NO: 10840
  chr11:43599075-43599105
  Hyper

SEQ ID NO: 106213 - DNA, 199 bp, Homo sapiens; identical to SEQ ID NO: 72838
  chr11:43600016-43600215
  Hyper

SEQ ID NO: 106214 - DNA, 1105 bp, Homo sapiens; identical to SEQ ID NO: 72839
  chr11:43600492-43601597
  Hyper

SEQ ID NO: 106215 - DNA, 30 bp, Homo sapiens; identical to SEQ ID NO: 72840
  chr11:43602138-43602168
  Hyper

SEQ ID NO: 106216 - DNA, 1784 bp, Homo sapiens
  chr11:43602393-43604177
  Hyper
ctgattggtgggtgacgattttagtccgcaccaatgagctggcggcctcgtctgtatttatttagtgctctgggggagtttttctctttacgcagcgcctgtagtcacggctggaaccttggctgggggactctgagggataagaggggattcggggggaatccgaactgtacctgttcagagatccgcgaccttgcagccggggctggcggaactctgatagggagatagagggataggacaggcaggcggggaggctccgggtgctggggcgacaggaaaggggtggaggctgggctccgggatccgggtgcccctctgcggtccccttctcgccctccacacacttctctcggggctgagttgggggatcgcggacggtctggagaaatggagacacgagtccaggggcgcggaggggcgggcagcgcgcggagtggtgagactgagccgcgatggaacgcgctggggagacccagcctgttcggctccagggttcggagacatcctgggctgaaggcggcggcgaaccgaagaagccggcatattctgcccttcgcgaatctttttgcggtctgggcttgctgtacataactcaatagccggaagcccttaccccaaaaagcatttgcggagggcgcactcgtcgagaagacggcagccatccagcgatcgccgaagcccgcaccttcccgaagctgctccatccgagccttacccggccctttccccgttttccacggaagattcggccctttcccccgtcctttccgcggtgcccgaggctttggtcacctgtcttccctccgagcgagtcccccgcccccaactttttaacagactttgtatcacagggggaactggagcaggtggggtgtgtgtgttttcggagaagtgagaagaagctaaaatgcaataaaagtttacagaagttgtgtcttccccccaacccccgcccacaccacgaataaccccattcactcaatgcaaagaaaaggatctgagcttaaggccaagtcagaacctggaatatgaatcagtttaggacattttgtggtcatttttgaccgtaatgatccgattctgcaatatgggggtggggaagcccttgagggaggggctggaggcccttagtatcttatgtcctggtgcgggggacccggaggtgaggcgagccgcggtgaattgggtagatccgaaaaagagggaaaacacccaggcaccgcccgatccccggagtctcttcctcccgcgcctgcttccaacctaatttggggcgttttgcagcctcgggtctcccacatctcctctttttcaaaactaagtagcacggaagggggtaaaacaggcgagaactggggaagcccccgcagagaaggagctttggagagatgcggttgtgcccgactcagacgcttagcaggaacagaagcagcagcagcagcagcagccccatcccggcctctccaggcgccggtcctggggaggggggcaaagctgcaggagaggggagagtctgtgagtccccctcctccccctccactcattgcagtcctgaccacttcggtcacaagtggcacaaatcaggccttcaccacgctccccgcgcccttcgcctgctaggaacactgctagacgcccttgcccttagggactgggccagaaggacacacatacacacatgagtgcccacagggacagaaatgggtagaagatgggtctagagacaccggagttcaagacccgagggctgcgaaccttcacgttttcggggagggcctgaa

SEQ ID NO: 106217 - DNA, 127 bp, Homo sapiens; identical to SEQ ID NO: 72844
  chr11:43604737-43604864
  Hyper

SEQ ID NO: 106218 - DNA, 16 bp, Homo sapiens
  chr11:43694378-43694394
  Hypo
ccgcaccctggccaat

SEQ ID NO: 106219 - DNA, 30 bp, Homo sapiens; identical to SEQ ID NO: 72847
  chr11:43701969-43701999
  Hyper

SEQ ID NO: 106220 - DNA, 93 bp, Homo sapiens; identical to SEQ ID NO: 72848
  chr11:43963470-43963563
  Hyper

SEQ ID NO: 106221 - DNA, 392 bp, Homo sapiens; identical to SEQ ID NO: 72849
  chr11:43963623-43964015
  Hyper

SEQ ID NO: 106222 - DNA, 1054 bp, Homo sapiens; identical to SEQ ID NO: 72850
  chr11:43964245-43965299
  Hyper

SEQ ID NO: 106223 - DNA, 557 bp, Homo sapiens; identical to SEQ ID NO: 72851
  chr11:43965504-43966061
  Hyper

SEQ ID NO: 106224 - DNA, 48 bp, Homo sapiens
  chr11:44324942-44324990
  Hyper
taggtacttggcagccggtggcccctcttaccccgcccgtatctccca

SEQ ID NO: 106225 - DNA, 834 bp, Homo sapiens
  chr11:44325688-44326522
  Hyper
gtatcatcacatagccgggtcctcgcagtgttggtttcccaatccgatgactgtcacctcggtgaggacctgtgctgatggccggagaaccctgcgctgcgggcgcacatggccaggtggcgcctggcaggcgacgtccgggtgcaggacggcgctcttaccgccccaccccaaaccgttgcctgggcctaggtccttcggcttcctgaacaggggtttggggggctaaggacgctgaggctccgggggcaggaagttctctctggttaagcgttctctcttctctccggcatacactcccctacccacccacctcgcctaccctcggggcgagaggctcaccaaggcagggcgcgccccccccatgaatcatcccaaggcctctgagccgcgggggctccgggcaactatccccctcctctcctggcctcaggcaccccagtccaggggtctgcagagaagcccgaagcccggacaaacgcgccggacgtcaacaacctctcatccctggcagcagcaaaggccaatatatttccatttcttatttcagtttgccaccaaaacaaagctgcgcgcggctgagggcaggaaggcgctgagaccgagaagaagggacgtcccggagaaagtgcgcccagctgatcttagaaaccagagtcctccgggacttcgccgagattttctgtagggcgttttaatctgttttcctactgcgtgccggcgtcgcagcgcgtgcggctcagggcttggtgactccggcttagcccggcggtcgcggcgaggttcctggcgcagccgcttggaacttcgcattagaatcgggaccgcgcaaat

SEQ ID NO: 106226 - DNA, 1430 bp, Homo sapiens
  chr11:44330477-44331907
  Hyper
cagggtcccaggactcgggtcttgccagaccacagtgtcccctgggaccctagggtctctggctccgcactgtgttgcgccagtgcgcctggatttcccgtgagctttcggccaaccacgctccgggcttcccgcctggctccgcacctgcggcgctctcacctgcggcggcgccgcccgaggagcctcccagccggcgaggagcgaggcttctgcagtcctgctgtcccgcagccccgcagccccgcagcctcgcagccccgcagccccgcagccccgcagccccgcagccccgcagcccagcgccagagcgctgcgcggagactccttgccgccgcacgccctgggccggtaagaagcatccgcttcaaatcccgcccagcgggcagcgcaaagcgagcggtttggggaaatgccgaagggaccgggaaaaacaaactccaagtcgagtttaacagccgaaacgctccgtgcctaggccggcggacaagaaggagacagaacagatcccttggctccctcgcagcgatcgatcccgtttaccgaccagagtcaccaccccgcccccagcccgccaactcatacctcccgcaagccaccagtttcaagggatgcggaagccaagcaccccgtggtccccagcaccaggtgacccgcacgtgcactcaccgtagcagggaacctgcaaggccgcgctgtggccgctgctgccttcctggagtttgaggctgccgtccgggggcgtcttgcaggcgcctcgctgcaagtaaagatgcggttgcgcgggcggctggggctgcggctgctgctgctgcggctgcggctgcggcggcggctggggctgcggggtcgacggctggggctggaacttgttaaaggagccccgcgccccagctccactctccaggggtgtcgccaggtcctgctgcccagcgccgtaacgggcccggctcttggcgtccccgaatccctgtgctttggcggcggccgacaggaaagttgtgccgaacttgtcgcctccgggaaatgccctaaaaggcgacgagccctcccgactctgcgacaccgggctgtagtaggcgtccatggcagcggccggcgactcgcagtaagagacgcaagtctcagcattcatgcctggcttgcgcaggcggcgggcggggacgcgagcgagggcgcgaggacgccaccgcgcgccttggctgggagtttggggaggcgaggaggctgtggctgtgcactccttgcccggcctgctcgctctccctcctcccctccacgccggcctctctctctctccccctcttctttctctgtctctctcctctctctccctcctctctctctcttcccctccctcccccccccttcctctctctctccctctctctctttcctccctccccacagctagccgagggaaagaacgg

SEQ ID NO: 106227 - DNA, 814 bp, Homo sapiens; identical to SEQ ID NO: 72861
  chr11:44332324-44333138
  Hyper

SEQ ID NO: 106228 - DNA, 86 bp, Homo sapiens; identical to SEQ ID NO: 72862
  chr11:44333542-44333628
  Hyper

SEQ ID NO: 106229 - DNA, 898 bp, Homo sapiens
  chr11:44337654-44338552
  Hyper
tggacctccagggctcgcagaaaagctgccacttctccagagccgccagggcgggcgcgagagcagcgagtccgcgcgggtcctcggcgcgctcgccagacccagccgaccgcgtgactcaccacgtcctccgccgggaggaggtcagcatcggccctgggcaccggtccccagccgccgcagcccctgccccaatctccccggaatgcggacgccgccgcgccaacccgagcctccagtcggatagaggcagggagggaggcactgcccacgacgagtgctctccaggcgctgcaaagagcaggggtctcctaggggctttgagaccgcgggcggacctcgggggagcaggcgtgggacccgatctgtgccggctcagcagggccccagcagcgccccagcgtcgcccgcccttcctcctcgcccaccttacgctgggacttgcaccccgagtttaggggcttagccatttccggaactcgggctagtggactctggggaatcaggcgctgggagaggccttcgcagctgcgtctctcctgcccagcatattgtgttgaatgaggcaagggagtgagggggtcgtaaaggaaacccgcactcaggggcacaccttcatttatctgggaacagcgcggatcccagaggtgcgggataaaccaggcgttccagctgctcacacgctgtttggtaccccgcgtctatgaagcacaaagcaggagcggattggaggttttacaaactgaccaaccccgccgcccgcgcccgctggagggagacgcacacctttgccctgcatattcgcttccaggctctgcatctctgctcttggggagccggccacccgcttttccgcgcgggggctggggttctcgcctgaaggcgaagtccgcgtgcg

SEQ ID NO: 106230 - DNA, 30 bp, Homo sapiens; identical to SEQ ID NO: 72866
  chr11:44340703-44340733
  Hyper

SEQ ID NO: 106231 - DNA, 243 bp, Homo sapiens; identical to SEQ ID NO: 72867
  chr11:44341082-44341325
  Hyper

SEQ ID NO: 106232 - DNA, 68 bp, Homo sapiens; identical to SEQ ID NO: 3751
  chr11:44341966-44342034
  Hyper

SEQ ID NO: 106233 - DNA, 30 bp, Homo sapiens; identical to SEQ ID NO: 72869
  chr11:44525426-44525456
  Hypo

SEQ ID NO: 106234 - DNA, 66 bp, Homo sapiens; identical to SEQ ID NO: 72871
  chr11:44609349-44609415
  Hypo

SEQ ID NO: 106235 - DNA, 42 bp, Homo sapiens; identical to SEQ ID NO: 72872
  chr11:44620240-44620282
  Hypo

SEQ ID NO: 106236 - DNA, 30 bp, Homo sapiens; identical to SEQ ID NO: 72873
  chr11:44621968-44621998
  Hypo

SEQ ID NO: 106237 - DNA, 229 bp, Homo sapiens; identical to SEQ ID NO: 72874
  chr11:44748190-44748419
  Hyper

SEQ ID NO: 106238 - DNA, 196 bp, Homo sapiens; identical to SEQ ID NO: 72875
  chr11:44748675-44748871
  Hyper

SEQ ID NO: 106239 - DNA, 34 bp, Homo sapiens; identical to SEQ ID NO: 72876
  chr11:44749184-44749218
  Hyper

SEQ ID NO: 106240 - DNA, 51 bp, Homo sapiens; identical to SEQ ID NO: 72878
  chr11:44919182-44919233
  Hypo

SEQ ID NO: 106241 - DNA, 281 bp, Homo sapiens; identical to SEQ ID NO: 72879
  chr11:44922693-44922974
  Hypo

SEQ ID NO: 106242 - DNA, 30 bp, Homo sapiens; identical to SEQ ID NO: 72880
  chr11:44925810-44925840
  Hypo

SEQ ID NO: 106243 - DNA, 142 bp, Homo sapiens; identical to SEQ ID NO: 72881
  chr11:44929860-44930002
  Hypo

SEQ ID NO: 106244 - DNA, 33 bp, Homo sapiens; identical to SEQ ID NO: 72882
  chr11:44931098-44931131
  Hypo

SEQ ID NO: 106245 - DNA, 132 bp, Homo sapiens; identical to SEQ ID NO: 72884
  chr11:44941372-44941504
  Hypo

SEQ ID NO: 106246 - DNA, 32 bp, Homo sapiens; identical to SEQ ID NO: 72886
  chr11:45167668-45167700
  Hyper

SEQ ID NO: 106247 - DNA, 23 bp, Homo sapiens
  chr11:45195161-45195184
  Hypo
aaacaccgcgtcaaaaaaaaaaa

SEQ ID NO: 106248 - DNA, 37 bp, Homo sapiens; identical to SEQ ID NO: 72888
  chr11:45307820-45307857
  Hyper

SEQ ID NO: 106249 - DNA, 16 bp, Homo sapiens
  chr11:45337961-45337977
  Hypo
gcgcccagtctaaaaa

SEQ ID NO: 106250 - DNA, 56 bp, Homo sapiens; identical to SEQ ID NO: 72890
  chr11:45376235-45376291
  Hypo

SEQ ID NO: 106251 - DNA, 338 bp, Homo sapiens
  chr11:45376858-45377196
  Hyper
agaaaggagaggaggcggagacggttagtctagcctctctgtggggcctctctgctggtacccagatgctgagcgctgaaattctcatccgccacacacaacatggcggcttcctggacccgcgcccaattttcgcttccgggatggaagctacgtcatttccccctctgttgccctagcgccccttggaagccaagaatatgaggaagtcttcttccttcgcgccttcttcttccttacgctccagggcagcctgacagagccgctcgaaggctctgctggccgcggctagccggtgaggagggtggggggaggggccgtcccgcgtgtgggggagt

SEQ ID NO: 106252 - DNA, 65 bp, Homo sapiens; identical to SEQ ID NO: 72893
  chr11:45553228-45553293
  Hypo

SEQ ID NO: 106253 - DNA, 808 bp, Homo sapiens
  chr11:45686237-45687045
  Hyper
gcagcggtctgggtgcggaggccgggccagggctgggagcaggaagcagggagcggcgcccccgcctccgggtgcagctgggtttggaaagttggtgcgggcgcggggacctcagggtctcaaggcgcctccgcagacccgagccaggcgggtcgtgggacggtgagcccggagcagcccctgagtgcgctccgcagcggaggggagccaagcgcctcgggggccaccgcgcgtctcaagtttgctgccctcctcgaatgggggcagggagggctgaggtgatcgcggcgctcaccggccaccagccccggcagccccttcctgcgcccaacacgccgccgttcctcgccgccgccacccctccgctcaccgccggtagctgctgtccccgagcggaggggcgtctcccaccgcgcccgcgcccctcccggctgctgcggcggagtgtccgctcccgcccgccccggagcccgcggggcccggccaatacctggtcggggacgcgccgggagcagctgcagcgcccagcgccggctccatcctcgggtctggagtcagggtcgccggggacccgcgggtggcggcggcggcagcagccgcggcggcatcctccgcctcccgcgccctcctcctcggcctccctcctccctcctcttcctccgactccgcgcgcgcctcacgggcccctcttcatggcccgggggcgcgagcccggggcggctcgagcagctgagtgcgttctctccggccggacgcgggacccggggccggggctcagggacccgagagatgccgggacaggggccgg

SEQ ID NO: 106254 - DNA, 30 bp, Homo sapiens; identical to SEQ ID NO: 72896
  chr11:45825671-45825701
  Hyper

SEQ ID NO: 106255 - DNA, 30 bp, Homo sapiens; identical to SEQ ID NO: 72897
  chr11:45902551-45902581
  Hypo

SEQ ID NO: 106256 - DNA, 63 bp, Homo sapiens; identical to SEQ ID NO: 72898
  chr11:45921994-45922057
  Hyper

SEQ ID NO: 106257 - DNA, 23 bp, Homo sapiens
  chr11:46038808-46038831
  Hypo
accacgcccggcctacatctatt

SEQ ID NO: 106258 - DNA, 30 bp, Homo sapiens; identical to SEQ ID NO: 72900
  chr11:46141017-46141047
  Hyper

SEQ ID NO: 106259 - DNA, 169 bp, Homo sapiens; identical to SEQ ID NO: 72901
  chr11:46259315-46259484
  Hyper

SEQ ID NO: 106260 - DNA, 33 bp, Homo sapiens; identical to SEQ ID NO: 43057
  chr11:46298483-46298516
  Hypo

SEQ ID NO: 106261 - DNA, 109 bp, Homo sapiens; identical to SEQ ID NO: 72903
  chr11:46299747-46299856
  Hyper

SEQ ID NO: 106262 - DNA, 910 bp, Homo sapiens
  chr11:46316818-46317728
  Hyper
gtaccattactgccccgggagagtcccctctgccgccaccagagacagccaccaaagcgccccacggtaggacgattcgagatggagctgcaaggggatttaaggcccggctcgccctttgagtcggggtcgtcggggagaccctcggtctccacttctccctgcgggggtgggggcggggccgcgctactgatgaggggtttaggacaccgtgagacggccaggccatttctgcctcggccccagacgcagaaggggtcccatgcaggcccgagccagtgcaccctgcgctccctcagccgcgggccgtcggcgcaggccgggaccctcctccgcgcgagccctgcactcctccggtgccctccacgccgccaccggctgctgctcgcagcctcccgccattggccaggagctctgcggctcccaccagtgagcaggccggattccggtgaggggcggccccgggtgttcccgggttaaccctttgtgggccgctccaggacggcggcacccggatccttctctaaaatttaaagggcgggcggctgaggccaggctccaagagagggtgcagccgagaagaggggtacgcaggtctgcaagcaggagagctcgggaacctctcctccaagggagggaagccggcgccggctgcgcgtgacagccgagaaggagcttatattggcacgactataggaaaaagtctttaacgaggagggaaacaaatcataatatgtccttctccggcttcccacccccgttgcctggaaaggcacccctgtaggacgctcaccccctgcagaaccctgtcgccctcagagcgttgacacatggctcccctgaagttcgtgaactcctggccgccgaccccttgctcttgctccccaatttccatcggacaatctaaacc

SEQ ID NO: 106263 - DNA, 33 bp, Homo sapiens; identical to SEQ ID NO: 72907
  chr11:46332619-46332652
  Hypo

SEQ ID NO: 106264 - DNA, 591 bp, Homo sapiens
  chr11:46354344-46354935
  Hyper
gccctgagctaggttcgtgcccgtggtgggctgggccgggctcgctcccttcgtgccctgagcgggcgggctgggcggagcggcgccctcccctccggaccccaccggctggagagtgtctctaaggtgacactcgggtgcgcggcagcagcggcggttgcaggagctcgctctccgcccgggctccggctccgctccagccgtccggggggcgccgcggcgcgcagagcgcagcaccccgactccagccaggagcccccgcccccccggagcgcaggaggaccccggcccgcctctcccaggcgcagcgcccagcatctcgctgctcctgtcgtctaagcgtcggcgtcgctagggacctgcggaacccggcgctcccctccctccccgcctcgcgtccccggcccgggcggactggagactcgaacttgagcgggtgcccgaaaggccgcaggagccgcgggcggaaggcggccgcacgatggccgaggggcagggcggcggagggcagcgctgggactgggctggcggcggccgggcagccgaggaggaggtggtgcggcggcgatgccggcgcggggaggaggccca

SEQ ID NO: 106265 - DNA, 123 bp, Homo sapiens; identical to SEQ ID NO: 72910
  chr11:46403934-46404057
  Hyper

SEQ ID NO: 106266 - DNA, 209 bp, Homo sapiens; identical to SEQ ID NO: 72911
  chr11:46405726-46405935
  Hypo

SEQ ID NO: 106267 - DNA, 103 bp, Homo sapiens; identical to SEQ ID NO: 72912
  chr11:46413862-46413965
  Hyper

SEQ ID NO: 106268 - DNA, 221 bp, Homo sapiens; identical to SEQ ID NO: 72913
  chr11:46414479-46414700
  Hyper

SEQ ID NO: 106269 - DNA, 22 bp, Homo sapiens
  chr11:46614016-46614038
  Hypo
tacaacaaaactgggcgggcgc

SEQ ID NO: 106270 - DNA, 30 bp, Homo sapiens; identical to SEQ ID NO: 43060
  chr11:46774904-46774934
  Hypo

SEQ ID NO: 106271 - DNA, 19 bp, Homo sapiens
  chr11:46777041-46777060
  Hypo
ccaccgcacctggccccat

SEQ ID NO: 106272 - DNA, 85 bp, Homo sapiens; identical to SEQ ID NO: 72917
  chr11:46872609-46872694
  Hypo

SEQ ID NO: 106273 - DNA, 53 bp, Homo sapiens; identical to SEQ ID NO: 72918
  chr11:46916169-46916222
  Hypo

SEQ ID NO: 106274 - DNA, 16 bp, Homo sapiens
  chr11:46920026-46920042
  Hypo
gcgcccagccggtagt

SEQ ID NO: 106275 - DNA, 635 bp, Homo sapiens; identical to SEQ ID NO: 33862
  chr11:46938439-46939074
  Hyper

SEQ ID NO: 106276 - DNA, 167 bp, Homo sapiens
  chr11:46939396-46939563
  Hyper
agtaccagattctaccggggcctctctccgcaacccgcccgagcccccagccccaggaaggagggctatttacaatttatgggtttagcgaccctcctcacccgcctccctttcttcgcacgcattcattcgcaccaaggacacagagcccccgacctaacctgaaa

SEQ ID NO: 106277 - DNA, 83 bp, Homo sapiens; identical to SEQ ID NO: 72923
  chr11:46957761-46957844
  Hypo

SEQ ID NO: 106278 - DNA, 41 bp, Homo sapiens; identical to SEQ ID NO: 72924
  chr11:46959060-46959101
  Hypo

SEQ ID NO: 106279 - DNA, 105 bp, Homo sapiens; identical to SEQ ID NO: 72925
  chr11:47178630-47178735
  Hypo

SEQ ID NO: 106280 - DNA, 699 bp, Homo sapiens; identical to SEQ ID NO: 72926
  chr11:47208581-47209280
  Hyper

SEQ ID NO: 106281 - DNA, 144 bp, Homo sapiens; identical to SEQ ID NO: 72927
  chr11:47215919-47216063
  Hypo

SEQ ID NO: 106282 - DNA, 266 bp, Homo sapiens; identical to SEQ ID NO: 43063
  chr11:47358971-47359237
  Hypo

SEQ ID NO: 106283 - DNA, 141 bp, Homo sapiens; identical to SEQ ID NO: 72929
  chr11:47367760-47367901
  Hypo

SEQ ID NO: 106284 - DNA, 30 bp, Homo sapiens; identical to SEQ ID NO: 72930
  chr11:47463077-47463107
  Hypo

SEQ ID NO: 106285 - DNA, 198 bp, Homo sapiens; identical to SEQ ID NO: 72931
  chr11:47599117-47599315
  Hypo

SEQ ID NO: 106286 - DNA, 213 bp, Homo sapiens; identical to SEQ ID NO: 72932
  chr11:47615713-47615926
  Hyper

SEQ ID NO: 106287 - DNA, 23 bp, Homo sapiens
  chr11:47873752-47873775
  Hypo
agtcaccgcgcctggccacactt

SEQ ID NO: 106288 - DNA, 35 bp, Homo sapiens; identical to SEQ ID NO: 43066
  chr11:49212608-49212643
  Hypo

SEQ ID NO: 106289 - DNA, 109 bp, Homo sapiens; identical to SEQ ID NO: 72940
  chr11:49229761-49229870
  Hyper

SEQ ID NO: 106290 - DNA, 30 bp, Homo sapiens; identical to SEQ ID NO: 72942
  chr11:49837177-49837207
  Hypo

SEQ ID NO: 106291 - DNA, 30 bp, Homo sapiens; identical to SEQ ID NO: 43067
  chr11:50205839-50205869
  Hypo

SEQ ID NO: 106292 - DNA, 45 bp, Homo sapiens; identical to SEQ ID NO: 72944
  chr11:50206566-50206611
  Hypo

SEQ ID NO: 106293 - DNA, 163 bp, Homo sapiens; identical to SEQ ID NO: 72945
  chr11:50256715-50256878
  Hypo

SEQ ID NO: 106294 - DNA, 21 bp, Homo sapiens
  chr11:55684103-55684124
  Hypo
ttatttaaaagaaaacgtggc

SEQ ID NO: 106295 - DNA, 37 bp, Homo sapiens; identical to SEQ ID NO: 72960
  chr11:55743007-55743044
  Hypo

SEQ ID NO: 106296 - DNA, 160 bp, Homo sapiens; identical to SEQ ID NO: 72962
  chr11:55918225-55918385
  Hypo

SEQ ID NO: 106297 - DNA, 30 bp, Homo sapiens; identical to SEQ ID NO: 72963
  chr11:55919964-55919994
  Hypo

SEQ ID NO: 106298 - DNA, 32 bp, Homo sapiens; identical to SEQ ID NO: 72968
  chr11:57056902-57056934
  Hyper

SEQ ID NO: 106299 - DNA, 137 bp, Homo sapiens; identical to SEQ ID NO: 72969
  chr11:57071533-57071670
  Hypo

SEQ ID NO: 106300 - DNA, 230 bp, Homo sapiens; identical to SEQ ID NO: 72970
  chr11:57117349-57117579
  Hyper

SEQ ID NO: 106301 - DNA, 40 bp, Homo sapiens; identical to SEQ ID NO: 72971
  chr11:57150498-57150538
  Hypo

SEQ ID NO: 106302 - DNA, 30 bp, Homo sapiens; identical to SEQ ID NO: 72972
  chr11:57168307-57168337
  Hypo

SEQ ID NO: 106303 - DNA, 30 bp, Homo sapiens; identical to SEQ ID NO: 72973
  chr11:57168787-57168817
  Hypo

SEQ ID NO: 106304 - DNA, 614 bp, Homo sapiens; identical to SEQ ID NO: 72975
  chr11:57194178-57194792
  Hyper

SEQ ID NO: 106305 - DNA, 49 bp, Homo sapiens
  chr11:57227221-57227270
  Hyper
acgcacacactcgcacgcgcgcccatctcgcacccgcttgtaaatgcac

SEQ ID NO: 106306 - DNA, 207 bp, Homo sapiens; identical to SEQ ID NO: 72978
  chr11:57235251-57235458
  Hypo

SEQ ID NO: 106307 - DNA, 69 bp, Homo sapiens; identical to SEQ ID NO: 72979
  chr11:57243666-57243735
  Hyper

SEQ ID NO: 106308 - DNA, 30 bp, Homo sapiens
  chr11:57244209-57244239
  Hyper
cgcgcctactgaggacgactactggggggg

SEQ ID NO: 106309 - DNA, 32 bp, Homo sapiens; identical to SEQ ID NO: 72980
  chr11:57281984-57282016
  Hyper

SEQ ID NO: 106310 - DNA, 30 bp, Homo sapiens; identical to SEQ ID NO: 72981
  chr11:57308593-57308623
  Hypo

SEQ ID NO: 106311 - DNA, 163 bp, Homo sapiens; identical to SEQ ID NO: 72982
  chr11:57311354-57311517
  Hypo

SEQ ID NO: 106312 - DNA, 33 bp, Homo sapiens; identical to SEQ ID NO: 72983
  chr11:57373422-57373455
  Hypo

SEQ ID NO: 106313 - DNA, 30 bp, Homo sapiens; identical to SEQ ID NO: 72984
  chr11:57405988-57406018
  Hyper

SEQ ID NO: 106314 - DNA, 30 bp, Homo sapiens; identical to SEQ ID NO: 72985
  chr11:57417507-57417537
  Hyper

SEQ ID NO: 106315 - DNA, 30 bp, Homo sapiens; identical to SEQ ID NO: 72986
  chr11:57421913-57421943
  Hypo

SEQ ID NO: 106316 - DNA, 25 bp, Homo sapiens
  chr11:57423912-57423937
  Hypo
ttattataaccggactcagaaactc

SEQ ID NO: 106317 - DNA, 20 bp, Homo sapiens
  chr11:57437214-57437234
  Hypo
gcccccgtgcccagctggca

SEQ ID NO: 106318 - DNA, 37 bp, Homo sapiens; identical to SEQ ID NO: 72989
  chr11:57501031-57501068
  Hypo

SEQ ID NO: 106319 - DNA, 91 bp, Homo sapiens; identical to SEQ ID NO: 72990
  chr11:57548730-57548821
  Hypo

SEQ ID NO: 106320 - DNA, 18 bp, Homo sapiens
  chr11:57551113-57551131
  Hypo
gagcgagactccatctca

SEQ ID NO: 106321 - DNA, 30 bp, Homo sapiens; identical to SEQ ID NO: 72993
  chr11:57994277-57994307
  Hypo

SEQ ID NO: 106322 - DNA, 148 bp, Homo sapiens; identical to SEQ ID NO: 72994
  chr11:58275194-58275342
  Hypo

SEQ ID NO: 106323 - DNA, 141 bp, Homo sapiens; identical to SEQ ID NO: 72995
  chr11:58406402-58406543
  Hypo

SEQ ID NO: 106324 - DNA, 229 bp, Homo sapiens; identical to SEQ ID NO: 72996
  chr11:58668329-58668558
  Hyper

SEQ ID NO: 106325 - DNA, 603 bp, Homo sapiens
  chr11:58672686-58673289
  Hyper
ggcattgtctgtgttcgccagcccctccacgaagttggatcatttgcggagcaggccaagtccctctagacctcacgcagacgcgggtgcagcctgctctgcgacttgcagtcagctggaagctgggcctctgcatcatcagggtggagctctctctgctgctgccgctggatcccgcctggatgcacgtcccgccaccgccgccgacccatcagcggcagaagggcagcaatggccacacaccgaagcaccttggcgggctattccccttgcagctctcctcagcgcgctgctcccactcgcaatcaaaaggcggaaaaagcgcgaaaccgccaggcatctcccatacccacccggctgccgcgcaacccctccttggcttccactgggagacaggggacgccgatgagcaggaagaagcagggcagtgactgcttagtttatcctggtacgcgggaactggctgtggaccgagtggttcgggggaggggatcgctgggaccgggatgggtcatctggacaaatagggagggtgggcgggtgggcgcgcagtcccctcggcctggccgtctgacccgcccgcgagcgcgtgcgcccaggcgt

SEQ ID NO: 106326 - DNA, 16 bp, Homo sapiens
  chr11:58821650-58821666
  Hypo
gcgtggcctcctattc

SEQ ID NO: 106327 - DNA, 152 bp, Homo sapiens; identical to SEQ ID NO: 73000
  chr11:58835165-58835317
  Hypo

SEQ ID NO: 106328 - DNA, 30 bp, Homo sapiens; identical to SEQ ID NO: 73001
  chr11:58953988-58954018
  Hypo

SEQ ID NO: 106329 - DNA, 179 bp, Homo sapiens; identical to SEQ ID NO: 73002
  chr11:59245284-59245463
  Hypo

SEQ ID NO: 106330 - DNA, 30 bp, Homo sapiens; identical to SEQ ID NO: 15547
  chr11:59312651-59312681
  Hypo

SEQ ID NO: 106331 - DNA, 53 bp, Homo sapiens; identical to SEQ ID NO: 33871
  chr11:59318986-59319039
  Hyper

SEQ ID NO: 106332 - DNA, 30 bp, Homo sapiens; identical to SEQ ID NO: 73005
  chr11:59323446-59323476
  Hyper

SEQ ID NO: 106333 - DNA, 28 bp, Homo sapiens
  chr11:59323871-59323899
  Hyper
gatagactaagcaaacgcttttcttcag

SEQ ID NO: 106334 - DNA, 28 bp, Homo sapiens
  chr11:59323959-59323987
  Hyper
gtccctgttcgggcggatgctgttttag

SEQ ID NO: 106335 - DNA, 19 bp, Homo sapiens
  chr11:59328895-59328914
  Hypo
accttaaaggctgggcgcg

SEQ ID NO: 106336 - DNA, 138 bp, Homo sapiens; identical to SEQ ID NO: 43081
  chr11:59329214-59329352
  Hypo

SEQ ID NO: 106337 - DNA, 330 bp, Homo sapiens; identical to SEQ ID NO: 73010
  chr11:59333343-59333673
  Hyper

SEQ ID NO: 106338 - DNA, 30 bp, Homo sapiens; identical to SEQ ID NO: 73014
  chr11:59521144-59521174
  Hypo

SEQ ID NO: 106339 - DNA, 61 bp, Homo sapiens; identical to SEQ ID NO: 73016
  chr11:59609779-59609840
  Hypo

SEQ ID NO: 106340 - DNA, 188 bp, Homo sapiens; identical to SEQ ID NO: 73017
  chr11:59807943-59808131
  Hypo

SEQ ID NO: 106341 - DNA, 120 bp, Homo sapiens; identical to SEQ ID NO: 73018
  chr11:59841387-59841507
  Hypo

SEQ ID NO: 106342 - DNA, 30 bp, Homo sapiens; identical to SEQ ID NO: 43085
  chr11:60282848-60282878
  Hypo

SEQ ID NO: 106343 - DNA, 23 bp, Homo sapiens
  chr11:60409067-60409090
  Hypo
ttatatactttcccccgttctat

SEQ ID NO: 106344 - DNA, 213 bp, Homo sapiens; identical to SEQ ID NO: 73021
  chr11:60524504-60524717
  Hypo

SEQ ID NO: 106345 - DNA, 26 bp, Homo sapiens
  chr11:60535370-60535396
  Hypo
aaaggacgggaaaggcggggcacggt

SEQ ID NO: 106346 - DNA, 67 bp, Homo sapiens; identical to SEQ ID NO: 73024
  chr11:60640875-60640942
  Hypo

SEQ ID NO: 106347 - DNA, 609 bp, Homo sapiens
  chr11:60718628-60719237
  Hyper
ccgcagaaggagctgcggccgtcggggaaggcggtggcgggcagcaggcccgaggcggccaggtagagcagcaggctgagcgcgaccgcgcggtagcggcccaggtacacgtcggccagccagccgcccacgggcgccagcaggtaggaggcgcccaggaataccagcgcggcgcgcgtcgcctgctcgccggtccagttgaagttggtgctgttgaggtacagcacgaggttggcggtgacgccgaagaaggcggcgcgctccagcatctccaccagcagcacggccgcgcccgccgcccgccgccaccgtcgagggccccgcgcaccgcgaggcagcagcggctggcgctccccgggcacgcggggctgctcccgggcgcgcggcgcgggcatcctggctccgggctgggccccccgcggctcttctctcctctcctctccccgcctcagagccctgcactcctgcccccgggcctcggccctctcccccacccaactggctggccctcctttctcaccgctttggcccacccttccctcctgtcccctctccctttcttgccctacccttcctgtccctccgctcactacccggactctaccacct

SEQ ID NO: 106348 - DNA, 30 bp, Homo sapiens; identical to SEQ ID NO: 43087
  chr11:60892552-60892582
  Hypo

SEQ ID NO: 106349 - DNA, 170 bp, Homo sapiens; identical to SEQ ID NO: 73029
  chr11:60897862-60898032
  Hypo

SEQ ID NO: 106350 - DNA, 86 bp, Homo sapiens; identical to SEQ ID NO: 73030
  chr11:60927434-60927520
  Hypo

SEQ ID NO: 106351 - DNA, 171 bp, Homo sapiens; identical to SEQ ID NO: 5117
  chr11:60941596-60941767
  Hypo

SEQ ID NO: 106352 - DNA, 30 bp, Homo sapiens; identical to SEQ ID NO: 73032
  chr11:61014723-61014753
  Hypo

SEQ ID NO: 106353 - DNA, 41 bp, Homo sapiens; identical to SEQ ID NO: 73033
  chr11:61027383-61027424
  Hypo

SEQ ID NO: 106354 - DNA, 39 bp, Homo sapiens; identical to SEQ ID NO: 73034
  chr11:61036508-61036547
  Hypo

SEQ ID NO: 106355 - DNA, 377 bp, Homo sapiens; identical to SEQ ID NO: 73035
  chr11:61038898-61039275
  Hypo

SEQ ID NO: 106356 - DNA, 30 bp, Homo sapiens; identical to SEQ ID NO: 73036
  chr11:61041904-61041934
  Hypo

SEQ ID NO: 106357 - DNA, 158 bp, Homo sapiens; identical to SEQ ID NO: 73037
  chr11:61049497-61049655
  Hypo

SEQ ID NO: 106358 - DNA, 175 bp, Homo sapiens; identical to SEQ ID NO: 73038
  chr11:61058212-61058387
  Hypo

SEQ ID NO: 106359 - DNA, 124 bp, Homo sapiens; identical to SEQ ID NO: 73039
  chr11:61058771-61058895
  Hypo

SEQ ID NO: 106360 - DNA, 470 bp, Homo sapiens
  chr11:61062688-61063158
  Hyper
aggggacgcggcggacgattgtggggagggtctctggcacctcgaagcgaaacacacaaaggcaacgccgcccgcctgctgatgcctctccgagaggcgcggagcccggggcgggggcaaagatcagggacccctgggggcggggtttcgccctcggcccacaccccctgccccggtttgggagtcggcttcctgcgaagcgctgactgaaggcgtcagaccgaggccccgggaggaaacagacttcgggaacaaggctagcaccagaggctgcgcgccccgggcatggcccctgtcggtgggacccgagacgccttgttgtgacgaggtgggaaccgtggaaattcgaacccacgacgccaggtcgctgtgccgctgagcagttctaggcctgcccccagcctgccagaaggtctgcaccctaacgccggagtgcgttgatctgtgggtccaaccgctccctggcctgg

SEQ ID NO: 106361 - DNA, 30 bp, Homo sapiens; identical to SEQ ID NO: 73042
  chr11:61112512-61112542
  Hypo

SEQ ID NO: 106362 - DNA, 18 bp, Homo sapiens
  chr11:61198502-61198520
  Hypo
tttttttttttgagacgg

SEQ ID NO: 106363 - DNA, 40 bp, Homo sapiens; identical to SEQ ID NO: 73044
  chr11:61276061-61276101
  Hyper

SEQ ID NO: 106364 - DNA, 926 bp, Homo sapiens
  chr11:61276416-61277342
  Hyper
cggggcgatgcctggcggtggcagtggcggcggccccggccggggcccgtgaccatgggcatcgccgagtccacgccggatgagctgccgtcggacgcagaggagcagctgcgcagcggcgaccagcagctggagctgagcgggcggcggttgcggcggctgcccagcgcagtgtgcgcgctgagccgcctgcagaagctgtatgtgagcggcacggggctgcgcgagctgccggaggagatcgaggagctgcgcgagctgcgcatcctggcgctggacttcaacaagctcgagcgactgcctgacggcctgtgccgcctgccgcgcctcacgcgcctctatctgggcggcaaccggctgctggcgctgcccgccgacttcgcgcagttgcagagcctgcgctgcctctggatcgagggcaacttcttgcggcgcttcccgcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgctgctgcgcatgggccgcctgcacatcctcgacctcgaccgcaaccgcctgggcggcttccccgacctgcacccgctgcgcgcgctgcgcgtcttctcctacgaccacaaccccgtcaccgggcccccgcgcgtcgcggacaccgtgttcctcgtgggcgagggcgccgtcgagcgcatggcggagcgcgacgagcccacgccccggcctccgccccggcgcccagcgcgggcctttgaggatgaggaggaggaagacctgctcataggcggcgctggttcccgggctctgggcgcccccgggggcagcttccgcgccctggaagccgctccaggactggg

SEQ ID NO: 106365 - DNA, 30 bp, Homo sapiens; identical to SEQ ID NO: 73048
  chr11:61305680-61305710
  Hypo

SEQ ID NO: 106366 - DNA, 518 bp, Homo sapiens; identical to SEQ ID NO: 73049
  chr11:61334835-61335353
  Hyper

SEQ ID NO: 106367 - DNA, 95 bp, Homo sapiens; identical to SEQ ID NO: 73050
  chr11:61347879-61347974
  Hyper

SEQ ID NO: 106368 - DNA, 38 bp, Homo sapiens; identical to SEQ ID NO: 73051
  chr11:61355533-61355571
  Hyper

SEQ ID NO: 106369 - DNA, 43 bp, Homo sapiens; identical to SEQ ID NO: 73052
  chr11:61356081-61356124
  Hyper

SEQ ID NO: 106370 - DNA, 93 bp, Homo sapiens; identical to SEQ ID NO: 73053
  chr11:61447983-61448076
  Hyper

SEQ ID NO: 106371 - DNA, 51 bp, Homo sapiens; identical to SEQ ID NO: 73054
  chr11:61526128-61526179
  Hypo

SEQ ID NO: 106372 - DNA, 30 bp, Homo sapiens; identical to SEQ ID NO: 73056
  chr11:61581920-61581950
  Hypo

SEQ ID NO: 106373 - DNA, 239 bp, Homo sapiens
  chr11:61582570-61582809
  Hyper
tggcgataagattcacgttggcaggtccggcagccccgggccctgtaagtgatgcggcgtgtggggcgggggccggggcggagccggcggccggtggcaccacacatacggaccaatcgccgtccccgccgcggcattcccggccccaaatcacactgcgggaagctccagcgttggtgcctgtttcgtctgcgcatgcgccgggacacgcctgcgcccttggccgcagtcagggctcc

SEQ ID NO: 106374 - DNA, 448 bp, Homo sapiens; identical to SEQ ID NO: 73059
  chr11:61583181-61583629
  Hyper

SEQ ID NO: 106375 - DNA, 232 bp, Homo sapiens; identical to SEQ ID NO: 73060
  chr11:61583894-61584126
  Hyper

SEQ ID NO: 106376 - DNA, 46 bp, Homo sapiens; identical to SEQ ID NO: 73061
  chr11:61584805-61584851
  Hyper

SEQ ID NO: 106377 - DNA, 511 bp, Homo sapiens; identical to SEQ ID NO: 73062
  chr11:61594981-61595492
  Hyper

SEQ ID NO: 106378 - DNA, 944 bp, Homo sapiens; identical to SEQ ID NO: 73063
  chr11:61595751-61596695
  Hyper

SEQ ID NO: 106379 - DNA, 30 bp, Homo sapiens; identical to SEQ ID NO: 73064
  chr11:61625542-61625572
  Hypo

SEQ ID NO: 106380 - DNA, 82 bp, Homo sapiens; identical to SEQ ID NO: 73065
  chr11:61633635-61633717
  Hypo

SEQ ID NO: 106381 - DNA, 81 bp, Homo sapiens; identical to SEQ ID NO: 43095
  chr11:61641410-61641491
  Hypo

SEQ ID NO: 106382 - DNA, 488 bp, Homo sapiens; identical to SEQ ID NO: 73068
  chr11:61664512-61665000
  Hypo

SEQ ID NO: 106383 - DNA, 59 bp, Homo sapiens; identical to SEQ ID NO: 43097
  chr11:61665728-61665787
  Hypo

SEQ ID NO: 106384 - DNA, 140 bp, Homo sapiens; identical to SEQ ID NO: 73070
  chr11:61666088-61666228
  Hypo

SEQ ID NO: 106385 - DNA, 174 bp, Homo sapiens; identical to SEQ ID NO: 73071
  chr11:61669877-61670051
  Hypo

SEQ ID NO: 106386 - DNA, 244 bp, Homo sapiens; identical to SEQ ID NO: 73072
  chr11:61674856-61675100
  Hypo

SEQ ID NO: 106387 - DNA, 245 bp, Homo sapiens; identical to SEQ ID NO: 73073
  chr11:61684587-61684832
  Hyper

SEQ ID NO: 106388 - DNA, 499 bp, Homo sapiens
  chr11:61722682-61723181
  Hyper
cccttctggctgttccgggtccctgtggccgcccaggctccagacaggccaggggaggatcacgaggagctgcggcaaggggctggggagggggcgggggaacgccagcggcaggtcggcgcctctctgtagggaaaggtgcggactgcagccagtgaaactgaagttagacgttaggtaagacgtcctgccgttagcaatgaaaaccccattttctgagggaagcgctgacatcatggtccctggagcccctgcgcgggaggggagggggtctggcggatttctgggaccagcagggggacccccgggtgacagaacccttggggctctcgcgcctccatgcgaggctctgcctgcctctcgctcccgagcgccttccaggagggctgggggctaggcccgctcgcagcagaaagctggaggagccgaggcatcgccgggcgctgggccctgggctctggccgcagcctggcccctcgcccctcgccccccgcccctc

SEQ ID NO: 106389 - DNA, 32 bp, Homo sapiens; identical to SEQ ID NO: 73075
  chr11:61736195-61736227
  Hypo

SEQ ID NO: 106390 - DNA, 23 bp, Homo sapiens
  chr11:61736670-61736693
  Hypo
ttgcctggggctgggcgcggtgg

SEQ ID NO: 106391 - DNA, 82 bp, Homo sapiens; identical to SEQ ID NO: 43102
  chr11:61736993-61737075
  Hypo

SEQ ID NO: 106392 - DNA, 42 bp, Homo sapiens; identical to SEQ ID NO: 73078
  chr11:61753272-61753314
  Hypo

SEQ ID NO: 106393 - DNA, 30 bp, Homo sapiens; identical to SEQ ID NO: 43103
  chr11:61784772-61784802
  Hypo

SEQ ID NO: 106394 - DNA, 137 bp, Homo sapiens; identical to SEQ ID NO: 73080
  chr11:61793162-61793299
  Hyper

SEQ ID NO: 106395 - DNA, 30 bp, Homo sapiens; identical to SEQ ID NO: 73081
  chr11:61899800-61899830
  Hypo

SEQ ID NO: 106396 - DNA, 256 bp, Homo sapiens; identical to SEQ ID NO: 73082
  chr11:62105312-62105568
  Hyper

SEQ ID NO: 106397 - DNA, 35 bp, Homo sapiens; identical to SEQ ID NO: 73083
  chr11:62184274-62184309
  Hypo

SEQ ID NO: 106398 - DNA, 203 bp, Homo sapiens; identical to SEQ ID NO: 73084
  chr11:62191247-62191450
  Hypo

SEQ ID NO: 106399 - DNA, 228 bp, Homo sapiens; identical to SEQ ID NO: 43104
  chr11:62370522-62370750
  Hypo

SEQ ID NO: 106400 - DNA, 95 bp, Homo sapiens; identical to SEQ ID NO: 43105
  chr11:62421710-62421805
  Hypo

SEQ ID NO: 106401 - DNA, 30 bp, Homo sapiens; identical to SEQ ID NO: 43106
  chr11:62440622-62440652
  Hypo

SEQ ID NO: 106402 - DNA, 117 bp, Homo sapiens; identical to SEQ ID NO: 73088
  chr11:62445413-62445530
  Hypo

SEQ ID NO: 106403 - DNA, 78 bp, Homo sapiens; identical to SEQ ID NO: 73089
  chr11:62450128-62450206
  Hypo

SEQ ID NO: 106404 - DNA, 27 bp, Homo sapiens
  chr11:62497829-62497856
  Hypo
agccactgcacccggcccagtaatttt

SEQ ID NO: 106405 - DNA, 40 bp, Homo sapiens; identical to SEQ ID NO: 73092
  chr11:62609977-62610017
  Hyper

SEQ ID NO: 106406 - DNA, 43 bp, Homo sapiens; identical to SEQ ID NO: 73093
  chr11:62661211-62661254
  Hypo

SEQ ID NO: 106407 - DNA, 209 bp, Homo sapiens; identical to SEQ ID NO: 73094
  chr11:62666677-62666886
  Hypo

SEQ ID NO: 106408 - DNA, 160 bp, Homo sapiens
  chr11:63258610-63258770
  Hyper
gcactgggggcggctcggggaggaaccgcggaggggaaagcgccgcgggctgcaaacggcagaggcgcgcggggtggcgacagtggcgcgggcgcagtgagcgcgtccgagaacagaatgggacgaaacggggcgcttagaggcccgggaatctgtgggt

SEQ ID NO: 106409 - DNA, 101 bp, Homo sapiens; identical to SEQ ID NO: 73100
  chr11:63374106-63374207
  Hypo

SEQ ID NO: 106410 - DNA, 101 bp, Homo sapiens; identical to SEQ ID NO: 73102
  chr11:63537119-63537220
  Hyper

SEQ ID NO: 106411 - DNA, 154 bp, Homo sapiens; identical to SEQ ID NO: 73103
  chr11:63572071-63572225
  Hypo

SEQ ID NO: 106412 - DNA, 96 bp, Homo sapiens; identical to SEQ ID NO: 73104
  chr11:63609980-63610076
  Hypo

SEQ ID NO: 106413 - DNA, 18 bp, Homo sapiens
  chr11:63641124-63641142
  Hypo
tatttttttctgagacgg

SEQ ID NO: 106414 - DNA, 56 bp, Homo sapiens; identical to SEQ ID NO: 73106
  chr11:63652242-63652298
  Hypo

SEQ ID NO: 106415 - DNA, 30 bp, Homo sapiens; identical to SEQ ID NO: 73110
  chr11:63735580-63735610
  Hypo

SEQ ID NO: 106416 - DNA, 30 bp, Homo sapiens; identical to SEQ ID NO: 73111
  chr11:63743650-63743680
  Hypo

SEQ ID NO: 106417 - DNA, 767 bp, Homo sapiens
  chr11:63767704-63768471
  Hyper
ccgggagccgatagccgccggtgatcttggccttgccagtcttacagctctgcagggtccggcactcgtcggtaagcagggggccggcggcccgatgaatgcagccgtccactgcgggaagggcgggcgcgactgagctggcctggcaaggctgcggccccggggtgagcaccctcagtcccgagaagcccctcggcgatgcgaggacccatgcggagccgcgccccaaccccgtggcctccggccgcggccgctgcccccacccccgcccggaatgtttcacatctggggaaaccgaggcgcagagcgggacggccctgggcctggcgggaagtcgcgcaaggaggccggcagggggcgcacccggcccaccctgtcccttccaggccgcgccgccagggcccaggcagggcggctccgggaggcgggggccgccgggacaggaaccgccgcccgagccggggtgacggggaagcttcctccccgacgcccctccctagccctgtcccgggcgcgctgcagggcccgcgaccagtcgctgcctccgcccgggcctcagcgtcggtgcgatcccaaggcccacctccccaggcggcgccccatcacggggcggcggcaaaccctaggacccattttgcggatgaggaaaccgaggccaccttgttacagggtgatcagatctgtagctggagtctgggtcttccagccgcgcggggaggtgagcccgacgcccgggcccgagtctcctggcgcgcaaaccccagctg

SEQ ID NO: 106418 - DNA, 145 bp, Homo sapiens; identical to SEQ ID NO: 73114
  chr11:63779111-63779256
  Hypo

SEQ ID NO: 106419 - DNA, 30 bp, Homo sapiens; identical to SEQ ID NO: 43111
  chr11:63780950-63780980
  Hypo

SEQ ID NO: 106420 - DNA, 32 bp, Homo sapiens; identical to SEQ ID NO: 73116
  chr11:63783251-63783283
  Hypo

SEQ ID NO: 106421 - DNA, 82 bp, Homo sapiens; identical to SEQ ID NO: 43112
  chr11:63783734-63783816
  Hypo

SEQ ID NO: 106422 - DNA, 30 bp, Homo sapiens; identical to SEQ ID NO: 73118
  chr11:63785738-63785768
  Hypo

SEQ ID NO: 106423 - DNA, 295 bp, Homo sapiens; identical to SEQ ID NO: 73119
  chr11:63803412-63803707
  Hyper

SEQ ID NO: 106424 - DNA, 30 bp, Homo sapiens; identical to SEQ ID NO: 73120
  chr11:63804018-63804048
  Hyper

SEQ ID NO: 106425 - DNA, 94 bp, Homo sapiens; identical to SEQ ID NO: 73121
  chr11:63804348-63804442
  Hyper

SEQ ID NO: 106426 - DNA, 254 bp, Homo sapiens; identical to SEQ ID NO: 73122
  chr11:63849380-63849634
  Hypo

SEQ ID NO: 106427 - DNA, 30 bp, Homo sapiens; identical to SEQ ID NO: 73123
  chr11:63906088-63906118
  Hypo

SEQ ID NO: 106428 - DNA, 59 bp, Homo sapiens; identical to SEQ ID NO: 73124
  chr11:63916700-63916759
  Hypo

SEQ ID NO: 106429 - DNA, 30 bp, Homo sapiens; identical to SEQ ID NO: 73125
  chr11:63920212-63920242
  Hypo

SEQ ID NO: 106430 - DNA, 20 bp, Homo sapiens
  chr11:63934599-63934619
  Hypo
aaacacgaggatggattttt

SEQ ID NO: 106431 - DNA, 30 bp, Homo sapiens; identical to SEQ ID NO: 73127
  chr11:63938071-63938101
  Hypo

SEQ ID NO: 106432 - DNA, 37 bp, Homo sapiens; identical to SEQ ID NO: 73128
  chr11:63955145-63955182
  Hypo

SEQ ID NO: 106433 - DNA, 129 bp, Homo sapiens; identical to SEQ ID NO: 73129
  chr11:63978732-63978861
  Hypo

SEQ ID NO: 106434 - DNA, 40 bp, Homo sapiens; identical to SEQ ID NO: 73130
  chr11:64010257-64010297
  Hypo

SEQ ID NO: 106435 - DNA, 80 bp, Homo sapiens; identical to SEQ ID NO: 73131
  chr11:64039207-64039287
  Hyper

SEQ ID NO: 106436 - DNA, 67 bp, Homo sapiens; identical to SEQ ID NO: 73132
  chr11:64042943-64043010
  Hypo

SEQ ID NO: 106437 - DNA, 99 bp, Homo sapiens; identical to SEQ ID NO: 73133
  chr11:64054286-64054385
  Hypo

SEQ ID NO: 106438 - DNA, 1379 bp, Homo sapiens
  chr11:64058814-64060193
  Hyper
gttgcggacccttcccgatccggtaatgggcctgggagatgccagattagcgtggtgcctgtccggagagacgggccagctgatgcccaggtcggggccctgccgctggccacactgggctccggtccaaggctagaaggctggcccctgctgcaacccctctccggctcctctgccacccacctcccggggctggccggctgtggggagccaggcggccgcaggtaaacggcttggggcggcgccggcggcgagggcgctgcacggagggaagcgcggcgccggaggggttaaccgcgggaggaggggggcttctgccggcgggaggggggtcccagccccggcggccgcccgctccgcccctgccgcctccgcggcccagtcggcaccggcgaggccgtgctggaacccgggcctcagccgcagccgcagcggggccgacagtaagtgcggtgcgggctccggtgcgcgggcaggactcaggggcagggacgccccaggggcgactggccgggcggggtgcccacctctcgcgcgtgggcgcctccgggagtggtgtggccgccggtcccgccgcccgccacgctccgaggcgtcgctgtgcggacgcgggggaggcggtgggagcgagctgcgggcgctgcgcggtggccctgctgtctggcgtgtgcacgctagtgtccacacacgtgtgcgtgggctctgggtgccctggcgcggccggcacgcccatgggggccggggatgccggggcgtctgcggagagtgcaggtggggtgcgtgcgtgcagcggggcggcgcggcgctgcagcctcgggatggagcgtgggcgcgcgggtctttgtgcccgcgcttggcggcgcgtgccggggcgtgtgtgcgcgtgggcgccgccgcccgctgtctcggactgacagctgtctcgggggctgtcgccccggtgtggcctttgcggacccccgccccgctttttccgggaactgggcgtccccagcacccctcctcgcctgggtgcggcggccgggacccgcccctgggttcctcgaaagcccggcggggcgcgggggcaccctggagggccagccaggaagcagggcgaggcgagaggggacggagaagccgcggagatgctgtcacagccgcagcgggcgagcagggacccaccattcccctgtccccgccttgcgctgtccggcctctcctccgggtttcccttcggacgcctccgagccccctcagcctcctcctcgagggccagctccccgcacccccaccaagctccacacatttcctcgctcgccccgcttccccctaggcaggcttaggctctctttcggcctcccactcgccttcctttcccttctcggtgccctcctctc

SEQ ID NO: 106439 - DNA, 420 bp, Homo sapiens; identical to SEQ ID NO: 73136
  chr11:64066842-64067262
  Hyper

SEQ ID NO: 106440 - DNA, 215 bp, Homo sapiens; identical to SEQ ID NO: 73137
  chr11:64105859-64106074
  Hypo

SEQ ID NO: 106441 - DNA, 108 bp, Homo sapiens
  chr11:64108263-64108371
  Hyper
tgagaggaggggaagcgggtgggcggagcctgatgctcagtgggcggggcctgagggacggtgggcgaggcctgttgacgggaggcgggtcctcgagcccacctccgg

SEQ ID NO: 106442 - DNA, 95 bp, Homo sapiens; identical to SEQ ID NO: 73139
  chr11:64117072-64117167
  Hypo

SEQ ID NO: 106443 - DNA, 105 bp, Homo sapiens; identical to SEQ ID NO: 73140
  chr11:64120222-64120327
  Hypo

SEQ ID NO: 106444 - DNA, 126 bp, Homo sapiens; identical to SEQ ID NO: 73141
  chr11:64120822-64120948
  Hypo

SEQ ID NO: 106445 - DNA, 30 bp, Homo sapiens; identical to SEQ ID NO: 73142
  chr11:64124074-64124104
  Hypo

SEQ ID NO: 106446 - DNA, 88 bp, Homo sapiens; identical to SEQ ID NO: 73143
  chr11:64124704-64124792
  Hypo

SEQ ID NO: 106447 - DNA, 66 bp, Homo sapiens; identical to SEQ ID NO: 73144
  chr11:64129402-64129468
  Hypo

SEQ ID NO: 106448 - DNA, 41 bp, Homo sapiens; identical to SEQ ID NO: 73145
  chr11:64140397-64140438
  Hypo

SEQ ID NO: 106449 - DNA, 30 bp, Homo sapiens; identical to SEQ ID NO: 73146
  chr11:64147610-64147640
  Hypo

SEQ ID NO: 106450 - DNA, 104 bp, Homo sapiens; identical to SEQ ID NO: 73147
  chr11:64168551-64168655
  Hypo

SEQ ID NO: 106451 - DNA, 21 bp, Homo sapiens
  chr11:64184141-64184162
  Hypo
aagaatgaggctgggcgcggt

SEQ ID NO: 106452 - DNA, 76 bp, Homo sapiens; identical to SEQ ID NO: 73149
  chr11:64187500-64187576
  Hypo

SEQ ID NO: 106453 - DNA, 209 bp, Homo sapiens; identical to SEQ ID NO: 73150
  chr11:64292291-64292500
  Hypo

SEQ ID NO: 106454 - DNA, 44 bp, Homo sapiens; identical to SEQ ID NO: 73151
  chr11:64313087-64313131
  Hypo

SEQ ID NO: 106455 - DNA, 62 bp, Homo sapiens; identical to SEQ ID NO: 73152
  chr11:64323679-64323741
  Hypo

SEQ ID NO: 106456 - DNA, 126 bp, Homo sapiens; identical to SEQ ID NO: 73153
  chr11:64361015-64361141
  Hypo

SEQ ID NO: 106457 - DNA, 522 bp, Homo sapiens
  chr11:64409914-64410436
  Hyper
agctggggtggggcccgcgggggcccagctgcgcacacgggaagcgccccccgcccccgggccaaccgggtggccggcatctacagtgccacttaccgtggccgccgcgggtgaggaagggcatgcggttgatggcgatgggcacggtgccgtgcttgctgtggaagtggtggacgtggtgggtggtgctgaggctggaggagacccgggccccctcggccgcccccagcagcaacagcagcaacagcggcaacagcggcagcagaggtggcggcggcggcggtggaggcggcggcaggggcccagccagggccggggggcggcgcgggcacccccccggcccgctccccccggggggcatttcggcccgggggcgaccgcctcacagccccatggccgggggcggggacgcggggctgcgcagccccgcgaagcccccctccggctccgagctccgggagcggggtagggatgaagcggaggtaaaccagggcccaagcctcggtccggagccaacaaaat

SEQ ID NO: 106458 - DNA, 359 bp, Homo sapiens; identical to SEQ ID NO: 73156
  chr11:64410638-64410997
  Hyper

SEQ ID NO: 106459 - DNA, 30 bp, Homo sapiens; identical to SEQ ID NO: 73157
  chr11:64411442-64411472
  Hyper

SEQ ID NO: 106460 - DNA, 257 bp, Homo sapiens; identical to SEQ ID NO: 73158
  chr11:64478747-64479004
  Hyper

SEQ ID NO: 106461 - DNA, 1003 bp, Homo sapiens
  chr11:64480253-64481256
  Hyper
ccaccgccaaccccacgcgccctcgcccggacacgcgtccccgcagccctggagcgctcgcacccactcacaagccctcgtgcccagcccccgtgcctcaggagcccacacacactccgacccccacgaagcgccccaggccctcacccccgcgcccaggcaccgggcggccgctccccggggctcaccttcgctgcagaacttgccgccgaagcccgtgtggctgcagtcgcagcccacctcgccgggggccagcacggtgcagaggccgccgttggcgcaggggttgcgcgcgggcgcgcacagcgggtcggcggtggcgccgcgcaggccctggctgcccagcagcgcggggggccgctcgcccagcttcaggttggccaagaggccgcggaagggcggctcgtacttgacggtgctcagcgtaagcgccgagaggcgcacgtcgggcgggatgccgcccacgaacaggtcgctggccacctgcatctcgcgccgcttggagcgcacctcggcggcgcgggcctcgccgtccaccgccagcgccgtgcggcgcgcgtcgcgggtcagcagcaccatgtgccagcggtcgtcggccaccggcgtgtccagctgcagcgtggccggctcggcgcacgaaagcgtgaagcgcagccgcaggcggccgtccaccagcagcagctccaggaagtcgcagtcgccgccgtcgtccaggtagagcagcagcgcgcgcgtggcgttggtgcgcaggctgaagctgagctcgccgctgctcgccgcgcccgcccagcgcgcgtagcgagcccactgcccggggccgccgccgaactccaggccgtccgcgcgcgccgccagcgccagcagcagcagcaacagcagcggcggcggtgtcggccgccaccggctcccggacgccatgcctacggcggccccggccccgcccggcccccggcccccgctcaggcttcagagccgcgggcgcatggggcgggagggggccggg

SEQ ID NO: 106462 - DNA, 214 bp, Homo sapiens; identical to SEQ ID NO: 73161
  chr11:64488458-64488672
  Hypo

SEQ ID NO: 106463 - DNA, 33 bp, Homo sapiens; identical to SEQ ID NO: 73162
  chr11:64496441-64496474
  Hypo

SEQ ID NO: 106464 - DNA, 30 bp, Homo sapiens; identical to SEQ ID NO: 43124
  chr11:64507459-64507489
  Hypo

SEQ ID NO: 106465 - DNA, 30 bp, Homo sapiens; identical to SEQ ID NO: 73164
  chr11:64508029-64508059
  Hypo

SEQ ID NO: 106466 - DNA, 202 bp, Homo sapiens; identical to SEQ ID NO: 73165
  chr11:64511882-64512084
  Hyper

SEQ ID NO: 106467 - DNA, 850 bp, Homo sapiens; identical to SEQ ID NO: 73166
  chr11:64512898-64513748
  Hyper

SEQ ID NO: 106468 - DNA, 43 bp, Homo sapiens; identical to SEQ ID NO: 73167
  chr11:64572043-64572086
  Hypo

SEQ ID NO: 106469 - DNA, 80 bp, Homo sapiens; identical to SEQ ID NO: 73168
  chr11:64578524-64578604
  Hypo

SEQ ID NO: 106470 - DNA, 58 bp, Homo sapiens; identical to SEQ ID NO: 73169
  chr11:64609349-64609407
  Hypo

SEQ ID NO: 106471 - DNA, 53 bp, Homo sapiens; identical to SEQ ID NO: 73170
  chr11:64610107-64610160
  Hypo

SEQ ID NO: 106472 - DNA, 87 bp, Homo sapiens; identical to SEQ ID NO: 43128
  chr11:64667987-64668074
  Hypo

SEQ ID NO: 106473 - DNA, 96 bp, Homo sapiens; identical to SEQ ID NO: 43129
  chr11:64669480-64669576
  Hypo

SEQ ID NO: 106474 - DNA, 30 bp, Homo sapiens; identical to SEQ ID NO: 73173
  chr11:64733479-64733509
  Hypo

SEQ ID NO: 106475 - DNA, 602 bp, Homo sapiens; identical to SEQ ID NO: 73174
  chr11:64739234-64739836
  Hyper

SEQ ID NO: 106476 - DNA, 30 bp, Homo sapiens; identical to SEQ ID NO: 73175
  chr11:64766930-64766960
  Hypo

SEQ ID NO: 106477 - DNA, 19 bp, Homo sapiens
  chr11:64774608-64774627
  Hypo
gagcacagcagctcacgcc

SEQ ID NO: 106478 - DNA, 30 bp, Homo sapiens; identical to SEQ ID NO: 73177
  chr11:64794372-64794402
  Hypo

SEQ ID NO: 106479 - DNA, 152 bp, Homo sapiens; identical to SEQ ID NO: 73178
  chr11:64809453-64809605
  Hypo

SEQ ID NO: 106480 - DNA, 31 bp, Homo sapiens; identical to SEQ ID NO: 73179
  chr11:64809845-64809876
  Hypo

SEQ ID NO: 106481 - DNA, 30 bp, Homo sapiens; identical to SEQ ID NO: 73180
  chr11:64825805-64825835
  Hypo

SEQ ID NO: 106482 - DNA, 337 bp, Homo sapiens; identical to SEQ ID NO: 73181
  chr11:64875821-64876158
  Hypo

SEQ ID NO: 106483 - DNA, 96 bp, Homo sapiens; identical to SEQ ID NO: 73182
  chr11:64878797-64878893
  Hypo

SEQ ID NO: 106484 - DNA, 30 bp, Homo sapiens; identical to SEQ ID NO: 73183
  chr11:64879104-64879134
  Hyper

SEQ ID NO: 106485 - DNA, 200 bp, Homo sapiens; identical to SEQ ID NO: 73184
  chr11:64883895-64884095
  Hypo

SEQ ID NO: 106486 - DNA, 29 bp, Homo sapiens
  chr11:64888917-64888946
  Hyper
ccacactcactagacgcttaccggtactt

SEQ ID NO: 106487 - DNA, 79 bp, Homo sapiens; identical to SEQ ID NO: 73185
  chr11:64903249-64903328
  Hypo

SEQ ID NO: 106488 - DNA, 19 bp, Homo sapiens
  chr11:64903448-64903467
  Hypo
caggcgtgagccacaacac

SEQ ID NO: 106489 - DNA, 30 bp, Homo sapiens; identical to SEQ ID NO: 73187
  chr11:64937648-64937678
  Hypo

SEQ ID NO: 106490 - DNA, 135 bp, Homo sapiens; identical to SEQ ID NO: 73188
  chr11:64950220-64950355
  Hypo

SEQ ID NO: 106491 - DNA, 159 bp, Homo sapiens; identical to SEQ ID NO: 73189
  chr11:64951735-64951894
  Hypo

SEQ ID NO: 106492 - DNA, 72 bp, Homo sapiens; identical to SEQ ID NO: 73191
  chr11:64975460-64975532
  Hypo

SEQ ID NO: 106493 - DNA, 72 bp, Homo sapiens; identical to SEQ ID NO: 73192
  chr11:64977462-64977534
  Hypo

SEQ ID NO: 106494 - DNA, 144 bp, Homo sapiens; identical to SEQ ID NO: 73193
  chr11:65028520-65028664
  Hypo

SEQ ID NO: 106495 - DNA, 151 bp, Homo sapiens; identical to SEQ ID NO: 73194
  chr11:65091310-65091461
  Hypo

SEQ ID NO: 106496 - DNA, 205 bp, Homo sapiens; identical to SEQ ID NO: 73195
  chr11:65127486-65127691
  Hypo

SEQ ID NO: 106497 - DNA, 30 bp, Homo sapiens; identical to SEQ ID NO: 73196
  chr11:65168665-65168695
  Hypo

SEQ ID NO: 106498 - DNA, 30 bp, Homo sapiens; identical to SEQ ID NO: 73197
  chr11:65182751-65182781
  Hypo

SEQ ID NO: 106499 - DNA, 585 bp, Homo sapiens; identical to SEQ ID NO: 73198
  chr11:65185143-65185728
  Hyper

SEQ ID NO: 106500 - DNA, 30 bp, Homo sapiens; identical to SEQ ID NO: 73199
  chr11:65192943-65192973
  Hyper

SEQ ID NO: 106501 - DNA, 209 bp, Homo sapiens; identical to SEQ ID NO: 73200
  chr11:65197681-65197890
  Hyper

SEQ ID NO: 106502 - DNA, 30 bp, Homo sapiens; identical to SEQ ID NO: 73201
  chr11:65259108-65259138
  Hypo

SEQ ID NO: 106503 - DNA, 28 bp, Homo sapiens
  chr11:65276916-65276944
  Hypo
gagccaccgatcccggcccacagttttg

SEQ ID NO: 106504 - DNA, 44 bp, Homo sapiens; identical to SEQ ID NO: 73203
  chr11:65306381-65306425
  Hypo

SEQ ID NO: 106505 - DNA, 30 bp, Homo sapiens; identical to SEQ ID NO: 73204
  chr11:65306775-65306805
  Hypo

SEQ ID NO: 106506 - DNA, 203 bp, Homo sapiens; identical to SEQ ID NO: 73205
  chr11:65309028-65309231
  Hypo

SEQ ID NO: 106507 - DNA, 30 bp, Homo sapiens; identical to SEQ ID NO: 73206
  chr11:65360776-65360806
  Hypo

SEQ ID NO: 106508 - DNA, 79 bp, Homo sapiens; identical to SEQ ID NO: 73207
  chr11:65405437-65405516
  Hyper

SEQ ID NO: 106509 - DNA, 251 bp, Homo sapiens; identical to SEQ ID NO: 73208
  chr11:65413862-65414113
  Hypo

SEQ ID NO: 106510 - DNA, 30 bp, Homo sapiens; identical to SEQ ID NO: 43146
  chr11:65463016-65463046
  Hypo

SEQ ID NO: 106511 - DNA, 83 bp, Homo sapiens; identical to SEQ ID NO: 43147
  chr11:65478528-65478611
  Hypo

SEQ ID NO: 106512 - DNA, 104 bp, Homo sapiens; identical to SEQ ID NO: 73211
  chr11:65511076-65511180
  Hypo

SEQ ID NO: 106513 - DNA, 66 bp, Homo sapiens; identical to SEQ ID NO: 73212
  chr11:65511418-65511484
  Hypo

SEQ ID NO: 106514 - DNA, 154 bp, Homo sapiens; identical to SEQ ID NO: 43150
  chr11:65551581-65551735
  Hypo

SEQ ID NO: 106515 - DNA, 145 bp, Homo sapiens
  chr11:65553972-65554117
  Hyper
tttgggatcccgcgccgcctgggcccaggcccggttcaacaagtgcggaccgggccgcccgttcccgcccggcggcttcgcgcctccccaggagcctcgggcgcgccgggttgggccggccccagtggggcgagtttcgtgtcat

SEQ ID NO: 106516 - DNA, 86 bp, Homo sapiens; identical to SEQ ID NO: 73215
  chr11:65554637-65554723
  Hyper

SEQ ID NO: 106517 - DNA, 170 bp, Homo sapiens; identical to SEQ ID NO: 73216
  chr11:65577359-65577529
  Hypo

SEQ ID NO: 106518 - DNA, 908 bp, Homo sapiens
  chr11:65600749-65601657
  Hyper
ccccaggttttctctcgcagcatcggcacccccttgcagccccgctccagtggcgaccgttcgcggaccccggcctcgcttggggcgccctggccgcgggacttgtggagctccctagtcctcctaggctgcttaccccgccgctccctcccgtccaagagcggaaacctaaacagaccccccttctccacagacattgtcccctgccctcgcccctggtccaccacccacatccccaccactgcttcccattccctgtccccaccctgccaccctcaccctcttccccttccccttccccttccccactgcctggtgggcgccaaactgggcgagtgcgcacgcgcaggccgcacgtggccgttggaaggaggggcccggaacggcggcacggggttgttgtgggggtcagtcccccggggactggagggagacgcggcacgcggcctctgcgaccctatgaactctgaccccagctcccacactgtcgcctatcaccggcccactctccgtgccgcgtgtcccttaaaagctggggcctgggacaggaacgacagacaatgcagccaatggcgtcacgcgcggtgccccgctacccaatcgaaaggcgtggctgagggaaacgcggtgggaaccgcccccgactccaggcgactccttggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaaggtagagaaaggatgaagacccccaccccagcctcccctcactccatgaaagcccgtgatgcccaatcatgcggtggtgtgtgtgt

SEQ ID NO: 106519 - DNA, 137 bp, Homo sapiens; identical to SEQ ID NO: 73219
  chr11:65629450-65629587
  Hypo

SEQ ID NO: 106520 - DNA, 99 bp, Homo sapiens; identical to SEQ ID NO: 73220
  chr11:65640238-65640337
  Hyper

SEQ ID NO: 106521 - DNA, 21 bp, Homo sapiens
  chr11:65665095-65665116
  Hypo
ccacagcgcccagcctagtat

SEQ ID NO: 106522 - DNA, 68 bp, Homo sapiens; identical to SEQ ID NO: 73222
  chr11:65666703-65666771
  Hyper

SEQ ID NO: 106523 - DNA, 243 bp, Homo sapiens; identical to SEQ ID NO: 73223
  chr11:65667149-65667392
  Hyper

SEQ ID NO: 106524 - DNA, 30 bp, Homo sapiens; identical to SEQ ID NO: 73224
  chr11:65677170-65677200
  Hypo

SEQ ID NO: 106525 - DNA, 212 bp, Homo sapiens; identical to SEQ ID NO: 73225
  chr11:65684960-65685172
  Hypo

SEQ ID NO: 106526 - DNA, 30 bp, Homo sapiens; identical to SEQ ID NO: 73226
  chr11:65721988-65722018
  Hypo

SEQ ID NO: 106527 - DNA, 36 bp, Homo sapiens; identical to SEQ ID NO: 73227
  chr11:65722778-65722814
  Hypo

SEQ ID NO: 106528 - DNA, 30 bp, Homo sapiens; identical to SEQ ID NO: 43154
  chr11:65741409-65741439
  Hypo

SEQ ID NO: 106529 - DNA, 398 bp, Homo sapiens; identical to SEQ ID NO: 73229
  chr11:65779206-65779604
  Hyper

SEQ ID NO: 106530 - DNA, 272 bp, Homo sapiens
  chr11:65816447-65816719
  Hyper
cctccaaccccatgccggccactgcagtactcacaccgcacgcctgggctctgcctctggcccgggttgggggcggccgccgctatctctggacccttgtctcgaaatccgcacggggtccgagggtgcccggggccctgcgcgccgagtgccggtggcttgcctctcagcgcctggatgggatcaggtggcagcgtccgctaggctcgctcctcccggctctgcccgccccccgccccccgccccccatcgcacaccggaggaaggcgagg

SEQ ID NO: 106531 - DNA, 30 bp, Homo sapiens; identical to SEQ ID NO: 73232
  chr11:65901677-65901707
  Hypo

SEQ ID NO: 106532 - DNA, 166 bp, Homo sapiens; identical to SEQ ID NO: 73233
  chr11:66048056-66048222
  Hypo

SEQ ID NO: 106533 - DNA, 217 bp, Homo sapiens; identical to SEQ ID NO: 73234
  chr11:66059146-66059363
  Hyper

SEQ ID NO: 106534 - DNA, 33 bp, Homo sapiens; identical to SEQ ID NO: 73235
  chr11:66059580-66059613
  Hyper

SEQ ID NO: 106535 - DNA, 60 bp, Homo sapiens; identical to SEQ ID NO: 73236
  chr11:66101601-66101661
  Hypo

SEQ ID NO: 106536 - DNA, 30 bp, Homo sapiens; identical to SEQ ID NO: 73237
  chr11:66114013-66114043
  Hypo

SEQ ID NO: 106537 - DNA, 86 bp, Homo sapiens; identical to SEQ ID NO: 73238
  chr11:66147017-66147103
  Hypo

SEQ ID NO: 106538 - DNA, 68 bp, Homo sapiens; identical to SEQ ID NO: 73239
  chr11:66186333-66186401
  Hyper

SEQ ID NO: 106539 - DNA, 107 bp, Homo sapiens; identical to SEQ ID NO: 73240
  chr11:66187360-66187467
  Hyper

SEQ ID NO: 106540 - DNA, 30 bp, Homo sapiens; identical to SEQ ID NO: 73241
  chr11:66187796-66187826
  Hyper

SEQ ID NO: 106541 - DNA, 1054 bp, Homo sapiens
  chr11:66188095-66189149
  Hyper
aattagtgtcagtgccggcccctctctgccctctgcggactcctgccgcgggcttcaggccgccctaaacctggccctgtcgcttccctcaactgaacgcattcagacgccagggtccccacactccattcaagctttcctaacgcagcgccttcctctccgctcagctcccgccaggcttggccccctccgcagcctcctgctcccccctcgcccgcctccctccctctctcattctacgtcatgagatgacgtcggaagccgggcgggaggaggagcccccctccccagtcagcggctcccgctgcagcttgcttagcccagcctcccgctctcccgcccccccggctctaaaacgagccccccacgcctggcaggagctatataaggcggcgtgaggcaggcgaggggggcagcgcagccgagcggagcccaggagagcagagagcgagcctgagcgagagacggggaagcacggaggaggaagccgccggtgcgtcgggacgggagcgcaggtgctcgggcacccgagctggagctccgcagccgccggtcatgtaccgctccaccaagggcgcctccaaggcgcgccgggaccagatcaacgccgagatccggaacctcaaggagctgctgccgctggccgaagcggacaaggtccggctgtcctacctgcacatcatgagcctcgcctgcatctacactcgcaagggcgtcttcttcgctggtggtgagcatgctggggctaccgcagatccgagctgccaggcgccggagaccctggagctgagggaacccgctggggctgtcgcatgtctagggcagcgtgctggcgagctggggagattcgggactcgggagattcgggactttctacttttcctcctgagctccctccagacctcaccttagttctgaatgagagttagagagcctggacggtgtccctaacaccagattatgagaggataagagccaggacagagcggcctcggtgcccgccagtgcagaagcgctccgggagccggggagggaagcccgggaagttgcaggg

SEQ ID NO: 106542 - DNA, 33 bp, Homo sapiens; identical to SEQ ID NO: 43156
  chr11:66324511-66324544
  Hypo

SEQ ID NO: 106543 - DNA, 167 bp, Homo sapiens; identical to SEQ ID NO: 73246
  chr11:66325229-66325396
  Hypo

SEQ ID NO: 106544 - DNA, 39 bp, Homo sapiens; identical to SEQ ID NO: 73247
  chr11:66327260-66327299
  Hypo

SEQ ID NO: 106545 - DNA, 35 bp, Homo sapiens; identical to SEQ ID NO: 73248
  chr11:66332091-66332126
  Hypo

SEQ ID NO: 106546 - DNA, 30 bp, Homo sapiens; identical to SEQ ID NO: 73249
  chr11:66346865-66346895
  Hyper

SEQ ID NO: 106547 - DNA, 33 bp, Homo sapiens; identical to SEQ ID NO: 73250
  chr11:66347133-66347166
  Hypo

SEQ ID NO: 106548 - DNA, 30 bp, Homo sapiens; identical to SEQ ID NO: 73251
  chr11:66410982-66411012
  Hypo

SEQ ID NO: 106549 - DNA, 189 bp, Homo sapiens; identical to SEQ ID NO: 43158
  chr11:66411368-66411557
  Hypo

SEQ ID NO: 106550 - DNA, 30 bp, Homo sapiens; identical to SEQ ID NO: 73253
  chr11:66454424-66454454
  Hypo

SEQ ID NO: 106551 - DNA, 51 bp, Homo sapiens; identical to SEQ ID NO: 73254
  chr11:66494819-66494870
  Hyper

SEQ ID NO: 106552 - DNA, 156 bp, Homo sapiens; identical to SEQ ID NO: 43159
  chr11:66511194-66511350
  Hypo

SEQ ID NO: 106553 - DNA, 94 bp, Homo sapiens; identical to SEQ ID NO: 43160
  chr11:66513159-66513253
  Hypo

SEQ ID NO: 106554 - DNA, 93 bp, Homo sapiens; identical to SEQ ID NO: 43161
  chr11:66513553-66513646
  Hypo

SEQ ID NO: 106555 - DNA, 16 bp, Homo sapiens
  chr11:66515380-66515396
  Hypo
gcgcagggcagcatta

SEQ ID NO: 106556 - DNA, 82 bp, Homo sapiens; identical to SEQ ID NO: 43163
  chr11:66557367-66557449
  Hypo

SEQ ID NO: 106557 - DNA, 1097 bp, Homo sapiens; identical to SEQ ID NO: 73260
  chr11:66625090-66626187
  Hypo

SEQ ID NO: 106558 - DNA, 410 bp, Homo sapiens; identical to SEQ ID NO: 73261
  chr11:66626525-66626935
  Hypo

SEQ ID NO: 106559 - DNA, 79 bp, Homo sapiens; identical to SEQ ID NO: 73262
  chr11:66627238-66627317
  Hypo

SEQ ID NO: 106560 - DNA, 573 bp, Homo sapiens; identical to SEQ ID NO: 73263
  chr11:66631279-66631852
  Hypo

SEQ ID NO: 106561 - DNA, 94 bp, Homo sapiens; identical to SEQ ID NO: 73264
  chr11:66633739-66633833
  Hypo

SEQ ID NO: 106562 - DNA, 143 bp, Homo sapiens; identical to SEQ ID NO: 73265
  chr11:66637063-66637206
  Hypo

SEQ ID NO: 106563 - DNA, 144 bp, Homo sapiens; identical to SEQ ID NO: 73266
  chr11:66648961-66649105
  Hypo

SEQ ID NO: 106564 - DNA, 30 bp, Homo sapiens; identical to SEQ ID NO: 73267
  chr11:66658260-66658290
  Hypo

SEQ ID NO: 106565 - DNA, 78 bp, Homo sapiens; identical to SEQ ID NO: 73268
  chr11:66683635-66683713
  Hypo

SEQ ID NO: 106566 - DNA, 17 bp, Homo sapiens
  chr11:66683833-66683850
  Hypo
ggcgtgagccactgtga

SEQ ID NO: 106567 - DNA, 408 bp, Homo sapiens; identical to SEQ ID NO: 73270
  chr11:66725945-66726353
  Hyper

SEQ ID NO: 106568 - DNA, 978 bp, Homo sapiens
  chr11:66790528-66791506
  Hyper
acccctgtccccaggcgtgggagcgaggggttgggcttggcctcagggcgtccctggatcccggacgcgcttggggatctccggctcggaccccaggagcagagacagcgctcgagcttgtcactttaaattcaagagggagcgggcgggcaagcgggcgagcgcgagggagcgcgcggcgggctcctgggagcgtgcccggactgcggcgcagctccggtccgccgccccggcccggccgagcccccggcccgcgccgcgctcctcggaggcgggagcccggcgacactgcaggggtggcgttgccgccggcggccgggctaggcgcaggtgcgtgcgcgctgcgggaggcgggccggcagctggagcccagccggagcggcggcccctccgcggagcccgggtgagtacgcaccccgccgacccccgtgcgcggccgggatcgcaccctgatcgcggacgcacgcagccccctcctcgggccctgggcccgggaccccagagccccgcgcactccgcgctcctgcacctccgcgccgcgcttgcacacgaacgaatgccgggcaccgcgcacgctgggcgcccttacccggcccggccactccgcgcagtgcgcatcgcatcgcacgccccgcatgtgcacacacgcggctcacccggccatttacacgcctccccgcgcccacgctgcacacacgcccctcactttcgcattcagcgccctgactgtcctcactgtccctgctctggcttcgcaccccctcccgacactccggtccccatacaccctggaggttcccgaggcaggagcgctgggtctgcaggaaccgtcccaatctggaggggaacgttgcaccccagcccgaggaggccctggccgtgtgaagagccagatatgaccctcagccgccggtggcaccagcctgagtggggggctttccagagcttaggagaggggtatggcggggcaggggagga

SEQ ID NO: 106569 - DNA, 241 bp, Homo sapiens; identical to SEQ ID NO: 73276
  chr11:66824362-66824603
  Hyper

SEQ ID NO: 106570 - DNA, 307 bp, Homo sapiens
  chr11:66885504-66885811
  Hyper
ccagggcggcagggtcgggccgggggccgggggcggcccgcgcacccctccgtggggggcgccccgactcgccgggggcggggtcacgtcccacccgggccgccgggggcaccggcgcggcggaaagctgagcgtggccgaggagcgggggcttcctgggccacctcgccgggcgcctccggccggcggtgggcgcgccggccgccaccgcccccgggccgtcgcggagaccgcttctgcgcctggtacctgtggacgcccttgttaagcgcctgcagcacccccggggagccgagcccaggacaga

SEQ ID NO: 106571 - DNA, 180 bp, Homo sapiens; identical to SEQ ID NO: 73277
  chr11:66897583-66897763
  Hypo

SEQ ID NO: 106572 - DNA, 42 bp, Homo sapiens; identical to SEQ ID NO: 73278
  chr11:66897883-66897925
  Hypo

SEQ ID NO: 106573 - DNA, 295 bp, Homo sapiens; identical to SEQ ID NO: 43169
  chr11:67072101-67072396
  Hypo

SEQ ID NO: 106574 - DNA, 183 bp, Homo sapiens; identical to SEQ ID NO: 73280
  chr11:67179695-67179878
  Hypo

SEQ ID NO: 106575 - DNA, 264 bp, Homo sapiens; identical to SEQ ID NO: 73281
  chr11:67209957-67210221
  Hypo

SEQ ID NO: 106576 - DNA, 217 bp, Homo sapiens; identical to SEQ ID NO: 73282
  chr11:67230800-67231017
  Hypo

SEQ ID NO: 106577 - DNA, 206 bp, Homo sapiens; identical to SEQ ID NO: 73283
  chr11:67232077-67232283
  Hyper

SEQ ID NO: 106578 - DNA, 36 bp, Homo sapiens; identical to SEQ ID NO: 73284
  chr11:67258422-67258458
  Hypo

SEQ ID NO: 106579 - DNA, 30 bp, Homo sapiens; identical to SEQ ID NO: 73285
  chr11:67291596-67291626
  Hypo

SEQ ID NO: 106580 - DNA, 51 bp, Homo sapiens
  chr11:67350939-67350990
  Hyper
gctccgggatcgcagcggtcttagggaatttccccccgcgatgtcccggcg

SEQ ID NO: 106581 - DNA, 30 bp, Homo sapiens; identical to SEQ ID NO: 73287
  chr11:67378945-67378975
  Hypo

SEQ ID NO: 106582 - DNA, 155 bp, Homo sapiens; identical to SEQ ID NO: 73288
  chr11:67402314-67402469
  Hypo

SEQ ID NO: 106583 - DNA, 32 bp, Homo sapiens; identical to SEQ ID NO: 73289
  chr11:67408869-67408901
  Hypo

SEQ ID NO: 106584 - DNA, 128 bp, Homo sapiens; identical to SEQ ID NO: 73290
  chr11:67442012-67442140
  Hypo

SEQ ID NO: 106585 - DNA, 215 bp, Homo sapiens; identical to SEQ ID NO: 73291
  chr11:67462618-67462833
  Hypo

SEQ ID NO: 106586 - DNA, 573 bp, Homo sapiens
  chr11:67478792-67479365
  Hyper
ataggaggtgcaaagcgcggtcacacgcggcccgggtccgcggccgacagctgggaggatctggagcggggccgggtcgcaagaagaccctgaccctgctcccgcgctggggcgcgtgctaagggcccgcagggtttcagctgtattttcgaacccctgtgcttggccgaggggttcccaaggctccactccgccttggagggggctgcggaagcccggaggtgacccgggctctgggaggggcgtccccaatgtgggggaggggagacaggggcctttgaatacagcgcgggactcagagggggtccccccgacctaagacgtggtaaactgaggccggcgaggagggaggctgagtccggggaccaggcggcccctcactgctcctccggtccgtctcccctctgcgcctgttcgtacgggcagggccggcggccgagtccagcgggctcggggccaggcctgggccccgcgggcggcgcctcctcctccgcgccgtccccatgctcgtcctcagcgtcgctctcctccgagttgtcctccaagtagcggtaaccgcgcaccttgtgctgg

SEQ ID NO: 106587 - DNA, 232 bp, Homo sapiens; identical to SEQ ID NO: 73294
  chr11:67764062-67764294
  Hypo

SEQ ID NO: 106588 - DNA, 147 bp, Homo sapiens; identical to SEQ ID NO: 15585
  chr11:67781462-67781609
  Hypo

SEQ ID NO: 106589 - DNA, 146 bp, Homo sapiens; identical to SEQ ID NO: 73296
  chr11:67797137-67797283
  Hypo

SEQ ID NO: 106590 - DNA, 154 bp, Homo sapiens; identical to SEQ ID NO: 73297
  chr11:67811705-67811859
  Hypo

SEQ ID NO: 106591 - DNA, 23 bp, Homo sapiens
  chr11:67865088-67865111
  Hypo
caagactccgtctcaaaaaaaaa

SEQ ID NO: 106592 - DNA, 405 bp, Homo sapiens; identical to SEQ ID NO: 73299
  chr11:67895795-67896200
  Hyper

SEQ ID NO: 106593 - DNA, 187 bp, Homo sapiens; identical to SEQ ID NO: 73300
  chr11:67915941-67916128
  Hypo

SEQ ID NO: 106594 - DNA, 68 bp, Homo sapiens; identical to SEQ ID NO: 73301
  chr11:67984320-67984388
  Hypo

SEQ ID NO: 106595 - DNA, 45 bp, Homo sapiens; identical to SEQ ID NO: 73302
  chr11:68096122-68096167
  Hyper

SEQ ID NO: 106596 - DNA, 154 bp, Homo sapiens; identical to SEQ ID NO: 15587
  chr11:68111091-68111245
  Hypo

SEQ ID NO: 106597 - DNA, 236 bp, Homo sapiens; identical to SEQ ID NO: 73304
  chr11:68132977-68133213
  Hypo

SEQ ID NO: 106598 - DNA, 30 bp, Homo sapiens; identical to SEQ ID NO: 73305
  chr11:68133516-68133546
  Hypo

SEQ ID NO: 106599 - DNA, 81 bp, Homo sapiens; identical to SEQ ID NO: 73306
  chr11:68210051-68210132
  Hypo

SEQ ID NO: 106600 - DNA, 76 bp, Homo sapiens; identical to SEQ ID NO: 73307
  chr11:68225302-68225378
  Hypo

SEQ ID NO: 106601 - DNA, 42 bp, Homo sapiens; identical to SEQ ID NO: 73308
  chr11:68226707-68226749
  Hypo

SEQ ID NO: 106602 - DNA, 82 bp, Homo sapiens; identical to SEQ ID NO: 43183
  chr11:68385159-68385241
  Hypo

SEQ ID NO: 106603 - DNA, 201 bp, Homo sapiens; identical to SEQ ID NO: 73310
  chr11:68385532-68385733
  Hypo

SEQ ID NO: 106604 - DNA, 30 bp, Homo sapiens; identical to SEQ ID NO: 73311
  chr11:68400244-68400274
  Hypo

SEQ ID NO: 106605 - DNA, 30 bp, Homo sapiens; identical to SEQ ID NO: 73312
  chr11:68409085-68409115
  Hypo

SEQ ID NO: 106606 - DNA, 38 bp, Homo sapiens; identical to SEQ ID NO: 73313
  chr11:68409607-68409645
  Hypo

SEQ ID NO: 106607 - DNA, 30 bp, Homo sapiens; identical to SEQ ID NO: 43185
  chr11:68412854-68412884
  Hypo

SEQ ID NO: 106608 - DNA, 197 bp, Homo sapiens; identical to SEQ ID NO: 73315
  chr11:68417837-68418034
  Hypo

SEQ ID NO: 106609 - DNA, 41 bp, Homo sapiens; identical to SEQ ID NO: 73316
  chr11:68418419-68418460
  Hypo

SEQ ID NO: 106610 - DNA, 242 bp, Homo sapiens; identical to SEQ ID NO: 43187
  chr11:68432989-68433231
  Hypo

SEQ ID NO: 106611 - DNA, 456 bp, Homo sapiens; identical to SEQ ID NO: 73318
  chr11:68437415-68437871
  Hypo

SEQ ID NO: 106612 - DNA, 878 bp, Homo sapiens; identical to SEQ ID NO: 73319
  chr11:68451662-68452540
  Hyper

SEQ ID NO: 106613 - DNA, 319 bp, Homo sapiens; identical to SEQ ID NO: 73320
  chr11:68460889-68461208
  Hypo

SEQ ID NO: 106614 - DNA, 36 bp, Homo sapiens; identical to SEQ ID NO: 73321
  chr11:68564345-68564381
  Hypo

SEQ ID NO: 106615 - DNA, 153 bp, Homo sapiens; identical to SEQ ID NO: 73322
  chr11:68607258-68607411
  Hyper

SEQ ID NO: 106616 - DNA, 30 bp, Homo sapiens; identical to SEQ ID NO: 43189
  chr11:68672906-68672936
  Hypo

SEQ ID NO: 106617 - DNA, 30 bp, Homo sapiens; identical to SEQ ID NO: 43190
  chr11:68692056-68692086
  Hypo

SEQ ID NO: 106618 - DNA, 38 bp, Homo sapiens; identical to SEQ ID NO: 43191
  chr11:68771669-68771707
  Hypo

SEQ ID NO: 106619 - DNA, 76 bp, Homo sapiens; identical to SEQ ID NO: 43192
  chr11:68804728-68804804
  Hypo

SEQ ID NO: 106620 - DNA, 30 bp, Homo sapiens; identical to SEQ ID NO: 73327
  chr11:68902975-68903005
  Hypo

SEQ ID NO: 106621 - DNA, 172 bp, Homo sapiens; identical to SEQ ID NO: 73328
  chr11:68965052-68965224
  Hypo

SEQ ID NO: 106622 - DNA, 30 bp, Homo sapiens; identical to SEQ ID NO: 73329
  chr11:68975015-68975045
  Hypo

SEQ ID NO: 106623 - DNA, 376 bp, Homo sapiens; identical to SEQ ID NO: 73330
  chr11:69192450-69192826
  Hypo

SEQ ID NO: 106624 - DNA, 30 bp, Homo sapiens; identical to SEQ ID NO: 73331
  chr11:69193336-69193366
  Hypo

SEQ ID NO: 106625 - DNA, 30 bp, Homo sapiens; identical to SEQ ID NO: 43195
  chr11:69206384-69206414
  Hypo

SEQ ID NO: 106626 - DNA, 148 bp, Homo sapiens; identical to SEQ ID NO: 73333
  chr11:69227108-69227256
  Hypo

SEQ ID NO: 106627 - DNA, 30 bp, Homo sapiens; identical to SEQ ID NO: 73334
  chr11:69253125-69253155
  Hypo

SEQ ID NO: 106628 - DNA, 94 bp, Homo sapiens; identical to SEQ ID NO: 73335
  chr11:69269195-69269289
  Hypo

SEQ ID NO: 106629 - DNA, 111 bp, Homo sapiens; identical to SEQ ID NO: 73336
  chr11:69279556-69279667
  Hypo

SEQ ID NO: 106630 - DNA, 190 bp, Homo sapiens; identical to SEQ ID NO: 73337
  chr11:69280486-69280676
  Hypo

SEQ ID NO: 106631 - DNA, 67 bp, Homo sapiens; identical to SEQ ID NO: 43197
  chr11:69339948-69340015
  Hypo

SEQ ID NO: 106632 - DNA, 167 bp, Homo sapiens; identical to SEQ ID NO: 43198
  chr11:69360946-69361113
  Hypo

SEQ ID NO: 106633 - DNA, 30 bp, Homo sapiens; identical to SEQ ID NO: 73340
  chr11:69431611-69431641
  Hypo

SEQ ID NO: 106634 - DNA, 91 bp, Homo sapiens; identical to SEQ ID NO: 73341
  chr11:69452198-69452289
  Hyper

SEQ ID NO: 106635 - DNA, 711 bp, Homo sapiens; identical to SEQ ID NO: 73342
  chr11:69452657-69453368
  Hyper

SEQ ID NO: 106636 - DNA, 48 bp, Homo sapiens; identical to SEQ ID NO: 73343
  chr11:69458766-69458814
  Hypo

SEQ ID NO: 106637 - DNA, 64 bp, Homo sapiens; identical to SEQ ID NO: 73344
  chr11:69466049-69466113
  Hypo

SEQ ID NO: 106638 - DNA, 59 bp, Homo sapiens; identical to SEQ ID NO: 73345
  chr11:69468423-69468482
  Hypo

SEQ ID NO: 106639 - DNA, 32 bp, Homo sapiens; identical to SEQ ID NO: 73347
  chr11:69481718-69481750
  Hypo

SEQ ID NO: 106640 - DNA, 154 bp, Homo sapiens; identical to SEQ ID NO: 73348
  chr11:69498956-69499110
  Hypo

SEQ ID NO: 106641 - DNA, 472 bp, Homo sapiens; identical to SEQ ID NO: 73349
  chr11:69516989-69517461
  Hyper

SEQ ID NO: 106642 - DNA, 897 bp, Homo sapiens
  chr11:69517719-69518616
  Hyper
aatatcaaaggaggccgaataatgggtttcctcggtccggctaggccggcctttgactcaattggaaatgcaaaggcagcttttgcctattctctggctgctggctgagaccctaaatttccgtaggaaatcgtcggacatgcacttaatcggtctttgcaatctttccctcgaagttgcacgcgggtctgggcggaggaggcgaggaaaccctggattcgaaccagcgcctttctctccttcaggcctccgcccggggacaggcgccggtcccccgccccggcgcatccgccccgtggggacacttaccagcccctgcatcttgccgtcggcgcccatgcagaggtaccgcacgctgtgcacgcccttgatggccacggtccgcagagcgactgccttgatctccagcaaacctaggcgcaggggaagcgagaagctgcagcaaggaccgctgggcccgcaccacgtgggtgcggtcggtccacaagcctgtgcttctccctagcgtcccgcgctgtttggggactaacggagggatcctaacgtccaggtgccaaaacctggggttcccaggagttgaggggtccgcaggagcctaagggtggcaaaggaaggaagggcgctggggtggggcgcgcgcagcggggtggggtgcgcgcggcggggcgggcgggggtgctggcgggcactcactgtgcgcgctctggccccgcgcgcagtccacgacgccgtcggcacggatgcgcaggaagcagctggagagcccgtgggggccggaggtgtacaggtgccgcaggcggatggggtcgccccagccgtagtgcacgtggggccccgcgtccgagaaggcgagggggcgcccggccacggccagccagaggccggccaggatccata

SEQ ID NO: 106643 - DNA, 870 bp, Homo sapiens; identical to SEQ ID NO: 73352
  chr11:69519059-69519929
  Hyper

SEQ ID NO: 106644 - DNA, 101 bp, Homo sapiens; identical to SEQ ID NO: 73353
  chr11:69533072-69533173
  Hyper

SEQ ID NO: 106645 - DNA, 670 bp, Homo sapiens; identical to SEQ ID NO: 73354
  chr11:69588847-69589517
  Hyper

SEQ ID NO: 106646 - DNA, 889 bp, Homo sapiens
  chr11:69589746-69590635
  Hyper
tgggtgcagtgggtgcggcggcgccccctcggcccgcccagggcgccagcaaggccagcaggaccgccgggagcagcgctaccgcggccgtcccgggccccgacatcccggcccgagggccgtgcgtcggtcaggcggtcagtgcgcccgggaagctggggggcagagctgcgcctgtggcgtcccgcgggagcgcacggccgacctcgggcaggagtgcgcaaccgaggaggtgcgggaggcaagcgacggggcccccgggcgccgggctctaccccggctgcatggagcggcgagccgggcggaaagcgcgcggctggagctgggactctgaggagcagtgcgcgcctccctgagcgccaggcccgcccgaggccgagccgctatatatatagcccggcgccccctcctactcgcccgctcccgcggggggccgttcgcgttctcctgggcgcccggggcgctgtggcgttcgcggctggtcgcaggccgcctgccaatcagggccgggggaagggaggaggctggggactagcgccgcgagtgccacctggagggaccccggcccccacccttggctccgcccggcccacggacctgttcgtcccgccccttggcggctcctacacttctgcttttcagccagttttgcctcttgcactttgtccctgcctgtccccgtccccgtctccctctctgctccggccgccttggcgcagccctaactcgggcatccgaagctcctagtgggcgcagaagccagcggctgctgcctgcccttcgcctttcggaggctcacgggaacttggttcctttgctggggccttgaggaccggcctgggaaggaggggtggataagagcagtaagcgacaccggggcctggctggg

SEQ ID NO: 106647 - DNA, 99 bp, Homo sapiens; identical to SEQ ID NO: 73357
  chr11:69611957-69612056
  Hypo

SEQ ID NO: 106648 - DNA, 184 bp, Homo sapiens; identical to SEQ ID NO: 73359
  chr11:69970448-69970632
  Hypo

SEQ ID NO: 106649 - DNA, 50 bp, Homo sapiens; identical to SEQ ID NO: 73360
  chr11:70005678-70005728
  Hypo

SEQ ID NO: 106650 - DNA, 36 bp, Homo sapiens; identical to SEQ ID NO: 73361
  chr11:70017163-70017199
  Hypo

SEQ ID NO: 106651 - DNA, 30 bp, Homo sapiens; identical to SEQ ID NO: 43204
  chr11:70022959-70022989
  Hypo

SEQ ID NO: 106652 - DNA, 30 bp, Homo sapiens; identical to SEQ ID NO: 73363
  chr11:70023256-70023286
  Hypo

SEQ ID NO: 106653 - DNA, 265 bp, Homo sapiens; identical to SEQ ID NO: 73364
  chr11:70050901-70051166
  Hypo

SEQ ID NO: 106654 - DNA, 42 bp, Homo sapiens; identical to SEQ ID NO: 73365
  chr11:70098175-70098217
  Hypo

SEQ ID NO: 106655 - DNA, 98 bp, Homo sapiens; identical to SEQ ID NO: 73368
  chr11:71098921-71099019
  Hypo

SEQ ID NO: 106656 - DNA, 30 bp, Homo sapiens; identical to SEQ ID NO: 73369
  chr11:71108366-71108396
  Hypo

SEQ ID NO: 106657 - DNA, 57 bp, Homo sapiens; identical to SEQ ID NO: 43207
  chr11:71117658-71117715
  Hypo

SEQ ID NO: 106658 - DNA, 185 bp, Homo sapiens; identical to SEQ ID NO: 73371
  chr11:71192648-71192833
  Hypo

SEQ ID NO: 106659 - DNA, 54 bp, Homo sapiens; identical to SEQ ID NO: 33940
  chr11:71274712-71274766
  Hyper

SEQ ID NO: 106660 - DNA, 783 bp, Homo sapiens
  chr11:71318274-71319057
  Hyper
taggcggggaaggtgcggggcgaggcggccgcggctccctggcatccctctccttacccccaggctaagctggcggtgctgctggtgacgctggtggcggccgcggtctcctacctgcggatggagcagaagctgcggcggggcgtgcgccagccccgcatcccgtggccccagcacaaggtgcgcagttaccgctacttggaggaggacaactcggacgagagcgacgcggagggcgagcatggggacggcgcggaggaggaggcgccgcccgcggggaccaggcctggtcccgagcaggctggactcggccgccggccctgcccgtaggaacaggcgcaggggggcgactggccagaggagcagtgaggggccgcctggtccacggactcagcctccctcctcgccggccttagtttaccacttcttaggtcggggggaccccctccgagtcccgcgctgtcttcaaaggcccctgtctcccgtcccccacgttggggacgcccctcccagagcccaggtcacctccgggcttccgcagccccctccaaggcggagtggagctttgggaacccctcggccaagcacagcggttcgaaaatacagctgaaacccagcgggcccttagcacgcgccccagcgccggagcagggtcagggtcttcttgcgacccggctccgctccagatccccccagctctcggcggcggacccgggccgcgtgtgagcgcgctttgcacctcctatccccagggtccgccgagagccacgattttttacagaa

SEQ ID NO: 106661 - DNA, 98 bp, Homo sapiens; identical to SEQ ID NO: 73376
  chr11:71507939-71508037
  Hypo

SEQ ID NO: 106662 - DNA, 29 bp, Homo sapiens
  chr11:71781578-71781607
  Hypo
cccagtggctcacagcggtaatcccagca

SEQ ID NO: 106663 - DNA, 30 bp, Homo sapiens; identical to SEQ ID NO: 73378
  chr11:71792634-71792664
  Hypo

SEQ ID NO: 106664 - DNA, 30 bp, Homo sapiens; identical to SEQ ID NO: 73379
  chr11:71850743-71850773
  Hypo

SEQ ID NO: 106665 - DNA, 30 bp, Homo sapiens; identical to SEQ ID NO: 73380
  chr11:71939243-71939273
  Hypo

SEQ ID NO: 106666 - DNA, 566 bp, Homo sapiens
  chr11:71951172-71951738
  Hyper
ccgccgcgcccttggcgctggccgcgcgctcctgtttgcggaacttggcccggcggttctggaaccagacctgcgggcacaggggccagtcagcctggacgagggtcggagaacgcacggggtcagcccgcggccgcaaggctcgagtgagatcctggttcggaaagaaccgggcccgggttcttactagttggaggggccttcggccctccgcacgcagcccgctgcactccgcgctccactggcccctgcctccagatccctgggttcttgcccttgggatccactcacccgctgactctgctgcctcccagcactcttggtctcccggaggggaccctgccttcgttctcctcactctaagttcttcccccaattccttcttttaggaagctctgggacttccctcctggagtgttccagggccgtggagagcagtttagggcgccagtaaaccttttgtctagggcatccagtcaaggcgggccaactgaacatctgtacacggagttgtacaaatagacaacagtctgctctagcccggctctcttcggccctgtgcctgc

SEQ ID NO: 106667 - DNA, 406 bp, Homo sapiens
  chr11:71952135-71952541
  Hyper
atacacgcacctgcacgcgagcctcagtgaggtcgatcttgagcgccagctcctcacgcgtgtaaatgtcggggtagtgggtctcagcgaaaacgcgctccagctccttgagctgcgcgctggtgaacgtggtgcggatgcgccgctgcttgcgcttctcgtgcaggccggatggctctgggaagaacttgtagggcactgcgggtgtgtgcaggggggccggggggggggcaaaaaggatgggggagtgagaagcagagttcaacccgttgtgtccagctccgggggaatcacacgcctcccccgtccctggcctgatccctcgtcttggtcccggcagcctggggccgagcgtcctccctattactcaatggagccggcgggataaaggcggagggagatcagg

SEQ ID NO: 106668 - DNA, 1784 bp, Homo sapiens
  chr11:71954593-71956377
  Hyper
ttgacctgaagggcacgagacagagatttggcaacgagaaaaaggaacaggagagatgagagggtgaggctcattcctgcggaggagaacctcgtattctgggggtctctcggggcattggagggtctggccaaggcaggaatgggggcggctgagggggacagtcgcattcacttggcgagcgggcccagggattctgcaggaattggagggagggttgggccggggctgcgctcacctgccgagtagggcgcgggctggtggtcgcgtagggcgccaagtgcgcagttggaggagccgagcgcggggcagggcggccctgccgcggggaaagcgggccgcagggggctgtattggaagccgccgggctggctgcaggcgccaaagtcgccgtaggcggacgcctccatggccgccacgcacgagtcgtacgaattgaggtaggagtagtccatcggcccggggggcgggggcgggggccgggccaggccgggtcggggtcggggtccgggtggaggtcggaagggaggttcgagcgccaggctccgaggacccgaggccagctctgagcgcccgagagtccgcccgccccgtcgcggccgcactcagcccgggtgcaacgcaagtgcagccagcccggcccgcgcgccttttaacgcgcaggaccccgcggaggggggcggggcggggcgagctccgaaggggcggggcctaggaggcccagacaccgcccaaagccgccccgacccccaccccgaagggtccccgccgccgtcttagggctcagaggtgtggagctgggatgcgcgggaccctatccccggagtccctatcctgccccaatccggaccagaccttcggtctctacacagcgtccgaggccagagggtcccgacccttttcccgggcctccccacctgcggccccgcggaagggaggggaggcaggcctggcggcgctcgtgtgaagaagttaattcaattcgctctgataaccgagttattccgatctggcccctcagccccgcccccagcgaggtcccatcccggcggagactgcggaggcggcccaggaagggggatggagaccgggaagagacggagcctgggatggggacagggaagggacgtggatagacagaggaaacagagaccgggagagaaaggggcagaaacagtgatggagacagggacaagagatacaggtacacagagggagacaaggacggaacatacacagcgaaagacaggatggagcggggacagggcagagacaggagatgagggtaagagagagacaggatggagcggggacagggcagagacaggagatgaggttaagagagagacaagaggagacagggagacagggggacgagaaagagagtgagggaggcatggagacagaaggggtcgggatgagacatggacggcaaccaggactgcggtggagagcaagggagggatgagacaaaacagaggcaggaatcgtgagacagacacatatgcccagggacagtctgagagagacagggccagggacagccacaagcgcgggagcagaggctgagagcggagagaaaacgcctccggggagcttagacacgagggctggagcgcagaggggcccagggatgatgctggaggctctggggtgcggcctccacggggctgcggagagggagggtcgtgggagccaggtccctctaccctgacttgtcccgaggcccacacgaccttgcaccttcagggcccgcctgcctctccccccgttccctcagctcc

SEQ ID NO: 106669 - DNA, 269 bp, Homo sapiens; identical to SEQ ID NO: 73390
  chr11:72109412-72109681
  Hypo

SEQ ID NO: 106670 - DNA, 174 bp, Homo sapiens; identical to SEQ ID NO: 73391
  chr11:72125662-72125836
  Hypo

SEQ ID NO: 106671 - DNA, 24 bp, Homo sapiens
  chr11:72146622-72146646
  Hypo
gagccactgcgcctggccctgatt

SEQ ID NO: 106672 - DNA, 169 bp, Homo sapiens; identical to SEQ ID NO: 73393
  chr11:72388041-72388210
  Hyper

SEQ ID NO: 106673 - DNA, 322 bp, Homo sapiens; identical to SEQ ID NO: 33953
  chr11:72432837-72433159
  Hyper

SEQ ID NO: 106674 - DNA, 253 bp, Homo sapiens; identical to SEQ ID NO: 73395
  chr11:72433380-72433633
  Hyper

SEQ ID NO: 106675 - DNA, 431 bp, Homo sapiens; identical to SEQ ID NO: 73396
  chr11:72465657-72466088
  Hypo

SEQ ID NO: 106676 - DNA, 46 bp, Homo sapiens; identical to SEQ ID NO: 43212
  chr11:72475677-72475723
  Hypo

SEQ ID NO: 106677 - DNA, 30 bp, Homo sapiens; identical to SEQ ID NO: 73398
  chr11:72492307-72492337
  Hyper

SEQ ID NO: 106678 - DNA, 204 bp, Homo sapiens; identical to SEQ ID NO: 73399
  chr11:72532174-72532378
  Hypo

SEQ ID NO: 106679 - DNA, 42 bp, Homo sapiens; identical to SEQ ID NO: 73400
  chr11:72532613-72532655
  Hypo

SEQ ID NO: 106680 - DNA, 228 bp, Homo sapiens; identical to SEQ ID NO: 73407
  chr11:72905832-72906060
  Hypo

SEQ ID NO: 106681 - DNA, 388 bp, Homo sapiens; identical to SEQ ID NO: 73408
  chr11:72929267-72929655
  Hyper

SEQ ID NO: 106682 - DNA, 266 bp, Homo sapiens; identical to SEQ ID NO: 73409
  chr11:73019833-73020099
  Hyper

SEQ ID NO: 106683 - DNA, 762 bp, Homo sapiens; identical to SEQ ID NO: 73410
  chr11:73072907-73073669
  Hypo

SEQ ID NO: 106684 - DNA, 153 bp, Homo sapiens; identical to SEQ ID NO: 73411
  chr11:73310292-73310445
  Hypo

SEQ ID NO: 106685 - DNA, 26 bp, Homo sapiens
  chr11:73507247-73507273
  Hypo
ttccgagtgcagttacggccgcccaa

SEQ ID NO: 106686 - DNA, 135 bp, Homo sapiens; identical to SEQ ID NO: 73414
  chr11:73662980-73663115
  Hypo

SEQ ID NO: 106687 - DNA, 84 bp, Homo sapiens; identical to SEQ ID NO: 73415
  chr11:73679409-73679493
  Hypo

SEQ ID NO: 106688 - DNA, 30 bp, Homo sapiens; identical to SEQ ID NO: 73416
  chr11:73679852-73679882
  Hypo

SEQ ID NO: 106689 - DNA, 30 bp, Homo sapiens; identical to SEQ ID NO: 73417
  chr11:73764263-73764293
  Hypo

SEQ ID NO: 106690 - DNA, 30 bp, Homo sapiens; identical to SEQ ID NO: 43218
  chr11:73805524-73805554
  Hypo

SEQ ID NO: 106691 - DNA, 33 bp, Homo sapiens; identical to SEQ ID NO: 73419
  chr11:73883502-73883535
  Hypo

SEQ ID NO: 106692 - DNA, 37 bp, Homo sapiens; identical to SEQ ID NO: 73421
  chr11:74022679-74022716
  Hyper

SEQ ID NO: 106693 - DNA, 141 bp, Homo sapiens; identical to SEQ ID NO: 73422
  chr11:74064904-74065045
  Hypo

SEQ ID NO: 106694 - DNA, 23 bp, Homo sapiens
  chr11:74100854-74100877
  Hypo
cttgaaggaactggccgggtgcg

SEQ ID NO: 106695 - DNA, 39 bp, Homo sapiens; identical to SEQ ID NO: 73424
  chr11:74107733-74107772
  Hypo

SEQ ID NO: 106696 - DNA, 36 bp, Homo sapiens; identical to SEQ ID NO: 33956
  chr11:74178590-74178626
  Hyper

SEQ ID NO: 106697 - DNA, 36 bp, Homo sapiens; identical to SEQ ID NO: 73426
  chr11:74246640-74246676
  Hypo

SEQ ID NO: 106698 - DNA, 202 bp, Homo sapiens
  chr11:74302524-74302726
  Hypo
caccgcgcccggtctgctaccctattttaaaccaccactatctttcacttaaaaatctcagaatgtaagttacatgtgaacaggctcggtttattattgctcatagctgcagccccagcacctcaacactcagaatagtatctggcctttctcaggattttgctatgctttgaatgaatgcatgtcgcgacaagcctttgaa

SEQ ID NO: 106699 - DNA, 242 bp, Homo sapiens; identical to SEQ ID NO: 73429
  chr11:74394395-74394637
  Hyper

SEQ ID NO: 106700 - DNA, 37 bp, Homo sapiens; identical to SEQ ID NO: 73430
  chr11:74394860-74394897
  Hyper

SEQ ID NO: 106701 - DNA, 1038 bp, Homo sapiens
  chr11:74441835-74442873
  Hyper
ctcccggtctacttacgggctcgagcgtgggagtccagggggaaccagagcagcgcgagtcccagcaaggaggagaggaccctcacctcgggaaccatcctttccccagggtcaggccgctggtccgggagcggagtcgggaggaagggagacgaaaaggacacggaggcacaggggccacagatcaacccacagaccccaggaggtctgctgctagagcggggtcggagaagggccaggaagcagcggtgggcaggaaaggagggcaggaagggaggtctaaggtgggaagaagagaaaggtggaaagagaacgcggggaaaggagggagagatggagagacgaaggaaggtccagcagaagggagaggcgatcaaagaaagggggaaggtgagagggagaggaggagaaagcagggagaggaccggcgtctgccgagcgcgcagcgccgggcgaggcgcgcgggaccagcgggtgttgcgggcgcgcgggctagaggcggccggcgccccctgctcggtgggctcggggtcgggccgcgggggcctggggcccggcggggcggcggtcccagcagcggcggcggcgcggcggccgcggagggaggctgagcgcgggccggctgtgctcgccaagggcttcaggcgccgcgctcgggcgcatttgtactttgccgcgggaagcaggcagcccggcctggcgctggcctagcgctggcgcctcctctggggcaccgcgggctcggtggattggccacccgagaaacaggcccactttttcccctcctctcttgtgcgggtctccgggacggacgctccaggcgcggcgccgagtggaggcgagggggctgcggagggggaaggggccacgcgggccacggggtttaacccctgactccccgcgacgccaagaatgcaggagggcagagttgagggagacctcaggtggaactttcaggtggggaaggctgagctgtcggggctgcgggtaccgggaaggctcagggtaaggcgctcggcggtgcgtgcccggaactcc

SEQ ID NO: 106702 - DNA, 167 bp, Homo sapiens; identical to SEQ ID NO: 73433
  chr11:74951632-74951799
  Hyper

SEQ ID NO: 106703 - DNA, 1319 bp, Homo sapiens
  chr11:74952123-74953442
  Hyper
ccaggggctgctgctcgtggcggcggcgctgagccagcccgcggcaccctgccccttccagtgctactgcttcggcggccccaagctgctgctgcgctgcgcgtcgggagccgagctccgccagcctccgcgggacgtgccgcccgacgcgcgcaacctcaccatcgtaggcgccaacctgacggtgctgcgcgcggccgccttcgccggcggggacggggacggcgaccaggcggcgggcgtgcgcctgccgctcctgagcgcgctgcgcctcacgcacaaccacatcgaggtggtggaggacggcgccttcgacgggctgcccagcctggcggcgctcgacctcagccacaacccgctgcgcgccctgggcggcggcgccttccgcgggctgcccgcgctgcgctcgctgcagctcaaccacgcgctggtgcgcggcggccccgcgctgctggccgcgctggacgctgcgctggcaccgctggccgagcttcgcctgctgggcctagcgggcaacgcgctgagccgtctgccgccagccgccctgcgcctggcgcgcctggagcagctggacgtgcgcctcaacgcgctggccggcctggaccccgacgagctgcgcgcgctggagcgcgatggcggcctccccgggccgcgcctgctgctcgccgacaaccccctgcgctgcggctgtgccgcacgccccctgctggcctggctgcgcaacgccacggagcgcgtgcccgactcgcggcgcctgcgctgcgccgccccgcgggcgctgctagaccggccgctactggacctggacggggcgcggcttcgctgcgcggacagcggcgccgacgctcgcggagaggaggcggaggccgccggcccggagctggaagcctcctacgtgttcttcgggctggtgctggcactcatcggcctcatcttcctcatggtgctctacctaaaccgccgcggcatccagcgctggatgcgcaacctgcgcgaggcgtgccgggaccagatggagggctaccactaccgctacgagcaggacgccgacccgcgccgcgcgcccgcgcccgccgcgcccgcgggctcccgcgccacctccccgggctcggggctctgagcggcgcccccgggctcggggcttcccttgcctggcccgaagccgtggagatgagacacccgcgagccccgagctctgagaccttcccctgactcggaggcgctaagccgtaccctctcgttcccgcctccgagagctcccaccgtcaaagacccagagatagccggtccgaatccagaaaccccgcctgcccacccta

SEQ ID NO: 106704 - DNA, 35 bp, Homo sapiens; identical to SEQ ID NO: 43221
  chr11:75100584-75100619
  Hypo

SEQ ID NO: 106705 - DNA, 33 bp, Homo sapiens; identical to SEQ ID NO: 73437
  chr11:75140949-75140982
  Hyper

SEQ ID NO: 106706 - DNA, 660 bp, Homo sapiens; identical to SEQ ID NO: 73438
  chr11:75141202-75141862
  Hyper

SEQ ID NO: 106707 - DNA, 30 bp, Homo sapiens; identical to SEQ ID NO: 73439
  chr11:75146658-75146688
  Hypo

SEQ ID NO: 106708 - DNA, 56 bp, Homo sapiens; identical to SEQ ID NO: 43222
  chr11:75152480-75152536
  Hypo

SEQ ID NO: 106709 - DNA, 30 bp, Homo sapiens; identical to SEQ ID NO: 73441
  chr11:75160673-75160703
  Hypo

SEQ ID NO: 106710 - DNA, 30 bp, Homo sapiens; identical to SEQ ID NO: 73442
  chr11:75163174-75163204
  Hypo

SEQ ID NO: 106711 - DNA, 49 bp, Homo sapiens; identical to SEQ ID NO: 73443
  chr11:75221046-75221095
  Hypo

SEQ ID NO: 106712 - DNA, 30 bp, Homo sapiens; identical to SEQ ID NO: 73444
  chr11:75229378-75229408
  Hypo

SEQ ID NO: 106713 - DNA, 381 bp, Homo sapiens
  chr11:75294375-75294756
  Hyper
cactatccttcccaccggcccgatcccgcgtcccgaggtctcgcggggccaggctgcacgggcggcggagcccggagcccggggcggggccggagatgagcctgcaggcggggggctgtgcgagtgcgcggggacgggggctgctgtttccgagccgagagccctggtagcggggctctgtgggcggagacgccctcccgagcctgggcatcttcggagtgggactctcgggtcggagttccgccgccggcccatccagtttcagcgggtcgcctttgcctctgggccgggtggggagcctcccattccagagaccccccgactccctgcccctcgcggcgtaggggcgccctttctgcggcgccgcggggccgtcctctc

SEQ ID NO: 106714 - DNA, 1709 bp, Homo sapiens
  chr11:75378401-75380110
  Hyper
tggagggaggctgcacgctaggcctgcgctggggatcctgggccccgggcagcccgcggggagggtctgcgtggtgactcccccgcgctagcagcggccgcgtctcacctgtaggagctgctcactgcactcgccacctcctcgcggatttgccggttgagggcgtccgccgcggcgcgccccctgccagcctcggggccggtggcctggacctgggcctgggccgcgggcagcggcgtctgctcgtgccccaggccctcggcgcggcgcacaatccaggcaggcccggccttcctgcgcgtgtcgcgctcgtccgccccggacgcctttccggccgccaggccacccgctccgccgggggccgcctcctgctcccgggcctcagcggcggcctgcactggccagcgctcctggctctgcggccggcgcttgggcgccccgagaatgggcgccgacgcctgggaggccgcagagatctgcacgggcttggggatccacgggtggtccccgcggcgcggcagcggccaggcgcggaagtccttctggtactgggtctcgcgctcgaagggagcgtcggagggctggtattcgctgcgcggccggcagctgggctcgggccgctgcaccttccaggctcggtaatcctgccgcatcaccgagtccgcggggccggaggtggagccggagcccaggcccgggcccggcccgctccggccggggcccgccgccggctcgcgctcgccggtaggcccaggcgctggccccgttgcccgggcaactgcatccaactcgccctgggctggctgcgtctctatggcaaccgcgcgcgccgaggggggcgcgagcgccggctgcgcctgctgctgcggcggcggtggctgcggcggggcgcccgggtgctcggtggcctccgagtacttggtgaaaaccagcggcacagcgatgtccgctttgtccaactggttccagaagcgggcgatgcagcaggccctcgtgatgcacggccacgccatgatgctagctgaaaagccggcctcctctttcttcttgtggttctaaagcaagtctctataatcttccttcagcctccgatcctgaccggccaatgtggttcccaccgttttctacccccgatcagccggagctagttcgccctcctccctcagcgagcacccggggagagctgtcctaggagagtctgtagagtccctcgattaccggtcgcaaacgcctttgggagcgcagtctgctgcgagcgccgaagggtgagacgcacggcgttcccgagtccccggcgagggtgtctgggacgcgcccctccctgcggctgcggcggcgcacagacctcggtcgagcgaggcgacgtgaggagaggtggctacaggcttaagccatggcgcagaggaggggccgggcggtgtggccgcagggtccgcggaccgggctcgagtctccttcctgccggcgtcctagtgcagccggccacctagcagggctgggaggccatcacctccagcggagaccgagcattgctgcctccgccgctgcccgcgaggatgccgcagccgccgccgccaccgcctcttctcctgggaagcgaccccacccttttctgcagctctcggtctccgccgctgcccgcgaatgatgctgcagccgctgccgccgccgcctctgcctctgctgcagggaagcggccccaccctttt

SEQ ID NO: 106715 - DNA, 55 bp, Homo sapiens; identical to SEQ ID NO: 73449
  chr11:75428929-75428984
  Hypo

SEQ ID NO: 106716 - DNA, 91 bp, Homo sapiens; identical to SEQ ID NO: 15601
  chr11:75459473-75459564
  Hypo

SEQ ID NO: 106717 - DNA, 718 bp, Homo sapiens; identical to SEQ ID NO: 73451
  chr11:75863175-75863893
  Hyper

SEQ ID NO: 106718 - DNA, 30 bp, Homo sapiens; identical to SEQ ID NO: 43224
  chr11:75879446-75879476
  Hypo

SEQ ID NO: 106719 - DNA, 30 bp, Homo sapiens; identical to SEQ ID NO: 73453
  chr11:75921359-75921389
  Hyper

SEQ ID NO: 106720 - DNA, 320 bp, Homo sapiens; identical to SEQ ID NO: 73454
  chr11:76032896-76033216
  Hyper

SEQ ID NO: 106721 - DNA, 609 bp, Homo sapiens; identical to SEQ ID NO: 43225
  chr11:76371627-76372236
  Hypo

SEQ ID NO: 106722 - DNA, 243 bp, Homo sapiens; identical to SEQ ID NO: 73458
  chr11:76382021-76382264
  Hyper

SEQ ID NO: 106723 - DNA, 77 bp, Homo sapiens; identical to SEQ ID NO: 73459
  chr11:76510624-76510701
  Hyper

SEQ ID NO: 106724 - DNA, 21 bp, Homo sapiens
  chr11:76571168-76571189
  Hypo
cccagacgggggctgggagta

SEQ ID NO: 106725 - DNA, 282 bp, Homo sapiens; identical to SEQ ID NO: 73461
  chr11:76902405-76902687
  Hypo

SEQ ID NO: 106726 - DNA, 18 bp, Homo sapiens
  chr11:77025115-77025133
  Hypo
aaaaatatttaaggccgg

SEQ ID NO: 106727 - DNA, 154 bp, Homo sapiens; identical to SEQ ID NO: 73463
  chr11:77116020-77116174
  Hypo

SEQ ID NO: 106728 - DNA, 40 bp, Homo sapiens; identical to SEQ ID NO: 73464
  chr11:77186167-77186207
  Hypo

SEQ ID NO: 106729 - DNA, 41 bp, Homo sapiens; identical to SEQ ID NO: 73465
  chr11:77301363-77301404
  Hyper

SEQ ID NO: 106730 - DNA, 94 bp, Homo sapiens; identical to SEQ ID NO: 73466
  chr11:77309684-77309778
  Hypo

SEQ ID NO: 106731 - DNA, 101 bp, Homo sapiens; identical to SEQ ID NO: 73467
  chr11:77534272-77534373
  Hypo

SEQ ID NO: 106732 - DNA, 30 bp, Homo sapiens; identical to SEQ ID NO: 73469
  chr11:78262164-78262194
  Hypo

SEQ ID NO: 106733 - DNA, 30 bp, Homo sapiens; identical to SEQ ID NO: 73470
  chr11:78369244-78369274
  Hypo

SEQ ID NO: 106734 - DNA, 30 bp, Homo sapiens; identical to SEQ ID NO: 73471
  chr11:78381201-78381231
  Hypo

SEQ ID NO: 106735 - DNA, 162 bp, Homo sapiens; identical to SEQ ID NO: 73472
  chr11:78387174-78387336
  Hypo

SEQ ID NO: 106736 - DNA, 427 bp, Homo sapiens; identical to SEQ ID NO: 33973
  chr11:78672891-78673318
  Hyper

SEQ ID NO: 106737 - DNA, 30 bp, Homo sapiens; identical to SEQ ID NO: 73475
  chr11:78775970-78776000
  Hypo

SEQ ID NO: 106738 - DNA, 135 bp, Homo sapiens; identical to SEQ ID NO: 73478
  chr11:79148413-79148548
  Hyper

SEQ ID NO: 106739 - DNA, 204 bp, Homo sapiens; identical to SEQ ID NO: 73479
  chr11:79148811-79149015
  Hyper

SEQ ID NO: 106740 - DNA, 1097 bp, Homo sapiens
  chr11:79149239-79150336
  Hyper
cttcagcgttccccacggctgtgtcagggctggggtggcttatccccctacagacgaaaatcaagatttaaaagcatactcttactgtggtttctctatcaaagcccatcaacgtgatacacaggctgcggcgctggagggaagcggcgaaacggggagaataaacgcaacagaagcaaactgctgtctgcagaggcgagaggcgaaggaacggaagccatacccgaccccagccccatcccgtccccatcagcgccgggctagcgcaggaaaccaggaataggtgtaggtaagggtggcagcccggcagagccagcgttctactccctctaacccctcgccagcgtgggcctggatggctgggctgcctgggcatctccaagggggaccaggcaccgcgggcaggtttctaaacacgtgaagggcacagggcttgaaagacaaggaggggcgcccaggaagggcggaaaagaggggctttggggctccccaggacaccaagtcagtttctgaaaacggcgttccctggaaggccttccaacacctccgagggaagacttggagctctgaagacccaatgaaacctcagttctgactgactcctcctctgcgatcaattccggatgcccccacttagtccctgcctcggtaaccggttctttggggacagcagcatcagcacccgacgcccatcgcacaagtgggcgccgtggtgcgaggcgtatcctagctacccaggccggggtgggggcgccccggtacttacactccccaagcaggcaaactttcaggcttgtctttcgagaaccgggagctcgcatcacagttccgggtaatcaccgaggcagcttatgtaattgcccgcgatgccgctcagcagatctctctccttactcggcctcagagctcagtacatgggcaccctcttccccccaccccccaccccggcgattggaatcccgagcttgccccaccaccgccttctacaaagcagcggggtgatctcgtgtgctacaaacaccaagccagtatgcaggttcaggcaaaactctggctgcctccctgcgcccctttcactgcgtcgatggtttacagat

SEQ ID NO: 106741 - DNA, 1849 bp, Homo sapiens
  chr11:79150674-79152523
  Hyper
tggttgtgtattcctcggttgcgtgtgtgtgtccacacacacacacacacacacacacacacgccgccccactaccttccagtctgctcctccaatgtaacgaccgcatttaaaaatggcaattaaaatgactgaggagctcggtgatcacatttcaacccagagcacatttcccgaagctgggggtgagagtagtcatacagtcacactcacacccgggagccctccaagcgtccatctggcggctgcagcctcagttggctcctagacgaacatcaataccgcggccgggcgcccggtgaggagaggcgggcgccccgcgggttgcagagggcgaggagctggggtcgcatctccaggatctgagctccaaccaccgcccgtgcggggctgctgcagccggcacttgccccgcagggcaggctgcagccgctgaagcccggcgccgcctcgcgggctcctccagcgcccgacgggggcctggggcgagctagtctgcagaggggctgcaggcgaccgggccggggcggggaacgggatccgggagaggcagacgaacctggggcgcgccgcctccctcccacccgcttcccacctccctgccctcccccaacccttgctcccaggctccagtccgcggcgggctccgggggctgcggcggctccaggctccagaacagcttgcctcttcggccacccgcgccctagcctccctcctcctgggccaggggagcaagcaaacatctcccggagccctcggcagccgcgtgagctacccgaaccctgcccgggccagcagtgcagagggcgatggagctggcgaggcgtcgccgcggtccccaaggcgcttttccgtagagcggatcacgccgccttaccgtggctgcaggctgctaccgccggggaagcggcgaggacggcggcagggaggcaaggcgccgcgccggtggctcctctctctctcggcggcgcggctcctctgctccgcgagccgtagcggggcgcccaggaaggagcaggtccgggctctgcgctcagctccagcgagaccaacaatagctcccgcggggagcggagccccagcgagcctccagccgcgcgcgcacgaccggctcccgctcccggccgctcccggccggcgtccctgccagcactgctgccccacatgaaacagctgcaatcccgaggcttctggggggttggggcgggtgtgtgcgcgcgcgtgtgtgagtgtgtgtgtgtgtgtgtgtgtttaatagcttcccttctcttcttcccctccctgcctgctcgcctgcctgcctccgtcccccaccctcgctctcttacacacagaaagagagggcgagcgagagagagacacacacacacacgcacacgcacacgcaggttacatgaatgggaggcggtagccaatcctacgaggccggcgagccgcgcggcgcactggcgctgggagcagggccgcactccggcgcgggggggcgccacgcaggtgatgggcgcctctccgggggccacgcgcggccgctccctcaccccagtctcggttcctctgtctccttcccccttcctctccgccgccttctccatcttctctccttttacctcctttgctttctcgagttctccgagctctctcagttcggtatctttctggtctctttcttcttttaccctccttgcttgctttctcttcccctttctgaaactttctcttttcctttctggactttcttgtacttcctctcctcttgccttttgttctttcctcctcctttggctttctctccaggctccccgtagcacggtctcgtcccctctccctcctcttcgcctttccctgggt

SEQ ID NO: 106742 - DNA, 151 bp, Homo sapiens; identical to SEQ ID NO: 73484
  chr11:79152734-79152885
  Hyper

SEQ ID NO: 106743 - DNA, 24 bp, Homo sapiens
  chr11:81697887-81697911
  Hypo
agaattcaagcatggcgtgggtgg

SEQ ID NO: 106744 - DNA, 44 bp, Homo sapiens; identical to SEQ ID NO: 73496
  chr11:82214275-82214319
  Hypo

SEQ ID NO: 106745 - DNA, 1813 bp, Homo sapiens
  chr11:82443379-82445192
  Hyper
ctggtttcatctccacgtgcattttcccatcgttcttcagatttaggagaaacccacggaggcgcggcgctctccacagccgtctctaatgaagggaagcgtgcctcgaagtcagtcccggtgcgccccctcctcccccggcgccccttcccaaaccccgtcggatctccaaaggctggaataggcggtgcggctgtagcccgcgctgtaatcgtaggacacctgatggggcggcggcggcgggggcagggcgcagtctggaaagaagggggcgaaagaggccaaatggccccgcccgtcctccccgccgggagaatccgcagcggcggggtacagggggctcaagggctcgttcaaggtcaagccgccgcggggggcagtcagggggctctttttggtcggggagcagcccgggacgctccagggctcggggtacagtaggtttcccaccactgccggcggcggctcaaagaggccgggctccagctccgggggtccccgcagtacggaggctccggcggggaacacgtcgagaggctcggcggcaagcaagactgccgcctccgtgccggcgccgtagtcgggccccagcagctcaaagaactccacggcctccgcgcccttctccaggtcgcccaagctcacgtccggccccgacgggccacacccgccgccgcctgcccgggacggctccgtgaagaaggacggaggcagattgcgtgcccgcagcgggaccttcctggcccctgggatcgccgtggcccccgcggggcctgccacgtcccctcccgcgcccccagtgcccgcacctcctagcccggccgccggcgcagccacctcaccccccgccggctcggcacccccggggacgtggcgcagcgagtcgaagagcgcggccagacttcggctttgcaagctggcggccgcggcggcctgcgacgcctcccgccggggggcagccttgccgtgggccggggccgcgactgtcggggcgctaggggcggccagcggccgtttggctggcgtgtcggcggcgctcggggagggcgggccggggggcgcggcgcccatgaggccgctgcagcgcttgatctgcttctgcaggtacttgcggtggttcaccttccgcttcgacttgcccggcttgtccagcgccagcttgatgttgctggacgccgagtcaatgaagctgagtagatcgcgggtggcctcgcgcacgtcccctccttcggctcccgacagcagcgcacccgccggagccccggtctcatcgtcctcgaaacagcagcccttgtccagggctccgaaggcgccccctagcccgtccggggagcccccgaagccgaagggcacgaaagggtgcgtgctgaggagcgccgcctgcaccgccatcgccgcggctcccgggctgtccgcagcgctgcccgtgcgcccccgccagctcctgcccgccgcccagacccagctcccgccccggcgcggcgcgcgcggcgcagcctactagttccgggcctggctcgctgcgctgcctcccgggggagctcattaggtcttgtaagcaaggggcggagggagggagcgcgcggcgaccgtcccggtggtagaggggaggggcttacttagcctggcttggaggagtggggggtcgctttagttttctgagctttctgaagctcaacgccttaactccttcgtttccctttgccccgtggtgtttctcttgactcctctaaccgcaaggggtgaggaagagatggctggtctcaaactccagttcaggcccatgaggccgctgcagcgcttgataggcttc

SEQ ID NO: 106746 - DNA, 84 bp, Homo sapiens; identical to SEQ ID NO: 73505
  chr11:82851824-82851908
  Hypo

SEQ ID NO: 106747 - DNA, 30 bp, Homo sapiens; identical to SEQ ID NO: 43229
  chr11:83561479-83561509
  Hypo

SEQ ID NO: 106748 - DNA, 269 bp, Homo sapiens
  chr11:84431431-84431700
  Hyper
aggggacattccttccgggctgcggcagtggcagctcgctgggggacccaaacgctgtgctcgccgggcacatggagcgacagcctagaccgagctgccgcttcgatcactgccccctgcacccgccgtggccatcccggagccccggtggaagcaacgccgcgggcaagtaccgagcctctcggggtctcccttccctggggaacgaggcgtgtggggggagggacagaaccaagaaagaatttttccccctacggtgaatttggggg

SEQ ID NO: 106749 - DNA, 316 bp, Homo sapiens; identical to SEQ ID NO: 33990
  chr11:84431954-84432270
  Hyper

SEQ ID NO: 106750 - DNA, 45 bp, Homo sapiens; identical to SEQ ID NO: 73514
  chr11:84578824-84578869
  Hypo

SEQ ID NO: 106751 - DNA, 198 bp, Homo sapiens; identical to SEQ ID NO: 73517
  chr11:85071077-85071275
  Hypo

SEQ ID NO: 106752 - DNA, 150 bp, Homo sapiens; identical to SEQ ID NO: 73518
  chr11:85359853-85360003
  Hypo

SEQ ID NO: 106753 - DNA, 40 bp, Homo sapiens; identical to SEQ ID NO: 73519
  chr11:85379748-85379788
  Hypo

SEQ ID NO: 106754 - DNA, 30 bp, Homo sapiens; identical to SEQ ID NO: 73521
  chr11:85521596-85521626
  Hyper

SEQ ID NO: 106755 - DNA, 213 bp, Homo sapiens; identical to SEQ ID NO: 73522
  chr11:85564766-85564979
  Hypo

SEQ ID NO: 106756 - DNA, 39 bp, Homo sapiens; identical to SEQ ID NO: 73525
  chr11:85906236-85906275
  Hypo

SEQ ID NO: 106757 - DNA, 250 bp, Homo sapiens
  chr11:86085741-86085991
  Hyper
ctaagggggtgaggtcgaatcccagccttgacgccttagcaaccgagcgagcctttctcgcgtcccagcaacgcgcccttccctctgccgggcctattctccctggtgcccctcccttcctcgaggctgcagctcacccctcattgggtctctcgttggtcaggagggcgcgggtctgcacactctcactcggtgccggacatcagttcctgcggctcttgctgtgggagctgcccgagagccagagcag

SEQ ID NO: 106758 - DNA, 259 bp, Homo sapiens; identical to SEQ ID NO: 73532
  chr11:86382846-86383105
  Hyper

SEQ ID NO: 106759 - DNA, 69 bp, Homo sapiens; identical to SEQ ID NO: 73533
  chr11:86385660-86385729
  Hypo

SEQ ID NO: 106760 - DNA, 33 bp, Homo sapiens; identical to SEQ ID NO: 73536
  chr11:86641548-86641581
  Hypo

SEQ ID NO: 106761 - DNA, 217 bp, Homo sapiens; identical to SEQ ID NO: 73541
  chr11:87908267-87908484
  Hyper

SEQ ID NO: 106762 - DNA, 965 bp, Homo sapiens
  chr11:88241705-88242670
  Hyper
gaacacggggggctccgctccgcacgcgcaggccggcgtgctttccagggacattcacaacgacgaggagctctgagtgtaatctcttatgataagagtgtcatatttgggagacgacgggatacagagggccgactcggacactggcgagttgggggttgtgctccccgagtccaccgagtctctgaagggggacggcggggtgagagccaccagctcctccaggtctggcttggcggccgcagcctcgggaccggccgcggggctctcccgggccgcgtccccagccgcctgcgcccctgccgcgggctgcgcgcctcccgtgacttcgatggccggcagaggctggatttcggcaaaggtcgtcatggtcgtgggcaactggatctctttggggatcaggtaggacgagcagagcggggcgccgacgccggggctgggggccgcggtggacagcatcatggagttgagctcgctgatgttggccgtgaagcgggtgaccacactgctgatctgctccatgagggagccctgcgaggagctgctgcgcgccacaggctccgagtgcagcgacggcacatcgtcgtccgtgcggctggccgagcccgcgcggtggctcagcgtgctgatgggcgacggtgagcgcggccgcgcgggcgccgggaagtgctcctcagcctcggccacatcatacagcgccttggggccggcgtctggggactcgggcccgcctgggccggcgcctgcgcagcccgcaccgcccgtggcccccacgcccccagcgctcccgcctgcgccagcgccagcgcccaggccacggctctccgtgctcttggggaagggcttgatgacggccgtttggttggggttttctttcttgttgatgtggatggacaggcgctgccacaggtgctgcccccggctgctcttctcattctgggcccacgtgacggattttccattgg

SEQ ID NO: 106763 - DNA, 30 bp, Homo sapiens; identical to SEQ ID NO: 73546
  chr11:88796652-88796682
  Hyper

SEQ ID NO: 106764 - DNA, 481 bp, Homo sapiens
  chr11:88798746-88799227
  Hyper
aaacttgcaggacctcgtagcgttcctggctctaccagccctccacctgcccaccacttgccctcctgggtctttttagccccagctcccgccccttgcttgattgctctccatccctgcactgggggaggggctccagcggtatcctatatccgtggtaactatagccaagagaaagaaaaaggcgctgtgcttaccaggtgcgcgccctgagccttgcgcccccaggcagccgctcctcgagggcttcctgcgctctcgtagcggccttggctgcagctggagcgctagtgtcggcgatggaggcagcggtgacagcaggcagaacggctgcggggcccgcggcggtggcgctcgctctctcgcgccagcgccgggagcacgtgccgcgctcgggcagacgcagctggaagcgcagcgcagggctggcttatactcccgcagcgcgcggcgggggttggcagaacggccagggcataga

SEQ ID NO: 106765 - DNA, 475 bp, Homo sapiens
  chr11:89224313-89224788
  Hyper
gcaggacagagagaacgcaaggagagcctagcccgccatcctaccaggcagaggtgtttaaccccttcgttggcgagccagctcctccaggacacagccatgccgccggccccgccgcgctgcgctctgtgcccgccggaccgagaaggagcgggcggcggccggggcagcggttacagttgtgcggcctgccgggccgctgagcgaggaccgagggtcaaagactgagtggaagcccgaaggcccggcgccgagccagcccgggcggggtctgctacccagagccgggttttccgggcgccctgactcccacccgcaccgggtcagctctgcccactcagctgcccagacgcccagcgctctgagcgcgcggcccaggctgcaccagtctgctccgccgcgccggcccctttgtctaggggcgagcctgttgttgtggctgctgctgttcaggatgtcccgggtgggaacttgg

SEQ ID NO: 106766 - DNA, 95 bp, Homo sapiens
  chr11:89785685-89785780
  Hyper
agtttttggagccctcgggcttctgcgccctctcgtggagcggaggcagctcaagctggtacttttcccccaaccgctcccggcaggggcgctcc

SEQ ID NO: 106767 - DNA, 21 bp, Homo sapiens
  chr11:89899713-89899734
  Hypo
tacagattggctgggcgcggt

SEQ ID NO: 106768 - DNA, 30 bp, Homo sapiens; identical to SEQ ID NO: 73554
  chr11:89957319-89957349
  Hypo

SEQ ID NO: 106769 - DNA, 30 bp, Homo sapiens; identical to SEQ ID NO: 73556
  chr11:90705557-90705587
  Hypo

SEQ ID NO: 106770 - DNA, 2314 bp, Homo sapiens
  chr11:91957315-91959629
  Hyper
gaagagattggaccacgttagctgcttagtctagttccctcctccacaaggcaatcggatgaccccaggatctcaatgtttaggaaagtcgtaggagccctcactgggaggcacatttttagtccagaggcacgacatttgatggtttaatcttcacactacaaactagccttgggacgttatataaaccatgttaacctcgatgtgcctcagtttcctctttgtcccaggagagtaacgcgttctctgtcttcacagggatgtggtgcgggtgagactcaatgcactgtgcgaaagctctcccaagccagcaagcaccacgctctccccgcggcaggaaagtacgttggtgtcatcctagagccccagagggctgagggaagactcgagctctaaaattagccgcttccaggcccggcgccgggaatgccctccagttcgccgcgcctcctccgccgccccctcccgcgcgccccctctcccctgcgccacgctcctagatcgctagtcatccccgccgccgaggctcctctccccctcgcccttttcgctcgcggtttgggaggaggagactgcgagagacaagcgcgagggggagactggagaggggcttggccgtgcgtcggcgtcggctgtgatggggagcccggagcagccaggcggcgagcagtagcggcggcggctgcagctcggagcagacaggagagccggcgctcctccccgcaggctgcgctgtgaactggcctgcggattgggatctcgcgcctcccgtccctctcctcccgctgctgttctcttcatctcggctcccctcctccgcttgcgaacccccggcggcggcggcggcggcgtcccgagcgcagagcgcttctgctcgcggcctcagtcccggctagcgcgcggtgggcgctgcggcggcagcagccgggggaccggctcgcccggagcaagagcgccgagcaccgggtgaagaagaccacgggggaggcgcctcgtagagccgtggatcgccagcggaggcaagggtgcgtggggatttgtagcgtgatgatttggctgcctggtgcaccgactggagcgcgcctgccggagcacagcctcagctgctgggtgcaaatgggctgcgaggtgggctggggaggcgagagccgacgaagcgcgtgggggaaacttttcaccttgtaaagttccaacctccgcgcagccccgagccgccgttgctaccgctgcaaacaggagaagagggtggcttggccccgcggcgggagccgggaggtttacacggagagttggccaagtttggggctgaggatctggggaggggttgcgaggggggttgcggatcagtgcacccatccccggctcccagccgcccctgcaggtggatgagaaggttcaggtggcgagcctgcttggcagccggtgcctctcgggcgcagtgggggatgttcagatgccgatggatgatgcacttaggggaccccgaggtgcaagttgggtcatcgctaggcgaggcgcggcgcagagagggagcccagcctccactttcgctaggaaagggaaagggttaccagtctgcgggtccgttccccacgcctgactcgggcttgcggggcttgtggtcagggtgagatgtagtgaacggcggcggcggctcttcgactggggacgacatcctttacggagtggttggggacagagactgtccctgctatcttgacaaggagagggaaccggaatgctttgcgagagtgcatgatttttggcgggcgtgtgggaaggctgcttgtctttgaaaagaaagcagcgcgggtctgaccatccccaggagtgcggaggagctgtctccggattgggggcgagaacgccaggggcaccagctccgagctcaggccccactcccgggcggttcgggacgaatcccctctacaggccagtgtgtgtgcagggcaagtgtagggggctgaggggcgctggcggggaggcagtagaggtggcctggaccatcttggcgcggcgcgcggtgagcgcgaggattccgccagtgggagtcgctgagctaaagtgcatctggccccccggcttgcatgatggcgagcccggatatttttagctgtgctgtgatctgaattccctcctctcctctctcgttgacttttgtcacatgtgctttccgagatggtttaacattgaacatgattgggctttgcggaaagcaacttttattcactttccaccgttctcctcttgtgggcggggggtggcgggggcgtgcttggggcaaggatgcaggggtggccggagtttggctgcg

SEQ ID NO: 106771 - DNA, 128 bp, Homo sapiens; identical to SEQ ID NO: 73563
  chr11:91959986-91960114
  Hyper

SEQ ID NO: 106772 - DNA, 101 bp, Homo sapiens; identical to SEQ ID NO: 34006
  chr11:91960369-91960470
  Hyper

SEQ ID NO: 106773 - DNA, 73 bp, Homo sapiens; identical to SEQ ID NO: 34007
  chr11:92675236-92675309
  Hyper

SEQ ID NO: 106774 - DNA, 85 bp, Homo sapiens; identical to SEQ ID NO: 73567
  chr11:92929479-92929564
  Hypo

SEQ ID NO: 106775 - DNA, 30 bp, Homo sapiens; identical to SEQ ID NO: 73568
  chr11:92931349-92931379
  Hyper

SEQ ID NO: 106776 - DNA, 610 bp, Homo sapiens; identical to SEQ ID NO: 73569
  chr11:93063447-93064057
  Hyper

SEQ ID NO: 106777 - DNA, 88 bp, Homo sapiens; identical to SEQ ID NO: 73570
  chr11:93476681-93476769
  Hypo

SEQ ID NO: 106778 - DNA, 21 bp, Homo sapiens
  chr11:94064788-94064809
  Hypo
ccaccgcgcctggcccaagaa

SEQ ID NO: 106779 - DNA, 812 bp, Homo sapiens
  chr11:94134049-94134861
  Hyper
gcgtgatcattatgtcggcaactgccaggttgacgatgaagaggctggtggccgagtgcattcgctggttcttgaagatgacatgacagaccaggacgttgccaaagagtgagaagacaatgatgaaggagtaagccacaatgagcagggctttcaccgtggggttctgggactcagcgccgtagcgcctcctgcccacaaagttctgccagtcggagaaggtgtagttgttccaagagaagaagtgcgaggcattgggcacggccagggccgcctccgcgctctgctcgtcggcccggccctcgtggggctcggtggctcgcaccaaggggaggagacagagcagcaagaggtgagggaccattttgcaggagccacccctcccctgggagcctgcgggccgggcgtcccctcccgctgggatcggagcgcgcagccggggtgcggggcgcacagcatacaaggccgtcccgaggagccagggagcccggacgcgcggagcaccgcgccgcccgccaccagcccgcggtcggcacgccagctccgggtttgttggagcacttttatatctctgctcccaccaggctgctagggagcgcctctgcctattgggcagcgcggcgtctctcgcggcgacggtgacgcgctctggctctgacaagcctggctccccccaccctaccgggtggcgccgttgctgaccccacgcccagccgttcccactcccgcctgaaactcctccgacagggcttcgcttcgggggctcagtccccagcgcgtacacactcgcgtggtgtcggcttagcctcttg

SEQ ID NO: 106780 - DNA, 169 bp, Homo sapiens; identical to SEQ ID NO: 73576
  chr11:94156922-94157091
  Hypo

SEQ ID NO: 106781 - DNA, 30 bp, Homo sapiens; identical to SEQ ID NO: 73577
  chr11:94275224-94275254
  Hypo

SEQ ID NO: 106782 - DNA, 26 bp, Homo sapiens
  chr11:94275794-94275820
  Hypo
ttttttttttttttccgagacggagt

SEQ ID NO: 106783 - DNA, 26 bp, Homo sapiens
  chr11:94276060-94276086
  Hypo
gggagtataggcgtgagccaccgcgc

SEQ ID NO: 106784 - DNA, 313 bp, Homo sapiens
  chr11:94277810-94278123
  Hyper
gctgggggcagctgccgccgctgccctgggcgtcgccaaccccgtcgcgaccggtgggcgtgctgctgtggtgggagcccttcggggggcgcgatagcgccccgaggccgccccctgactgccggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggc

SEQ ID NO: 106785 - DNA, 487 bp, Homo sapiens
  chr11:94473423-94473910
  Hyper
agcccacagaacaaacgatttcccaagcatcagaggagggcagacataacataacagagcagggaatcgggttagaacgggttatgctctgattttttggaaaatgggcaaacggggcggggactagggaggattccgccagccgggagttgggaggccgcgcgcgcctctgcggagcgtgacggccacggtcgcctagcaacgagcggggatgcgcggggcgcctgggtgggcgaggggtgctcgccgccgccgccgcgcgccctcgggcccccgggaccgcgggaaaacttcgcggctcctcggcgctggggcgtcggcgccaggcccggcagacagagcaatgcgccccgcgggctgagggcagaggatgcggccgcggcccagcgcccggccgggggagccgcggggtggcacgcggggaaagttggcgcgcgcctgaccgcgcctggaagccgcgcggtgccagggccgagttgtcccccaa

SEQ ID NO: 106786 - DNA, 58 bp, Homo sapiens; identical to SEQ ID NO: 34015
  chr11:94474489-94474547
  Hyper

SEQ ID NO: 106787 - DNA, 653 bp, Homo sapiens
  chr11:94501445-94502098
  Hyper
gtagggttctagtgacgagcccgggcgaccctccccggcccgcgcgcggggagcggggagcgcggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaaggtaaccagcccccactcgaggtgccgggagggcgtctccgagtctcccacgcgaagaacccagtcgccccgggctccccgggcccctgctgctcacggaagggggcagcttctgggggcccggggctgagatcccagattgttgtttttaagcgggttcccttgccccgctccaggtccagttgcctgcgggccgggcctcagcgtcttgccgccccgcgacccacgttgactgaagttgtggccccggggtttgggccccggggtgctgcgcgcccgacgcggggctggcctttcctgaggggcgcagccatatggccagacactccgaggcgcgcccgcgcccgcgcgcgggtctcgcggcgagggaggg

SEQ ID NO: 106788 - DNA, 400 bp, Homo sapiens
  chr11:94502372-94502772
  Hyper
acaataatctgctttcgcggggagaaaatttaaactttccaaatggaactgttttttcttggaatgtgacatttgtggcaggagggagagtggtacgttggccgatgacagccgagcggaacggtggcctagtgccgggacagggaccgagcgtgccccataggcggccgggctggaggacgcggcggcagagcagacgagccctggcgcgcacctctagggcctccgctacctggactgcgctcgcggcgacgtgtccaagtttcccccctcagagccccaggccgagaatcccgggtatctgcgcaaagctcccgcgcctcgcccaccctactcttcctatctttactgatgactaggaagactttccttttccatttttgttcgaagatttttgcct

SEQ ID NO: 106789 - DNA, 247 bp, Homo sapiens; identical to SEQ ID NO: 73588
  chr11:94884155-94884402
  Hyper

SEQ ID NO: 106790 - DNA, 18 bp, Homo sapiens
  chr11:94885458-94885476
  Hypo
agtaggataaaaggccgg

SEQ ID NO: 106791 - DNA, 26 bp, Homo sapiens
  chr11:94892054-94892080
  Hypo
tcctccctgggcgacaaagcaagact

SEQ ID NO: 106792 - DNA, 24 bp, Homo sapiens
  chr11:94895717-94895741
  Hypo
gcgagactccgtctcaaaaaaaaa

SEQ ID NO: 106793 - DNA, 30 bp, Homo sapiens; identical to SEQ ID NO: 43237
  chr11:94924721-94924751
  Hypo

SEQ ID NO: 106794 - DNA, 30 bp, Homo sapiens; identical to SEQ ID NO: 73593
  chr11:94965054-94965084
  Hyper

SEQ ID NO: 106795 - DNA, 146 bp, Homo sapiens; identical to SEQ ID NO: 73594
  chr11:95007432-95007578
  Hypo

SEQ ID NO: 106796 - DNA, 30 bp, Homo sapiens; identical to SEQ ID NO: 73595
  chr11:95462538-95462568
  Hypo

SEQ ID NO: 106797 - DNA, 94 bp, Homo sapiens; identical to SEQ ID NO: 73596
  chr11:95488635-95488729
  Hypo

SEQ ID NO: 106798 - DNA, 43 bp, Homo sapiens; identical to SEQ ID NO: 73597
  chr11:95658708-95658751
  Hypo

SEQ ID NO: 106799 - DNA, 172 bp, Homo sapiens; identical to SEQ ID NO: 73602
  chr11:98437969-98438141
  Hypo

SEQ ID NO: 106800 - DNA, 120 bp, Homo sapiens; identical to SEQ ID NO: 73603
  chr11:98480681-98480801
  Hypo

SEQ ID NO: 106801 - DNA, 30 bp, Homo sapiens; identical to SEQ ID NO: 73605
  chr11:98627345-98627375
  Hypo

SEQ ID NO: 106802 - DNA, 818 bp, Homo sapiens; identical to SEQ ID NO: 73607
  chr11:98891098-98891916
  Hyper

SEQ ID NO: 106803 - DNA, 1217 bp, Homo sapiens
  chr11:100997659-100998876
  Hyper
gctttcggttctggccggccacctctcaagtcccacccctcccgggggaacggtgccttaactcctctccaagacaagcactcctggtaaacgtccttcttctaagaaagaagcatttcataaagcccccaactcgccgcgcactttctgccccactgggctacagcggacctagtgtgacgctgcacgttttaaatcggggttggttctgcttcggaatctggaagattcggaaagttaaaaaacaaacaaaaaaacagctttcagggaggcacgccccaaaaatagtatattctgcgcccaccttcgtgtccccaagagtgaggagaggagggaagaagaagggaggcaactgcccctgtgctgtgtcccgctgcccaccctctccggccgccccggggagcgcagcggtgcgctggggctggggctgagggttggcggccgccgccgccaacggaaccgctactcccggacgcgctgggcgtgccccgtcccgggccctcacctcaggtagttgagatagggcgggtagacctgcggcaggccctccttgagcacggcggcctggtagccgagctgcgggagcccgttgaggccgagtgcagggtagagcgcgggggccgccccggcggcggcggcagaggcggaggtggagggcaggccgtcccgcgggagcaggcagccgctcgcgcccggcgccttgcagggcggcggcgcgaacgggccctgctggggcggcgcgccctccgctttgtacaggatgcactccagggtcgaccccgaggaggacgcagacgagactgaggcactggcgggtgcggccgtcaccgccgcttccccgggtctggatggggtcgctcgcggcggcagcgggggcggtggccccaacgggaaatccgggaaggctgcggggttggcaccggccacaaggtaggaacgcggggagcgcgcggaggcctccgcgccttcctcctcctcctttatctttagagcgggcggctggaagtcgctatagagagggtacgcgtcgtccttgggctcggcgtcgggcgggtacgcgcagtcggggaagtcgcctacagcgaccggggtggacgaggcacagggtgaactccgcggcggggcaaaggcgctggcagccccggccccgccgtcgtaactttcgtcttccagcagctgccgagtgcgggctgccaataaggcgtgattgagaggca

SEQ ID NO: 106804 - DNA, 40 bp, Homo sapiens; identical to SEQ ID NO: 71886
  chr11:100999320-100999360
  Hyper

SEQ ID NO: 106805 - DNA, 118 bp, Homo sapiens; identical to SEQ ID NO: 71887
  chr11:100999601-100999719
  Hyper

SEQ ID NO: 106806 - DNA, 74 bp, Homo sapiens; identical to SEQ ID NO: 71888
  chr11:101000148-101000222
  Hyper

SEQ ID NO: 106807 - DNA, 18 bp, Homo sapiens
  chr11:101361883-101361901
  Hypo
ttagaaaatcctaaccgg

SEQ ID NO: 106808 - DNA, 463 bp, Homo sapiens
  chr11:101453090-101453553
  Hyper
tagagctgagaacctcgggaaaccgcttgcgggtggatgtgacaagtcaggaaacttgactacccaatcacccaaaggggcaatgggacagaaatgctatctgcccgctgcacatgtggtcacagcggtgtcggggaagcggagtcttttcttctggagtccactctgcttactccctacctcccctcccgccacccacccagctaaaaaaaaaaataccctagattcataaacaaaagcttgcagttacccacagcccaatacaaacgacccgacgccctcacttctatagcccgtgagtctcccagcccctaacaggctcgtctccccagacgccccgggtgaaaaggttcgcgccgccggtggagagtcctattggttctatttctgtcttcactccaaggccccaggaccggggagaggtcctggtctaactttggctgtcccacggtccaaggacctc

SEQ ID NO: 106809 - DNA, 602 bp, Homo sapiens
  chr11:101454145-101454747
  Hyper
tcctggctctcgttgcgccgcgcagcggctccggcagcgccccggggagaactgcccctccggggcccgaacgccgggctctggctcatggcgggaacgcccgactggcctgggccccgctcccgggggagccgagtgggcagttccagcggggacccggtgcggagggttcgcgtcagcggccgaactggacctgggcagaccggtgcccaggggacgacggtgaagcagggggtgcagacgcccgccgcaagtggctcgcccactggcccggggaaaagtcaccacttaagggggtgcaaagaggatcttgacctgagcaggtcaggccgaggagaccccgcgaggatgcgtctggggcgcccgggcagagagggcacaggcggggccgctggtggtagcgaagcgtaagagcggagagcaagggagacggagctgaagagttactatgtcaacagagactctccagccctcagctcccgccttcatcccccgcactctccgtcaagatccccacctttaaagggatccgagcgacgttctagaaagcagccaaagcctgtcctgtagccacaactttcaggaggcggtatgagcctgaa

SEQ ID NO: 106810 - DNA, 330 bp, Homo sapiens; identical to SEQ ID NO: 71893
  chr11:101918176-101918506
  Hyper

SEQ ID NO: 106811 - DNA, 330 bp, Homo sapiens; identical to SEQ ID NO: 71894
  chr11:101981634-101981964
  Hyper

SEQ ID NO: 106812 - DNA, 89 bp, Homo sapiens; identical to SEQ ID NO: 71895
  chr11:101982771-101982860
  Hyper

SEQ ID NO: 106813 - DNA, 20 bp, Homo sapiens
  chr11:102158481-102158501
  Hypo
gcgcccggcccctgtttact

SEQ ID NO: 106814 - DNA, 31 bp, Homo sapiens; identical to SEQ ID NO: 71903
  chr11:102961347-102961378
  Hypo

SEQ ID NO: 106815 - DNA, 29 bp, Homo sapiens
  chr11:102980027-102980056
  Hyper
tgaccgcagggagccgctgaagagctccg

SEQ ID NO: 106816 - DNA, 66 bp, Homo sapiens; identical to SEQ ID NO: 71904
  chr11:102980422-102980488
  Hyper

SEQ ID NO: 106817 - DNA, 96 bp, Homo sapiens; identical to SEQ ID NO: 71908
  chr11:103327717-103327813
  Hypo

SEQ ID NO: 106818 - DNA, 36 bp, Homo sapiens; identical to SEQ ID NO: 71909
  chr11:103327933-103327969
  Hypo

SEQ ID NO: 106819 - DNA, 1176 bp, Homo sapiens
  chr11:104034042-104035218
  Hyper
actgctagattgaaacgcacgatttctcctctcactcgtaaaaataaataaataaataaataaaatttaaataaacgtctatcacccagggaaagctactcttgactccttccacctatcaaaattgcctaagaaaggttgagtctgaccaaggggcggcgcagcttgcaactttcgccaactccgggatgaggcaccgcatcctggtaccagaggcttggacaccaaaatgacttctctagggtgcagcaaggtgagccacctggcttatcctatccccatcagcacgcgtcccacacctctcagtcccattccggaaatggagctctctcaggactggatacaggcaggagacctccctccccaaacaatgcattcagcccgagttcacattcaagattcaaaaagaaaggggaaaaacatagaaagaacaataacaatagcaaacatgatttttttttcagttaaaaaataaaatgagtctcttaccatctcgcctgaggttggcgttgcgcaaagctttgatggatgcgctctgcggggttgcagaagtgtcccgacagctgcaaaagtttgcgcagattagagtgtagacaaagatgagccggtgcatttgggatcagcgactagagacagcgtcgctccaagaaaaagccgggttctgctcccgggaccgacgccgcgccgccctgcgctctcgccgcctgcgctcgccctgcgctggcccgggtcgctgtgctaatcgccgagctctccccaaacttcctgcatgctgaactttccgagcgcgtgtgggtgccgcacttccttgtggtgctgagctgataaatggtgacgggacaaacaacaggttgacgtttgtttgttcgccccctccggtggccggcagctgcagcacaggctgcagggggcgggcagcgccgaatctagcggggcaggcgagcggagcagcagcgttctccagccccggccgcggcccctgagaggcgcgcactcgggctcagagcggcggcgcgagcacctcagctccccagtttcccaggccgggcctaaacctgctctgccactgagcatgcccagtttaatcgccggccgggactcttcccaccgccctgggctttaccctcctggttggacctgtaagggctcaggaaacaaactcgccaggaggaagtg

SEQ ID NO: 106820 - DNA, 21 bp, Homo sapiens
  chr11:104099607-104099628
  Hypo
agccaccgtgcccggctattc

SEQ ID NO: 106821 - DNA, 1156 bp, Homo sapiens
  chr11:105480721-105481877
  Hyper
ggctctccagattcccgggctgtttgctggtgagaaatctttgctgcagcgaggaccggagtcccccgcgcgcagcccagtggcagaagagggctaggctgagagggaagccaggactgtaggagagggaggcagcccgtcctcctcacgaacctgcaaggatgcggcaggggcctgggggcatggggaggtactaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccggtgagcacccagggggtgaagccagccgagcggtgggcgaggggcgtgcggagggagtgcgcgctcgaggaggggacgccaggagggcagcgatgctccgggctggtgcaggcttgctgggggatgtcggctgatgcgagctggagagcgcgtgtggcggccgcggcgccagtgtttgtgtgtatgtgagaaagcaaggggcgagcgcgagtgcgagtgaggcaaagatagagcgcatgtctcatccctgcgagcagccactagacgctccaccaccatcttttgcatgtgcaacatttgcagccggacagaaaacctctcccagggctatggagactgcgggaaaaatctggcggctcgcgatggattgctaaggagaactagtcataatcttaaaccaccgaaacctctttccttttttttctttcttttctttcttttctttttttttttttttttttggttgattttaattttagcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtaaggtgtgctccgatggggtgtgcatgtggctggttgtagcagatatccgaaagtgagttaaa

SEQ ID NO: 106822 - DNA, 808 bp, Homo sapiens; identical to SEQ ID NO: 34035
  chr11:106888283-106889091
  Hyper

SEQ ID NO: 106823 - DNA, 850 bp, Homo sapiens
  chr11:106889348-106890198
  Hyper
tgggagtctctgcctcgcctgtcgccacgtttcaggagcaacgaggacacttcgttgctgtcctctgcgcgccctccctgctccgaggaggtgcgcacaggagctcgggtcggactgagggccccaaccccaaacgccttatcctcggccctcgggagcagatgggtcccggcggcgctggtggggagaagggctcggggctggggggcgagaggcctccccctggagccaccttggggaaacctgacagtgtgaagtgggggttagggtccatgttgtcctttctccgagtttatttaggaagttccgaggcaaaagggaaaggccaagcgtccagccagcccactccagaggagacgctttcaggggaagggaaggacaggggcaacattttggcgcccatcctgctggagcagctcctggggacttgtgttccccgcctcgtgcgaggccgtgtgggcgcggagcgagcccagaaaggggcggcagtgaggacagcgtctgctctgacaagacagcactgttgctgagcctcagccgggcggggtgcgcggggctcccggctccgctggctcctcactagtgctggacagctccgcttgccacctatagccgcctttgcaggcgttgagaactggagaacagttcctcctcaaacgacctagcacctggcccgggggaaaccggggaatgatcccacgtccctcatcctcagggctctttgcgccaaatatgcgatctgtttgcacctgactgcaaatgctgctcagaaagctaaggggagtagggataaatgcttctcgaactgactcgccacagcgcgagcatgtcttgccgcgagttttcagct

SEQ ID NO: 106824 - DNA, 30 bp, Homo sapiens; identical to SEQ ID NO: 71929
  chr11:107047782-107047812
  Hypo

SEQ ID NO: 106825 - DNA, 1339 bp, Homo sapiens; identical to SEQ ID NO: 71930
  chr11:107461396-107462735
  Hyper

SEQ ID NO: 106826 - DNA, 1236 bp, Homo sapiens; identical to SEQ ID NO: 71933
  chr11:107798867-107800103
  Hyper

SEQ ID NO: 106827 - DNA, 48 bp, Homo sapiens; identical to SEQ ID NO: 71943
  chr11:108540610-108540658
  Hypo

SEQ ID NO: 106828 - DNA, 30 bp, Homo sapiens; identical to SEQ ID NO: 71945
  chr11:108603360-108603390
  Hypo

SEQ ID NO: 106829 - DNA, 471 bp, Homo sapiens
  chr11:109292773-109293244
  Hyper
ggcttggagccctggcggtggctgcctgacgtcaccggcctctctggcaataggctgcgagctcagctccctgaagcggcggcgaaggcggcggcggcggcggcggcggcggcagcagcgcggctcggtctctggtccattcactccacgctttctgcagccgccactgcagccgcgcggcgggggctccctccttgcagccagccggcggtccaggtaagagacaaggtgtgagtaaaggcttctgatggccgggtggcctgacggccaggtgcgagtggggaggacagctcacgcggcctgagcagccacccctggccatagctccagcccccgcccctgcccccggcccctgccctggcttgcttgcgcgctacctcgctactccgcagtgcaacagtttgcagctgcctcttgggagcagcaaggaggctctcctgtgcgctgcgggtctaccggctccagtatgcc

SEQ ID NO: 106830 - DNA, 393 bp, Homo sapiens
  chr11:109293506-109293899
  Hyper
agaagagatggagcgcgttcctgcgcgtcagccgcggtcgcggacagaggcagagtgggatgtggtgccaggggtatccccctgggaatgggacccaagggatctgacgctgtccagggagggcgagtctggacggggagggaaaggaagggaggactgcgtacccggagcccgcgcggcggcccggagtgggtgctgggaagggtaggatccaggcgaagacatcaaccgagagggcgcagaaaagaggagagccggcgctctgggaagtagggacttcaaccaaagcggctgcgtgtctgttgcaattataaagttgtgaagggcggaagggaggctgccttatctgctgagtaatctgcacctccgcggtgccggcgcagaccccatcct

SEQ ID NO: 106831 - DNA, 76 bp, Homo sapiens; identical to SEQ ID NO: 71951
  chr11:109294113-109294189
  Hyper

SEQ ID NO: 106832 - DNA, 21 bp, Homo sapiens
  chr11:109661438-109661459
  Hypo
ccaccacgcccggccgatatt

SEQ ID NO: 106833 - DNA, 30 bp, Homo sapiens; identical to SEQ ID NO: 43243
  chr11:109880267-109880297
  Hypo

SEQ ID NO: 106834 - DNA, 170 bp, Homo sapiens; identical to SEQ ID NO: 71958
  chr11:110089331-110089501
  Hypo

SEQ ID NO: 106835 - DNA, 30 bp, Homo sapiens; identical to SEQ ID NO: 71959
  chr11:110132980-110133010
  Hypo

SEQ ID NO: 106836 - DNA, 2402 bp, Homo sapiens
  chr11:110581773-110584175
  Hyper
gcgggggtggggaggcgggggacaggcagacagggctagaaacacccaaatcaattcctcagggagcgaaacggcagaggccggcagcccgcggcccacgtgcacttgctcagggaaccgttccagcgaaacctgacccggatcggaatcctcccgcagcacagcggccgtgtttatcggaatggaacgctacaagttgtcacctgcatccctctcccagctttgacagggaacacgcgctgcccccacgcccacaccgacacccggatccctatccagcccggccagagtcccaggggccagggaccagtgcagggagaaggtcccccacctcagccctcaggacccccaaccacagcccacccgcccccaccctgctcggttctaggcccagccgaacctacatgtccccgtagtgtcgagcgttatcatccacagtcgcccctcaaactgtgacccccacctgggagacccggaatcatccaggaccctggtgtggggggcagtactccccatatctgccccccgaaaactgctatggagcagccgcgcctcggcgggcaggtgagggggccgagcccaccagcgccgcagccccgctgcctaccttcttcagcgccggctgccgctcccgggcagacatcgccggccctgactttggggctgacaccgccaaagggcagtcagtgctcgcccaggccacttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgagacactcctgtcagggaagaggagcgccccggctgtccccctagagtctcctgctggggggacatcgcttccatgaagaaaatcttcaaacaaatcccagcccaggaggaggctacacgatcatgtccgcgggctgccggccggaggggcgaggacgcgcgggcggaggcgcggctgccgtgctcaggcagggagccgagctccgggtgctcgccgcgcgcctcccgtcggggccatgtacctccgcctgcgctcgacaccgcgggctggaggcgagtgcagcggcgacagcccgtcagcgccgcggcccgccccgcctcgggcccgccccctccgctccgggcgccctgcgccggggcccgcccccgcagccctcctcagccctcctccagcctgggccctcctagcctcgtcccagcctgcggcgcgcctggcgggcgtctctctatatatgttagcacaccggccaccggctgaccttttcggtctgtgactccgcgtgggtgcagcccgcaggagctcatcggcctgtgtcacgcacgggggcctctagtgcacggacacgcgcctctcccgccacctgcccactcccaccagaccccatcccttcccgcgccgtgcccgcggcggaaggcgcccctgcagcgcgtgcatccgcggagcggtggcgacctcagcctgagcagaggagttgcagtgattcctgcctcgctttcagcggactgcggagggaatcccccaccccaccccactggggatagggtggcacgtcgcagagtgtcgcagctgtacaaatttggaagcccacagcatcgcctgacctcttgtgcaatcccgaacgctagcctgttcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccgaaatttggctaagctattgagaaggctacaatatgtggaagtgtttatcagatatctgcgccgagagcataacttcctgtcagcccaaatagaggcaaaaatattttaaaggccaaagaataatcagagggagaggatttggagctgacccgcgttgagctgagtgttgctgcactttgcggggctggttgactggtacggatgattcggtagatggcattcttcccttggagtcaggactagagaagcagtggcggattagtgaggaaggacaccacgctatgatattagg

SEQ ID NO: 106837 - DNA, 30 bp, Homo sapiens; identical to SEQ ID NO: 71964
  chr11:111089918-111089948
  Hypo

SEQ ID NO: 106838 - DNA, 397 bp, Homo sapiens; identical to SEQ ID NO: 71965
  chr11:111154359-111154756
  Hypo

SEQ ID NO: 106839 - DNA, 100 bp, Homo sapiens; identical to SEQ ID NO: 43245
  chr11:111156679-111156779
  Hypo

SEQ ID NO: 106840 - DNA, 379 bp, Homo sapiens; identical to SEQ ID NO: 71967
  chr11:111169972-111170351
  Hyper

SEQ ID NO: 106841 - DNA, 780 bp, Homo sapiens
  chr11:111383125-111383905
  Hyper
ctcccccacccgccccgtctcgcgcccgccccgcccctcggcccgcggggttccaaggacggttggtcgcccccgccacagtcactcggccgctcagagcggcggggcgcacggggtcgagagagccagctctagggtttggggctgggaactgaagcctggcgtgaaggaagtgggagcccgggccgaggaggcgaaggggaaaggaaaagcgaggggaacctgagcgggagggccctgagaggagcgggaggctgcgggaaggggaggcctggcactcctgggggtcatgggggtcggggcgcggctcccggcctgggagggcgcgggtcctccccggcagcgccgcccgctggcccagctacgcgtgttgtgcgctgcgaggccggcgggggtcccgctgggcccgggggtgtcctcgggggccgcttgcgcccagccatggtagggcgtcccccggtgaaatggggtccgaggcgggccccgaccccgcgtcggcgctgcggaccgtccgggagctgcagccgcgggtgcccggtgctcggtttgtaggcagtgtcattagctgattgtactgtggtggttacaatcactaactccactgccatcaaaacaaggcacagcatcaccgccgcccggccgggaagaagacgccggctcgggcagcccgcagccttcgagagaagatgcctgagaagcgcggcgtcggcgtgggtcctgcgcagcctgccccgcgagcgcccgctgcaagtgcgaggaaacccgcggtttctccagata

SEQ ID NO: 106842 - DNA, 218 bp, Homo sapiens; identical to SEQ ID NO: 71971
  chr11:111385246-111385464
  Hyper

SEQ ID NO: 106843 - DNA, 1192 bp, Homo sapiens
  chr11:111411112-111412304
  Hyper
cttggctaaggtcagcgggagaggaggggtgagatgtggtgctagttttaggcacactgtgctcgttatcagattgcctaggggcccgactgaagtattcctccgcccagcgcctcgggcaaacgcgggatctcccagggaagctcggagggggacagggagctggttcccctctgcgactcgcccctctctggctggccgagtgtctggcgccaacctcgctggaggaggctgtcgggggcgggccagccagcggggctgccctcctcgcagtgacgtcccagggggcggaggggcgaccgactgactccgcgccctcccccccgcctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtggtgagtgcgcgcgctggggcgggggctggtgccggggtgggctcactgcaccccagctgctgctgaccctcttctgggtcgccacgtatgggactagaaggccgtcccatgccccactcccagacgcagcccttcggagtctcttgcgttctgggggcagtcgcacggcgtctgagacccacgccagttcccggagctgcgcagttccctgcgcgtcctggaacgctcgaagcccgttcccagtccagagttatgggggtgggttggagaatgtaggagaggtggggcagtgggcaaacctgccccagtgggtgccccttcggcccgctcctttacacgcatcgaatcagtccttgggaccacccccgcggggcaggcttgccagctggcccccgcctaccgcccgctccgggaggcggccgcagagacagcggggtagggatgctggatccccggtgccgtgggaaccctgcctgttactcctcgtctcttctgcggggttggatggctgggtcgagcgcccggtatgagagcgcttagagatcgggaaagaactccagttagtgtgggacgagccccacctgactccggggaatgactctctgcttccttcctcctgttgtgtcactgcagcctcggatttggacctca

SEQ ID NO: 106844 - DNA, 30 bp, Homo sapiens; identical to SEQ ID NO: 34057
  chr11:111412594-111412624
  Hyper

SEQ ID NO: 106845 - DNA, 30 bp, Homo sapiens; identical to SEQ ID NO: 71978
  chr11:112370516-112370546
  Hypo

SEQ ID NO: 106846 - DNA, 30 bp, Homo sapiens; identical to SEQ ID NO: 71979
  chr11:112651559-112651589
  Hypo

SEQ ID NO: 106847 - DNA, 177 bp, Homo sapiens; identical to SEQ ID NO: 71980
  chr11:113258642-113258819
  Hyper

SEQ ID NO: 106848 - DNA, 56 bp, Homo sapiens; identical to SEQ ID NO: 71981
  chr11:113286309-113286365
  Hypo

SEQ ID NO: 106849 - DNA, 744 bp, Homo sapiens; identical to SEQ ID NO: 71982
  chr11:113344994-113345738
  Hyper

SEQ ID NO: 106850 - DNA, 102 bp, Homo sapiens; identical to SEQ ID NO: 34060
  chr11:113346239-113346341
  Hyper

SEQ ID NO: 106851 - DNA, 23 bp, Homo sapiens
  chr11:113373844-113373867
  Hypo
cgagactccgtctcaaaaaaaaa

SEQ ID NO: 106852 - DNA, 265 bp, Homo sapiens; identical to SEQ ID NO: 71985
  chr11:113552719-113552984
  Hypo

SEQ ID NO: 106853 - DNA, 262 bp, Homo sapiens; identical to SEQ ID NO: 71986
  chr11:113560957-113561219
  Hypo

SEQ ID NO: 106854 - DNA, 93 bp, Homo sapiens; identical to SEQ ID NO: 71988
  chr11:113902101-113902194
  Hypo

SEQ ID NO: 106855 - DNA, 59 bp, Homo sapiens; identical to SEQ ID NO: 71989
  chr11:113907046-113907105
  Hyper

SEQ ID NO: 106856 - DNA, 525 bp, Homo sapiens; identical to SEQ ID NO: 71990
  chr11:113929598-113930123
  Hyper

SEQ ID NO: 106857 - DNA, 434 bp, Homo sapiens; identical to SEQ ID NO: 71991
  chr11:113930367-113930801
  Hyper

SEQ ID NO: 106858 - DNA, 37 bp, Homo sapiens; identical to SEQ ID NO: 71992
  chr11:113931030-113931067
  Hyper

SEQ ID NO: 106859 - DNA, 821 bp, Homo sapiens; identical to SEQ ID NO: 71993
  chr11:113931299-113932120
  Hyper

SEQ ID NO: 106860 - DNA, 48 bp, Homo sapiens; identical to SEQ ID NO: 71995
  chr11:114112577-114112625
  Hypo

SEQ ID NO: 106861 - DNA, 87 bp, Homo sapiens; identical to SEQ ID NO: 71996
  chr11:114112965-114113052
  Hypo

SEQ ID NO: 106862 - DNA, 183 bp, Homo sapiens; identical to SEQ ID NO: 71997
  chr11:114115465-114115648
  Hypo

SEQ ID NO: 106863 - DNA, 248 bp, Homo sapiens; identical to SEQ ID NO: 71998
  chr11:114120983-114121231
  Hypo

SEQ ID NO: 106864 - DNA, 30 bp, Homo sapiens; identical to SEQ ID NO: 72000
  chr11:114314811-114314841
  Hypo

SEQ ID NO: 106865 - DNA, 136 bp, Homo sapiens; identical to SEQ ID NO: 72001
  chr11:114494121-114494257
  Hypo

SEQ ID NO: 106866 - DNA, 30 bp, Homo sapiens; identical to SEQ ID NO: 72003
  chr11:114743244-114743274
  Hypo

SEQ ID NO: 106867 - DNA, 1514 bp, Homo sapiens; identical to SEQ ID NO: 72007
  chr11:115373239-115374753
  Hyper

SEQ ID NO: 106868 - DNA, 443 bp, Homo sapiens; identical to SEQ ID NO: 72008
  chr11:115374991-115375434
  Hyper

SEQ ID NO: 106869 - DNA, 62 bp, Homo sapiens; identical to SEQ ID NO: 72009
  chr11:115375832-115375894
  Hyper

SEQ ID NO: 106870 - DNA, 579 bp, Homo sapiens
  chr11:115529982-115530561
  Hyper
ctcccatctctacagcgactcccctatgaccgtcccccacccggtgctctcgggccacggggaagggacactcgggaaagacaccagagaccgggagggtgcagctgggctcttcgcggggagcgggcgggaggccttcctgttacatgtcgcagctgggacacagacggcagcgctccagggtccacttgccggcttcggttccctcaggcccaggaccaggctccacaccgctgtcgcgtcccttagccgtgtgggctgtagcacagagggggcaaacacctccaggggcttgtgccaagtaattaccaagcaaattcccggcgatttcctctcctccccccgcccccccgggcagtgcccgctgcgtgttccctgattcggcccccggctgtgcaatcagctccaggtaacctgcggggacccgtaattgctctggagttgcctgcgagtttgcaaggtaagcacgcgcggcgcttctccctggccctggggcgcgcggtggagcgccttgcgcccgcccccgatgggccggatgccggggacctgcggaagcagaggctgcgggggtagagatcc

SEQ ID NO: 106871 - DNA, 190 bp, Homo sapiens; identical to SEQ ID NO: 72014
  chr11:115587766-115587956
  Hypo

SEQ ID NO: 106872 - DNA, 997 bp, Homo sapiens
  chr11:115630411-115631408
  Hyper
ccccttctccagcctcgcctccccaatgcgcttcccgcctctgcatcgccgccggccccttcacgcctctaccttgggcgggtttggggtaagggccgcgcagaccctaagggaaggcccgaggtcgccggagctcctcctctcgcggctgagtgagggtctgggaggccagatgaagggagctgctcggctgagctgcggaccagcgcgagagcagcgggcagtggcggaccagcgccagggcagggcaggggtggacagagggctctccccacccttccctcctccagtgaaagtaccagaagagatggcggccgctccgccgagtgtcattaccgcggaagcagcagaagccggcggcaggagcgggcccgagagcccgcggccagtggcctgcgcaccccgcgcccagcgcccccgccgcgggtcatcagtgtcagcgttgaggggtcccggggagcggttgcagggcggcggcggcggccgggtcatcagaagcacagtggagccgccccctgctttgggaggagcaaaagagcctctcgcttgcctcccgctcgagctccttctcctcttccttttcctagcgcttctctccctccctcggcggggtccgcagagacagctgggcaggcggaggctgcgcgcctctcgcacctccacgcccaccctcccgccgcccccccctcggcctgaaagatctgcgtccacaccaccctgcacccagggcccgtcaggttttgcagaagtttgctgagggtcctcacagggggtctcccaggggaaggggtggagggctggaggggccgcggtgggaagaggtggcagacgccgcctggcaacggagaccctaccctttctagaaattcagaacgcagagaaaccagtgcccagccctgctcttcagcaaacggtgtatttcagcccgagtttccttccgggggtttggctgtgagtgtgtgtgacctcccagatggcggcacggttcagatcccat

SEQ ID NO: 106873 - DNA, 163 bp, Homo sapiens; identical to SEQ ID NO: 72019
  chr11:115733020-115733183
  Hypo

SEQ ID NO: 106874 - DNA, 30 bp, Homo sapiens; identical to SEQ ID NO: 43252
  chr11:115763341-115763371
  Hypo

SEQ ID NO: 106875 - DNA, 30 bp, Homo sapiens; identical to SEQ ID NO: 72021
  chr11:115771022-115771052
  Hypo

SEQ ID NO: 106876 - DNA, 42 bp, Homo sapiens; identical to SEQ ID NO: 72023
  chr11:116146911-116146953
  Hypo

SEQ ID NO: 106877 - DNA, 64 bp, Homo sapiens; identical to SEQ ID NO: 72026
  chr11:116451313-116451377
  Hyper

SEQ ID NO: 106878 - DNA, 30 bp, Homo sapiens; identical to SEQ ID NO: 72027
  chr11:116453617-116453647
  Hypo

SEQ ID NO: 106879 - DNA, 596 bp, Homo sapiens; identical to SEQ ID NO: 72028
  chr11:116706286-116706882
  Hyper

SEQ ID NO: 106880 - DNA, 32 bp, Homo sapiens; identical to SEQ ID NO: 15607
  chr11:116890012-116890044
  Hypo

SEQ ID NO: 106881 - DNA, 75 bp, Homo sapiens; identical to SEQ ID NO: 43254
  chr11:116952331-116952406
  Hypo

SEQ ID NO: 106882 - DNA, 30 bp, Homo sapiens; identical to SEQ ID NO: 72031
  chr11:116976981-116977011
  Hypo

SEQ ID NO: 106883 - DNA, 39 bp, Homo sapiens; identical to SEQ ID NO: 72032
  chr11:117010334-117010373
  Hypo

SEQ ID NO: 106884 - DNA, 30 bp, Homo sapiens; identical to SEQ ID NO: 43256
  chr11:117054963-117054993
  Hypo

SEQ ID NO: 106885 - DNA, 37 bp, Homo sapiens; identical to SEQ ID NO: 72034
  chr11:117068532-117068569
  Hypo

SEQ ID NO: 106886 - DNA, 62 bp, Homo sapiens; identical to SEQ ID NO: 72035
  chr11:117186235-117186297
  Hyper

SEQ ID NO: 106887 - DNA, 43 bp, Homo sapiens; identical to SEQ ID NO: 72036
  chr11:117307989-117308032
  Hypo

SEQ ID NO: 106888 - DNA, 30 bp, Homo sapiens; identical to SEQ ID NO: 72037
  chr11:117344740-117344770
  Hypo

SEQ ID NO: 106889 - DNA, 190 bp, Homo sapiens; identical to SEQ ID NO: 72038
  chr11:117376155-117376345
  Hypo

SEQ ID NO: 106890 - DNA, 1130 bp, Homo sapiens; identical to SEQ ID NO: 72039
  chr11:117667010-117668140
  Hyper

SEQ ID NO: 106891 - DNA, 178 bp, Homo sapiens; identical to SEQ ID NO: 34080
  chr11:117746361-117746539
  Hyper

SEQ ID NO: 106892 - DNA, 62 bp, Homo sapiens; identical to SEQ ID NO: 72041
  chr11:117747138-117747200
  Hyper

SEQ ID NO: 106893 - DNA, 257 bp, Homo sapiens; identical to SEQ ID NO: 72042
  chr11:117747499-117747756
  Hyper

SEQ ID NO: 106894 - DNA, 30 bp, Homo sapiens; identical to SEQ ID NO: 72043
  chr11:117973031-117973061
  Hypo

SEQ ID NO: 106895 - DNA, 48 bp, Homo sapiens; identical to SEQ ID NO: 72044
  chr11:118023387-118023435
  Hyper

SEQ ID NO: 106896 - DNA, 450 bp, Homo sapiens; identical to SEQ ID NO: 72045
  chr11:118023775-118024225
  Hyper

SEQ ID NO: 106897 - DNA, 254 bp, Homo sapiens; identical to SEQ ID NO: 72046
  chr11:118663050-118663304
  Hyper

SEQ ID NO: 106898 - DNA, 32 bp, Homo sapiens; identical to SEQ ID NO: 72047
  chr11:118663788-118663820
  Hyper

SEQ ID NO: 106899 - DNA, 52 bp, Homo sapiens; identical to SEQ ID NO: 43257
  chr11:118768516-118768568
  Hypo

SEQ ID NO: 106900 - DNA, 30 bp, Homo sapiens; identical to SEQ ID NO: 72049
  chr11:118769490-118769520
  Hypo

SEQ ID NO: 106901 - DNA, 41 bp, Homo sapiens; identical to SEQ ID NO: 72050
  chr11:118769734-118769775
  Hypo

SEQ ID NO: 106902 - DNA, 30 bp, Homo sapiens; identical to SEQ ID NO: 72051
  chr11:118780738-118780768
  Hypo

SEQ ID NO: 106903 - DNA, 32 bp, Homo sapiens; identical to SEQ ID NO: 43258
  chr11:118781045-118781077
  Hypo

SEQ ID NO: 106904 - DNA, 40 bp, Homo sapiens; identical to SEQ ID NO: 72053
  chr11:118997065-118997105
  Hypo

SEQ ID NO: 106905 - DNA, 30 bp, Homo sapiens; identical to SEQ ID NO: 72054
  chr11:119040119-119040149
  Hyper

SEQ ID NO: 106906 - DNA, 30 bp, Homo sapiens; identical to SEQ ID NO: 72055
  chr11:119058038-119058068
  Hypo

SEQ ID NO: 106907 - DNA, 515 bp, Homo sapiens; identical to SEQ ID NO: 72056
  chr11:119191642-119192157
  Hyper

SEQ ID NO: 106908 - DNA, 993 bp, Homo sapiens
  chr11:119210435-119211428
  Hyper
tctcggagcgcttggcgctgaaggcggatcgcggaggcaccgagcactccccggcaggcccggtgggccccgcgggtcccgcctctcctcgcggcccggggtcccctcgaggtcccggcagtcctgcggggtaagcggggcggcagggtgagagtagcggcggctcagcccgcagcggggcggcgactctaaggtcaccgtacccctccccgcccctgcctgagcttcggccagcgcctcctcccgcacgggtacctcctccaccccttcccgcagggcagatctggggggctggccaagggggctcccgccgcctgggcccctcccccgctcagggctgcaaagcgcggggagtggcgccccctggcgggagacccgagtcccggacaccgggagctggagctgcggccgcgcctgctcggacatcgccaccgatagccgcggcggtgccttcttacccggcctcccgccctcgcctttctctcccggagccccgggcgcgccgtcgcggccgtcgcggccatcgcggcccggcaagccctggctgccatggtggcccggcgtgcctggaaggccggggtgccccgggcagaggctggggatcttgttgtcgtccagtgggggcgagccggccgccaggcccaggagcagcaggacgaggagtggcctcatagcgctggcaccgggagcccggacgccggggtcctctcgcagtctgtggaccaggcaggactggagtcgggacccagaatcctgggacctgcctctctccccaccccggcgcggcccagtcggtccccaccccactgccgtgcccctgaggctgagcgctcgcagggccgagcatccggagagcacaggcaggcgcgagagggtgggagcggccagccctccctcccaccgccggcccgcgccagcctttcccacagtcccctccccagcccctttcccctcctccgccagactcaccccccctcccggctccccgatggc

SEQ ID NO: 106909 - DNA, 378 bp, Homo sapiens; identical to SEQ ID NO: 72058
  chr11:119234569-119234947
  Hyper

SEQ ID NO: 106910 - DNA, 158 bp, Homo sapiens; identical to SEQ ID NO: 72059
  chr11:119292746-119292904
  Hyper

SEQ ID NO: 106911 - DNA, 767 bp, Homo sapiens
  chr11:119293305-119294072
  Hyper
agctctcccctcccccgtccgcccgccttccacccagtccccgcctgcggcactgcggcttccttctcctccggtgccccgcacccagcccgccgcgaggtcacccggcagattccctctagctcgccatcctccatcctctccccgcagtttcatccgtcctcctccccgcctctgcgagctgggtttggggacgtctgggtggaatgtagacccacaggctgtccttggtgcccttcctccctgttctccagcgccccagccccagacaccagtcccccagcgggcgaaagcccgggagcgccttccccgaaagacatcagggtgccacgcggcccctgccctgcagaagcatccccctcccgcccctgcctggaaagcaggcccctccctaagctctgcgcccttcttccctgggcgccctcggaccgtggcccgaagcctagtgttgggaagtcttgcatgggcgcctgacggcggtccccgagccccaggtcccaccggctccagttcccacctggactggggtcttccgctgctgcagcctcctccagacgcgccgccgcctccggttgctgcacccagctcggagcccgcagttttcaccggggatggaggagagggggagcggggagccgggggctcagccaatcagaggcggagattgggggagaaaggacggcagggtggggtggggggtggggaaggaagagaaggcggtcccgcattggtgtgagagtggcaggttgcggcggaagggggccctc

SEQ ID NO: 106912 - DNA, 30 bp, Homo sapiens; identical to SEQ ID NO: 72063
  chr11:119354677-119354707
  Hypo

SEQ ID NO: 106913 - DNA, 30 bp, Homo sapiens; identical to SEQ ID NO: 72064
  chr11:119487017-119487047
  Hypo

SEQ ID NO: 106914 - DNA, 46 bp, Homo sapiens; identical to SEQ ID NO: 43259
  chr11:119524180-119524226
  Hypo

SEQ ID NO: 106915 - DNA, 37 bp, Homo sapiens; identical to SEQ ID NO: 72066
  chr11:119600611-119600648
  Hyper

SEQ ID NO: 106916 - DNA, 143 bp, Homo sapiens; identical to SEQ ID NO: 72067
  chr11:119608970-119609113
  Hypo

SEQ ID NO: 106917 - DNA, 30 bp, Homo sapiens; identical to SEQ ID NO: 72068
  chr11:119609728-119609758
  Hypo

SEQ ID NO: 106918 - DNA, 29 bp, Homo sapiens
  chr11:119611794-119611823
  Hypo
tctgattggtctggcgcagaatggtcaag

SEQ ID NO: 106919 - DNA, 398 bp, Homo sapiens
  chr11:119612034-119612432
  Hyper
gcatggacaaatgcacgaatgaatgagactgcgggaatgctgcccccacctcctctccgcctccccacctcgcctccaggtaccctgggcgcctgggaccctgcggggcctcctggaggcgggacgggcacggcgccacctagcggtcgtgggccgcggagagagcgtccctgtccttccccgtgtgggacctgcaaccgccccatagcgcagagtccgggaggctccagccaccgcctctgtcggccccattctctaggtccacagagggtagagacactcgggggaacgtacttttactggggtacggggagccctgccccacggctgtcagctcgggtcgggcgcgccgggtgcccaggaggcagcctcccaccctcccccgcacacgtcgttcc

SEQ ID NO: 106920 - DNA, 27 bp, Homo sapiens
  chr11:119612791-119612818
  Hyper
aggcacacacagaggcgcacacacaca

SEQ ID NO: 106921 - DNA, 446 bp, Homo sapiens; identical to SEQ ID NO: 72072
  chr11:119612998-119613444
  Hyper

SEQ ID NO: 106922 - DNA, 147 bp, Homo sapiens; identical to SEQ ID NO: 72073
  chr11:119884295-119884442
  Hyper

SEQ ID NO: 106923 - DNA, 652 bp, Homo sapiens; identical to SEQ ID NO: 72074
  chr11:120008071-120008723
  Hypo

SEQ ID NO: 106924 - DNA, 222 bp, Homo sapiens; identical to SEQ ID NO: 72075
  chr11:120039752-120039974
  Hyper

SEQ ID NO: 106925 - DNA, 30 bp, Homo sapiens; identical to SEQ ID NO: 72076
  chr11:120081073-120081103
  Hyper

SEQ ID NO: 106926 - DNA, 118 bp, Homo sapiens; identical to SEQ ID NO: 34096
  chr11:120110849-120110967
  Hyper

SEQ ID NO: 106927 - DNA, 93 bp, Homo sapiens; identical to SEQ ID NO: 72081
  chr11:120367603-120367696
  Hypo

SEQ ID NO: 106928 - DNA, 80 bp, Homo sapiens; identical to SEQ ID NO: 72082
  chr11:120382368-120382448
  Hyper

SEQ ID NO: 106929 - DNA, 131 bp, Homo sapiens; identical to SEQ ID NO: 34097
  chr11:120382817-120382948
  Hyper

SEQ ID NO: 106930 - DNA, 148 bp, Homo sapiens; identical to SEQ ID NO: 72084
  chr11:120383999-120384147
  Hypo

SEQ ID NO: 106931 - DNA, 30 bp, Homo sapiens; identical to SEQ ID NO: 43264
  chr11:120410117-120410147
  Hypo

SEQ ID NO: 106932 - DNA, 30 bp, Homo sapiens
  chr11:120434939-120434969
  Hyper
tccagccccttgttacgggggaaaatgctc

SEQ ID NO: 106933 - DNA, 787 bp, Homo sapiens; identical to SEQ ID NO: 72087
  chr11:120435208-120435995
  Hyper

SEQ ID NO: 106934 - DNA, 30 bp, Homo sapiens; identical to SEQ ID NO: 72088
  chr11:120449384-120449414
  Hypo

SEQ ID NO: 106935 - DNA, 109 bp, Homo sapiens; identical to SEQ ID NO: 43265
  chr11:120748772-120748881
  Hypo

SEQ ID NO: 106936 - DNA, 321 bp, Homo sapiens; identical to SEQ ID NO: 72090
  chr11:120772435-120772756
  Hypo

SEQ ID NO: 106937 - DNA, 30 bp, Homo sapiens; identical to SEQ ID NO: 72091
  chr11:120773074-120773104
  Hypo

SEQ ID NO: 106938 - DNA, 179 bp, Homo sapiens; identical to SEQ ID NO: 72092
  chr11:120837755-120837934
  Hypo

SEQ ID NO: 106939 - DNA, 30 bp, Homo sapiens; identical to SEQ ID NO: 72093
  chr11:120937707-120937737
  Hypo

SEQ ID NO: 106940 - DNA, 231 bp, Homo sapiens; identical to SEQ ID NO: 72094
  chr11:120998602-120998833
  Hypo

SEQ ID NO: 106941 - DNA, 30 bp, Homo sapiens; identical to SEQ ID NO: 43269
  chr11:121000904-121000934
  Hypo

SEQ ID NO: 106942 - DNA, 209 bp, Homo sapiens; identical to SEQ ID NO: 72096
  chr11:121023611-121023820
  Hypo

SEQ ID NO: 106943 - DNA, 139 bp, Homo sapiens; identical to SEQ ID NO: 72097
  chr11:121152146-121152285
  Hypo

SEQ ID NO: 106944 - DNA, 30 bp, Homo sapiens; identical to SEQ ID NO: 72098
  chr11:121192536-121192566
  Hyper

SEQ ID NO: 106945 - DNA, 316 bp, Homo sapiens; identical to SEQ ID NO: 72099
  chr11:121297857-121298173
  Hyper

SEQ ID NO: 106946 - DNA, 202 bp, Homo sapiens; identical to SEQ ID NO: 72104
  chr11:121546780-121546982
  Hypo

SEQ ID NO: 106947 - DNA, 257 bp, Homo sapiens; identical to SEQ ID NO: 72106
  chr11:121593379-121593636
  Hyper

SEQ ID NO: 106948 - DNA, 30 bp, Homo sapiens; identical to SEQ ID NO: 43272
  chr11:121910451-121910481
  Hypo

SEQ ID NO: 106949 - DNA, 30 bp, Homo sapiens; identical to SEQ ID NO: 72115
  chr11:122311181-122311211
  Hyper

SEQ ID NO: 106950 - DNA, 157 bp, Homo sapiens; identical to SEQ ID NO: 72116
  chr11:122402591-122402748
  Hypo

SEQ ID NO: 106951 - DNA, 98 bp, Homo sapiens; identical to SEQ ID NO: 72117
  chr11:122511898-122511996
  Hypo

SEQ ID NO: 106952 - DNA, 75 bp, Homo sapiens; identical to SEQ ID NO: 72118
  chr11:122575506-122575581
  Hypo

SEQ ID NO: 106953 - DNA, 30 bp, Homo sapiens; identical to SEQ ID NO: 72119
  chr11:122659896-122659926
  Hypo

SEQ ID NO: 106954 - DNA, 139 bp, Homo sapiens; identical to SEQ ID NO: 72120
  chr11:122752920-122753059
  Hypo

SEQ ID NO: 106955 - DNA, 473 bp, Homo sapiens; identical to SEQ ID NO: 72121
  chr11:122753630-122754103
  Hyper

SEQ ID NO: 106956 - DNA, 1641 bp, Homo sapiens
  chr11:122847129-122848770
  Hyper
taatgaaaggttattcgcaagttcatttctacagggactaggaaactgcctagggccgaggggagggggcgtacgcgtaggagaacgcggtggcaaaccattcctggaaacgcgtgatcattcccagttttgccctgcgagcctacaaacccggtaaaagaataagagacctcccaggggaaaaggagaggggtaaagcgcaaagtcaatcagacccccgccccatctattccccaaacaggtgcacgcccggaacgcctttagccttaaccctttggccttcatcttgatttcctaaaatgcactgagaatgaatatttccacacacaacccgaggaacactcacttttaaaatatcagtagcccgtggaacgtggaagcgttgcgggacaggagcgcaacaagttcgggaagcagaaattgctctaggggttttctgtgcccaagtttcccgccgcgcgctggcgccgcgcagtacgcgggaggcagggcgtaaggggcgtctgcgcctgggggctacaaactcaggaagggtgccaggatgcagaaccgcgagctctagaggagaacagggacgggagaggatggaagcgccgcccagagaaggagggagtcgccttagtatttgagtcagagatgggactctggggatgggggatgggggcgagtgggaggttagtgacgagcagtgcacgagtctgtcctgaaactggacgttttaaagatcagattgtggttctatctggatctcggcggagcggaggccccagagacctggtccctttgcagccaaacggactgcccaagaacgggcaaggacttggcgtggagaggaaagaacagagctaggggcaagttgctgaaaggcgagggagaaaggggtctatgatcggagaaaacagagagccgagagctgaatttccagtctgggacgcggtacttgggctggtccctgaccccaaggacgacggacgcaggaaaatgggcgcccgggcgcacagtctcccgtggctgggaccgggagggctagaggggaggcgggaggccgggccgcgggccgtgctggctccgcaccggcctggaggacaggtgggttttgtttgtcttccaggagcggatttccaaggcccgccacgagactggagtctgagtcttccggtccaggagggaaccgcgctcggccccgcagtctcctcccctgcctactaccctccccagcctggcggctcagagcacgtgcggccctgagcccagctccccctcgtctccaatgtccacctcgtcctctggctcggtcagcacgaagggaccggcgggcaggctcagccgagcctcggcggcggtggcggcctctgaaccgcgggggctgccctcggggctttctggcccgtctggtgctttgggttcgtcttggcttttccgcagttgctttttatgcttcatccgccggttctggaaccacgttttcacctgatttcggggagataaaaataaaatcatgtcattcctccaaatctgagccatcgctggggtttaggaaaatgggctgcagtccgttgatgaagtatccaagagcggtgatagcctcaactgctcataagttatcgccttaagccgaatgagaatcgaacagtctgaggc

SEQ ID NO: 106957 - DNA, 1485 bp, Homo sapiens
  chr11:122849807-122851292
  Hyper
ggccaggtgtaggtaattttacgaaagctcttgggaaaggcttagaataagcgtcagcggggtctatttctactcgaactccacaaggtcccgaaggtattaagacttgaaggcagagaggaacgaagcagagatcagggcctccctctcctcccgcccacctgcgtctcggacaggctgagggccgtggccagctccactcgttctggcgtggacaggtagcgctggatctcgaacctcttctccaagcccgagagctgcgagtcagagaaaaccgtgcgggctttgcggcggcggcagtgcttccccggcagctccgcgtgctgcgggtgcgggaacagcgctgggactggcatccctgcagagagaagagcaaccaagtgggcagagcgtgggtcgccggagagcaatctccgctccgctcccctcccctcccctagcccccagtgccttcctccgcccctcgcctccgtcagtctgctcgccccaaagcccctcaagcctttctctcaggaatccagggcagaggaagaaaaaaaaaaaaagccgcaagaatagcgcttggagatctttatctggaaagtcatctagaaatacaaacaacaaacagtaaataaaacagaaaagaaaatcggaaaatagatccggaggctgtttaaaaatgtcttcttggagagacttccgtagggtcggccagcgcggagtcttcagttgcgcctggccaagttttttgcaaacgtcaaatggcccaggagcagtcctgtccccagcccccacctatcctcctagacccctgatgacactcattgctgttctggggctggtagatgcatggatataatcttgcctccaaaccttactgaaaaatacctttctgtttcccaagccacccctatccccctgcagccaaagggagagcaaaactgccttatccggagaagccccggagccgaaacagaggagcatttctcgcctctcacgtctcctcgtccgtttcggggtcgcgctagggacccagctacctaatatagtcctcattctttttctcattctttccctctcactccaagcccagcgaagcagaagggtttgaggggtttttccatggccgggtccggggagacttgtctttcctgaccctcgcaggcttgactctgtctgagacgcaccaagcagagagaagctgccacaagcaacatcggccaatcccagagaaaataaacaaacataacaacaaccagtgcgggtacttagggctttggccactgctgtatgggaggaccaccggagcagctgagaatagattgtcaccggcgggtggtgaagccagtgcagagatgcggacctggatttacaaacacttttagctttgttctggattccagcgcgcacaaactgcctcctgtcttgcccccagcccctccaccgaccatggttgttgccgcctctgagctatgagtctggactcaacgaattattctattc

SEQ ID NO: 106958 - DNA, 482 bp, Homo sapiens; identical to SEQ ID NO: 34105
  chr11:122852370-122852852
  Hyper

SEQ ID NO: 106959 - DNA, 30 bp, Homo sapiens; identical to SEQ ID NO: 72127
  chr11:122854391-122854421
  Hyper

SEQ ID NO: 106960 - DNA, 142 bp, Homo sapiens
  chr11:122854915-122855057
  Hyper
ggccctgctctcaggcggagaagccaggagcgatgaggggcggggcggctcccggcgccctcttttccagccccgctcccgcgctgccgccggagagggactcggggcgcagccgccccgcctctgccggggccccaggagg

SEQ ID NO: 106961 - DNA, 137 bp, Homo sapiens; identical to SEQ ID NO: 72130
  chr11:122855295-122855432
  Hyper

SEQ ID NO: 106962 - DNA, 142 bp, Homo sapiens
  chr11:122855676-122855818
  Hyper
accttcctgcctgctcgagccctaacccccaccccacccaccagccgcgggccccagggctgcccagggaaggagtacatttttagacatttttagatagcttgcaaaggttgtctgtggcagggaacggggacagggaaac

SEQ ID NO: 106963 - DNA, 768 bp, Homo sapiens; identical to SEQ ID NO: 72135
  chr11:123065429-123066197
  Hyper

SEQ ID NO: 106964 - DNA, 63 bp, Homo sapiens; identical to SEQ ID NO: 72136
  chr11:123066400-123066463
  Hyper

SEQ ID NO: 106965 - DNA, 183 bp, Homo sapiens; identical to SEQ ID NO: 72137
  chr11:123169348-123169531
  Hypo

SEQ ID NO: 106966 - DNA, 575 bp, Homo sapiens
  chr11:123172454-123173029
  Hyper
cgcagcgggcagggacggaggcgcccaggggcaggcggcagcacgggaagaggccagcaggtggcgcggtcgcccaacccggccgccccccgggcgccgagggaagcgggtcaggggcgtccccacctgcccaagcgccggctctcccaggcagcaggggcggcggcggcctggctggctgcgctgcagagcggagagcaggagcggcgtgggaggaattcggagcactttcgccgcctgcctccttttactgctggttgccctcaaaggagccctctccctccacacgcctttgggccttaccagccgccggaagcggcggcatccatcccagcaaagcgtgcattccatcctctggaaaaaaagtctttgagcttcctttacagtgaccttactttggggactgaaccgttgcgactaagaaaacccctcctcaagtttaatggaacgatcacatgacacgtggttgacgaagccattccctccttgctacttgccttgtgtgatacactgtcacggcccgggcttctggcttggtggaggggacaccaccgcggctccggctgcggacttcg

SEQ ID NO: 106967 - DNA, 968 bp, Homo sapiens
  chr11:123228623-123229591
  Hyper
cagatgcttccccatcgtgaagatcctccgggtcacctatgcactcctgctaatctctgccatttgccttcttacaccctttccataccttcccgtggaacacggtaatctggtttccagatgggctaatgtctcctcctagctgcaaggcagcggcgcttctggcgttggtttccgcactaaacttgatggtctgattttaaaggttgattttaaagaaactgtctggttgtatgtccccgagttacactgcagtgctaaatgttggagcgaggcaataccgggagaatccaggctgcaggcttcacccagagagggagggtgaggggaggagagagacggagagaggagagagggggaatgaaaggggagagagagggaccaagaccggcgagcgggagacaggagcggaaaccacagaggtagagtcagggccgacactgaagaaacgtagatgcacagggaggggccaatattagtgtacagagagaaagagggaacacggtgcggtgacacctagcctcggagacagtgggagctccgagcccacggagagcgggggagttccgcttcctcccgccccagcggctcccgccccgcctgggcgcagccggccgtcccggctccgagggtgcagcgcgcccgggcgcagcgcgagtgcgtggagccgggctccagcacgaccccgccgctcgggtttgggtgtcctcaggctccgcgctcctcctcccctcctccagatgggactggctctcctctttgcaaagccaggctcgcggggagacgtggtgagcagtagccagcagctggtgtgccgtggacgccgctgaccgccgcgcgcccgaaccgggtgtccacatgagtgcctctcccagcagatccaggtaagaacttcctgaccttcctgagccctaggaggaacacacatggatgccgagtgatggtgagggatccgggtgaaactggag

SEQ ID NO: 106968 - DNA, 144 bp, Homo sapiens; identical to SEQ ID NO: 72144
  chr11:123300811-123300955
  Hyper

SEQ ID NO: 106969 - DNA, 1104 bp, Homo sapiens
  chr11:123301015-123302119
  Hyper
ctgcctcttcctcccgctctctacctccctgcagcgccaagccggctccccaacctggtctgctgaacgcaaaccgctgagagtttgctgcaccgccccctggggcccctggctgccgagtcccgctaaggcaaagacgccagcaagcgaggaagcgcagcggaagaaaaacaagcgggcgcgcgaggggagccccaggagggctgccgagtggctggcaggcggctcccgcccctcccgggtggcctcgccggcggctgacggcccggaggacgcgcgctccgaaaagttagactccgggcggcggcgcgctacgccgcgtcccctcgcgtcccttcctcgctgcgctccgggaaaggaacttgttccttcggccccaggattggggagtgtgccgcggggccgagggtggggaacagccagagggagacgcgaaccaggccgctggcggagggctcagggggagcgcagaggcgacggcccccatgccggcggccaacatgatggagaaccggccgctgcccgccctgcaggtgcccgagccgcagggtgcgcccgagggcagcccggtctggtccagttcgtcgacccccacgcttcgccgccggcgcttcaagatgcgccgcatgaagaacgtacaggagcagagcctggaggccgggctggcccgggacctgcccgccgtcttggcccccggcaaggagttcctgcagctgccgtccatcgagatcacgccctccagcgacgaggacaccccgtggtccaactgctccacacccagcgcgtccccgcgccgaaaacgcttcctcctccgcaagtggctgagggtgagggagcggaaggagtgcagtgaaagcaggtacgtccccgttccgcccgtctccttcccttccctcccgtcctctccagagccgtccagggccccggggcattctgggggaaacgtcctgggggagaacaggagcccgtcaccagaggcgcttctggagggcgctgcgcctggtcccagggatggtggcattcagcttccacgcgtgccacccgctccccaactcagggtgaggggcttcatgttgcacgacacgtttacgtggggctttacgc

SEQ ID NO: 106970 - DNA, 74 bp, Homo sapiens; identical to SEQ ID NO: 72147
  chr11:123443648-123443722
  Hypo

SEQ ID NO: 106971 - DNA, 47 bp, Homo sapiens; identical to SEQ ID NO: 72148
  chr11:123457217-123457264
  Hypo

SEQ ID NO: 106972 - DNA, 439 bp, Homo sapiens; identical to SEQ ID NO: 72149
  chr11:123524538-123524977
  Hyper

SEQ ID NO: 106973 - DNA, 79 bp, Homo sapiens; identical to SEQ ID NO: 72150
  chr11:123525394-123525473
  Hyper

SEQ ID NO: 106974 - DNA, 30 bp, Homo sapiens; identical to SEQ ID NO: 72151
  chr11:123543339-123543369
  Hypo

SEQ ID NO: 106975 - DNA, 78 bp, Homo sapiens; identical to SEQ ID NO: 72152
  chr11:123885065-123885143
  Hypo

SEQ ID NO: 106976 - DNA, 30 bp, Homo sapiens; identical to SEQ ID NO: 72158
  chr11:124522134-124522164
  Hypo

SEQ ID NO: 106977 - DNA, 30 bp, Homo sapiens; identical to SEQ ID NO: 43276
  chr11:124526915-124526945
  Hypo

SEQ ID NO: 106978 - DNA, 68 bp, Homo sapiens; identical to SEQ ID NO: 72160
  chr11:124588270-124588338
  Hyper

SEQ ID NO: 106979 - DNA, 163 bp, Homo sapiens
  chr11:124629399-124629562
  Hyper
ctcggccctctgcctcggagcggaagacgccacctccgcgtggcgagcaggcggccaacgccgcgggaagaggccgcagccaggccccgctctccaccctcgccctaggagagccaggctgaaggcctctaagggctgggagccgatccggccaggatgcaag

SEQ ID NO: 106980 - DNA, 408 bp, Homo sapiens; identical to SEQ ID NO: 72163
  chr11:124631502-124631910
  Hyper

SEQ ID NO: 106981 - DNA, 30 bp, Homo sapiens; identical to SEQ ID NO: 72164
  chr11:124639029-124639059
  Hypo

SEQ ID NO: 106982 - DNA, 46 bp, Homo sapiens; identical to SEQ ID NO: 34126
  chr11:124709117-124709163
  Hyper

SEQ ID NO: 106983 - DNA, 374 bp, Homo sapiens; identical to SEQ ID NO: 72166
  chr11:124709482-124709856
  Hyper

SEQ ID NO: 106984 - DNA, 156 bp, Homo sapiens; identical to SEQ ID NO: 34128
  chr11:124712781-124712937
  Hyper

SEQ ID NO: 106985 - DNA, 336 bp, Homo sapiens; identical to SEQ ID NO: 34129
  chr11:124713057-124713393
  Hyper

SEQ ID NO: 106986 - DNA, 30 bp, Homo sapiens; identical to SEQ ID NO: 72169
  chr11:124733379-124733409
  Hyper

SEQ ID NO: 106987 - DNA, 1454 bp, Homo sapiens
  chr11:124735003-124736457
  Hyper
cagaagggcagagtccgacagagcctcgtccctcatcttgggtgctttgagacagggaaaatctctcgccgcgtccagaacggaacgctgggcttggggtgcggggcggggactccaactcgcgcgctacgctactcgtgtctcctgctcggatagtgactgtagaggtaagggtgggagggtggagggaggcggattaatcccttaattacgccgtgatcggcgtggcacctgctttccgcctgcccagctcccaggggactccggcactagggggtggagagaaggacgagggaaggaggagggcacgaagaggcaccgaccgtacccaggcgcaccggcaggagagcggcaccgtggctgccgcagcgcgcagaggctgtggaggggcttacggctcccagcccacgggtctcagacccaggggctgggcccccagcccccagtcccgatcccagctgggtcgagccatgctgcgctacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacggtgagaccctgcctcttggggatatgggatcctgggatggggatgaggtgagagggcggcgtggaagggaaggagaagcgctcctgtcccgaggtccgggattgagtggcgcctcccagcgcctccctgggtcgtggggtctaagggataatttggagcttcgagcacatgagtgggggtacccgcgggaggtcgagggcttgggagaagatggctactgagtctttttacacctccttcccttcccctacaacgcccaccccaggtgagaagaaccgttgctggtaacgggcagggaagtccgagctaagaaaggcccgggcccagcgcagggagggcagaggagggggcacagtctcccgccggcctcggccaagccaggtcactcggtgacccacccaggcagctggtcttcggaaccccgaagtttcccaagaactcacttaggaccagaggaagccaaaatgctggatgtgtttgctacggaggggataggggcggcgatcattttaaggaaacttagaagtttgtctttcagcggcgggactctcagccggcccaccccggcagagctgtggcgggcgggcggagctggcggcgaggtcgttaccgctaattacggtgattaataaatgactgggacagcgcgctctcccctagcgccgcggggaagctgcgggagccggccgccgccagcctgcggagaggccggagcgcgccccctgcctgccgcatcgggaacccccgctttaccgggcgctttcgcgtgtggttccctccaggtgcacgcggtccccatccctctgcctcgacccactcgagtc

SEQ ID NO: 106988 - DNA, 579 bp, Homo sapiens; identical to SEQ ID NO: 72172
  chr11:124738445-124739024
  Hyper

SEQ ID NO: 106989 - DNA, 247 bp, Homo sapiens; identical to SEQ ID NO: 72173
  chr11:124739234-124739481
  Hyper

SEQ ID NO: 106990 - DNA, 151 bp, Homo sapiens; identical to SEQ ID NO: 72174
  chr11:124743216-124743367
  Hypo

SEQ ID NO: 106991 - DNA, 145 bp, Homo sapiens
  chr11:124790908-124791053
  Hyper
acaccagcgcccccccgggacctcccctcgtccccagcgcgccgcgcccgggcttcccagccccagctttcccccgggccactggccgcagaccgcgggcgcctctcaggggatcccgaggcggctcaggcgctgatctccaccg

SEQ ID NO: 106992 - DNA, 39 bp, Homo sapiens; identical to SEQ ID NO: 72176
  chr11:124791254-124791293
  Hyper

SEQ ID NO: 106993 - DNA, 315 bp, Homo sapiens; identical to SEQ ID NO: 72177
  chr11:124933396-124933711
  Hyper

SEQ ID NO: 106994 - DNA, 140 bp, Homo sapiens; identical to SEQ ID NO: 72179
  chr11:125034165-125034305
  Hyper

SEQ ID NO: 106995 - DNA, 354 bp, Homo sapiens; identical to SEQ ID NO: 72180
  chr11:125034624-125034978
  Hyper

SEQ ID NO: 106996 - DNA, 1330 bp, Homo sapiens
  chr11:125035358-125036688
  Hyper
ggagatgctttccagcggctggaggcgggagcggtcccaggctggggccaggtgaccggaggagtcgaggagccgcggccgcggcctggggaggcagggcgaatgagggtttgcagacggatcagtggagacaggggaacaccggcggggcccgggaagccaggatccgaggggctacacgcacggaccctcacccagggaggagcgagaatgtgtagggtcaccggctttccatgattgctggggatctttggtgaggcgggcgtaggggcccgcgcgaggcttgggaatcgggagcccttctggctcgagaactaggggatgagttcgtaaaagagggaactgaaagcgatcgagagcggagagctgagggggatggcgcaggatcccgaatctgccgctcaaagtttgcatttctttcgggttaggagacgggctttcctggctcccgatccccaggaagaaacgagcgaaatgggccgtcctttcccggggctcttcacgggggagccgggggtttccgcgcggtggggagactcgggttgggaattgaggggtaggggcttgtggatcggcctgaattagggctgggttttaggaccagtctagagttcggtttataggatccagactgtttacggaatcgggatcgaggggccgataagtagtttacacgccggccagagcagagggctggaggtcggagttgggggctggaggaacgggtggcgtttttaggattcagtaacaggatcacagctttttcttgtggtggaagctattggaatttggggagggtagcacgaggggtcctgcagctccgcgtgtgaaaaagcgtttaggtaggcgatgaaagtagttgatctgagccatggcaggcgagccccgaatttttgctgcttccccctgaaagtgtttctttaggaggagaggacttgggccacacaggacccggtcctaagagagcgattccgggaagcggacagatcgaagagaccttctgggcgaagcggcagggcagcctcgcggggctgggagtggatctgaggtcccgacccaggcggctcggagtgctccaggagccacctgggtctgcgggcgcagcgcggcggggcgggagcggtggcccgcaggggccgcggcctgcgatgaaggccggggggcagcgctagcagcgaggtgccacagtgggccgaggagtctgggctgtggcccagggtaggaccggctcaaactccagtgccctgattggagccgcttcctgtgcttacccgcgccggactgagaagcccacaaacccggcctttggtgcgcccgggggaggaggaag

SEQ ID NO: 106997 - DNA, 52 bp, Homo sapiens; identical to SEQ ID NO: 72183
  chr11:125133192-125133244
  Hyper

SEQ ID NO: 106998 - DNA, 182 bp, Homo sapiens; identical to SEQ ID NO: 72185
  chr11:125220500-125220682
  Hypo

SEQ ID NO: 106999 - DNA, 30 bp, Homo sapiens; identical to SEQ ID NO: 72186
  chr11:125221866-125221896
  Hypo

SEQ ID NO: 107000 - DNA, 182 bp, Homo sapiens; identical to SEQ ID NO: 72187
  chr11:125259900-125260082
  Hypo

SEQ ID NO: 107001 - DNA, 16 bp, Homo sapiens
  chr11:125271700-125271716
  Hypo
gcgggcacatgcattc

SEQ ID NO: 107002 - DNA, 42 bp, Homo sapiens; identical to SEQ ID NO: 72190
  chr11:125304472-125304514
  Hypo

SEQ ID NO: 107003 - DNA, 1267 bp, Homo sapiens; identical to SEQ ID NO: 72191
  chr11:125365065-125366332
  Hyper

SEQ ID NO: 107004 - DNA, 158 bp, Homo sapiens; identical to SEQ ID NO: 72196
  chr11:125755569-125755727
  Hypo

SEQ ID NO: 107005 - DNA, 36 bp, Homo sapiens; identical to SEQ ID NO: 72197
  chr11:125757373-125757409
  Hyper

SEQ ID NO: 107006 - DNA, 31 bp, Homo sapiens; identical to SEQ ID NO: 72198
  chr11:125759609-125759640
  Hypo

SEQ ID NO: 107007 - DNA, 860 bp, Homo sapiens
  chr11:125773662-125774522
  Hyper
ggaatttggttctttcgtccaaattgagcggtcattaaatcattagtaccagggatccagggatctataccggattatgcaaacgcatgtaggacgtagaggttataccgaaaggtaatgtttttaacaagagaccacatttcagaataaaagctttaaaaagcctatgtggaacatcacaggtatctagggcaggaacagcagttagagcttgaacagttctgcttcctttccgcaactgtggcattcgaggtcattcgtcatatcaaattcatcagattttgtctccactttgctaaccaattcgctaacctttctgacatcttgtgatgtggaggcggaaatttccagggaaaccgacacggggcgtaaagcgcggcggggagtccggggggctcccgcctggagggctgtgtgagcggcgggccgcggggcggcgcggggggcgctctccactctgcggaagctgccccctctgccctccggtccgcgccctttcgccccgctctctgccctccgccccgctctctgccctccgccccgctctctgccccccgccccgctctctgccctccgccccttccgcgcgccacccagccttccagcgcctgcgcgccgcaccgcggtggtcgcgggcgcggacgcggacgcctgccccctaaggaagcccattggccagcggatggggccagcaccgcctcgcgccggtggtggaagcacgtgctgggggcgggagcagcaatcgcagccatggcgtcgttactgtggggaggcgacgcaggggcggcggagagcgagcggctgaacagccacgtaaccgccaccgagccggggggccacagccgcgggggtggagctcc

SEQ ID NO: 107008 - DNA, 184 bp, Homo sapiens; identical to SEQ ID NO: 72204
  chr11:126083469-126083653
  Hypo

SEQ ID NO: 107009 - DNA, 94 bp, Homo sapiens; identical to SEQ ID NO: 72205
  chr11:126083885-126083979
  Hypo

SEQ ID NO: 107010 - DNA, 215 bp, Homo sapiens; identical to SEQ ID NO: 72206
  chr11:126085129-126085344
  Hypo

SEQ ID NO: 107011 - DNA, 28 bp, Homo sapiens
  chr11:126154206-126154234
  Hypo
gcgtgaaccactgcgcccagcccttcat

SEQ ID NO: 107012 - DNA, 30 bp, Homo sapiens; identical to SEQ ID NO: 72208
  chr11:126225281-126225311
  Hyper

SEQ ID NO: 107013 - DNA, 109 bp, Homo sapiens; identical to SEQ ID NO: 72209
  chr11:126226052-126226161
  Hyper

SEQ ID NO: 107014 - DNA, 231 bp, Homo sapiens; identical to SEQ ID NO: 43282
  chr11:126273042-126273273
  Hypo

SEQ ID NO: 107015 - DNA, 30 bp, Homo sapiens; identical to SEQ ID NO: 72212
  chr11:126320587-126320617
  Hypo

SEQ ID NO: 107016 - DNA, 30 bp, Homo sapiens; identical to SEQ ID NO: 72213
  chr11:126713464-126713494
  Hypo

SEQ ID NO: 107017 - DNA, 30 bp, Homo sapiens; identical to SEQ ID NO: 72214
  chr11:126719627-126719657
  Hypo

SEQ ID NO: 107018 - DNA, 30 bp, Homo sapiens; identical to SEQ ID NO: 72215
  chr11:126786457-126786487
  Hypo

SEQ ID NO: 107019 - DNA, 577 bp, Homo sapiens
  chr11:126870174-126870751
  Hyper
ccattttgttgcattcgcaaaggcgaagaggcaatgccagagcatctcagcccggcaccgagagacgcatccatcagtccgagttcccgaagcctgcccacgttcctgcccacagcctcccgcgccctgacaacccagccgactttcttccaactccagcagcgcaggggtcctaccttgactgaagaggaagaagcagacgaagagcagatcgagctggaagggtttcattccttagcgcagcgaaggaaagccggcggggtaacttggctgtggttagtttctcttccttggcggctctcggtgctcagcctccgccggtcctctcgggttcgcgcctaccatctgtccgtccgtgggtccctccgggtggcttcggtctctttgtgcctctgggtatctgcagccagccgacacaaactgcctgttcttagccgcctcgggaagccgggattgtcagcaatgtccccactcggagaagatccattctctggctcttggcatcccaggcacacggcttcctcaggcgggctcctcccacagtgagcgagcgagctagtgacgagtgacagaagga

SEQ ID NO: 107020 - DNA, 30 bp, Homo sapiens; identical to SEQ ID NO: 72219
  chr11:126870952-126870982
  Hyper

SEQ ID NO: 107021 - DNA, 764 bp, Homo sapiens; identical to SEQ ID NO: 34149
  chr11:126873058-126873822
  Hyper

SEQ ID NO: 107022 - DNA, 30 bp, Homo sapiens; identical to SEQ ID NO: 72223
  chr11:127009561-127009591
  Hypo

SEQ ID NO: 107023 - DNA, 30 bp, Homo sapiens; identical to SEQ ID NO: 72224
  chr11:127013703-127013733
  Hypo

SEQ ID NO: 107024 - DNA, 23 bp, Homo sapiens
  chr11:128110182-128110205
  Hypo
tacaaaaaaattagccgggcctg

SEQ ID NO: 107025 - DNA, 173 bp, Homo sapiens; identical to SEQ ID NO: 72235
  chr11:128419104-128419277
  Hyper

SEQ ID NO: 107026 - DNA, 124 bp, Homo sapiens; identical to SEQ ID NO: 72236
  chr11:128556976-128557100
  Hyper

SEQ ID NO: 107027 - DNA, 1055 bp, Homo sapiens
  chr11:128562763-128563818
  Hyper
aactggggcgcgcggcggcccaggagggaggcggggaggtctccgggttgggccggggaacgccggcctccaggctgggtagggaggacggtccagagcgcgggcctccgggtctcaccccgggaaaagtctgggtctgctctgcgctgttgcgtgctgcgctcctgggacctgctgactgtcctagagggaacgtcccgcggtagtgtcagttccctggggaccaggaagggcgactcttgcctgggagtcagtgcttgggccgtcgggtccgggtaagcgctgggggtttggctcgagaagatgcggataggtggcctagggcgccgcggatctccgccctctgcgggcaccgggagcccagggtcgaggcgcgccgccccgaggggccccttctcctaacaatgcgcccggaatggagtccgcgccctgacagcgcgggtcagcccgaaaccgcccagaatccgcttcgatgagtgggtgagccgctctgggagtctgccgcgtctcggcagcggagggcctgagtggaaaaattcttattggatgcactttttaatggttggtttgcctcggttttcgtccgagtcttccccggcagtaggcgctgggttacccgcagccctagccaactctccctccataccccccctaccccacccccaaaaagtttgtctccggctggaaaaagcattaatgaacgtatctgtgggaagaaacggaaagtgaatgagtcaggagggccaccttcggccaaccgcctcaggaaaagcaaagaagccaaaggtctttggctttggattttgggggaaggtgatggggggaggttcagacttcgggaatcagggcgcggacgctgggcgtggaccccgtcattgttcccggctagctcttatctcccaggagcaagtatcctgtgtgcgcagcgcatgaatgtgtctgggcatctccgcgtatatttatatagtgtgtgatgcgaaaagcaggaccagcaggggaggaagagggggtgtggggggggagggaagacgagggagagcagaggggagagaaga

SEQ ID NO: 107028 - DNA, 1655 bp, Homo sapiens
  chr11:128563878-128565533
  Hyper
gagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggtaagcggcggggcaacggacgcgggcggcggggaccggccggggaggcgaagcggcgggcgggtaggtgcggggcccgcgtcccggaagacgtggcctctctcccttccctccgcgccccggcttcgcgccggctcctccggcgctcgggtggcgagtcctactcgcgggccagccggccaggcgcccgcattgagggcgaccctcccccgaaatcccagcccccaaagtggagccccggcccccctcccacctcgctgcccgccggggctgcaggaggggacggcgggaaaccgggggaccccagggtacggaacggagtcaagggcgagagacctcggggtccaccactcccaccgacacccggggctcccgtggccccagcgctaggcactgggcttcctctccgcagaggcggaacacggcgggggcgggggctgcagtcgcccgggctcgggtccctgcctggtgggccctggggtgggtaagtggcctcgttgcacgagggtaggggtgcaagtgagtgtgtcgggggatctatctgagcgggctcctccagatggaagcccctgtttacatgtcagcgctttcccttcctctcggcactcagtcgcccggctctaggcgctggagagccgccggctccgcgggactcctgggccggcctcgccgcctctccggcggggaaccttccccagcccccgtccgcacagatccctagcgccccgagcccccgcccttcgcgcctaggcgtgcgccggctccaggaccagggctcctggagctgtcgcctccgaaagggtcctgcgtccttcggagccgcctccgttgcaggggccggctgtgagcccgcgccccgcgcccgcccggccattcccaccccagccgccgccgccaagcctgggtctaggttgcaaagtgcaacccaggcggaaaggtgagggtttgggttcgcgtctcacttcagaaaagttgactgctgtctctgaaagggttcgccaagtagggccaggagcagagaggagggacaccccctaacgtgacgggccttagaggacctaggggaatgaatgggaccaggggttagcttcgaggctgccgcgcaacaccaagcgggagtctgtctggaaaaactattaggctggcgaggtggggactggcagagcccgccattccccagaacccgaaagaatcgactccctgctcagggctcagcaagagaaggctaagatgttgggctcagagaattcaagagatttttatcttctgggtggggtcgtggtttttattttctaagttttttttatgaaagtttgaaatatgctgacttaggtaaaagacaccaaccgaaggaacttgcaa

SEQ ID NO: 107029 - DNA, 98 bp, Homo sapiens; identical to SEQ ID NO: 72243
  chr11:128634531-128634629
  Hypo

SEQ ID NO: 107030 - DNA, 34 bp, Homo sapiens; identical to SEQ ID NO: 72244
  chr11:128634871-128634905
  Hypo

SEQ ID NO: 107031 - DNA, 30 bp, Homo sapiens; identical to SEQ ID NO: 72245
  chr11:128635204-128635234
  Hypo

SEQ ID NO: 107032 - DNA, 182 bp, Homo sapiens; identical to SEQ ID NO: 72246
  chr11:128647566-128647748
  Hypo

SEQ ID NO: 107033 - DNA, 180 bp, Homo sapiens; identical to SEQ ID NO: 72247
  chr11:128657932-128658112
  Hypo

SEQ ID NO: 107034 - DNA, 37 bp, Homo sapiens; identical to SEQ ID NO: 72248
  chr11:128665419-128665456
  Hypo

SEQ ID NO: 107035 - DNA, 104 bp, Homo sapiens
  chr11:129242303-129242407
  Hyper
tctagactccaagatcgggcatctctccctctccactgcacaggggacttgtgcccgcagaccccttctgagatttcttgcctctgtagcgcgaaatagaaaag

SEQ ID NO: 107036 - DNA, 991 bp, Homo sapiens
  chr11:129242652-129243643
  Hyper
ccgcgaccaggaacacgcgaacgcgagtccagacccgggtttggaaaaagggaagaaggagaggaggagaagggaagttaaaaagagagagagaaaacaaggatgaacgatggggagaagggagggcagaagagagaaaacagaagcgggaaattcgacagaggaggagaggcccaaagggcggggagcaatgcggggaagggagaagtgggagggaagaagaggagaggagtcagtggcggtggaaggaaggggaagaaccagagagaagaaaagaggttaaggaaaagaagagcaatgcaaagtcggggccccgaatagtgccgcattctgtgggcacacgccgggcagatagaaagtatagacgcgacgcgctcggcccctcgtcgggcgtcgggtcctggtgctgtcgctcaggtgctggtccccagctccaagcccgcctcgtagtcggcgctgcgggtgagatcgcccgcaagcactcagtttactggcggctgcctaccagcggctcactttcctcggggcgcctaaagctccccgcccggcattgccccgggagcgaacgctgagcccctgggacccagccccgactcggcgcagcggtttccctctcggcttgcgcccgggagaaccccctccgtcgtggcgtcggacggcgatgccagggctgagcggtgagctgtcccgggtcccgcgctttgaccgcggaccagcctcagggtcccgccgcggaagcagggggcgcgcctggggccagcctgtagaccccagagtccggcggcaggacccccggcgccacccggacacctggcagcagttctcgcctgccctgcagccgcctctgcatggagaaagagaatgaaagaaaacaattctagatggagaggaggggaggggaggccagtttgcaaatacttcgggaatgaagttcctcaaagacgcgttgcgggccttgtctaatgctaggctgtgacttggcctcttaaca

SEQ ID NO: 107037 - DNA, 720 bp, Homo sapiens
  chr11:129243943-129244663
  Hyper
ctaacagcctaatgattagtcctctgggcgtgtccctccctcctagtttaatcaccggcccaggcgccctcatttacttgcttccgcggccaccagggccccctgggcaagcagctccgcagagagcccgccggcactcgcggacgcttctaggctgggagcggggaggaaatgtcaccggccccaaactcggccctagggaaggccatccgcgtctatacttctcagtgtccctgtcgtgcgttttccttccaaccccatgcacactcattccaacataaagtcgtggaaacgggcgtgcactgggctgttcccgccgaacaccgggcgcgactcaggctgccggaggcttcccgggcgcggaggctcggcggggtcccctttacgcagcaattccaatgaacaactaaagtccgtacagattttgattggaacagaccctaagactaagagcctggaaagaaaaaggcaaatcacccaataaacgcctgtcttcgcgactctctaacccggtcgtatcgcgagggatccggatattgaaagcccctttgccggaagactcgggcgctgggagaagcccgcatgggacaggctgccccagtgcccgccggctccctagaatcgtgcagctctgaccctttccaacgaggaaaaaatgtttttataaacaatgttttaaaaaaaaccgcacacttttttaaaaagtcagaatctcgctct

SEQ ID NO: 107038 - DNA, 127 bp, Homo sapiens; identical to SEQ ID NO: 72253
  chr11:129245832-129245959
  Hyper

SEQ ID NO: 107039 - DNA, 206 bp, Homo sapiens; identical to SEQ ID NO: 34162
  chr11:129565510-129565716
  Hyper

SEQ ID NO: 107040 - DNA, 32 bp, Homo sapiens; identical to SEQ ID NO: 72255
  chr11:129685906-129685938
  Hyper

SEQ ID NO: 107041 - DNA, 30 bp, Homo sapiens; identical to SEQ ID NO: 72256
  chr11:129732116-129732146
  Hypo

SEQ ID NO: 107042 - DNA, 66 bp, Homo sapiens; identical to SEQ ID NO: 43284
  chr11:129866993-129867059
  Hypo

SEQ ID NO: 107043 - DNA, 40 bp, Homo sapiens; identical to SEQ ID NO: 72258
  chr11:129907763-129907803
  Hypo

SEQ ID NO: 107044 - DNA, 207 bp, Homo sapiens; identical to SEQ ID NO: 72259
  chr11:129993552-129993759
  Hypo

SEQ ID NO: 107045 - DNA, 120 bp, Homo sapiens; identical to SEQ ID NO: 72260
  chr11:130017420-130017540
  Hypo

SEQ ID NO: 107046 - DNA, 55 bp, Homo sapiens; identical to SEQ ID NO: 72261
  chr11:130058066-130058121
  Hypo

SEQ ID NO: 107047 - DNA, 120 bp, Homo sapiens; identical to SEQ ID NO: 72262
  chr11:130059618-130059738
  Hypo

SEQ ID NO: 107048 - DNA, 149 bp, Homo sapiens; identical to SEQ ID NO: 72263
  chr11:130060258-130060407
  Hypo

SEQ ID NO: 107049 - DNA, 60 bp, Homo sapiens; identical to SEQ ID NO: 72264
  chr11:130079328-130079388
  Hypo

SEQ ID NO: 107050 - DNA, 51 bp, Homo sapiens; identical to SEQ ID NO: 72265
  chr11:130089830-130089881
  Hypo

SEQ ID NO: 107051 - DNA, 30 bp, Homo sapiens; identical to SEQ ID NO: 43287
  chr11:130090184-130090214
  Hypo

SEQ ID NO: 107052 - DNA, 24 bp, Homo sapiens
  chr11:130242942-130242966
  Hypo
tacaaaggacagatgcgtgaatta

SEQ ID NO: 107053 - DNA, 39 bp, Homo sapiens; identical to SEQ ID NO: 72268
  chr11:130285847-130285886
  Hypo

SEQ ID NO: 107054 - DNA, 30 bp, Homo sapiens; identical to SEQ ID NO: 72269
  chr11:130286135-130286165
  Hypo

SEQ ID NO: 107055 - DNA, 1034 bp, Homo sapiens
  chr11:130297386-130298420
  Hyper
gggagattttagagacgctgggaggcgtctggggggcctccgggcacggcggctggaggaggctctcagtcctacctgcaggtcggccccgtagaaggcagccatggacgcatcggccaccagcagcgtctccacgaagcgcgcctcagacacaaaccgcttggtcctactcgtggcccccaggggcggtggcggctcgctagcgccttctgcctcctcttcttggctctcctcctcgctgtcctcctggtggtctcctctctcctgcctctgaccctctcccgtctccacctcccactcgggtcctcgcgggagggggcgggctccggcgggaccccagcgctgcaggcggtgcggctgagccagggagccccccgcgccctgcggctggatggtgaactcctcgccgtccagcaggaaggagccgctcagcccgcggcacaggctgaccgccgccagcgactcgggctccccattcacggtgccggagaagaagcagccgcgcagcccccgctcgcccccggtcgcccggccggagcccccgaggcgctcgatcttgaactcgggcgctaggaagctgtcgtcgggcgccaggcgcagcacgaagcccttgccgaaggcggacaggtggagcgcgagctcgcccgcgctgccgggcaaccgcgtgggcaccaccagctccgaggcctgccccccggctgcgggccgggccggggcgccgcgggccagcggcagcagcagcagcagcagcagcaggagcggaggccaccggggggcggcgggggcggggagcatgggggctgcggcggtggctgcgcgcaggagagggaagaagcccgccaggcgcgggcaggtgctggcggcccgagcgcggcccggccgctctctccaggaaaagcggaatcaatcgggtgcaaggccgactcggcccgcggggcccggcggcgggagcgctcccccggcggcccctctggctggcgcagcccgctcctcccgcgccgccgcccccgagccgagcgcgagcagctggcccc

SEQ ID NO: 107056 - DNA, 932 bp, Homo sapiens; identical to SEQ ID NO: 72273
  chr11:130318226-130319158
  Hyper

SEQ ID NO: 107057 - DNA, 116 bp, Homo sapiens; identical to SEQ ID NO: 72274
  chr11:130319517-130319633
  Hyper

SEQ ID NO: 107058 - DNA, 192 bp, Homo sapiens; identical to SEQ ID NO: 72279
  chr11:130515653-130515845
  Hypo

SEQ ID NO: 107059 - DNA, 30 bp, Homo sapiens; identical to SEQ ID NO: 15616
  chr11:130717573-130717603
  Hypo

SEQ ID NO: 107060 - DNA, 226 bp, Homo sapiens; identical to SEQ ID NO: 43290
  chr11:130785458-130785684
  Hypo

SEQ ID NO: 107061 - DNA, 48 bp, Homo sapiens; identical to SEQ ID NO: 72282
  chr11:131068439-131068487
  Hypo

SEQ ID NO: 107062 - DNA, 30 bp, Homo sapiens; identical to SEQ ID NO: 72283
  chr11:131422789-131422819
  Hypo

SEQ ID NO: 107063 - DNA, 112 bp, Homo sapiens; identical to SEQ ID NO: 43291
  chr11:131522754-131522866
  Hypo

SEQ ID NO: 107064 - DNA, 30 bp, Homo sapiens; identical to SEQ ID NO: 72285
  chr11:131542213-131542243
  Hypo

SEQ ID NO: 107065 - DNA, 64 bp, Homo sapiens; identical to SEQ ID NO: 72286
  chr11:131558038-131558102
  Hyper

SEQ ID NO: 107066 - DNA, 39 bp, Homo sapiens; identical to SEQ ID NO: 72287
  chr11:131564961-131565000
  Hyper

SEQ ID NO: 107067 - DNA, 169 bp, Homo sapiens; identical to SEQ ID NO: 43292
  chr11:131631013-131631182
  Hypo

SEQ ID NO: 107068 - DNA, 88 bp, Homo sapiens; identical to SEQ ID NO: 72289
  chr11:131766898-131766986
  Hypo

SEQ ID NO: 107069 - DNA, 1075 bp, Homo sapiens
  chr11:131780260-131781335
  Hyper
ttcctaatttggaagcgcgtaaatggttaaactcctggcctgggctgggctggtgcacagcctgggcccggcgcggcgggggttaaggtgggcgcccgcgccccgcgccccgcgccctcccgccgggatgagagcgcagtccgcgccgccagcccgcccgctcgctccgaggcggcaccgggagaaagtggcggtcagggatggagctgctgccatgacaaccccggcggtcggggcccgcgcgcgtcggggctgctcccgggaggaaggcggcgcggaggccgggggcggccgctgagcttggcgtccgcgcggctccggtgcgggctgcgccgcgccttccccagcgagctaccgagcttggggccgccgcggtccgctcccgccgcccggcctctccctcctcggccaccgccgcagcccctgccccgccgagccccgccggacagcggcggccgcagcgcgcatttgggctccgaggaagttgaccgaggcggctgccgcaggatcccgggcccggatcgcacgaagcccgcgcggccgtctcctccgcgcgccacccctgcgcctcccgcgagctccacttcccatctgctattgtttccgattgttttccggtggcgagcccggctccgaaacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgccgcgcgcttccccctcctcggccaccttcccggcggaagcagcgaggagggagccccctttggccgtcctccgtggaaccggttttccgaggctggcaaaagccgaggctggatttgggggaggaatattagactcggaggagtctgcgcgcttttctcctccccgcgcctcccggtcgccgcgggttcaccgctcagtccccgcgctcgctccgcaccccacccacttcctgtgctcgcccggggggcgtgtgcc

SEQ ID NO: 107070 - DNA, 30 bp, Homo sapiens
  chr11:131781572-131781602
  Hyper
tggtttgtatggggtcggggtaaggggcag

SEQ ID NO: 107071 - DNA, 153 bp, Homo sapiens; identical to SEQ ID NO: 72294
  chr11:131799626-131799779
  Hypo

SEQ ID NO: 107072 - DNA, 30 bp, Homo sapiens; identical to SEQ ID NO: 72295
  chr11:131996346-131996376
  Hyper

SEQ ID NO: 107073 - DNA, 30 bp, Homo sapiens; identical to SEQ ID NO: 72296
  chr11:132031455-132031485
  Hypo

SEQ ID NO: 107074 - DNA, 32 bp, Homo sapiens; identical to SEQ ID NO: 72297
  chr11:132311339-132311371
  Hypo

SEQ ID NO: 107075 - DNA, 48 bp, Homo sapiens; identical to SEQ ID NO: 43295
  chr11:132484374-132484422
  Hypo

SEQ ID NO: 107076 - DNA, 30 bp, Homo sapiens; identical to SEQ ID NO: 43296
  chr11:132792371-132792401
  Hypo

SEQ ID NO: 107077 - DNA, 630 bp, Homo sapiens
  chr11:132813619-132814249
  Hyper
ccggtcggcgactcgcggccagccgggggagcgccgcccggcgcaggctccgggcgcacggggagctgggcggacggcggcccccgcctcctccggggacgcggcacgagacgcggggacgcgcggacgccacgctcagcggccgcccccggcctccgcgccgccttcctcccgggagcagccccgacgcgcgcgggcccggaccgccggggttgtcatggcagcagctccatccctgaccgccactttctcccggtgccgcctcggagcgagcgggctggcgggcggcgcggactgcgcgctcatcccgacgggcgggcgcccaccttaacctccgccgcgcccaccgggctggggatgcctgcggggatgagcccgcaccgcgcccacttcgctccgtcccgacacccgcgccagcggagagaacgcggcgcccctcgcagcggcttcccctacagaggggcggggtggggggagcggggagggagaggggagggcgggagagggagttctggggaaagcagcaaactgaaaactgacactggcaccttccctcgccgatgccagcgcagaagttgacaaaccccgccctggagagctgaactaccctgcccacgccagatggggcac

SEQ ID NO: 107078 - DNA, 141 bp, Homo sapiens; identical to SEQ ID NO: 72302
  chr11:132864068-132864209
  Hyper

SEQ ID NO: 107079 - DNA, 30 bp, Homo sapiens; identical to SEQ ID NO: 72303
  chr11:132933115-132933145
  Hypo

SEQ ID NO: 107080 - DNA, 564 bp, Homo sapiens
  chr11:132934044-132934608
  Hyper
gagtgaggggtggagcggagcccagccgagggagggaaggagaggaacgccggcccactagccgaccccagcgcaacccagcgcggttcccagacgctgccgggtaactgatgccgccggcacagcttctgttctcacttgtggagctttgtctcccctcgctgggcagcccctggtaccgcaacccgcctggccgccttcccggctgaggcccccgggcagagctcctccgcagggagcattcccgtggacaaacacccctttccctggtagctgtggcaacagttgatctgtggcagcggaccaggaggagggtcaaatgggagaagggacggccagctggtcctaccagagactgtcgctggcgtcctcaggggccgctgcagggccaccttgtgtgcttgccctttccccacggtagactgccccgggagggggactgtgctgcctgaattcttgtccgggtgggactggcctcggtgaaggatccgggaatgggacttccgggccgggccggaggggaagtgtcaggaagagctcaggctttagcgagcctggagggaa

SEQ ID NO: 107081 - DNA, 497 bp, Homo sapiens; identical to SEQ ID NO: 72306
  chr11:132952506-132953003
  Hyper

SEQ ID NO: 107082 - DNA, 257 bp, Homo sapiens
  chr11:132953063-132953320
  Hyper
gccgagcgggccgcacagtcactggggcgccgctcgctttgctgcctttcccgcgggtgcactgagcggcgggagcgggagccgcgggctttgcctgagccgggcgcgcgctgtggtctcactcccagacccgacccctctgagctgcccctctccgaggccccgcgaccgcatgcgtgtgtgctcccactgccccagcctgagtcccggatactggtgcccctgtctcgggtcgctggctgcggagagggctggcc

SEQ ID NO: 107083 - DNA, 194 bp, Homo sapiens; identical to SEQ ID NO: 72309
  chr11:133231266-133231460
  Hypo

SEQ ID NO: 107084 - DNA, 104 bp, Homo sapiens; identical to SEQ ID NO: 15619
  chr11:133231728-133231832
  Hypo

SEQ ID NO: 107085 - DNA, 101 bp, Homo sapiens; identical to SEQ ID NO: 72311
  chr11:133309666-133309767
  Hypo

SEQ ID NO: 107086 - DNA, 30 bp, Homo sapiens; identical to SEQ ID NO: 72312
  chr11:133374504-133374534
  Hypo

SEQ ID NO: 107087 - DNA, 192 bp, Homo sapiens; identical to SEQ ID NO: 43298
  chr11:133386010-133386202
  Hypo

SEQ ID NO: 107088 - DNA, 303 bp, Homo sapiens; identical to SEQ ID NO: 72314
  chr11:133401987-133402290
  Hyper

SEQ ID NO: 107089 - DNA, 37 bp, Homo sapiens; identical to SEQ ID NO: 72315
  chr11:133519102-133519139
  Hypo

SEQ ID NO: 107090 - DNA, 33 bp, Homo sapiens; identical to SEQ ID NO: 72316
  chr11:133559539-133559572
  Hypo

SEQ ID NO: 107091 - DNA, 30 bp, Homo sapiens; identical to SEQ ID NO: 72317
  chr11:133703684-133703714
  Hypo

SEQ ID NO: 107092 - DNA, 30 bp, Homo sapiens; identical to SEQ ID NO: 72318
  chr11:133773053-133773083
  Hypo

SEQ ID NO: 107093 - DNA, 62 bp, Homo sapiens; identical to SEQ ID NO: 72319
  chr11:133777783-133777845
  Hypo

SEQ ID NO: 107094 - DNA, 90 bp, Homo sapiens; identical to SEQ ID NO: 72320
  chr11:133790279-133790369
  Hypo

SEQ ID NO: 107095 - DNA, 30 bp, Homo sapiens; identical to SEQ ID NO: 43299
  chr11:133805206-133805236
  Hypo

SEQ ID NO: 107096 - DNA, 2251 bp, Homo sapiens
  chr11:133825189-133827440
  Hyper
gaagagttttaaaaccgtccggaccaacatgtcagttaacaaaatcacccttcgcttcgccctctgctcgttctgttttcagacaccaccacccccctcagaagcagaggcgacatattcattccattccggaaagtttcctgaagcacgcccccctgcacagacgagtgacgaggggaccccgtgagaggcgcctccagcccacccggcgccccatgccgctgggagagggttctctgtcggcgagtcctgcctgctgactcccacccacagcgggttctctcccgccgccatctcctccggcttggtgaacttgcccgcagccgggtcgtgtctgcgcgctgacagccctgagctcacagtcctggcaccctccaggctccgctcccacttccatacaagggccgagagccgggggtgccacccagaggcttgtaggtcgctctgcccatctccaaagcaaaagcccgcgcgctcacgcacgcatcacccaactcggtggctccccccttgcgtctcccccagctcagacccaggaaagcggaaagagaaaatcccccctccgctcggattcacagcgtggggacccccccttccccgcccctcccctcccccgccgccgcccccagccagctctgcctcgcagcctggggagggcggcgtggggcccgcgcggctgcggcgcgctcccggggaacttttgcctggccggggcccaggtgcggctgagaggcgcgggggccggcggggtccagccaaaagcggacacacctcgaagctggcctcatcaatcctcctctcaccgggcgcccctgctagggggatccgacctccagctgccaagatgtgtgggcaggaggggcgcgagcggagcgatggacgcccgcagggccgcgcgaacccggggccttagacgcgggtgccgccagtcccagggatcctccgggtcgcgcctccctgcaggcgctcctcgcggcgcggggctctagcgtgctgcagcctgcccggagaccgcaaactcccgcagccagagtttcccgcagctctgggaggcggccgccgggcaggaggcgacgggctaggcgcgccggtgtgcaccgtggggcccgtggtgggcgaagtcgacccaggttccactgcgtcctttccccgagtgcccggcagcccgtgggctctggccccttcccgcccgcccctccagcccacggcccccaggccctccccggcaatgctcccgggccgcctggcccgcgtcggagcccaagcctcacccgcgggaaggcgcgccggggagctggggaaccggggggccaaggagccgggaaaccgaggggccgggcgcgaggggccgagggcgccgggaggggcaggggagggacgccgcacttcaactcaccttcagccgcaagccctcgggtgccgatcacacttgctatgaaagtggccacataccaaatcatagtactaccgcgccagcccggagcctcatcctatcgcaaagtgctcccgcgcccgcacgcgcctcgcgcccgagcgcccgcctcgcgcccgcctcgcgccgcctacgccccgcgccggtgctcctgcagcccgggtggccagctctccatccctcctaggctccgctcggctcggcgcgcgcctccccggccccggcgcagcggcacctgcactactcgcccgggcggagcgcagccaggtccacggtgaagcctagccgggccgggcctccggaaccgcccccgccgcccgcctattgggcgccgcccgcaagccgggggtccgattggctcagccttccgcccgtcgcggcgcgaaggaggcgagcccatttcaaggtgcgttgaagtgtggcgagcacagagccgcagaatcatgcgcattgccggggagaaggtggtatagcgtctctgcccgcttctctctcggctcacactgcgtggcaagtttctggtgagggaaatggtagcttctaacgggaccctggcgggtctcaattaccccggacaggtctgagggaagtggagcccccgcccactcatggaacccaacatccggtttccatccggcaaaaagcagttcccgagaggaccatgctgattctatgatggggaaacccaggagccggcggcccgggagagccggggaacgtccttcgccggagatcttttcaaagaggtcacgcgccgcctccccaccccgtctccctccgcacccagacacgtccccagagcagcgcaccaccccctcc

SEQ ID NO: 107097 - DNA, 173 bp, Homo sapiens; identical to SEQ ID NO: 72326
  chr11:133845226-133845399
  Hypo

SEQ ID NO: 107098 - DNA, 408 bp, Homo sapiens; identical to SEQ ID NO: 72327
  chr11:133906570-133906978
  Hyper

SEQ ID NO: 107099 - DNA, 30 bp, Homo sapiens; identical to SEQ ID NO: 72328
  chr11:133912264-133912294
  Hypo

SEQ ID NO: 107100 - DNA, 665 bp, Homo sapiens
  chr11:133938772-133939437
  Hyper
agagaacccatgtgccggtccagagcatcgctgcatccgtaagcagctagacctcagcttcctctgtcaccatggtgccggctcggctgggcccggcggtcgccatggtaactggggcgggtcgcagggtcctggcaggctgggcgcatgcgcgcggggactacaagccgcgccgcgctgccgctggcccctcagcaaccctcgacatggcgctgaggcggccaccgcgactccggctctgcgctcggctgcctgacttcttcctgctgctgcttttcaggggtgagtttgcgcgtttccgctgttgggagactagggtctgggggcgacggaagcagagcgggccgaagctgctggagccggtccgggcgaggatagcggtcctggctccgagggctcccggggtcccgggccggaggggcggcgcgcgcccgcgtccccgcagccagggctgggactcgggcctggctagggcgggggccctgggacgcccggcagttggaccggggcggggagctaatttgggatggggggcccgtcccaggcagtgagtcggtcccggacagccgtcggaccccgggggcgggctcttctcgggcggggtcctgtgctgggcggtgggctcatcccccgggtgggctcctcccaggcggggtcctgtgctg

SEQ ID NO: 107101 - DNA, 50 bp, Homo sapiens; identical to SEQ ID NO: 34187
  chr11:133994694-133994744
  Hyper

SEQ ID NO: 107102 - DNA, 61 bp, Homo sapiens; identical to SEQ ID NO: 72333
  chr11:133995063-133995124
  Hyper

SEQ ID NO: 107103 - DNA, 219 bp, Homo sapiens; identical to SEQ ID NO: 43300
  chr11:134011075-134011294
  Hypo

SEQ ID NO: 107104 - DNA, 130 bp, Homo sapiens; identical to SEQ ID NO: 72335
  chr11:134011733-134011863
  Hypo

SEQ ID NO: 107105 - DNA, 1622 bp, Homo sapiens
  chr11:134145474-134147096
  Hyper
ctgtgttctttgcaacggaagaagcaaagacttcaaagggagaaatcggaagatttcttttttcatcgtagggacttcacatcagcgtttccaaaaccgagtccatcgccttttccctctgcgcagcctctatcccttcctgtgtttcgcatctcaataaacgtccccgccaagtgacttcagcctgaaacatgcggcctcccggactcctctctgtgtcaccgacctcttgcgctcagttctccggagctgccggtttaacctcgcaagtcttcccggaacccgtgccctcctcctgggcagcgttaccaccacgagcgcctacctgagaggacgcctgttctcatccagcctccaccctgcagccgagcaatctccgtaaaacgaacacctggcttagtttctgctggaaaccgttgaatagtccccactgtcttctggaagggtctgggcagctcggcgtggcgtccacggccccaccaggcctctgcctcctgcaggtcccgctacttcgtcaccaaagcgcccgccgcgctcgcatctgctgtgaggctgtgctcgggccgctcccgccgagggaacggccctcccaaggctctgcgccccaattctcgctcgtttgccaagaggtagccgtgtcggggagctagagttctccggggactctctcctgcccctcgtggccctctgtggaaccctcgttttaggatctgcacgccgtttccagtcgcgcgcgcggcacggagaccgcccgctgtgccccgcgctgcgctctctccgcccctctcccgcgcaggcctccctgtgccagccggctgtcgacccaggttaggaagcccgaggtcggggcgttaccccaagggccctcccgcttcccctccgagggcagagaggcgtccgcgcccggacgcactgcgggaacacctggagcgccggcggagctcggctgtccccgcgggagggagcccgacgcgcatccttgggacccggacccggcgcccgcgcctcgggacggatttctgcctcggctgcaggcgcagcgcgcagacctgagcctgccccgcggaaccggggctcgagtcccggcccgagcgcggcgtcggggccagcggagaggggcggaagccgcaagggaccctcggcgcctcggcctggccgcgatgaagtccccgcccctcctcaggtgacggatcgccgctgccgtcccgggctgcccaccaccccggcgcgtgcccgggagcctccaccctccccgggttctgtggccggccacgcgccccaggcacgcgccgcgccgggccgcgccaccaagcccgctgtccccagctttcctcggcagatcccctggctacccccaccctgcggaggggccgttcaccagatgccagaaaatcagggtggggcacgcaggccaggggctccagcggctgggcaccgtgtccttcccgaacctggtgctggaagtgcgcccgcctccgcctctcccaggcacccaccggcactgcccagccctgtctggagggtctaggactgaacgtctgtccccggccttcatcctggctgcagaggactggccgggtgatgccgcgctgtcctggccctgggcccgcctggaagacccg

SEQ ID NO: 107106 - DNA, 118 bp, Homo sapiens; identical to SEQ ID NO: 72339
  chr11:134201431-134201549
  Hyper

SEQ ID NO: 107107 - DNA, 364 bp, Homo sapiens; identical to SEQ ID NO: 72340
  chr11:134201790-134202154
  Hyper

SEQ ID NO: 107108 - DNA, 38 bp, Homo sapiens; identical to SEQ ID NO: 72341
  chr11:134274891-134274929
  Hypo

SEQ ID NO: 107109 - DNA, 208 bp, Homo sapiens; identical to SEQ ID NO: 72342
  chr11:134281335-134281543
  Hyper

SEQ ID NO: 107110 - DNA, 207 bp, Homo sapiens
  chr11:134281603-134281810
  Hyper
gcgcgcgcccgggaggacatggcgtgggcaccgatggggacgcagaaaggggctctgtgcgcggcggggcgcccgcgggggcgcggggagcactgacctgcggcgacgagtccggagcgtctccggtgcggtccatcgcgggcaacggcccctacgccccggccccggcgcccctagaccgctgccctgggccgcgtgcggctccct

SEQ ID NO: 107111 - DNA, 30 bp, Homo sapiens; identical to SEQ ID NO: 72345
  chr11:134282306-134282336
  Hyper

SEQ ID NO: 107112 - DNA, 82 bp, Homo sapiens; identical to SEQ ID NO: 72346
  chr11:134282850-134282932
  Hyper

SEQ ID NO: 107113 - DNA, 69 bp, Homo sapiens; identical to SEQ ID NO: 72347
  chr11:134395375-134395444
  Hypo

SEQ ID NO: 107114 - DNA, 202 bp, Homo sapiens; identical to SEQ ID NO: 72348
  chr11:134458477-134458679
  Hypo

SEQ ID NO: 107115 - DNA, 32 bp, Homo sapiens; identical to SEQ ID NO: 72349
  chr11:134526234-134526266
  Hypo

SEQ ID NO: 107116 - DNA, 117 bp, Homo sapiens; identical to SEQ ID NO: 72350
  chr11:134534227-134534344
  Hypo

SEQ ID NO: 107117 - DNA, 77 bp, Homo sapiens; identical to SEQ ID NO: 72351
  chr11:134607452-134607529
  Hypo

SEQ ID NO: 107118 - DNA, 200 bp, Homo sapiens; identical to SEQ ID NO: 72352
  chr11:134608540-134608740
  Hypo

SEQ ID NO: 107119 - DNA, 30 bp, Homo sapiens; identical to SEQ ID NO: 72353
  chr11:134670064-134670094
  Hypo

SEQ ID NO: 107120 - DNA, 98 bp, Homo sapiens; identical to SEQ ID NO: 72354
  chr11:134909746-134909844
  Hypo

SEQ ID NO: 107121 - DNA, 366 bp, Homo sapiens; identical to SEQ ID NO: 74522
  chr12:298173-298539
  Hyper

SEQ ID NO: 107122 - DNA, 139 bp, Homo sapiens; identical to SEQ ID NO: 74530
  chr12:299633-299772
  Hypo

SEQ ID NO: 107123 - DNA, 90 bp, Homo sapiens; identical to SEQ ID NO: 74532
  chr12:300471-300561
  Hypo

SEQ ID NO: 107124 - DNA, 30 bp, Homo sapiens; identical to SEQ ID NO: 74560
  chr12:330158-330188
  Hypo

SEQ ID NO: 107125 - DNA, 243 bp, Homo sapiens; identical to SEQ ID NO: 74971
  chr12:569970-570213
  Hyper

SEQ ID NO: 107126 - DNA, 71 bp, Homo sapiens; identical to SEQ ID NO: 75110
  chr12:665830-665901
  Hypo

SEQ ID NO: 107127 - DNA, 35 bp, Homo sapiens; identical to SEQ ID NO: 43307
  chr12:709027-709062
  Hypo

SEQ ID NO: 107128 - DNA, 95 bp, Homo sapiens; identical to SEQ ID NO: 75171
  chr12:752339-752434
  Hyper

SEQ ID NO: 107129 - DNA, 30 bp, Homo sapiens; identical to SEQ ID NO: 75298
  chr12:926703-926733
  Hypo

SEQ ID NO: 107130 - DNA, 31 bp, Homo sapiens; identical to SEQ ID NO: 73680
  chr12:1057793-1057824
  Hypo

SEQ ID NO: 107131 - DNA, 82 bp, Homo sapiens; identical to SEQ ID NO: 73681
  chr12:1059279-1059361
  Hyper

SEQ ID NO: 107132 - DNA, 50 bp, Homo sapiens; identical to SEQ ID NO: 73697
  chr12:1073029-1073079
  Hypo

SEQ ID NO: 107133 - DNA, 86 bp, Homo sapiens; identical to SEQ ID NO: 73705
  chr12:1079112-1079198
  Hypo

SEQ ID NO: 107134 - DNA, 637 bp, Homo sapiens; identical to SEQ ID NO: 74399
  chr12:1639018-1639655
  Hyper

SEQ ID NO: 107135 - DNA, 83 bp, Homo sapiens; identical to SEQ ID NO: 74400
  chr12:1639894-1639977
  Hyper

SEQ ID NO: 107136 - DNA, 155 bp, Homo sapiens; identical to SEQ ID NO: 74401
  chr12:1640321-1640476
  Hyper

SEQ ID NO: 107137 - DNA, 38 bp, Homo sapiens; identical to SEQ ID NO: 74403
  chr12:1650724-1650762
  Hypo

SEQ ID NO: 107138 - DNA, 76 bp, Homo sapiens; identical to SEQ ID NO: 43309
  chr12:1651130-1651206
  Hypo

SEQ ID NO: 107139 - DNA, 160 bp, Homo sapiens; identical to SEQ ID NO: 74408
  chr12:1716717-1716877
  Hypo

SEQ ID NO: 107140 - DNA, 41 bp, Homo sapiens; identical to SEQ ID NO: 74409
  chr12:1738826-1738867
  Hyper

SEQ ID NO: 107141 - DNA, 186 bp, Homo sapiens; identical to SEQ ID NO: 74410
  chr12:1739589-1739775
  Hyper

SEQ ID NO: 107142 - DNA, 66 bp, Homo sapiens; identical to SEQ ID NO: 74411
  chr12:1762161-1762227
  Hyper

SEQ ID NO: 107143 - DNA, 56 bp, Homo sapiens; identical to SEQ ID NO: 74413
  chr12:1905770-1905826
  Hyper

SEQ ID NO: 107144 - DNA, 292 bp, Homo sapiens; identical to SEQ ID NO: 74414
  chr12:1906030-1906322
  Hyper

SEQ ID NO: 107145 - DNA, 30 bp, Homo sapiens; identical to SEQ ID NO: 74415
  chr12:1911756-1911786
  Hypo

SEQ ID NO: 107146 - DNA, 122 bp, Homo sapiens; identical to SEQ ID NO: 74416
  chr12:1914195-1914317
  Hypo

SEQ ID NO: 107147 - DNA, 71 bp, Homo sapiens; identical to SEQ ID NO: 74419
  chr12:1937150-1937221
  Hypo

SEQ ID NO: 107148 - DNA, 42 bp, Homo sapiens; identical to SEQ ID NO: 43311
  chr12:1948142-1948184
  Hypo

SEQ ID NO: 107149 - DNA, 270 bp, Homo sapiens; identical to SEQ ID NO: 74421
  chr12:1948392-1948662
  Hypo

SEQ ID NO: 107150 - DNA, 118 bp, Homo sapiens; identical to SEQ ID NO: 74422
  chr12:1951151-1951269
  Hypo

SEQ ID NO: 107151 - DNA, 80 bp, Homo sapiens; identical to SEQ ID NO: 74423
  chr12:1957154-1957234
  Hypo

SEQ ID NO: 107152 - DNA, 30 bp, Homo sapiens; identical to SEQ ID NO: 74426
  chr12:1987670-1987700
  Hypo

SEQ ID NO: 107153 - DNA, 77 bp, Homo sapiens; identical to SEQ ID NO: 74427
  chr12:1990410-1990487
  Hypo

SEQ ID NO: 107154 - DNA, 113 bp, Homo sapiens; identical to SEQ ID NO: 74428
  chr12:2017761-2017874
  Hypo

SEQ ID NO: 107155 - DNA, 58 bp, Homo sapiens; identical to SEQ ID NO: 74429
  chr12:2018087-2018145
  Hypo

SEQ ID NO: 107156 - DNA, 30 bp, Homo sapiens; identical to SEQ ID NO: 74431
  chr12:2022315-2022345
  Hypo

SEQ ID NO: 107157 - DNA, 162 bp, Homo sapiens; identical to SEQ ID NO: 74432
  chr12:2028903-2029065
  Hypo

SEQ ID NO: 107158 - DNA, 30 bp, Homo sapiens; identical to SEQ ID NO: 74433
  chr12:2029674-2029704
  Hypo

SEQ ID NO: 107159 - DNA, 30 bp, Homo sapiens; identical to SEQ ID NO: 74434
  chr12:2036436-2036466
  Hypo

SEQ ID NO: 107160 - DNA, 49 bp, Homo sapiens; identical to SEQ ID NO: 74435
  chr12:2038007-2038056
  Hypo

SEQ ID NO: 107161 - DNA, 151 bp, Homo sapiens; identical to SEQ ID NO: 74436
  chr12:2040511-2040662
  Hypo

SEQ ID NO: 107162 - DNA, 30 bp, Homo sapiens; identical to SEQ ID NO: 43316
  chr12:2046347-2046377
  Hypo

SEQ ID NO: 107163 - DNA, 81 bp, Homo sapiens; identical to SEQ ID NO: 74443
  chr12:2088757-2088838
  Hypo

SEQ ID NO: 107164 - DNA, 99 bp, Homo sapiens; identical to SEQ ID NO: 74444
  chr12:2138539-2138638
  Hypo

SEQ ID NO: 107165 - DNA, 150 bp, Homo sapiens; identical to SEQ ID NO: 74445
  chr12:2144292-2144442
  Hyper

SEQ ID NO: 107166 - DNA, 2050 bp, Homo sapiens
  chr12:2161460-2163510
  Hyper
cctcgctgcccctcccgcttcccctcccctcctctatctgtcacttctacaaccgctctgattataattgatcaaacagaatcacggaatcacggctcatcttgccgttttgttcagtggcccgatccgaaacgagactctggtagtcgggcaaattgtattcctcctccttggaattccgctcacagaggccttcccggcgtggccggcccagcagggacgcgccgccgcagcggaggagagaacgcgggcggggggctgcaggccggcgcggggggcgcgacgccgccggcggggcgcgagggggtgtgtccgcgccgcggccaccgcggccaccgcggctggcgcccgggtgcgccgcgcgccccggcctccccgggggctcctcacgccgcccctcgcccgccggcggccggggcccgctccctttgacgtcatgcgggcggagggctcgctcgggcggcgctgccgcgggcgccgggagggggcccgacttcgggctccagtccgccgccgtgcgccccgcgccgtgcgcccggctccctgcgcgccgccgcagccacatctggaagcgttcagcgcgtctgcctccggcgcgccgggcgggcgggcgggcggcgcgggcaggggcgggcgcgggcgcggcggggctgggccggggggagtgagcgcggcgctctcgcgcgcccggtgtctccctctcgctgcctctgcagaaacagctcctgccagagcggcgctcggcgcggcgcggcgggcccggagcggcggcggcggctcttcctgcctccgcgcccaggagttgccggctccctttgacagcagagagccgggcaggggcctcaggaggactcgctgggagtgggcagaggcgcctcggcccctgccggcccaggcgggccccgcgcgccccccgcccctcctctccgcctcttctcgccctgcctctcccgatttattttttcaaatggtgtagccgccggaggtgcggtgctcagttcttggaaggggcccggatgtactgaggatgcgttacagtttcactcgaggaggcagtagtggaaaggagcagtttttggggtttgatgccataatgggaatcaggtaatcgtcggcggggaagaagaaacgctgcagaccacggcttcctcgaatcttgcgcgaaagccgccggcctcggaggagggattaatccagacccgccggggggtgttttcacatttcttcctcttcgtggctgctcctcctattaaaaccatttttggtccatggtcaatgagaatacgaggatgtacattccagaggaaaaccaccaaggtaaggctggaccccgccgcctcgccggggctccctgccttttccaccgggttcctgccctacccgcgctccccgcggccccggggccggtccctgcggagtggcccggggccgcgtccgcgaggggcgcctccgcctcgtcggagcgcccgggagcccggcgggaccggggcccgaaccgccgcgcgagacggagcggaaaattcccgcccctccccctccgggccccagcttctccagagcatgtgtttcctgtgaaattccaggcgaggggggaaaagttccccaagtggctgccgccgcctcgctttctcgcgtccgcctggagagcccggctgcctggccagccgcgcggggggcagagggcgccggcgccgcggagcccagaggcccggggtccctcgcccggctcggggcgcggctgggagcgcgcgcgcgcgcaccctgcgccggcagagcccggcgcccacggccgcccctggggcgccctcgcgctgcccggcgtccactctcgtccaggcgcccctgccctgggcggcgcgctccaggtggcgggtgggggcggcggtgcagatgtgaagcccagcgcgcccctctggttccccctctgtaggtccccttcttcctctctccctccctcctccgccgctcacctacacccacccacctctccactgctgttgaccccgagcgcgcccacgccgcgtgtgttctcattcgcacccacatgtgg

SEQ ID NO: 107167 - DNA, 40 bp, Homo sapiens; identical to SEQ ID NO: 43318
  chr12:2245461-2245501
  Hypo

SEQ ID NO: 107168 - DNA, 57 bp, Homo sapiens; identical to SEQ ID NO: 74468
  chr12:2300563-2300620
  Hypo

SEQ ID NO: 107169 - DNA, 30 bp, Homo sapiens; identical to SEQ ID NO: 74469
  chr12:2403723-2403753
  Hypo

SEQ ID NO: 107170 - DNA, 30 bp, Homo sapiens; identical to SEQ ID NO: 74470
  chr12:2412108-2412138
  Hypo

SEQ ID NO: 107171 - DNA, 177 bp, Homo sapiens; identical to SEQ ID NO: 74476
  chr12:2482588-2482765
  Hypo

SEQ ID NO: 107172 - DNA, 194 bp, Homo sapiens; identical to SEQ ID NO: 5128
  chr12:2566053-2566247
  Hypo

SEQ ID NO: 107173 - DNA, 30 bp, Homo sapiens; identical to SEQ ID NO: 15624
  chr12:2590465-2590495
  Hypo

SEQ ID NO: 107174 - DNA, 44 bp, Homo sapiens; identical to SEQ ID NO: 74503
  chr12:2778028-2778072
  Hypo

SEQ ID NO: 107175 - DNA, 123 bp, Homo sapiens; identical to SEQ ID NO: 74504
  chr12:2783720-2783843
  Hypo

SEQ ID NO: 107176 - DNA, 52 bp, Homo sapiens; identical to SEQ ID NO: 74505
  chr12:2788862-2788914
  Hypo

SEQ ID NO: 107177 - DNA, 43 bp, Homo sapiens; identical to SEQ ID NO: 74506
  chr12:2797716-2797759
  Hypo

SEQ ID NO: 107178 - DNA, 63 bp, Homo sapiens; identical to SEQ ID NO: 34202
  chr12:2800100-2800163
  Hyper

SEQ ID NO: 107179 - DNA, 948 bp, Homo sapiens
  chr12:2861643-2862591
  Hyper
cacgccacatcaccccggtcctttagactcctgcgcattctatttccccgtttccttctcacacccactttcttccctggctcccaccacagcagtgcccatctgctcctccccgctcactcaggtctcctgctcaggacgcccttgccgagggcgcggggcatttgtactgaagaagggctgcaggagagtcggtgacccctccttctacttgtatgtagcggccccaagtgtcccgggagctggtggggcgcttgggctgtatgagcccggccgccaggaggctggggctgcgtcaggagctgtccgtggtgcttaagcggcgtctgctcgggcgcggggtgtggcgcggcgggtgagcgctgtccctggtcctggagaggttcctggcccccagtggcaacggtgagagcagtggcccagaaggccagtaccgggaacgacgatggcgggcacaagggtgggcttgcagcagctgctgctggtgctcccacaggctgcggttctccgcgctcagctcatccagccgccgctcctgctcgtcgatgcgctggcgctggatgtggacgaggctctgctggttctgcacgatggatggcccagagcccttgaggtacagcacggcgcgcaccgggttttccagcaggctctcgatgccacccaccgccgcctgcgccctgcctgcccctgggctggcgcctgggagcgcgagggcgcgggaacccagcagcccagcggtcctctcccacgggcccagcctccctcccgccgccagcgccgcgtcaccgccaccccgattgtcacacactcaccacggggagaggccgcggcccagagcaccccttcctgtctcttggtgtccagaggaggctctgcctcccgctgggcagagaggagagggaggaggccagcgagagggagcctgtgtcggggcgtgggagggaagca

SEQ ID NO: 107180 - DNA, 105 bp, Homo sapiens; identical to SEQ ID NO: 74514
  chr12:2903684-2903789
  Hyper

SEQ ID NO: 107181 - DNA, 145 bp, Homo sapiens; identical to SEQ ID NO: 74516
  chr12:2920998-2921143
  Hypo

SEQ ID NO: 107182 - DNA, 548 bp, Homo sapiens; identical to SEQ ID NO: 74521
  chr12:2964264-2964812
  Hypo

SEQ ID NO: 107183 - DNA, 31 bp, Homo sapiens; identical to SEQ ID NO: 74531
  chr12:2999407-2999438
  Hypo

SEQ ID NO: 107184 - DNA, 105 bp, Homo sapiens; identical to SEQ ID NO: 74551
  chr12:3198028-3198133
  Hypo

SEQ ID NO: 107185 - DNA, 38 bp, Homo sapiens; identical to SEQ ID NO: 74568
  chr12:3340974-3341012
  Hypo

SEQ ID NO: 107186 - DNA, 33 bp, Homo sapiens; identical to SEQ ID NO: 74575
  chr12:3414273-3414306
  Hypo

SEQ ID NO: 107187 - DNA, 195 bp, Homo sapiens; identical to SEQ ID NO: 74576
  chr12:3419740-3419935
  Hypo

SEQ ID NO: 107188 - DNA, 34 bp, Homo sapiens; identical to SEQ ID NO: 74577
  chr12:3421073-3421107
  Hypo

SEQ ID NO: 107189 - DNA, 785 bp, Homo sapiens; identical to SEQ ID NO: 74595
  chr12:3474882-3475667
  Hyper

SEQ ID NO: 107190 - DNA, 106 bp, Homo sapiens; identical to SEQ ID NO: 74596
  chr12:3562914-3563020
  Hypo

SEQ ID NO: 107191 - DNA, 561 bp, Homo sapiens
  chr12:3599973-3600534
  Hyper
caaatcgtaattcgccgaggaaggatccaggaactggcagaggagcgggagagctggggtgggccggggtggggagggtgcgagttaactgtggcccggtctcgcccggacctcgccctaggtgggagcacgcgcaccgggtctgagaacctgcaagagcctcgcccggcgccggctttctctgggccccccgcgcgggcctggcctccacgtaagttgtgtgcagcgccagggagtggaggcggccgagaccctcggagactaggggagggggcgggcccgggggcgctgggggccctcggtctgcgcccagccgccgccggctccagcgaacctcctaccccgcccccactcacccggctcagcccctaggagagacgcgcaggaagcgtgttgcttcgcccagcggatcggcagaagttgagaggagttggcggctgcctccggccggccggactttgcgagcagcctggagaggatccgcgaccgccgccgccgccgccgcggaggcttcggggctgcttccctcgagcttagcccgcagcgcgggtggagaggggc

SEQ ID NO: 107192 - DNA, 214 bp, Homo sapiens
  chr12:3600768-3600982
  Hyper
tcaccaaacccttgccggctcttatgggcatgaaacactcctcccgctgcctgctcctgaggaggaaaatggcggagaacgcggccgagagcaccgaggtaaggaggcgagcgagcaggggctctcggagaccccgccgcccacccggaccaccgcgccgccgccgccgctcagcgccgagtgccaaactttccccagtttcatcccgctcgct

SEQ ID NO: 107193 - DNA, 214 bp, Homo sapiens; identical to SEQ ID NO: 34211
  chr12:3601042-3601256
  Hyper

SEQ ID NO: 107194 - DNA, 147 bp, Homo sapiens; identical to SEQ ID NO: 74602
  chr12:3601478-3601625
  Hyper

SEQ ID NO: 107195 - DNA, 940 bp, Homo sapiens
  chr12:3602021-3602961
  Hyper
gtctggtggggctgccgcacatttcacatatggttacccatatgcagcggggggcggggatgggggtgtggcgcggggattgtccctctgtcttgccggaatgcaaaaaggtagagagacccttcctggtcttcttccctcgagttcttaactctgcgctaaaacccctaccccacggcgtaggcagcaaagctttataaatcccccttctctgagagactagaagcagcatgcatctgacaattgtcaatttcaaaacaaacacgctccgggacttgaacgcagcggggcattcagtagcgaatgctgtctccttgagttagggcaaagcctgcgtgcccgccgtcccctcaccacttcctcttccccagcccccacctgagagcagacattcggaatgatgtgtagtgcgaggcggctagcctcccagcagaaagccatccttaccattcccctcaccctccgccctctgatcgcccacccgccgaaagggtttctaaaaatagcccagggcttcaaggccgcgcttctgtgaagtgtggagcgagcgggcacgtagcggtctctgccaggtggctggagccctggaagcgagaaggcgcttcctccctgcatttccacctcaccccacccccggctcatttttctaagaaaaagtttttgcggttccctttgcctcctacccccgctgccgcgcggggtctgggtgcagacccctgccaggttccgcagtgtgcagcggcggctgctgcgctctcccagcctcggcgagggttaaaggcgtccggagcaggcagagcgccgcgcgccagtctatttttacttgcttcccccgccgctccgcgctcccccttctcagcagttgcacatgccagctctgctgaaggcatcaatgaaaacagcagtaggggcggccgggctcctgcgaacaacaacaaaa

SEQ ID NO: 107196 - DNA, 37 bp, Homo sapiens; identical to SEQ ID NO: 74605
  chr12:3640833-3640870
  Hypo

SEQ ID NO: 107197 - DNA, 113 bp, Homo sapiens; identical to SEQ ID NO: 74606
  chr12:3724027-3724140
  Hypo

SEQ ID NO: 107198 - DNA, 205 bp, Homo sapiens; identical to SEQ ID NO: 74630
  chr12:4018922-4019127
  Hypo

SEQ ID NO: 107199 - DNA, 18 bp, Homo sapiens
  chr12:4051745-4051763
  Hypo
aaccgtgtctccaaaaaa

SEQ ID NO: 107200 - DNA, 349 bp, Homo sapiens; identical to SEQ ID NO: 74640
  chr12:4140405-4140754
  Hyper

SEQ ID NO: 107201 - DNA, 46 bp, Homo sapiens; identical to SEQ ID NO: 74641
  chr12:4154674-4154720
  Hypo

SEQ ID NO: 107202 - DNA, 196 bp, Homo sapiens; identical to SEQ ID NO: 43325
  chr12:4194712-4194908
  Hypo

SEQ ID NO: 107203 - DNA, 30 bp, Homo sapiens; identical to SEQ ID NO: 74650
  chr12:4206588-4206618
  Hypo

SEQ ID NO: 107204 - DNA, 165 bp, Homo sapiens; identical to SEQ ID NO: 74651
  chr12:4212424-4212589
  Hypo

SEQ ID NO: 107205 - DNA, 148 bp, Homo sapiens; identical to SEQ ID NO: 74652
  chr12:4214009-4214157
  Hypo

SEQ ID NO: 107206 - DNA, 125 bp, Homo sapiens; identical to SEQ ID NO: 74653
  chr12:4217500-4217625
  Hypo

SEQ ID NO: 107207 - DNA, 84 bp, Homo sapiens; identical to SEQ ID NO: 43327
  chr12:4268526-4268610
  Hypo

SEQ ID NO: 107208 - DNA, 17 bp, Homo sapiens
  chr12:4272614-4272631
  Hypo
agcgagactctgtctca

SEQ ID NO: 107209 - DNA, 633 bp, Homo sapiens
  chr12:4273871-4274504
  Hyper
gcggcacccgggcctcgcctccttccagcggagccgcgcgccctgcgtcctggcctccccgccccgagtccccttccctggagcctgggggaccgacagtcgcgggccacgcacgcggtcccagcctcgccgtccgccccggggagagctggaaggtgggcccggatctcccacatcactatgagctcattccagccccggccaagcaaagcctggccctactcgctccacatgcatttcagtctcctctcgcctttcatgcgcggaggagccgggagggagaggatgtgacctcatctgcgcggcatctgagcccaggggtgccccagctcttccacccaggccgctccccgagcccagctccccgcgcccctctctctatccaggagagacgcattggacagccaggagggctcgacgtggaaggaaaggaagctgcaattctgggacaggggcagacgggagaggaagtgaacgtggctaaacgctcactttatgtaaaacgtcccccagactagaatctcgtccacagagctgcacacatacactcgcacgggcccggcttgtactcaggcaggcacactcgccccccgccgtccccaccgcatcccccatacccgtcctaactcactc

SEQ ID NO: 107210 - DNA, 87 bp, Homo sapiens; identical to SEQ ID NO: 74664
  chr12:4280838-4280925
  Hypo

SEQ ID NO: 107211 - DNA, 30 bp, Homo sapiens; identical to SEQ ID NO: 74665
  chr12:4286260-4286290
  Hypo

SEQ ID NO: 107212 - DNA, 101 bp, Homo sapiens; identical to SEQ ID NO: 74669
  chr12:4301350-4301451
  Hypo

SEQ ID NO: 107213 - DNA, 30 bp, Homo sapiens; identical to SEQ ID NO: 74670
  chr12:4307938-4307968
  Hypo

SEQ ID NO: 107214 - DNA, 34 bp, Homo sapiens; identical to SEQ ID NO: 74671
  chr12:4309680-4309714
  Hypo

SEQ ID NO: 107215 - DNA, 30 bp, Homo sapiens; identical to SEQ ID NO: 74672
  chr12:4315483-4315513
  Hypo

SEQ ID NO: 107216 - DNA, 36 bp, Homo sapiens; identical to SEQ ID NO: 74673
  chr12:4322949-4322985
  Hypo

SEQ ID NO: 107217 - DNA, 30 bp, Homo sapiens; identical to SEQ ID NO: 74674
  chr12:4334601-4334631
  Hypo

SEQ ID NO: 107218 - DNA, 30 bp, Homo sapiens; identical to SEQ ID NO: 43330
  chr12:4356247-4356277
  Hypo

SEQ ID NO: 107219 - DNA, 30 bp, Homo sapiens; identical to SEQ ID NO: 74676
  chr12:4358486-4358516
  Hypo

SEQ ID NO: 107220 - DNA, 30 bp, Homo sapiens; identical to SEQ ID NO: 74677
  chr12:4362436-4362466
  Hypo

SEQ ID NO: 107221 - DNA, 190 bp, Homo sapiens; identical to SEQ ID NO: 74678
  chr12:4373080-4373270
  Hypo

SEQ ID NO: 107222 - DNA, 664 bp, Homo sapiens; identical to SEQ ID NO: 74679
  chr12:4377894-4378558
  Hyper

SEQ ID NO: 107223 - DNA, 1118 bp, Homo sapiens; identical to SEQ ID NO: 34218
  chr12:4378802-4379920
  Hyper

SEQ ID NO: 107224 - DNA, 30 bp, Homo sapiens; identical to SEQ ID NO: 34219
  chr12:4380166-4380196
  Hyper

SEQ ID NO: 107225 - DNA, 553 bp, Homo sapiens; identical to SEQ ID NO: 74682
  chr12:4380480-4381033
  Hyper

SEQ ID NO: 107226 - DNA, 1006 bp, Homo sapiens
  chr12:4381433-4382439
  Hyper
tcgctcccctcctccgccttgcagggaacctagtgtacggctcacccagcccgcgccccaccccgccttgctggctctccgcgcccctgcccgggccccctctctcggtgagggaggcactcagtcggcctcggtgtgcccagagagctcgagccacgccatgcccgctgcacgtgccagcttggccagcacatcagggcgctggtctctccccttcctcctggagtgaaatacaccaaagggcgcggtgggggtggggggtgacgggaggaaggaggtgaagaaacgccaccagatcgtatctcctgtaaagacagccttgactcaagcatgcgttagagcacgtgtcagggccgaccgtgctggcggcgacttcaccgcagtcggctcccagggagaaagcctggcgagtgaggcgcgaaaccggaggggtcggcgaggatgcgggcgaaggaccgagcgtggaggcctcatgcctccggggaaaggaaggggtggtggtgtttgcgcagggggagcgagggggagccggacctaatccctcactcgccccctccccctcccgggccatttcctagaaagctgcatcggtgtggccacgctcagcgcagacacctcgggcggcttgtcagcagatgcaggggcgaggaagcgggtttttcctgcgtggccgctggccgcgggggaaccgctgggagccctgcccccggcctgcggcggccctagacgctgcaccgcgtcgccccacggcgcccgaagagcccccagaaacacgatggtttctgctcgaggatcacattctatccctccagagaagcaccccccttccttcctaatacccacctctccctccctcttcttcctctgcacacactctgcaggggggggcagaagggacgttgttctggtccctttaatcggggctttcgaaacagcttcgaagttatcaggaacacagacttcagggacatgacctttatctctgggtatgcgaggttgctatttt

SEQ ID NO: 107227 - DNA, 34 bp, Homo sapiens
  chr12:4382965-4382999
  Hyper
tttaaggggaggaccggtgcgagtgaggcagccc

SEQ ID NO: 107228 - DNA, 851 bp, Homo sapiens; identical to SEQ ID NO: 74684
  chr12:4383208-4384059
  Hyper

SEQ ID NO: 107229 - DNA, 220 bp, Homo sapiens; identical to SEQ ID NO: 74685
  chr12:4384313-4384533
  Hyper

SEQ ID NO: 107230 - DNA, 30 bp, Homo sapiens; identical to SEQ ID NO: 74686
  chr12:4390499-4390529
  Hypo

SEQ ID NO: 107231 - DNA, 229 bp, Homo sapiens; identical to SEQ ID NO: 74687
  chr12:4391671-4391900
  Hypo

SEQ ID NO: 107232 - DNA, 55 bp, Homo sapiens; identical to SEQ ID NO: 74688
  chr12:4392892-4392947
  Hypo

SEQ ID NO: 107233 - DNA, 55 bp, Homo sapiens; identical to SEQ ID NO: 74694
  chr12:4397850-4397905
  Hypo

SEQ ID NO: 107234 - DNA, 30 bp, Homo sapiens; identical to SEQ ID NO: 74695
  chr12:4399394-4399424
  Hypo

SEQ ID NO: 107235 - DNA, 159 bp, Homo sapiens; identical to SEQ ID NO: 74696
  chr12:4405568-4405727
  Hypo

SEQ ID NO: 107236 - DNA, 30 bp, Homo sapiens; identical to SEQ ID NO: 43332
  chr12:4411192-4411222
  Hypo

SEQ ID NO: 107237 - DNA, 136 bp, Homo sapiens; identical to SEQ ID NO: 74705
  chr12:4554801-4554937
  Hypo

SEQ ID NO: 107238 - DNA, 30 bp, Homo sapiens; identical to SEQ ID NO: 43334
  chr12:4734872-4734902
  Hypo

SEQ ID NO: 107239 - DNA, 138 bp, Homo sapiens; identical to SEQ ID NO: 74720
  chr12:4829055-4829193
  Hypo

SEQ ID NO: 107240 - DNA, 30 bp, Homo sapiens; identical to SEQ ID NO: 43336
  chr12:4959461-4959491
  Hypo

SEQ ID NO: 107241 - DNA, 30 bp, Homo sapiens; identical to SEQ ID NO: 74766
  chr12:4970362-4970392
  Hypo

SEQ ID NO: 107242 - DNA, 2482 bp, Homo sapiens
  chr12:5017990-5020472
  Hyper
gtaggcgggaggcaacggtggtgagaagggtggtcccaaggccgcgggaggagccaatcagcggcgactctgggctcttgcagcctccttagagactccgcagccctggaggtaccaagctgcctgctgccttttctcgcgctgcaggcgcggagatgcagcgcctctgggggcgcagctccagccgcactcgcagggcaaggcacacgcccccggctcctgctgccatgcgcctctgcgggggaccctttccaaataaattgcaagctttgaaagtggccctgtggaggcactaggctggggaaaaaggctgcgggaggagggacatagggtgggaggtgagtaggcgacttgcttctcagattattcccaattagcaccaagttggcagacaaccccacaaacccacgaagccttcggtcccccacaagtcacattccctgtatttcagaataatcggatcgtaagaaaacttcaagtcccatcgtaggttaaagagggacaggctcttagtaccgccgccgcccagtaaaactacatggaacaaacccagggatcctcatctgcacagctctgcccaaagtctgcagctctgcgagtccagccggcgggggaagctgggtgggccccgcagagagcaagggccttcttgggggaggagcgggatggggcgcagagcagtgcgatcgaagagggttactgtgggactgcacaaaagcaaacccgtcggaggagttttgccagaaacaccaccgcctgcattgcgtcggacctgaccatttccaatgtgaaattcccggggaaggtcgcgagccgctaggggccgttcgtgggcggggcggcgggccacaggggaagtagagttagcggtcggcttttctggtaggagaggaaaaagctgtgctggcaagggtgggaactgaatgacaaccccgctctcttccaaaccaccccctcatattttccatccacctcctcgctcctgccctcccccgccctccccaacccacgcccgggtgggccaatcgctgctcggtattccaggcgctttctcaggtttctgctgatcttgcagcgcccagaaatggaccgagcggacccgccgccgcacgcaccctgctccactccaagctcctaagggctcctggcgcgccgcgtagccttggcgaggtccgcgctggggtgcggagagcgaagggaactggagagccatgtagatccaggctctcgcccgcccgcctccttcgggatcgaatcaagggctcccatagtgttaggagggggcgagagtgctgtttatcgtcatttgcctcggagcttcgagagagggtggtattttgcttttccgccccgcatcctccggaactccctgcaccggagagaggacggcgtctccaggttgctggcaaccggtgagaatgggggtagggaaggaacattttcgccgtagctgctccgtaaagcgattgtccaactgagaggggcgtcggacgagtggaccagggcggcgagtttgcccggcgcgtctcggatgctgctgcggcggccgccgcggctcccgccagggcactgcaaagacgacctgccgcattcccactcgggctctccgctgactcagcaccgcccctgcgccaagccagccggccaggtagggggttccccagctcggggatgcagaagcgggggttggggggaccgggtgggggaggccgggggtgcggggatgctgtccgggaccctgagcttcccccggcgtctctcggcgcttttccgatctctagtttaacgaagttgtaaacagatcggctgttgggcattggggaaagtgggatggaagagccccaaacttggatttccgggtgtctgcgtgtcgtctgtccgtgtgtgtgtgatagccctagcaaacgtccagtgctttctcaagctagaggtctgtgttcttcggtgtctgtaggtccgtcccatctgaatgcttctgattttctacccccgtatcactttctatttctctgcagcgtgcatcgatcgccctggtgggagcttagaaggcggcaggcgaagaggggtaggaggggggagagccgaggagaagcagagagggtggcaggcgtggggatctgccgagccggcactgcaccgggtcctaggaaggctctcggaggggaggggaggccagggcgacccccgaagcaatggcccagtccgctagaacggcactgcgttaaggcacctgggatcaggaagaaatatctaaacaacaacaacagaaaaccaacaaacccccaaacccaaacccaaccctctgcaaaaagctgcacccggcccgcaggcgagggggattccaaactgagtgaaaggcagggtggaggggaaggcagcgagaggcaaagtcgcagatctcccgacctgctcgtgttgaagcacctccccctgggcgtgagggagacgcgcgctccggtgggggggccgcttgggtcccccc

SEQ ID NO: 107243 - DNA, 30 bp, Homo sapiens; identical to SEQ ID NO: 74785
  chr12:5020739-5020769
  Hyper

SEQ ID NO: 107244 - DNA, 30 bp, Homo sapiens; identical to SEQ ID NO: 74800
  chr12:5141776-5141806
  Hypo

SEQ ID NO: 107245 - DNA, 810 bp, Homo sapiens
  chr12:5152915-5153725
  Hyper
taggggccccagctgcgccctccggggagacacccgctgccacgagacccgggaggggaagcgggaggagggggagaggaggggaaggcgggggaggcgccgagggtggaggccaagcgcggcgcagccagagaggggcggctgaaggttgcatctgctggaaggaggcttttcggctgcttggtaacgggctgccagaagagagagaggcagagagcagggcagcggcttcttgacgtcagggccaagcgaggggatcgcgccagcaaccccagctctccccagagaggggccggccgaccgctggagcggagcctgacgccaggcgcccgcggagcgtgagtagggggcgcgggagccggtcagctggggcgcagcatgccctctgctcccgcgccatggagatcgccctggtgcccctggagaacggcggtgccatgaccgtcagaggaggcgatgaggcccgggcaggctgcggccaggccacagggggagagctccagtgtcccccgacggctgggctcagcgatgggcccaaggagccggcgccaaaggggcgcggcgcgcagagagacgcggactcgggagtgcggcccttgcctccgctgccggacccgggagtgcggcccttgcctccgctgccagaggagctgccacggcctcgacggccgcctcccgaggacgaggaggaagaaggcgatcccggcctgggcacggtggaggaccaggctctgggcacggcgtccctgcaccaccagcgcgtccacatcaacatctccgggctgcgctttgagacgcagctgggcaccc

SEQ ID NO: 107246 - DNA, 37 bp, Homo sapiens; identical to SEQ ID NO: 74833
  chr12:5252286-5252323
  Hypo

SEQ ID NO: 107247 - DNA, 156 bp, Homo sapiens; identical to SEQ ID NO: 74849
  chr12:5315378-5315534
  Hypo

SEQ ID NO: 107248 - DNA, 146 bp, Homo sapiens; identical to SEQ ID NO: 74851
  chr12:5323880-5324026
  Hypo

SEQ ID NO: 107249 - DNA, 141 bp, Homo sapiens; identical to SEQ ID NO: 43339
  chr12:5335908-5336049
  Hypo

SEQ ID NO: 107250 - DNA, 87 bp, Homo sapiens; identical to SEQ ID NO: 74865
  chr12:5370466-5370553
  Hypo

SEQ ID NO: 107251 - DNA, 30 bp, Homo sapiens; identical to SEQ ID NO: 43340
  chr12:5384595-5384625
  Hypo

SEQ ID NO: 107252 - DNA, 761 bp, Homo sapiens; identical to SEQ ID NO: 74960
  chr12:5540932-5541693
  Hyper

SEQ ID NO: 107253 - DNA, 959 bp, Homo sapiens; identical to SEQ ID NO: 74962
  chr12:5542015-5542974
  Hyper

SEQ ID NO: 107254 - DNA, 44 bp, Homo sapiens; identical to SEQ ID NO: 74963
  chr12:5561220-5561264
  Hypo

SEQ ID NO: 107255 - DNA, 131 bp, Homo sapiens; identical to SEQ ID NO: 74975
  chr12:5713307-5713438
  Hypo

SEQ ID NO: 107256 - DNA, 21 bp, Homo sapiens
  chr12:5720406-5720427
  Hypo
ttacagcggtgagccaccaca

SEQ ID NO: 107257 - DNA, 191 bp, Homo sapiens; identical to SEQ ID NO: 74995
  chr12:5770987-5771178
  Hypo

SEQ ID NO: 107258 - DNA, 30 bp, Homo sapiens; identical to SEQ ID NO: 75021
  chr12:5840200-5840230
  Hypo

SEQ ID NO: 107259 - DNA, 68 bp, Homo sapiens; identical to SEQ ID NO: 75028
  chr12:6180311-6180379
  Hypo

SEQ ID NO: 107260 - DNA, 48 bp, Homo sapiens; identical to SEQ ID NO: 75044
  chr12:6310255-6310303
  Hyper

SEQ ID NO: 107261 - DNA, 155 bp, Homo sapiens; identical to SEQ ID NO: 75045
  chr12:6316943-6317098
  Hypo

SEQ ID NO: 107262 - DNA, 30 bp, Homo sapiens; identical to SEQ ID NO: 75057
  chr12:6420362-6420392
  Hypo

SEQ ID NO: 107263 - DNA, 116 bp, Homo sapiens; identical to SEQ ID NO: 34234
  chr12:6444922-6445038
  Hyper

SEQ ID NO: 107264 - DNA, 30 bp, Homo sapiens; identical to SEQ ID NO: 75059
  chr12:6449974-6450004
  Hyper

SEQ ID NO: 107265 - DNA, 30 bp, Homo sapiens; identical to SEQ ID NO: 75060
  chr12:6450274-6450304
  Hyper

SEQ ID NO: 107266 - DNA, 30 bp, Homo sapiens; identical to SEQ ID NO: 34235
  chr12:6450544-6450574
  Hyper

SEQ ID NO: 107267 - DNA, 152 bp, Homo sapiens; identical to SEQ ID NO: 75062
  chr12:6472461-6472613
  Hyper

SEQ ID NO: 107268 - DNA, 46 bp, Homo sapiens; identical to SEQ ID NO: 34237
  chr12:6472854-6472900
  Hyper

SEQ ID NO: 107269 - DNA, 44 bp, Homo sapiens; identical to SEQ ID NO: 75064
  chr12:6473627-6473671
  Hypo

SEQ ID NO: 107270 - DNA, 462 bp, Homo sapiens; identical to SEQ ID NO: 75070
  chr12:6483568-6484030
  Hypo

SEQ ID NO: 107271 - DNA, 63 bp, Homo sapiens; identical to SEQ ID NO: 75071
  chr12:6493353-6493416
  Hyper

SEQ ID NO: 107272 - DNA, 78 bp, Homo sapiens; identical to SEQ ID NO: 75072
  chr12:6495108-6495186
  Hypo

SEQ ID NO: 107273 - DNA, 111 bp, Homo sapiens; identical to SEQ ID NO: 75099
  chr12:6623485-6623596
  Hypo

SEQ ID NO: 107274 - DNA, 1338 bp, Homo sapiens
  chr12:6664165-6665503
  Hyper
atggcagagacaagccggaaaagtaggaatccccccgtgttccgctcccagcgtccttcttcctgtcacgagcagggcttctgcattctctgcggattctagtctccctgcatccaattgcttccaagctcctcattacacagcacaaactttactctcattcttttcacccctgattcttcggaacccacaccaactcgcggcccgttgtgagtggtatgacacagagagacctgtccccctttcccaatccctacctccgcttgtactcgtcccgctcccgcttcactttggccagcacgttgtagagagcgcggatctcgggcgtgatggtgtcgatctggacgcccaccccatccgggtgcacccacgacaagccaggcccttgcaccagagtgggctccagtcccggcccgagccggcgggcgtgcgagaacgaccagatggtgccgggcatgaagcgggccgacgaggaataggtggtggaggtggaggtggaggacgacgagaggctggccgcggagggcgcgagggggccggccggggagcgcgcgggcgagcccagcacgcgcgccgaagggctgcagacagcggccggccgggcgcccagctgcagccccaggggccggatggggctgacgaagccggtctgcactgcctggtcgcgacgacccaggccccgccggccctgcttaccctcctccagcgcttgctgcagttgcttctccaacagccggttccggcgctccagctcatgcaccttggccaggaagcagcggaaccggaggttcagggtcttgagcacgttgatgttggagcccaggtcattgcggagggccatggcggcaggcggggccgggcccggcccgggcggcgagtaggcagcagggccggccggcgagagaggcgccgggggcaagtctcctcccccggcgaagtggtcgcctcccagtgagtcccccagtggcccggccaggccctgctgctcctgctgcaggaggaagaggttggggccgaataacggattcatggctgcgccttctgctgggagatgcagaccggtgcaggagcagggatggaaggcgagccagaagagccaatgcggcgccggcgggacagagccgaccaatcaggcggctcggcagcggggcagaggtcagggggcgggccgaggggaagccaatgacaggctccaattggaggccggaccctggacctttccgggtctgaggccgagccctgtgatgaggggagccaccgcctggactccagccggggtggcgtaaagcccaggacctccagtaccccatgggttctggtggcaagcccatctcccct

SEQ ID NO: 107275 - DNA, 178 bp, Homo sapiens; identical to SEQ ID NO: 75114
  chr12:6803722-6803900
  Hypo

SEQ ID NO: 107276 - DNA, 70 bp, Homo sapiens; identical to SEQ ID NO: 75115
  chr12:6804640-6804710
  Hypo

SEQ ID NO: 107277 - DNA, 493 bp, Homo sapiens; identical to SEQ ID NO: 75116
  chr12:6809199-6809692
  Hyper

SEQ ID NO: 107278 - DNA, 76 bp, Homo sapiens; identical to SEQ ID NO: 75117
  chr12:6809993-6810069
  Hyper

SEQ ID NO: 107279 - DNA, 30 bp, Homo sapiens; identical to SEQ ID NO: 75118
  chr12:6812993-6813023
  Hyper

SEQ ID NO: 107280 - DNA, 91 bp, Homo sapiens; identical to SEQ ID NO: 75119
  chr12:6861239-6861330
  Hypo

SEQ ID NO: 107281 - DNA, 90 bp, Homo sapiens; identical to SEQ ID NO: 75158
  chr12:7249312-7249402
  Hypo

SEQ ID NO: 107282 - DNA, 16 bp, Homo sapiens
  chr12:7462672-7462688
  Hypo
gcgcctggcaggagac

SEQ ID NO: 107283 - DNA, 201 bp, Homo sapiens; identical to SEQ ID NO: 75173
  chr12:7559133-7559334
  Hypo

SEQ ID NO: 107284 - DNA, 81 bp, Homo sapiens; identical to SEQ ID NO: 43352
  chr12:7767211-7767292
  Hypo

SEQ ID NO: 107285 - DNA, 24 bp, Homo sapiens
  chr12:7840950-7840974
  Hypo
ctaactagggctaggcgcagtggc

SEQ ID NO: 107286 - DNA, 21 bp, Homo sapiens
  chr12:7844734-7844755
  Hypo
gtcaatagactgggccgggac

SEQ ID NO: 107287 - DNA, 30 bp, Homo sapiens; identical to SEQ ID NO: 75190
  chr12:7854770-7854800
  Hypo

SEQ ID NO: 107288 - DNA, 105 bp, Homo sapiens; identical to SEQ ID NO: 75191
  chr12:7864790-7864895
  Hypo

SEQ ID NO: 107289 - DNA, 17 bp, Homo sapiens
  chr12:7896250-7896267
  Hypo
cccggccttaattcttt

SEQ ID NO: 107290 - DNA, 120 bp, Homo sapiens; identical to SEQ ID NO: 75193
  chr12:7919057-7919177
  Hypo

SEQ ID NO: 107291 - DNA, 205 bp, Homo sapiens; identical to SEQ ID NO: 75195
  chr12:7921501-7921706
  Hypo

SEQ ID NO: 107292 - DNA, 43 bp, Homo sapiens; identical to SEQ ID NO: 43355
  chr12:7960433-7960476
  Hypo

SEQ ID NO: 107293 - DNA, 94 bp, Homo sapiens; identical to SEQ ID NO: 75202
  chr12:7963239-7963333
  Hypo

SEQ ID NO: 107294 - DNA, 80 bp, Homo sapiens; identical to SEQ ID NO: 75203
  chr12:7963796-7963876
  Hypo

SEQ ID NO: 107295 - DNA, 18 bp, Homo sapiens
  chr12:7973388-7973406
  Hypo
aattaaacaacagtccgg

SEQ ID NO: 107296 - DNA, 30 bp, Homo sapiens; identical to SEQ ID NO: 43358
  chr12:7980007-7980037
  Hypo

SEQ ID NO: 107297 - DNA, 85 bp, Homo sapiens; identical to SEQ ID NO: 75206
  chr12:7981128-7981213
  Hypo

SEQ ID NO: 107298 - DNA, 30 bp, Homo sapiens; identical to SEQ ID NO: 75207
  chr12:7984193-7984223
  Hypo

SEQ ID NO: 107299 - DNA, 30 bp, Homo sapiens; identical to SEQ ID NO: 43359
  chr12:7986413-7986443
  Hypo

SEQ ID NO: 107300 - DNA, 30 bp, Homo sapiens; identical to SEQ ID NO: 75210
  chr12:7998024-7998054
  Hypo

SEQ ID NO: 107301 - DNA, 38 bp, Homo sapiens; identical to SEQ ID NO: 75211
  chr12:8001679-8001717
  Hypo

SEQ ID NO: 107302 - DNA, 38 bp, Homo sapiens; identical to SEQ ID NO: 75212
  chr12:8009448-8009486
  Hypo

SEQ ID NO: 107303 - DNA, 275 bp, Homo sapiens; identical to SEQ ID NO: 75213
  chr12:8023505-8023780
  Hypo

SEQ ID NO: 107304 - DNA, 30 bp, Homo sapiens; identical to SEQ ID NO: 75215
  chr12:8050118-8050148
  Hypo

SEQ ID NO: 107305 - DNA, 30 bp, Homo sapiens; identical to SEQ ID NO: 75216
  chr12:8063011-8063041
  Hypo

SEQ ID NO: 107306 - DNA, 20 bp, Homo sapiens
  chr12:8074494-8074514
  Hypo
tctgtgtttctgggccgagt

SEQ ID NO: 107307 - DNA, 226 bp, Homo sapiens; identical to SEQ ID NO: 75218
  chr12:8088725-8088951
  Hyper

SEQ ID NO: 107308 - DNA, 96 bp, Homo sapiens; identical to SEQ ID NO: 43361
  chr12:8117682-8117778
  Hypo

SEQ ID NO: 107309 - DNA, 18 bp, Homo sapiens
  chr12:8122686-8122704
  Hypo
gcccgaactacaattctt

SEQ ID NO: 107310 - DNA, 375 bp, Homo sapiens; identical to SEQ ID NO: 75223
  chr12:8123153-8123528
  Hyper

SEQ ID NO: 107311 - DNA, 22 bp, Homo sapiens
  chr12:8127118-8127140
  Hypo
ccgtgcccggccaaggtcataa

SEQ ID NO: 107312 - DNA, 24 bp, Homo sapiens
  chr12:8148633-8148657
  Hypo
tataataaatgggctcggctgggt

SEQ ID NO: 107313 - DNA, 90 bp, Homo sapiens; identical to SEQ ID NO: 75231
  chr12:8165031-8165121
  Hypo

SEQ ID NO: 107314 - DNA, 145 bp, Homo sapiens; identical to SEQ ID NO: 75232
  chr12:8168130-8168275
  Hypo

SEQ ID NO: 107315 - DNA, 205 bp, Homo sapiens; identical to SEQ ID NO: 75233
  chr12:8170311-8170516
  Hypo

SEQ ID NO: 107316 - DNA, 592 bp, Homo sapiens; identical to SEQ ID NO: 34242
  chr12:8171294-8171886
  Hyper

SEQ ID NO: 107317 - DNA, 30 bp, Homo sapiens; identical to SEQ ID NO: 75236
  chr12:8214437-8214467
  Hypo

SEQ ID NO: 107318 - DNA, 30 bp, Homo sapiens; identical to SEQ ID NO: 75240
  chr12:8298283-8298313
  Hypo

SEQ ID NO: 107319 - DNA, 162 bp, Homo sapiens; identical to SEQ ID NO: 75241
  chr12:8322370-8322532
  Hypo

SEQ ID NO: 107320 - DNA, 125 bp, Homo sapiens; identical to SEQ ID NO: 75242
  chr12:8386013-8386138
  Hypo

SEQ ID NO: 107321 - DNA, 30 bp, Homo sapiens; identical to SEQ ID NO: 75243
  chr12:8388556-8388586
  Hypo

SEQ ID NO: 107322 - DNA, 81 bp, Homo sapiens; identical to SEQ ID NO: 75257
  chr12:8599745-8599826
  Hypo

SEQ ID NO: 107323 - DNA, 30 bp, Homo sapiens; identical to SEQ ID NO: 75258
  chr12:8702283-8702313
  Hypo

SEQ ID NO: 107324 - DNA, 143 bp, Homo sapiens; identical to SEQ ID NO: 75259
  chr12:8746970-8747113
  Hypo

SEQ ID NO: 107325 - DNA, 30 bp, Homo sapiens; identical to SEQ ID NO: 43368
  chr12:8748716-8748746
  Hypo

SEQ ID NO: 107326 - DNA, 175 bp, Homo sapiens; identical to SEQ ID NO: 75261
  chr12:8749845-8750020
  Hypo

SEQ ID NO: 107327 - DNA, 149 bp, Homo sapiens; identical to SEQ ID NO: 75262
  chr12:8751025-8751174
  Hypo

SEQ ID NO: 107328 - DNA, 30 bp, Homo sapiens; identical to SEQ ID NO: 75263
  chr12:8757665-8757695
  Hypo

SEQ ID NO: 107329 - DNA, 40 bp, Homo sapiens; identical to SEQ ID NO: 75264
  chr12:8757926-8757966
  Hypo

SEQ ID NO: 107330 - DNA, 198 bp, Homo sapiens; identical to SEQ ID NO: 43370
  chr12:8790007-8790205
  Hypo

SEQ ID NO: 107331 - DNA, 61 bp, Homo sapiens; identical to SEQ ID NO: 43371
  chr12:8799944-8800005
  Hypo

SEQ ID NO: 107332 - DNA, 81 bp, Homo sapiens; identical to SEQ ID NO: 15635
  chr12:8808559-8808640
  Hypo

SEQ ID NO: 107333 - DNA, 29 bp, Homo sapiens
  chr12:8835074-8835103
  Hypo
ttactgggaaatggccgggtgcggtggct

SEQ ID NO: 107334 - DNA, 214 bp, Homo sapiens; identical to SEQ ID NO: 75269
  chr12:8850501-8850715
  Hyper

SEQ ID NO: 107335 - DNA, 221 bp, Homo sapiens; identical to SEQ ID NO: 75270
  chr12:8851054-8851275
  Hyper

SEQ ID NO: 107336 - DNA, 25 bp, Homo sapiens
  chr12:8869424-8869449
  Hypo
caggctcaagcgatcttcccacctc

SEQ ID NO: 107337 - DNA, 24 bp, Homo sapiens
  chr12:8878090-8878114
  Hypo
ctcacctgacgtcaggatgctcta

SEQ ID NO: 107338 - DNA, 30 bp, Homo sapiens; identical to SEQ ID NO: 75276
  chr12:8905690-8905720
  Hypo

SEQ ID NO: 107339 - DNA, 80 bp, Homo sapiens; identical to SEQ ID NO: 43374
  chr12:8908240-8908320
  Hypo

SEQ ID NO: 107340 - DNA, 42 bp, Homo sapiens; identical to SEQ ID NO: 75278
  chr12:8926134-8926176
  Hypo

SEQ ID NO: 107341 - DNA, 190 bp, Homo sapiens; identical to SEQ ID NO: 75279
  chr12:8975180-8975370
  Hypo

SEQ ID NO: 107342 - DNA, 173 bp, Homo sapiens; identical to SEQ ID NO: 75281
  chr12:8982315-8982488
  Hypo

SEQ ID NO: 107343 - DNA, 103 bp, Homo sapiens; identical to SEQ ID NO: 43377
  chr12:8983831-8983934
  Hypo

SEQ ID NO: 107344 - DNA, 18 bp, Homo sapiens
  chr12:8989364-8989382
  Hypo
caccgcgcccagccaaga

SEQ ID NO: 107345 - DNA, 102 bp, Homo sapiens; identical to SEQ ID NO: 75285
  chr12:8995503-8995605
  Hypo

SEQ ID NO: 107346 - DNA, 198 bp, Homo sapiens; identical to SEQ ID NO: 75287
  chr12:9006823-9007021
  Hypo

SEQ ID NO: 107347 - DNA, 30 bp, Homo sapiens; identical to SEQ ID NO: 75288
  chr12:9008301-9008331
  Hypo

SEQ ID NO: 107348 - DNA, 149 bp, Homo sapiens; identical to SEQ ID NO: 75289
  chr12:9010027-9010176
  Hypo

SEQ ID NO: 107349 - DNA, 135 bp, Homo sapiens; identical to SEQ ID NO: 43379
  chr12:9016413-9016548
  Hypo

SEQ ID NO: 107350 - DNA, 30 bp, Homo sapiens; identical to SEQ ID NO: 75291
  chr12:9020600-9020630
  Hypo

SEQ ID NO: 107351 - DNA, 86 bp, Homo sapiens; identical to SEQ ID NO: 75293
  chr12:9026553-9026639
  Hypo

SEQ ID NO: 107352 - DNA, 20 bp, Homo sapiens
  chr12:9187316-9187336
  Hypo
acaggcgtgaggcaccgtgc

SEQ ID NO: 107353 - DNA, 152 bp, Homo sapiens; identical to SEQ ID NO: 75296
  chr12:9203194-9203346
  Hypo

SEQ ID NO: 107354 - DNA, 30 bp, Homo sapiens; identical to SEQ ID NO: 75297
  chr12:9251150-9251180
  Hypo

SEQ ID NO: 107355 - DNA, 34 bp, Homo sapiens; identical to SEQ ID NO: 75317
  chr12:9501895-9501929
  Hypo

SEQ ID NO: 107356 - DNA, 19 bp, Homo sapiens
  chr12:9916173-9916192
  Hypo
tttttttttttttttcgag

SEQ ID NO: 107357 - DNA, 30 bp, Homo sapiens; identical to SEQ ID NO: 75345
  chr12:9964565-9964595
  Hypo

SEQ ID NO: 107358 - DNA, 258 bp, Homo sapiens; identical to SEQ ID NO: 73608
  chr12:10029304-10029562
  Hypo

SEQ ID NO: 107359 - DNA, 29 bp, Homo sapiens
  chr12:10085916-10085945
  Hypo
gtaaaactggctgggcgcggtgtctgtca

SEQ ID NO: 107360 - DNA, 28 bp, Homo sapiens
  chr12:10086245-10086273
  Hypo
gcttttggtgcttcggtgcagagacaga

SEQ ID NO: 107361 - DNA, 100 bp, Homo sapiens; identical to SEQ ID NO: 73617
  chr12:10187643-10187743
  Hypo

SEQ ID NO: 107362 - DNA, 137 bp, Homo sapiens; identical to SEQ ID NO: 73619
  chr12:10243173-10243310
  Hypo

SEQ ID NO: 107363 - DNA, 48 bp, Homo sapiens; identical to SEQ ID NO: 73620
  chr12:10264235-10264283
  Hypo

SEQ ID NO: 107364 - DNA, 30 bp, Homo sapiens; identical to SEQ ID NO: 73621
  chr12:10264869-10264899
  Hypo

SEQ ID NO: 107365 - DNA, 30 bp, Homo sapiens; identical to SEQ ID NO: 73622
  chr12:10268125-10268155
  Hypo

SEQ ID NO: 107366 - DNA, 179 bp, Homo sapiens; identical to SEQ ID NO: 73623
  chr12:10306356-10306535
  Hyper

SEQ ID NO: 107367 - DNA, 41 bp, Homo sapiens; identical to SEQ ID NO: 43385
  chr12:10363278-10363319
  Hypo

SEQ ID NO: 107368 - DNA, 222 bp, Homo sapiens; identical to SEQ ID NO: 73639
  chr12:10364324-10364546
  Hypo

SEQ ID NO: 107369 - DNA, 30 bp, Homo sapiens; identical to SEQ ID NO: 73640
  chr12:10366550-10366580
  Hyper

SEQ ID NO: 107370 - DNA, 35 bp, Homo sapiens; identical to SEQ ID NO: 73684
  chr12:10658417-10658452
  Hypo

SEQ ID NO: 107371 - DNA, 218 bp, Homo sapiens; identical to SEQ ID NO: 73706
  chr12:10813764-10813982
  Hypo

SEQ ID NO: 107372 - DNA, 32 bp, Homo sapiens; identical to SEQ ID NO: 43387
  chr12:10823904-10823936
  Hypo

SEQ ID NO: 107373 - DNA, 17 bp, Homo sapiens
  chr12:10857716-10857733
  Hypo
ggagtctcactctgtcg

SEQ ID NO: 107374 - DNA, 174 bp, Homo sapiens; identical to SEQ ID NO: 73720
  chr12:10875104-10875278
  Hyper

SEQ ID NO: 107375 - DNA, 339 bp, Homo sapiens
  chr12:11653449-11653788
  Hyper
ggagctcagggccatcgtgctgaaccaacagaggctcgtccgcacccagcgccagagcatcgacgagctggagcggcggctgaacgagctgagcgcctagaatcgcagcctgtgggagcatccgcagctgccgcaagcgcagcctccgcccggattccttacctcgtagccgtccccgctgccggccctcctaggcaccgctgccgccgccaccgccggggcccaggaacatcttcaggaccacggacagcgctcatccgcccggccactgcccgcgcccgagctggcatcgtttcagaaccacgaacagctcctggcgcaacccgagccagaccctgg

SEQ ID NO: 107376 - DNA, 41 bp, Homo sapiens; identical to SEQ ID NO: 73905
  chr12:11745619-11745660
  Hypo

SEQ ID NO: 107377 - DNA, 30 bp, Homo sapiens; identical to SEQ ID NO: 74031
  chr12:12397276-12397306
  Hypo

SEQ ID NO: 107378 - DNA, 30 bp, Homo sapiens; identical to SEQ ID NO: 74036
  chr12:12419446-12419476
  Hyper

SEQ ID NO: 107379 - DNA, 45 bp, Homo sapiens; identical to SEQ ID NO: 74067
  chr12:12504479-12504524
  Hypo

SEQ ID NO: 107380 - DNA, 215 bp, Homo sapiens; identical to SEQ ID NO: 74112
  chr12:12848341-12848556
  Hypo

SEQ ID NO: 107381 - DNA, 224 bp, Homo sapiens; identical to SEQ ID NO: 74113
  chr12:12869188-12869412
  Hyper

SEQ ID NO: 107382 - DNA, 93 bp, Homo sapiens; identical to SEQ ID NO: 43389
  chr12:13025675-13025768
  Hypo

SEQ ID NO: 107383 - DNA, 187 bp, Homo sapiens; identical to SEQ ID NO: 43390
  chr12:13030748-13030935
  Hypo

SEQ ID NO: 107384 - DNA, 42 bp, Homo sapiens; identical to SEQ ID NO: 74140
  chr12:13035995-13036037
  Hypo

SEQ ID NO: 107385 - DNA, 30 bp, Homo sapiens; identical to SEQ ID NO: 74151
  chr12:13054219-13054249
  Hypo

SEQ ID NO: 107386 - DNA, 43 bp, Homo sapiens; identical to SEQ ID NO: 34247
  chr12:13069440-13069483
  Hyper

SEQ ID NO: 107387 - DNA, 388 bp, Homo sapiens; identical to SEQ ID NO: 74162
  chr12:13079623-13080011
  Hypo

SEQ ID NO: 107388 - DNA, 269 bp, Homo sapiens; identical to SEQ ID NO: 74212
  chr12:13154515-13154784
  Hyper

SEQ ID NO: 107389 - DNA, 24 bp, Homo sapiens
  chr12:13199095-13199119
  Hypo
ataccaccctgaacgcgcccgatc

SEQ ID NO: 107390 - DNA, 24 bp, Homo sapiens
  chr12:13199179-13199203
  Hypo
gttcacttgcgtttttccttgtct

SEQ ID NO: 107391 - DNA, 94 bp, Homo sapiens; identical to SEQ ID NO: 15639
  chr12:13215216-13215310
  Hypo

SEQ ID NO: 107392 - DNA, 30 bp, Homo sapiens; identical to SEQ ID NO: 43394
  chr12:13229039-13229069
  Hypo

SEQ ID NO: 107393 - DNA, 128 bp, Homo sapiens; identical to SEQ ID NO: 74383
  chr12:13431237-13431365
  Hyper

SEQ ID NO: 107394 - DNA, 32 bp, Homo sapiens; identical to SEQ ID NO: 74384
  chr12:13519032-13519064
  Hypo

SEQ ID NO: 107395 - DNA, 60 bp, Homo sapiens; identical to SEQ ID NO: 74385
  chr12:13716048-13716108
  Hypo

SEQ ID NO: 107396 - DNA, 114 bp, Homo sapiens; identical to SEQ ID NO: 74386
  chr12:13716358-13716472
  Hypo

SEQ ID NO: 107397 - DNA, 2142 bp, Homo sapiens; identical to SEQ ID NO: 74387
  chr12:14133113-14135255
  Hyper

SEQ ID NO: 107398 - DNA, 41 bp, Homo sapiens; identical to SEQ ID NO: 74388
  chr12:14720466-14720507
  Hyper

SEQ ID NO: 107399 - DNA, 36 bp, Homo sapiens; identical to SEQ ID NO: 43396
  chr12:14817857-14817893
  Hypo

SEQ ID NO: 107400 - DNA, 18 bp, Homo sapiens
  chr12:14905519-14905537
  Hypo
aaaaaaaaagctggccgg

SEQ ID NO: 107401 - DNA, 30 bp, Homo sapiens; identical to SEQ ID NO: 43398
  chr12:14926203-14926233
  Hypo

SEQ ID NO: 107402 - DNA, 1175 bp, Homo sapiens; identical to SEQ ID NO: 74392
  chr12:14927036-14928211
  Hyper

SEQ ID NO: 107403 - DNA, 172 bp, Homo sapiens; identical to SEQ ID NO: 74393
  chr12:14929885-14930057
  Hypo

SEQ ID NO: 107404 - DNA, 30 bp, Homo sapiens; identical to SEQ ID NO: 74394
  chr12:14930753-14930783
  Hypo

SEQ ID NO: 107405 - DNA, 107 bp, Homo sapiens; identical to SEQ ID NO: 74395
  chr12:15037662-15037769
  Hyper

SEQ ID NO: 107406 - DNA, 448 bp, Homo sapiens; identical to SEQ ID NO: 74396
  chr12:15374143-15374591
  Hyper

SEQ ID NO: 107407 - DNA, 73 bp, Homo sapiens; identical to SEQ ID NO: 74397
  chr12:15475263-15475336
  Hyper

SEQ ID NO: 107408 - DNA, 291 bp, Homo sapiens; identical to SEQ ID NO: 74398
  chr12:15475751-15476042
  Hyper

SEQ ID NO: 107409 - DNA, 103 bp, Homo sapiens; identical to SEQ ID NO: 74402
  chr12:16500483-16500586
  Hyper

SEQ ID NO: 107410 - DNA, 175 bp, Homo sapiens; identical to SEQ ID NO: 74405
  chr12:16757916-16758091
  Hyper

SEQ ID NO: 107411 - DNA, 30 bp, Homo sapiens; identical to SEQ ID NO: 34260
  chr12:16758398-16758428
  Hyper

SEQ ID NO: 107412 - DNA, 40 bp, Homo sapiens; identical to SEQ ID NO: 74407
  chr12:16758692-16758732
  Hyper

SEQ ID NO: 107413 - DNA, 82 bp, Homo sapiens; identical to SEQ ID NO: 43400
  chr12:17629461-17629543
  Hypo

SEQ ID NO: 107414 - DNA, 222 bp, Homo sapiens; identical to SEQ ID NO: 74417
  chr12:19283203-19283425
  Hyper

SEQ ID NO: 107415 - DNA, 109 bp, Homo sapiens; identical to SEQ ID NO: 74418
  chr12:19283674-19283783
  Hyper

SEQ ID NO: 107416 - DNA, 35 bp, Homo sapiens; identical to SEQ ID NO: 43401
  chr12:19636251-19636286
  Hypo

SEQ ID NO: 107417 - DNA, 97 bp, Homo sapiens; identical to SEQ ID NO: 74425
  chr12:19780563-19780660
  Hypo

SEQ ID NO: 107418 - DNA, 35 bp, Homo sapiens; identical to SEQ ID NO: 74430
  chr12:20198455-20198490
  Hypo

SEQ ID NO: 107419 - DNA, 697 bp, Homo sapiens; identical to SEQ ID NO: 74438
  chr12:20521144-20521841
  Hyper

SEQ ID NO: 107420 - DNA, 664 bp, Homo sapiens
  chr12:20522108-20522772
  Hyper
ggaagagcgtgcgtgcgtgtgtgtgtgtgtgtgtgtgcgcgcgcgcgcgtgggtcggggcgggggcgtcggggggccactgggaattcagtgaagagggcaccctataccatggcagtgcccggcgacgctgcacgagtcagggacaagcccgtccacagtggggtgagtcaagcccccacggcgggccgggactgccaccatcgtgcggaccccgcatcgccgcgggactcgggctgccgtggctgctggggagacctggtgctgcagccgctccggagctctcggaaactttcctccgcgctgtgcgcgggctccctgtcctttctgctggcgctgctggtgaggctggtccgcggggaggtcggctgtgacctggagcagtgtaaggaggcggcggcggcggaggaggaggaagcagccccgggagcagaagggggcgtcttcccggggcctcggggaggtgctcccgggggcggtgcgcggctcagcccctggctgcagccctcggcgctgctcttcagtctcctgtgtgccttcttctggatgggcttgtacctcctgcgcgccggggtgcgcctgcctctggctgtcgcgctgctggccgcctgctgcgggggggaagcgctcgtccagattgggctgggcgtcggggaggatcactt

SEQ ID NO: 107421 - DNA, 44 bp, Homo sapiens; identical to SEQ ID NO: 74441
  chr12:20523073-20523117
  Hyper

SEQ ID NO: 107422 - DNA, 19 bp, Homo sapiens
  chr12:20685629-20685648
  Hypo
tttttttttttgagacgga

SEQ ID NO: 107423 - DNA, 656 bp, Homo sapiens; identical to SEQ ID NO: 74448
  chr12:21680364-21681020
  Hyper

SEQ ID NO: 107424 - DNA, 501 bp, Homo sapiens; identical to SEQ ID NO: 74449
  chr12:21810473-21810974
  Hyper

SEQ ID NO: 107425 - DNA, 27 bp, Homo sapiens
  chr12:21833068-21833095
  Hypo
aattcaagtttgggccgaagtttaaag

SEQ ID NO: 107426 - DNA, 30 bp, Homo sapiens; identical to SEQ ID NO: 74451
  chr12:21860015-21860045
  Hypo

SEQ ID NO: 107427 - DNA, 778 bp, Homo sapiens
  chr12:21927174-21927952
  Hyper
gaattattttaaatgcgaaagaagtatgagttgcatctaaaaagagttaaaaaggttcctgtggaaatcataatattataaattgaaaacttttttttttttttttttttacaacgaaggaatcaaatatacaaggtgcgggggggaaaaaacccaagacaacagcctgcgggttgcagtagggagtgtgccccgaaaagtccatccatcactgcaagcctctgcggtgttttgcattttaaatcatttacgggaacacggacagcctcccccctccgctcccccggagcagctttgaaacttacagactccgggtagcgggcgcggcggctggacctccttgcacacgccggcgggccgcgggcaggtccctcgctctcccatgctggcgcgcgggaccaggggccgcccaggccggagggacaaattgggggctgcgtgtcctaaggagaagagttaaaataataaaaggtgcaactgaatctaaacgcagggagggctagaggaagggggatgggtgtagatcttcccctccccctgctcagctcaactcccttggccacttcagtggaaggaggagggactgggggggcgggggcgggggggcgatgctccacaaatcagcctcccagttagggctttgacgcacgccagacctcggaagccgacgttgtcgcggagtagggggcgggcggggagggggcgagcgcaagtccccgggaggtagggagcaggccagagggagggacgacccgggggagggcgggacctgcagagc

SEQ ID NO: 107428 - DNA, 34 bp, Homo sapiens; identical to SEQ ID NO: 34269
  chr12:21928417-21928451
  Hyper

SEQ ID NO: 107429 - DNA, 1532 bp, Homo sapiens
  chr12:22093664-22095196
  Hyper
gcttcaaacccctgccggtgcacttgagctaccttcaaaacaccgacttcctacactgtcttaagatgtaaatttcaaacccggacgcagaactcctaaaaaaaagtaaagagtaacaaaaattaagcagatagaaaactacttcttgaacatacaagaattgtctacaagaaaggcggtaataataactcctaataataataactcctttcactgtttccagttgatttgagtaggagacggcagttttgaagtaaaactggaaacctgatccccaccccttcacttctcgagccgggcctcgtcccttaattctagaaatagcgatcgcgaaagctaagtgccgagaagtgcgagagagtgcgagggcgtttttggatagcagaaatgttagctcaaaatcgacaacttacagttattcctaaaaatgtttaaatggcattcatgtaaaagacacggattcacttactccgatgacagttttcctcccctaggcgaagcacgcagtgcgccggaacggattatttttagggtggtgggagaccagctgctgcctcctatcgagtttctaaattgcacagactgctctgggccggggcagacaccgcggctgagaagcaggaaactgggcagaagccccgcgcgccgcgcctggggccggagaccttccccatccctgctctgctcagctttgacttggggcgggcgcgacgccgcgattttacaaacccaagtaataggcgtccccttaaacttcattagacactgaaacttggaatatgattccatgattctccggagtcgggttttcaaacgtcaaaacactcaaggtattcttgtttctttgttttgtttttccatgctctgtaagcacccctttattagccacgtaaggaagcggatttggggatttcgctgtttccccctgaacggatccgggaaatgaagggctcattctaggtagaggcacccactgctgggttatgagtgcacgaatgtctcacaggagcaaggctggctcaagtctaattttccgcttttccccggcgacctagaaaacttggtttctctggtggaccagccgccgcgctatcgaagggcgacccttgcccaccgtcccctaaagtgagacgctgattcccatggactgcgtaaacagtcaccctcttctcctgtttccaaccagagacataattaactctcgagataacgtgtttatattaagatcaccccacaaccactcccccgcgaaacacaagccgtgaattttgtccccgacaaccctctttaattaacaccggattttctcaagagccagttttgagtcagcttgagataagcattgttttcaggaactgtcgtattttaataaaggatggtcagccgggcggacttctgcccctgaggctccgcatgccgtcctcaaggggcgccgctgcaggactgcggtctgctggcgctggtccccagatctgaaccctaaacaccggtggcctcgtggcctgtgcgatgcaggccgactccagccctgc

SEQ ID NO: 107430 - DNA, 1463 bp, Homo sapiens
  chr12:22486799-22488262
  Hyper
aaggacatggaagagcggatgaaagggatgcctctgcgagacggtgcaaggcggtcctcgccggtgaccctgtcctctgcactcggggaggaaaggacgctagaggggaggagccgcgagggcaggagtacctgaacgctctggccgcggtctggttcctcctccacgccgtgccctgttgcagcaccccctgcacgatctctttctcgttgggcagccggtagacggggaagatgtagagccaacagaggaccacgacacagagggcactggctcccatgggcagccgggtccgcgggaacttccacgccagtacagccatggcccctctggacgtttgtcgccgggcccgcccgcaggggctcatcgcagccccggcgtcccaggggcgggggccggggcctcagcacaaagctaggcgaagtggcagcggagggtcccccaccgccagccccccatgcacacacacctttggttctcttacttgcaaacgcacgcacgcttcttcggccccgtcggccccaaaggtcagcgcaaggattttttcaaatgcaacttttccaaggatttctttctaggggaagtggctgggggtgaagtcacgatctatggccatggtcgcttcccctgcagaaggcgggcgctggggtctccgagtgcgcagagagcggcggcggcgagtcgctcccgccggttctgcagcatcacggtcgccctcggcgagggtccgggagaaggctcggctccctcctaaacatgtggcccgtggcgtccccttgtcccctccgagcgatgctcctgcgcccttcgccgcctcccgcgctgctgcgccgccaggcaacccccccccccccaccccgccccgagacgcgctctctgcgccgcaccaagtccttggaaatttccacggcggcccgggaccgctatcctgccccgggctcctccgcctcgcccgccgggaccctcgctccccacccctcccggagaagaaaagaactcgctctcatcagttaattcagcggcgcgccgcagccttccgctgcgccccggacttcgcagacaaacgcccggggattggtggaaatcaaggtctccccctccctcccccacccgcaaaattgcctccttcgacccgatccgagccgcgacactcgcccagagcgcgcacccctcactcgtgcccttgttctttggagataacggcagacaataaaaaccaacagccccccgccaatagaaatatatcagtccctgagtgtggcggagactggctaatatcctgatccttcgacaagcggccggtgtgcccaggctgtcaccctgctgccgtcaccctagtctttctctagctggttggatattaacccgcagccaggcgcgaggaggctggcggagatttattccttcctgggcccccacccccattagccggtcccggagccgcggcccgtgtgtgtgcgcgc

SEQ ID NO: 107431 - DNA, 383 bp, Homo sapiens
  chr12:22488322-22488705
  Hyper
gcaagcgagcgcgcgcacgaggaggtgcgtgcactccggggtcctccgcctcgcctcctccctgaaaggaagtgctgcatccagatgtgcaggcagctggtgcccaaacactagacctcaagatgtcacattgccttggaggcgcgcggccttttagattaaaggaccgttggttcttagacgtccttcttgcccttcttgcttgtgataagcgataagcttatcgcaaccccgaccttggaaaagcaccacccgccttgacccaccgagccgagagagtcgctgttagccatttctgctcgccccggcggccgacgcatagctcgggtacctcctagcggtcgcctattctatttgcttaagcatctcgtcaagcataaagt

SEQ ID NO: 107432 - DNA, 215 bp, Homo sapiens; identical to SEQ ID NO: 74464
  chr12:22634363-22634578
  Hypo

SEQ ID NO: 107433 - DNA, 95 bp, Homo sapiens; identical to SEQ ID NO: 74465
  chr12:22698101-22698196
  Hypo

SEQ ID NO: 107434 - DNA, 134 bp, Homo sapiens; identical to SEQ ID NO: 74466
  chr12:22852676-22852810
  Hypo

SEQ ID NO: 107435 - DNA, 27 bp, Homo sapiens
  chr12:22987972-22987999
  Hypo
agccaccgcgcccggcctcatttttta

SEQ ID NO: 107436 - DNA, 17 bp, Homo sapiens
  chr12:24596179-24596196
  Hypo
cccggccagtttatgga

SEQ ID NO: 107437 - DNA, 196 bp, Homo sapiens; identical to SEQ ID NO: 74472
  chr12:24632145-24632341
  Hypo

SEQ ID NO: 107438 - DNA, 1030 bp, Homo sapiens; identical to SEQ ID NO: 74473
  chr12:24714475-24715505
  Hyper

SEQ ID NO: 107439 - DNA, 660 bp, Homo sapiens
  chr12:24715757-24716417
  Hyper
ctccttcttgcagctcgccgcccggccgccctctctatccatccgaagggaaggagccccagagttttcttccccgtctgctgcagagtaactagattgtaaataacgcggcgattacccacaccgtgcaggaattttttttttatctgccctccacttaaaggagcgataaaaatgaaatggcaggagtggaaggagccagggagagcgggatatctctagatctcgatggagctcgcatctataaatacgcattcatgtttagtcaagtccctttgtcaacttcttcccggcgcctgagcctcagccgctgctctgcgcccaggacctggcccctcccggccccctagtccagtggtcaggcggtcgggccggcagggagggcgcgcgcggggggctgcggggtccgtggaacctttccgggaggcgagccgcgggctgctgggcgcggaggctggagccgcgagaggttcggctgctgaagcggccactgcctcccagagccaggctccgcgccgcgcgtccccgccgccgccggcactgtgcacccacctactcctcggagattggggtaggggaaaaaagttttgaggcgctctcatctctgcctccggggtggttgaactggtttggttttgtgttaagcgaagccaaaaaaaa

SEQ ID NO: 107440 - DNA, 1071 bp, Homo sapiens
  chr12:25055472-25056543
  Hyper
ggaggcagaaggctgcggtcaaaatattttggggtggcagagtcacgtaggatgtggctgtgggttctggcagcccagagattcagctcccgcctcctccctcagagcgagtccatagctaccctcacgtcccccgtggcggtcctcgccacgctccggagcgggttacccatgagggtgctagacctgggcagcgggaacctcgaagaggtggagattgcaggctgggactccagatttcgggcagggatgcggggaagggaagacgcctcgctggaggcggaatggagggcaaggcgaaggaggatggtgcaggaaacggcgacaaggcgcccggccaggcccgcgagctaccgagacccgggttccaatcctccccccttccgcaaacgcccgggttcgaggtacctggcgggcaagggccgcagcggagcgaagcgggctggccatggggaggctgcggggacgcggggctgcagagagcggcagtggcacggagcgcgcggctggaagcgaaagcaggcggtgtggccaagccccggcgcacggcccatagggcgctgggtaccacgacctggggccgcgcgccagggccaggcgcagggtacgacgcaacccctccagcatcccttggggaggagcctccaaccgtctcgtcccagtctgtctgcagtcgctaaaaccgaagcggttgtccctgtcaccggggtcgcttgcggaggcccgagaatgcgcgccacgaacgagcgcctttccaagcgcagatatttcgcgagcatccttgtttattaaacaacctctaggtgaatggccgggaagcgcccctcggtcaaggctaaggaaacctcggagaaactacattagggcagcttttccaccgactccaaatccaactgacaaaaagcagtttctgccctcgagagtttgcgggcggggattgacatttgtgcgtctgctcttgtctgccactgaccgctatgtgcaaactgaagggggagaacgtgaatccagcttttagatttccctgcgccacctacccaaaccgaatttgtaactcggggtgttatgggg

SEQ ID NO: 107441 - DNA, 187 bp, Homo sapiens; identical to SEQ ID NO: 43404
  chr12:25059405-25059592
  Hypo

SEQ ID NO: 107442 - DNA, 97 bp, Homo sapiens; identical to SEQ ID NO: 74480
  chr12:25081512-25081609
  Hypo

SEQ ID NO: 107443 - DNA, 913 bp, Homo sapiens
  chr12:25101375-25102288
  Hyper
taacagtgaaaagatcgttctccctcccctctccacccgggtcaactcttccagccgctccctcctgcatcacgaacacacgctgcaggaaagcgcatttacagcccgggacatccccagacctcctctccaaaattccccacctcctgtgcataggagaaactgagagaagccctcacttcctttccaaacttcacaagcaggggagggagctgtagcagactttcacctccgttcccaaaagcgaatgtgaaaaagtccgagaaggcacgtcctgcgagtggaggttaaaccgaaatctgaacagaatgcacggtccccgcaaactacgattgataaagaagatactgagacgtttgcgggggatataagccatggttgtctcgccttcctcccctccctgccaactatgtttcttggagaaatcgccggttcgattcacgcacacatttttgtaaaacacggacaaaaccataagtagttaccttcattgttccgtcggccacgagggaagctcgagctgagcggagggcagatcccaagggtcgtagcccctggccgtgtggaccgggtctgcggctgcagagcgcggtcccggctgcagcaagacctggggcagtgcccgaggcggcggcgagtacacgtggcgggctggattgcagaccggccctctcgcggcggagactcgcgacctagcggattgcatcagcaggaagacactaaggctgctcccccaggccgcccccagatggtggagtctctcccagcccgaagattcggagccagcgcccagacccgagcctcactcactgctcactcccggggtgcagggcagaggtgccagtgttgcaagcaaatgacacggttacccccgaatcagccactgtgggtgcgtatccgagtgtggggatgc

SEQ ID NO: 107444 - DNA, 30 bp, Homo sapiens; identical to SEQ ID NO: 74483
  chr12:25154975-25155005
  Hypo

SEQ ID NO: 107445 - DNA, 25 bp, Homo sapiens
  chr12:25191255-25191280
  Hypo
caaaattgcaaatgacgaactataa

SEQ ID NO: 107446 - DNA, 30 bp, Homo sapiens; identical to SEQ ID NO: 43407
  chr12:25195744-25195774
  Hypo

SEQ ID NO: 107447 - DNA, 120 bp, Homo sapiens; identical to SEQ ID NO: 74486
  chr12:25202526-25202646
  Hypo

SEQ ID NO: 107448 - DNA, 214 bp, Homo sapiens; identical to SEQ ID NO: 74487
  chr12:25256767-25256981
  Hypo

SEQ ID NO: 107449 - DNA, 32 bp, Homo sapiens; identical to SEQ ID NO: 74488
  chr12:25262917-25262949
  Hypo

SEQ ID NO: 107450 - DNA, 23 bp, Homo sapiens
  chr12:25273331-25273354
  Hypo
ggaagcaagccaccacgaggtta

SEQ ID NO: 107451 - DNA, 40 bp, Homo sapiens; identical to SEQ ID NO: 74490
  chr12:25537400-25537440
  Hypo

SEQ ID NO: 107452 - DNA, 193 bp, Homo sapiens; identical to SEQ ID NO: 74493
  chr12:25922413-25922606
  Hypo

SEQ ID NO: 107453 - DNA, 130 bp, Homo sapiens; identical to SEQ ID NO: 74494
  chr12:25956132-25956262
  Hypo

SEQ ID NO: 107454 - DNA, 30 bp, Homo sapiens; identical to SEQ ID NO: 74495
  chr12:26168478-26168508
  Hypo

SEQ ID NO: 107455 - DNA, 141 bp, Homo sapiens; identical to SEQ ID NO: 74496
  chr12:26348161-26348302
  Hyper

SEQ ID NO: 107456 - DNA, 168 bp, Homo sapiens; identical to SEQ ID NO: 74497
  chr12:26555243-26555411
  Hypo

SEQ ID NO: 107457 - DNA, 37 bp, Homo sapiens; identical to SEQ ID NO: 43411
  chr12:26555819-26555856
  Hypo

SEQ ID NO: 107458 - DNA, 30 bp, Homo sapiens; identical to SEQ ID NO: 74499
  chr12:26844976-26845006
  Hypo

SEQ ID NO: 107459 - DNA, 18 bp, Homo sapiens
  chr12:27072768-27072786
  Hypo
ctggaatttaggggccgg

SEQ ID NO: 107460 - DNA, 232 bp, Homo sapiens; identical to SEQ ID NO: 74501
  chr12:27426203-27426435
  Hypo

SEQ ID NO: 107461 - DNA, 153 bp, Homo sapiens; identical to SEQ ID NO: 43412
  chr12:27489449-27489602
  Hypo

SEQ ID NO: 107462 - DNA, 358 bp, Homo sapiens; identical to SEQ ID NO: 74508
  chr12:28122168-28122526
  Hyper

SEQ ID NO: 107463 - DNA, 140 bp, Homo sapiens; identical to SEQ ID NO: 74509
  chr12:28123065-28123205
  Hyper

SEQ ID NO: 107464 - DNA, 238 bp, Homo sapiens; identical to SEQ ID NO: 74510
  chr12:28123548-28123786
  Hyper

SEQ ID NO: 107465 - DNA, 1436 bp, Homo sapiens; identical to SEQ ID NO: 74511
  chr12:28127648-28129084
  Hyper

SEQ ID NO: 107466 - DNA, 43 bp, Homo sapiens; identical to SEQ ID NO: 74515
  chr12:29123308-29123351
  Hypo

SEQ ID NO: 107467 - DNA, 30 bp, Homo sapiens; identical to SEQ ID NO: 74517
  chr12:29268148-29268178
  Hypo

SEQ ID NO: 107468 - DNA, 33 bp, Homo sapiens; identical to SEQ ID NO: 74518
  chr12:29298795-29298828
  Hypo

SEQ ID NO: 107469 - DNA, 32 bp, Homo sapiens; identical to SEQ ID NO: 74519
  chr12:29302656-29302688
  Hyper

SEQ ID NO: 107470 - DNA, 120 bp, Homo sapiens; identical to SEQ ID NO: 74520
  chr12:29373965-29374085
  Hypo

SEQ ID NO: 107471 - DNA, 819 bp, Homo sapiens
  chr12:29935857-29936676
  Hyper
cctctcctgaacccacgcagccctgtcagctcaaggctcccgcctcgtctcatctgaacgaaacccttaaggggctgatacacttctcatctgcaaagctgcccaacagcctccgagaaattctctacttggaagcatcgccaccaccgccacccctccggaaccctctgggtccgcgctagtcccacttggtcacgatccggcaggcgaaggggtgcggaggcggtttcaccagcccgctcccagccctgcctcgagagagaagcccgctgagagggcagacagttgagaaactcgatcccaactccccagccggcgcctcccgaaccgccccgagagcccagattagccgggcagtggatcccggagcaaagtgccatgcacatcctggagaggagggaggcgtggagggaaagggcggcaaaaatgaaatgcccccaagtcagtcccgcaacttctcccggtccgagggacgggcggagggtagaggaggcagcggcggctagcgcgaggtgagggactcacttgaaggtgaggacgcagagcggccggtaggacttgtggctggtgttctcggccatgcccttgccccagaagtcgttggtgaagatgccccagcggagcggggcgccgggccgcacgtcggggttgttcacgatcgcccacacgtcgtcgtgcacgaactcgccctgcagggagcggccgtagcacaggcagcttgccccggccagcagcgccgcggccccggccggcgctagcccgcagccccgccgccgggagggtgtgcggtccccgccgccgcctcgggcagaggtggtc

SEQ ID NO: 107472 - DNA, 662 bp, Homo sapiens
  chr12:29936880-29937542
  Hyper
tccccccgcctcccccggccatcgccacctcctccgccccactgcgcatgcccgctcgctctctcttccaccgccccccaatcccgggacgcgggccggttcccccgcacagcccggcgccctctgcccccggcccgccttgcttgcaggtggaccggggttcgcggcgcgcggctgcccgggagctgcggggaaggacaccccaggttcccacttgcggtgtccggctgtgctcacccccacgcccccgcccccatccttctcccccgaatggggctgggaaggggcacatctggcggacccctcccgggggacccaggagggtttagcaggtgcgcagtctggaacccccacacccaccttccagggagaaaagtgccgctgcttcccgggaagttcccggcttttcagcacccgggacaacagcagcggcgcccggagagacgctctccacccgccccgcgctcgcgtccagtcgccggctctgtgctctcctgcccgggctttctctcacccgcccggcgcggcgtcccgcttggcggaggaacccgcggggatagggagcaccttcctcaaagccaggagaaggggtctccctggacaaggacatcctgctcgccctgcccgggtgtgttcagaggcgccaccggctctttaacttt

SEQ ID NO: 107473 - DNA, 30 bp, Homo sapiens; identical to SEQ ID NO: 74533
  chr12:30260329-30260359
  Hypo

SEQ ID NO: 107474 - DNA, 809 bp, Homo sapiens
  chr12:30322750-30323559
  Hyper
agtcccacaactccgcgacacgtcccagccaaggcgcggcggggagccttggacaggagtgcacttgaaggtgagggtgcagagtggccggtgggacttgtggctggtgttctcggccatgccctggccccagaagtcgttggtgaagatgccccagcagagcgaggcgctgggccgcacgtcggggttgttcacggtcgcccacgaactcgccctgcagggaacggccttagcacaggcagctcgcgcctgccagcagcgccgcggccccggctatcaacacctcctcctccccactgcgaatgccccgatcgtgctccccaaaacccaatacatccacgcccccaaaaaactgggaacccacgcgggtgccttctgtttaccgcagcgctctcactgcaggcgcttgagtaccagatggcgagagttcgcgcgcaggtggagtggggatcctggcgctaggctacccaggagaggaggggaagggcaacccgcggtcccgcctgtggtgcccggctgtgctcatccccacgccccagaccccaaaaggggctggggaggggcacatctggcggacccctcgcgggggaccaagcgggtttagcaggtgcgccgcctggaacccctacgcccaccttccagggagaaaagtgcctctgcttctcgggaagttcccggcttttcagcacccgggacaacagcagcggcacctggggagaggctctccaccccgccccgcgctcgcttccagtcgccagcttcgtgatcttctgcccggactttctctcacccgccgggcgctgcgtcct

SEQ ID NO: 107475 - DNA, 112 bp, Homo sapiens; identical to SEQ ID NO: 74537
  chr12:30354005-30354117
  Hyper

SEQ ID NO: 107476 - DNA, 20 bp, Homo sapiens
  chr12:30859424-30859444
  Hypo
acaagcgtaagccactgtac

SEQ ID NO: 107477 - DNA, 41 bp, Homo sapiens; identical to SEQ ID NO: 43415
  chr12:30947564-30947605
  Hypo

SEQ ID NO: 107478 - DNA, 45 bp, Homo sapiens; identical to SEQ ID NO: 74540
  chr12:30948625-30948670
  Hyper

SEQ ID NO: 107479 - DNA, 20 bp, Homo sapiens
  chr12:30959879-30959899
  Hypo
caccgcgcccagcccagaat

SEQ ID NO: 107480 - DNA, 629 bp, Homo sapiens
  chr12:30975310-30975939
  Hyper
cacaaaacaaaagagcgctccacagaagctcagcacatcttcatttggtgggcgctggtgccctttccctgtgggcggcgccagctcctttctcggctgcctgcccagctgctgggctggagctccgcgtgctgggtgtaggtcaagtgatcccgtcgcgggcgggcggaggtggccgggcagccgccgctgtgcccgggtctggggtgagctgcactgctgccctgggccccggctcccacgcctgtttcccggagctccgcggctccggctgcttcgccctccctctgtgggctgggctggggtcctcgcgagaagtcctgccccgctcccttctccaaatccacaggccctgtttctctggagacagggaggctcatacaggatatgtgcaaatgcttttattacaagctgagttgaaagacacccgtttgctctcgggtccttttggtgagcgccgcaggaagccgggctcctctctccccagaggcggccgcaggttcgcggcgcagggcctgcagtgccaggagcaggcaggggcctctgccctccccttcgtccctgatctcccgcctcctcctcacccgccgtctctgcgaactcaccctgggctgcggcctttcttccct

SEQ ID NO: 107481 - DNA, 680 bp, Homo sapiens
  chr12:31079258-31079938
  Hyper
gcagggagacctaagcggggagctgcggagcgcggggagtttgaaagccgctccaccgccctactagtccgtccttttgccccgccccccttagggatccccccggcaaccgcacagctgcctcggactctgacttaattccctccgcgtgctctgaatcgcagagaggcaaacccccaaacaaagagccggcagctcgcgtgcggggctcccgggcgcgtcctgccggctgggctgggagagccggcgccggggcgtcgcggccgagcgctgggcaggcggggactagagggccggcaggaagcctcagtgggcgcaggggcgcgggccgggctgcccacacgctgaccttcccgggctgggagggaggagcgctggctgcgggcggtgggcggctgggcggccccgggagccgccgctctcagtctctctaggcgcagctcccttcgccgcttccggagcccctggcagggtaagtgcagaagcgcgcccgaggagtgggggcgccgcgggagggggctgggggtccaggagaggcgcctccacctccgctgcccgccccgccggcagtcccgagctagactgtcccgagcttcccccgggcgggcagagggaagccggctggggatgaggagtggaggaggcaggaatgcctgggacactcgcggggcatgtgagca

SEQ ID NO: 107482 - DNA, 30 bp, Homo sapiens; identical to SEQ ID NO: 74547
  chr12:31134289-31134319
  Hypo

SEQ ID NO: 107483 - DNA, 101 bp, Homo sapiens; identical to SEQ ID NO: 74548
  chr12:31230802-31230903
  Hypo

SEQ ID NO: 107484 - DNA, 174 bp, Homo sapiens; identical to SEQ ID NO: 74549
  chr12:31255181-31255355
  Hypo

SEQ ID NO: 107485 - DNA, 30 bp, Homo sapiens; identical to SEQ ID NO: 74550
  chr12:31744505-31744535
  Hyper

SEQ ID NO: 107486 - DNA, 22 bp, Homo sapiens
  chr12:32086687-32086709
  Hypo
ttttattttgaaattcggggac

SEQ ID NO: 107487 - DNA, 180 bp, Homo sapiens; identical to SEQ ID NO: 74553
  chr12:32087009-32087189
  Hypo

SEQ ID NO: 107488 - DNA, 77 bp, Homo sapiens; identical to SEQ ID NO: 74554
  chr12:32188978-32189055
  Hypo

SEQ ID NO: 107489 - DNA, 30 bp, Homo sapiens; identical to SEQ ID NO: 74555
  chr12:32251556-32251586
  Hypo

SEQ ID NO: 107490 - DNA, 27 bp, Homo sapiens
  chr12:32340317-32340344
  Hypo
aatctatgggctgggcgcggtggctca

SEQ ID NO: 107491 - DNA, 151 bp, Homo sapiens; identical to SEQ ID NO: 15647
  chr12:32597645-32597796
  Hypo

SEQ ID NO: 107492 - DNA, 40 bp, Homo sapiens; identical to SEQ ID NO: 43420
  chr12:32831140-32831180
  Hypo

SEQ ID NO: 107493 - DNA, 240 bp, Homo sapiens; identical to SEQ ID NO: 43421
  chr12:32831300-32831540
  Hypo

SEQ ID NO: 107494 - DNA, 30 bp, Homo sapiens; identical to SEQ ID NO: 74561
  chr12:33047302-33047332
  Hypo

SEQ ID NO: 107495 - DNA, 55 bp, Homo sapiens; identical to SEQ ID NO: 74562
  chr12:33048730-33048785
  Hyper

SEQ ID NO: 107496 - DNA, 64 bp, Homo sapiens; identical to SEQ ID NO: 34302
  chr12:33049326-33049390
  Hyper

SEQ ID NO: 107497 - DNA, 244 bp, Homo sapiens; identical to SEQ ID NO: 74564
  chr12:33050001-33050245
  Hyper

SEQ ID NO: 107498 - DNA, 30 bp, Homo sapiens; identical to SEQ ID NO: 74565
  chr12:33139125-33139155
  Hypo

SEQ ID NO: 107499 - DNA, 345 bp, Homo sapiens; identical to SEQ ID NO: 74566
  chr12:33205376-33205721
  Hypo

SEQ ID NO: 107500 - DNA, 30 bp, Homo sapiens; identical to SEQ ID NO: 74567
  chr12:33205934-33205964
  Hypo

SEQ ID NO: 107501 - DNA, 344 bp, Homo sapiens
  chr12:33591748-33592092
  Hyper
aaattgtcaggtgcccgacaggttgcagccgcgggttacctcggaggccaaggcagccacctctgcaagggagttctgcgtccaagcatggcttgtccgtcccgcctggcccccatcaacaaggccgggaccagcggccggtggaacgagcgagagcagccctagtcccacaggtgagccgcccccacaagcagccaagccgcgagccgtcccggcgccgtcaccgcccgcactcacttctccactccgggagggagatgggaggcgtgggagaacgcggagaggcgcggcgaggctgggagcgggagacggcgccgggaggcgggaagcggaccagagaatgg

SEQ ID NO: 107502 - DNA, 554 bp, Homo sapiens
  chr12:33592578-33593132
  Hyper
tgcgccgctgagagccggcaactcttaggagccccacgttggccccatggcgggagcggagggcgtaggggaaggagaggcgcgcgaggaggctgcggctgccgcgaggtttgcgccaactctcccgccgcgcgagcgagccgaggcgcgctggaactagagacccggcatggagtgctgaggggaggggggagccgtaaaaaagccaaagcaagccctcgactcgcaagcacgcccccctcctctccccagcgcactggtgtttctggcgggtgcctggcggcgacgcgtccaatcgcagcccggcgcgggcgctaggtgacaggcggcggagcgcgcagacccggctccccgcgtcctctgaagaagggactcgcgagggagggagggagggagggcgggcggcccggcgcccctgccgaggccggggatgctcatcgttgcccagagttggcccgaggagccctctccgttttcccaatacttttccctgcatcagtgcagccatccccgccgcctttgtctctccaacttttccacggatgtattctact

SEQ ID NO: 107503 - DNA, 30 bp, Homo sapiens; identical to SEQ ID NO: 74578
  chr12:34261260-34261290
  Hyper

SEQ ID NO: 107504 - DNA, 30 bp, Homo sapiens; identical to SEQ ID NO: 74579
  chr12:34358492-34358522
  Hypo

SEQ ID NO: 107505 - DNA, 43 bp, Homo sapiens; identical to SEQ ID NO: 43423
  chr12:34362659-34362702
  Hypo

SEQ ID NO: 107506 - DNA, 105 bp, Homo sapiens; identical to SEQ ID NO: 74581
  chr12:34364426-34364531
  Hypo

SEQ ID NO: 107507 - DNA, 30 bp, Homo sapiens; identical to SEQ ID NO: 74582
  chr12:34463923-34463953
  Hypo

SEQ ID NO: 107508 - DNA, 90 bp, Homo sapiens; identical to SEQ ID NO: 74583
  chr12:34464013-34464103
  Hypo

SEQ ID NO: 107509 - DNA, 58 bp, Homo sapiens; identical to SEQ ID NO: 74584
  chr12:34471693-34471751
  Hypo

SEQ ID NO: 107510 - DNA, 30 bp, Homo sapiens; identical to SEQ ID NO: 74585
  chr12:34472580-34472610
  Hypo

SEQ ID NO: 107511 - DNA, 115 bp, Homo sapiens; identical to SEQ ID NO: 74586
  chr12:34474495-34474610
  Hypo

SEQ ID NO: 107512 - DNA, 36 bp, Homo sapiens; identical to SEQ ID NO: 74587
  chr12:34478137-34478173
  Hypo

SEQ ID NO: 107513 - DNA, 81 bp, Homo sapiens; identical to SEQ ID NO: 43427
  chr12:34494888-34494969
  Hypo

SEQ ID NO: 107514 - DNA, 30 bp, Homo sapiens; identical to SEQ ID NO: 74589
  chr12:34501815-34501845
  Hypo

SEQ ID NO: 107515 - DNA, 268 bp, Homo sapiens; identical to SEQ ID NO: 43428
  chr12:34502619-34502887
  Hypo

SEQ ID NO: 107516 - DNA, 136 bp, Homo sapiens; identical to SEQ ID NO: 74591
  chr12:34519267-34519403
  Hypo

SEQ ID NO: 107517 - DNA, 113 bp, Homo sapiens; identical to SEQ ID NO: 43430
  chr12:34520137-34520250
  Hypo

SEQ ID NO: 107518 - DNA, 65 bp, Homo sapiens; identical to SEQ ID NO: 74593
  chr12:34522274-34522339
  Hypo

SEQ ID NO: 107519 - DNA, 38 bp, Homo sapiens; identical to SEQ ID NO: 74594
  chr12:34527377-34527415
  Hypo

SEQ ID NO: 107520 - DNA, 40 bp, Homo sapiens; identical to SEQ ID NO: 74607
  chr12:37937804-37937844
  Hypo

SEQ ID NO: 107521 - DNA, 148 bp, Homo sapiens; identical to SEQ ID NO: 74608
  chr12:38471923-38472071
  Hypo

SEQ ID NO: 107522 - DNA, 183 bp, Homo sapiens; identical to SEQ ID NO: 74609
  chr12:38543382-38543565
  Hypo

SEQ ID NO: 107523 - DNA, 30 bp, Homo sapiens; identical to SEQ ID NO: 74610
  chr12:38548005-38548035
  Hypo

SEQ ID NO: 107524 - DNA, 30 bp, Homo sapiens; identical to SEQ ID NO: 74611
  chr12:38548938-38548968
  Hypo

SEQ ID NO: 107525 - DNA, 98 bp, Homo sapiens; identical to SEQ ID NO: 74612
  chr12:38549408-38549506
  Hypo

SEQ ID NO: 107526 - DNA, 60 bp, Homo sapiens; identical to SEQ ID NO: 74613
  chr12:38550213-38550273
  Hypo

SEQ ID NO: 107527 - DNA, 236 bp, Homo sapiens; identical to SEQ ID NO: 74614
  chr12:38550662-38550898
  Hypo

SEQ ID NO: 107528 - DNA, 152 bp, Homo sapiens; identical to SEQ ID NO: 74615
  chr12:38551153-38551305
  Hypo

SEQ ID NO: 107529 - DNA, 92 bp, Homo sapiens; identical to SEQ ID NO: 74616
  chr12:38551365-38551457
  Hypo

SEQ ID NO: 107530 - DNA, 234 bp, Homo sapiens; identical to SEQ ID NO: 74617
  chr12:38551828-38552062
  Hypo

SEQ ID NO: 107531 - DNA, 36 bp, Homo sapiens; identical to SEQ ID NO: 43437
  chr12:38553830-38553866
  Hypo

SEQ ID NO: 107532 - DNA, 54 bp, Homo sapiens; identical to SEQ ID NO: 74619
  chr12:38554204-38554258
  Hypo

SEQ ID NO: 107533 - DNA, 80 bp, Homo sapiens; identical to SEQ ID NO: 74620
  chr12:38595481-38595561
  Hypo

SEQ ID NO: 107534 - DNA, 34 bp, Homo sapiens; identical to SEQ ID NO: 74621
  chr12:38836094-38836128
  Hypo

SEQ ID NO: 107535 - DNA, 17 bp, Homo sapiens
  chr12:39142109-39142126
  Hypo
aacgcaatactattaat

SEQ ID NO: 107536 - DNA, 131 bp, Homo sapiens; identical to SEQ ID NO: 74623
  chr12:39298556-39298687
  Hyper

SEQ ID NO: 107537 - DNA, 194 bp, Homo sapiens; identical to SEQ ID NO: 74624
  chr12:39298908-39299102
  Hyper

SEQ ID NO: 107538 - DNA, 640 bp, Homo sapiens; identical to SEQ ID NO: 74625
  chr12:39299368-39300008
  Hyper

SEQ ID NO: 107539 - DNA, 75 bp, Homo sapiens; identical to SEQ ID NO: 74626
  chr12:39300330-39300405
  Hyper

SEQ ID NO: 107540 - DNA, 30 bp, Homo sapiens; identical to SEQ ID NO: 74627
  chr12:39300876-39300906
  Hyper

SEQ ID NO: 107541 - DNA, 231 bp, Homo sapiens
  chr12:39539241-39539472
  Hyper
cggctcagggtccggcgctgaggacgcgtgtgcggggtggtccgccgccccggaaggtcgcgaactcgccgcctccagcgccggcgccttaaccccgccggtcccggcgccaaagtcccgacagtggcggacgccggcaccaggggcgatggagagcaggcgacaccgagggtgtccatccggtccacccaacctggtgcaaggctctgggaagcgcgctgacaggatttc

SEQ ID NO: 107542 - DNA, 33 bp, Homo sapiens; identical to SEQ ID NO: 74629
  chr12:39726877-39726910
  Hypo

SEQ ID NO: 107543 - DNA, 60 bp, Homo sapiens; identical to SEQ ID NO: 74631
  chr12:40501737-40501797
  Hypo

SEQ ID NO: 107544 - DNA, 35 bp, Homo sapiens; identical to SEQ ID NO: 74633
  chr12:40540758-40540793
  Hypo

SEQ ID NO: 107545 - DNA, 34 bp, Homo sapiens; identical to SEQ ID NO: 74634
  chr12:40540853-40540887
  Hypo

SEQ ID NO: 107546 - DNA, 708 bp, Homo sapiens; identical to SEQ ID NO: 74635
  chr12:40618340-40619048
  Hyper

SEQ ID NO: 107547 - DNA, 32 bp, Homo sapiens; identical to SEQ ID NO: 74636
  chr12:41012036-41012068
  Hypo

SEQ ID NO: 107548 - DNA, 272 bp, Homo sapiens
  chr12:41086182-41086454
  Hyper
tttccctgtggtccccgccccactttccctgctgccccaataaccgccctaaaaggccgggcttctgctgtcaagtagccagggtgggctccgccgaggcgaggaggggcgccggtggggagatgcgctcccaggtgtttgcagcggaagtgggaaacctgtagggtatggtccagctgtgccgcaccgaggcgagcaggagcagggaacaggtaggaagctggacttttccttctttgcagataaaataaagaatgcgcatttccatgctg

SEQ ID NO: 107549 - DNA, 393 bp, Homo sapiens; identical to SEQ ID NO: 74639
  chr12:41086713-41087106
  Hyper

SEQ ID NO: 107550 - DNA, 1073 bp, Homo sapiens
  chr12:41582304-41583377
  Hyper
ggagtgcaaactgtgcggccaggtgcttgaagagcccctgtgcacgccgtgcgggcacgtcttctgcgccagctgcctgttgccctgggcggtgcggaggcgccggtgcccgctgcagtgccagcccttggcgcccggcgagctgtaccgggtgctgccgctgcgcagcctcatccagaagctgcgagtccagtgcgactaccgcgcccgcggctgcggccactcggtcaggctgcacgagctggaggcgcacgtcgagcactgcgacttcggccctgcccgccggctccgcagccgcgggggctgcgcttcggggctgggcggtggtgaggtgcccgcgcgggggggctgcggtccgacacccagggctggccggggcgggggcgcgcgcggggggccgccgggcggccgctggggccgcgggcggggacccgggcctcgggtcctcgcctggaggcggcgcgagaaggcgctgctggcgcagctctgggcgctgcagggcgaggtgcagctcacggcgcgcaggtaccaggagaagttcacccaatacatggctcacgtccgcaacttcgtcggcgacctcggtggcggccaccgcagggtaagcaaaggggggtgggcaccgcgggcatggtcgattggggtgggaaaaggagcggttctttctgacgcttcaggattcctttggaattgggcatccttcctcactatgcagcaggaaacatccacaccctgatcatactttcctgtcattatcttacgaatggattggcgtcgaagttaaggattgtcccttttctgattatattacgattggaaagagttaaacagattcgattctaactttcccccgggaaagtaggaattgtgaaaactcattttccatccagactctcgttttccatctttcaccctcctgcccaccgtctctgcctattttttgagcacttgtcccgtgcctgaagcaaatccgagaaggaaagacagaaagcgaagactttcccggcccagcctttcctctcccgcggccaccagcatccccgcggccctggcagccgcgcacgcacacctgg

SEQ ID NO: 107551 - DNA, 145 bp, Homo sapiens; identical to SEQ ID NO: 74643
  chr12:41583648-41583793
  Hyper

SEQ ID NO: 107552 - DNA, 164 bp, Homo sapiens; identical to SEQ ID NO: 74644
  chr12:41584085-41584249
  Hyper

SEQ ID NO: 107553 - DNA, 30 bp, Homo sapiens; identical to SEQ ID NO: 43440
  chr12:41925162-41925192
  Hypo

SEQ ID NO: 107554 - DNA, 30 bp, Homo sapiens; identical to SEQ ID NO: 74646
  chr12:41934689-41934719
  Hypo

SEQ ID NO: 107555 - DNA, 30 bp, Homo sapiens; identical to SEQ ID NO: 74648
  chr12:41957024-41957054
  Hypo

SEQ ID NO: 107556 - DNA, 30 bp, Homo sapiens; identical to SEQ ID NO: 74649
  chr12:42047159-42047189
  Hypo

SEQ ID NO: 107557 - DNA, 35 bp, Homo sapiens; identical to SEQ ID NO: 34320
  chr12:42326337-42326372
  Hyper

SEQ ID NO: 107558 - DNA, 126 bp, Homo sapiens; identical to SEQ ID NO: 74655
  chr12:42326595-42326721
  Hyper

SEQ ID NO: 107559 - DNA, 23 bp, Homo sapiens
  chr12:42443414-42443437
  Hypo
ttcctattcggccatcttggctc

SEQ ID NO: 107560 - DNA, 24 bp, Homo sapiens
  chr12:42654216-42654240
  Hypo
gataatagtacttgccgggaggcg

SEQ ID NO: 107561 - DNA, 83 bp, Homo sapiens; identical to SEQ ID NO: 43442
  chr12:42654300-42654383
  Hypo

SEQ ID NO: 107562 - DNA, 76 bp, Homo sapiens; identical to SEQ ID NO: 74666
  chr12:42970333-42970409
  Hypo

SEQ ID NO: 107563 - DNA, 863 bp, Homo sapiens; identical to SEQ ID NO: 74667
  chr12:42983011-42983874
  Hyper

SEQ ID NO: 107564 - DNA, 42 bp, Homo sapiens; identical to SEQ ID NO: 34323
  chr12:42984438-42984480
  Hyper

SEQ ID NO: 107565 - DNA, 1631 bp, Homo sapiens
  chr12:43944788-43946419
  Hyper
ggtccgagggccctgcgtcgctctcccaggccccgcgctccggggttcccaagtgcacctcggtgtagccggcggccagaaaggatgcatcggcggtcaggttcagctggaagagctgcccgtaggcagtgaagcgatagtgggttcggaacggcatgggttccagcgcctcggagctgcgtttctgccggctgaagtggtggctctgagggaacacttctccaaactcattgacccgctcggggatcactacttcgtaggaggtcagtgtcctcaccagggcttctgcaacaacagcgacaggaccagtgagctcccacgcgttcctcattgtccaactctaaacttcttccaccaaacgtccccgctaaaggtcccaggtcccagtacagccaggggcaagacaaatgcacacatgctgatgcgcacgcacacacacacacgtgcactgggacggttagtgctctgctttcccacacccccaacttgccctaccctccccaagcaaagaccctaccactaatggccctaagcaacccacttccttccccagtacctcctaacctccccgcagcccccaactcgttccctccgggtgcaagcgaccccctgccccttgcgcccccgccgtgtggtcctgggagtgcgatgcgtcttaggcgcgcgcgattcctcgaaacccggcgcagtcgcgacctctccggctgactggtccgggagtcccgggagctccagcagggccagcgttccccaacgggctgagccgctcgtccccgcgacctgcatgtcccactcgggccccgcgcccccacttagccgctgaaggcgtctcgcggtgactttaccttgcctggggtggaagtcaacttcccaagacctggtgatgaagagcgagagatggtagagcagcccagtcagccacttggccacccacatggttccaccctggggaccccgatcggggaggcccaccagagccgccggcagccaagccggcttccctcgcgctccgatccctctcctccctctcgcccgccgctctccgcgcctcagcagcctagggaacagcagcgcgggccctgggccggctggtccagccacaccgcctgtctccgctcgctgagccgctgcttcatcgcactgcagcctcaccccccttcctgcgcccgcgctgccctcagaaactctctgctcaggttcagctcggcgcggggaagcaactcgacctagcaggaatggtgccaatatagccaccccggaccggcgagcgccgcggagagcccgcccctatgggctgttcccggccaatcagcgggaggcgcggcccctgctcgcttttccccgcgcagccccctcccttctccactcagccgcaaggggactgcggtacccttctgctgccccagtgggcgcgcgacttgctgagtagccccaaggcccggctgggcaccaattccggacctatgaaaccgagcgagatgcaagcacccgcgtacgtgaaaggtgcctagggttttgagctcttagatgaaatgacaagcatcagatagaacgtttctgttttttatgttttacggtacttttaggcttctcaaacaaaataaaataagctacaacggaagttcttgtag

SEQ ID NO: 107566 - DNA, 120 bp, Homo sapiens; identical to SEQ ID NO: 74693
  chr12:43957403-43957523
  Hypo

SEQ ID NO: 107567 - DNA, 30 bp, Homo sapiens; identical to SEQ ID NO: 74698
  chr12:44319436-44319466
  Hypo

SEQ ID NO: 107568 - DNA, 1164 bp, Homo sapiens
  chr12:45268922-45270086
  Hyper
caaagttaggacaagcggcaagagcaactcctgccggggttatcggaactgaaatcacagtggggatgcagcacgccgggcataccttgaaagagaaaggctttcgtcccattatgcagccccgggacctgacgcactccggtcgtggactccccaagttctaactctgttaagacgtcaatctgtagggaagggtccacaccaagcccccaaactggtgaggggtatgaggtgggagagagaaaaaggaaaagctccatcaaaatgcaagtctcttcctccagggcagcaaagaaccgcgttttcgcgacaatattgggaactgaagatgagaggcgactgcctcctcctccgccgagagccttacctgagatcagcagccaagctttaaatagcggagcacccagtcccgtttccatgacctcctttaaacccttctctctgcaaagttccccctcagccctccgaccctggactaggggcgtgatccgcctcgcggtctccaaggcaagcacagaaaaaaaaaaaatccatatccaaacccgcccccttactccaagcttcccactccagacctactttgggtccgggaaaagcgaggcttccccagccagcccatgctgccccgaggcgggagccatccctttccccagccccagctctgcggccactcacctgctccgagaccgaagatcaaacagaatgttctcagtaagacccgagactccatggtgcggatcagctcagtccatcgtctccctctttaaaaataaaaataaaaatcgaagaggttcttggaatcaagcgggaaaataacgtttgtctctcctgctgctgcctcggatttactgatcagtaggattaatacgctttggttgcctaagaaagaaaagggaggcctccccaggcgcgtgaagaacttagaccctccaatgcgcacatcattcccacacgcagggccgaggcggcagcgcggcccggagggggcccggagggaggggtcggactcgccccggcgcggctccgtcggggaattagctcccgagccgaataaaagcagccaaagactcgcacacccggtagaaggggggcggccccaagaaagcccgggctggggcggccccgcacccccccgtcttccccgccgcccgaacctgttgtaaa

SEQ ID NO: 107569 - DNA, 535 bp, Homo sapiens; identical to SEQ ID NO: 74701
  chr12:45270378-45270913
  Hyper

SEQ ID NO: 107570 - DNA, 986 bp, Homo sapiens
  chr12:45443857-45444843
  Hyper
ctccccaagttgggccgcgcaaagctctccttgtcaagaacttttctgagagctggtgtcgtgcagcccgggaaacaggaccgggcaggttagaaacgttgaacttggtgaaaccccttgagactgatccaggcaggccgtagaaccctcagagtttcccagttaaggccaaaaagttaagcagccctaccacctgttgaaagaagggaacagcaaagaagctggtggaatgggatgggatggggcaaaaaagaatcacagaaagtggtgtgcctccgcctgggccccctactcccgaagtggcatctccactaaagctcgagatgctccaggaagttcccaaaccggctctccctgggcgcagtgcgcaccgccggcgctcccagatccctggaccacccggcctgggggcgcgggcgcggctggggagggaggggagagctggctcacctggcgctgaaggctggaaggtacagtctcggtcccccggagcccggcccggcagcctcgcactgtccgcagagggactgagcacttgaaaagcccaccgcgttccgtagggcgccccggcggggctaacttgttcggctgcggggcacagctttaggggaactgggctagcaggcaggggccggagctgcgcgcccgcggtggccagggcggtcgccgggtcgtggggcgcgggcggctgcagcctgggcgttggggcgcccccgacccgcagcaaattctcgatcaggaaactcttgcccaggttgccaaagccgggcgcagcggggaggttgaggagcgcggaggaagccacaacgtcccagtacgcaccggcgtgggctgcgaccgcgctggggagcatagtgcggcgccaaccggtctgctgcgcgcccgccttgcgcccgcctgtcgcccgggcgccccgcaccgcacccagagccgcagcttctcgccgccgcctcccgcagggctggagcgcgcggagccaggcaggg

SEQ ID NO: 107571 - DNA, 256 bp, Homo sapiens; identical to SEQ ID NO: 74704
  chr12:45445143-45445399
  Hyper

SEQ ID NO: 107572 - DNA, 29 bp, Homo sapiens
  chr12:46495833-46495862
  Hypo
gagaaacacatcagcggaagaacacacaa

SEQ ID NO: 107573 - DNA, 210 bp, Homo sapiens
  chr12:46767273-46767483
  Hyper
ccccagttttccactcgctgacacgttgcttctcttatcccaccaccgccgccccgggcaaaggcactgccttgtctgaatgcgggtctgaggcgctttctgcggagcctggtcctttcccttcaatggtgatgtgtgtggtcttgctgagccaggcaactagggggacccttcgctgtggaaaaattggtgctgcgggaaaggcaagac

SEQ ID NO: 107574 - DNA, 924 bp, Homo sapiens
  chr12:47224753-47225677
  Hyper
gcacacccgcgaccacgtatccctgagtttcctaacttagttcaccccttttcctccaagtcagcagcccggtgagcattccagggtcagtcctggtgctcaaagtaagggcaatcttccatctctgcctgctggatcacaaagaggagctgggagattcgccgttttcccccacaaccggcacctgccctggcccagagcgcagcgtccacctgtaccaccgctagatgaagagtacctcaccgcgcgctgcctgggcgcacagctggtgtgccgcgctcgccacctctcctggactcaagggtgctcccggcttacgcttctcggggcttcccgggtccgggttccctctcccccgtctcactttcttccttcattcgctcttctctcaatttttcctccatcagctctaacctgtaatcaattcccgccttctgcccctcctccctaggcttctcttagctcggttgccgcgaccccactatccgtccccgttcgcatttctgcaccgccctgcccttcactccagcgcgcagcaggccgggcaatccgaccgcgcggtaagccgccctcggaaccgctggcgcagttttcagactcgcccaccgcccagagaccaggggcccacatccagctctgctctcgccttctcccttgaaagagactccttgggggctccccaggtcagagtaccccgcccggggaatcatgctggtctctggggcgacccagctatcagagacgacagttctattttaagccttccacccagtgtccccgacctgaggacgcgggcgcgggtccagggactcgggtaacaccttgccagcaggatcccgggcggtcgcggagccagctcccgcgggggaagtcgggcctctcagccaggcaggcggcgcggccacggaacgcagtcccaataca

SEQ ID NO: 107575 - DNA, 132 bp, Homo sapiens; identical to SEQ ID NO: 74714
  chr12:47547800-47547932
  Hypo

SEQ ID NO: 107576 - DNA, 86 bp, Homo sapiens; identical to SEQ ID NO: 43444
  chr12:47628723-47628809
  Hypo

SEQ ID NO: 107577 - DNA, 162 bp, Homo sapiens; identical to SEQ ID NO: 74716
  chr12:47629046-47629208
  Hypo

SEQ ID NO: 107578 - DNA, 54 bp, Homo sapiens; identical to SEQ ID NO: 74717
  chr12:47629490-47629544
  Hypo

SEQ ID NO: 107579 - DNA, 169 bp, Homo sapiens; identical to SEQ ID NO: 74718
  chr12:47659833-47660002
  Hypo

SEQ ID NO: 107580 - DNA, 74 bp, Homo sapiens; identical to SEQ ID NO: 74719
  chr12:48206723-48206797
  Hyper

SEQ ID NO: 107581 - DNA, 46 bp, Homo sapiens; identical to SEQ ID NO: 74721
  chr12:48299419-48299465
  Hyper

SEQ ID NO: 107582 - DNA, 38 bp, Homo sapiens; identical to SEQ ID NO: 74722
  chr12:48348058-48348096
  Hypo

SEQ ID NO: 107583 - DNA, 30 bp, Homo sapiens; identical to SEQ ID NO: 74723
  chr12:48375679-48375709
  Hypo

SEQ ID NO: 107584 - DNA, 266 bp, Homo sapiens; identical to SEQ ID NO: 74724
  chr12:48395916-48396182
  Hyper

SEQ ID NO: 107585 - DNA, 338 bp, Homo sapiens; identical to SEQ ID NO: 74725
  chr12:48396748-48397086
  Hyper

SEQ ID NO: 107586 - DNA, 1598 bp, Homo sapiens; identical to SEQ ID NO: 74726
  chr12:48397146-48398744
  Hyper

SEQ ID NO: 107587 - DNA, 138 bp, Homo sapiens; identical to SEQ ID NO: 74727
  chr12:48398948-48399086
  Hyper

SEQ ID NO: 107588 - DNA, 30 bp, Homo sapiens; identical to SEQ ID NO: 74728
  chr12:48565607-48565637
  Hypo

SEQ ID NO: 107589 - DNA, 188 bp, Homo sapiens; identical to SEQ ID NO: 34342
  chr12:48576788-48576976
  Hyper

SEQ ID NO: 107590 - DNA, 861 bp, Homo sapiens; identical to SEQ ID NO: 74730
  chr12:48577469-48578330
  Hyper

SEQ ID NO: 107591 - DNA, 100 bp, Homo sapiens; identical to SEQ ID NO: 74731
  chr12:48590813-48590913
  Hypo

SEQ ID NO: 107592 - DNA, 22 bp, Homo sapiens
  chr12:48615310-48615332
  Hypo
agtgtaacgttaccacaaattt

SEQ ID NO: 107593 - DNA, 36 bp, Homo sapiens; identical to SEQ ID NO: 74733
  chr12:49074244-49074280
  Hypo

SEQ ID NO: 107594 - DNA, 18 bp, Homo sapiens
  chr12:49108598-49108616
  Hypo
tataaggcggccaggcgc

SEQ ID NO: 107595 - DNA, 36 bp, Homo sapiens; identical to SEQ ID NO: 74735
  chr12:49111559-49111595
  Hypo

SEQ ID NO: 107596 - DNA, 25 bp, Homo sapiens
  chr12:49174695-49174720
  Hypo
cattctggccaggtgcggtggctca

SEQ ID NO: 107597 - DNA, 49 bp, Homo sapiens; identical to SEQ ID NO: 74737
  chr12:49276337-49276386
  Hyper

SEQ ID NO: 107598 - DNA, 197 bp, Homo sapiens; identical to SEQ ID NO: 34345
  chr12:49297738-49297935
  Hyper

SEQ ID NO: 107599 - DNA, 501 bp, Homo sapiens; identical to SEQ ID NO: 74739
  chr12:49363677-49364178
  Hyper

SEQ ID NO: 107600 - DNA, 164 bp, Homo sapiens; identical to SEQ ID NO: 74740
  chr12:49366374-49366538
  Hyper

SEQ ID NO: 107601 - DNA, 39 bp, Homo sapiens; identical to SEQ ID NO: 34349
  chr12:49367954-49367993
  Hyper

SEQ ID NO: 107602 - DNA, 95 bp, Homo sapiens; identical to SEQ ID NO: 74742
  chr12:49372141-49372236
  Hyper

SEQ ID NO: 107603 - DNA, 122 bp, Homo sapiens; identical to SEQ ID NO: 74743
  chr12:49372537-49372659
  Hyper

SEQ ID NO: 107604 - DNA, 30 bp, Homo sapiens; identical to SEQ ID NO: 74744
  chr12:49373073-49373103
  Hyper

SEQ ID NO: 107605 - DNA, 2156 bp, Homo sapiens
  chr12:49373373-49375529
  Hyper
ggggatcctgcacagcgtgagtggggggctgcagagtgccgtgcgcgagtgcaagtggcagttccggaatcgccgctggaactgtcccactgctccagggccccacctcttcggcaagatcgtcaaccgaggtgggtgcccaggaaggcgacgcttccgggagcaggggaaacgcggggtcacccccagggcatgggcgggcgagttcagagaaggtgtcccaggcgcctggagggtcacacaatcaaccttgccaagtgcctcgtgcccagcgccagctcggggccagacttctaccaggcgttttccagccgtgcaccctggaaacgaagcttaacttttctgagctactgccccagataaagaaagtttcgggtcgcggacgccggctgaccgccgctttcccccagcctctctcaaaagcgcctgggaagctgctctctgcaggcgtgtgtctggcctctcgcccagcaaggcttgcaccgccaaaatgggccgaaagttttgggctgcgaagaagtcttggggatgtatggttcttccgctcccctctcttcggtttgtctctctggggctgctccacttccgctatcgagccaaaatgcgccctagaatctcccagtaaggtgtgattacgcccgtggacgtggctgcgtgcccacgcacctgctttctctactagccctagagaccagctttccagcactgccggccctggctctcaggactcaaagtgcggagtcgggggtgggattccggtcccaagcccttcatgagggtgctggccgcgccccgcgtaccccctcgctgatccccgctcccttctcccacaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgacttcggccgcctcttcggccgggagttcgtggactccggggagaaggggcgggacctgcgcttcctcatgaaccttcacaacaacgaggcaggccgtacggtgagctttgagaggctccgcaccctaagcggagcggcaggggccaacctcgggctggggaagtgacggtcggtgagataaggcaaggggcaccaggagagggcgtcctgggagagccggaggcttggaacgaagacggagaatagaggagacagtggctgagggcaaaggtatgtctggcccgcggacaggtagaagaggttgcaaatcaagcacagtctcttcgctgtacagattcgaaaaataagcctgagaggccgagactgactcgccgcggcggagcagggttgggcagggtttccaaatctcagcggaacatttcgcgcctcccttcccctgggctcagctaggcctgggcctttgctgaggtccggcccccgtggcgtccgggagagggcagtgtctgggagggtgactctggcccggtgccctgggacactctttcttcccctatccccgcagaccgtattctccgagatgcgccaggagtgcaagtgccacgggatgtccggctcatgcacggtgcgcacgtgctggatgcggctgcccacgctgcgcgccgtgggcgatgtgctgcgcgaccgcttcgacggcgcctcgcgcgtcctgtacggcaaccgcggcagcaaccgcgcttcgcgggcggagctgctgcgcctggagccggaagacccggcccacaaaccgccctccccccacgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgcagcgcgtcaccgagcgctgcaactgcaccttccactggtgctgccacgtcagctgccgcaactgcacgcacacgcgcgtactgcacgagtgtctgtgaggcgctgcgcggactcgcccccaggaacgctctcctcgagccctcccccaaacagactcgctagcactcaagacccggttattcgcccacccgagtacctccagtc

SEQ ID NO: 107606 - DNA, 32 bp, Homo sapiens; identical to SEQ ID NO: 74747
  chr12:49375761-49375793
  Hyper

SEQ ID NO: 107607 - DNA, 262 bp, Homo sapiens; identical to SEQ ID NO: 74748
  chr12:49388709-49388971
  Hyper

SEQ ID NO: 107608 - DNA, 1719 bp, Homo sapiens
  chr12:49390818-49392537
  Hyper
cttctcgcagggccccggcgtagggccctggggtccgcgcccagccccggccggcgcgccgctggaccaccgccacttccgacccctcggctctgccctgggctcccgaagctgctgggcctaaggcttggtgctctgggctacctggctgcgtgggggcgtcccgcaggtttacttcgggggccgggagccccaagatgcggaaagtgcgctcctccagtgtggagtcccccggcctcccgccctcagcttcgcccccgcggcccccgccgggctggtgtaaaaggcgactgctcgacagccgcttttgacaaggggaaggaaagaccgtggccccttcaccctcctccttgccgggcttcgattggctgggggaatcccccaccacgcgtgtcaccccagagggcaaaagctgcacctgctgggttcggggggttggaacatattgggatcgtatcactacgcacgtggcgtcaatgacaaagacgccttccccacgggacaggccctgggaactgcggggcaaggtgtgggcacggcgggtcgccttccaaccctccagggtctccggtcctgccccctctccaagacccagagattctctccatccggtgcctccgggagcccagggtctggggagtgtctggctatggcggggcggctgctttttaggggagggaatccagcatttgggaaaccagatctgttctccttctttcccttccctcgagcccttgaggtggtgcctggatctgggagcgggatgcggggcacagggagccgcagttgcagaccccgcaggagctatctcggtgcctgcgctccctgtagctttggcttggggatggctgtcgctaccactgttcaggtcagcagcagccagccccaggcttttctccacgacccccttgccgggctctggccttgctctggccgctccacagcctggggatccccccaagagaccttgcccctgtcggagaccccaagccccgaggacgtcccggtagatccgaggatccagcctcttctttgtgcgccctccgtctgtcctggctggagtcgcagctggggctgatgaagtgggcacctgagagttcccggggcctctcttagtccccaaggtcctatgggggccttcgtaagaaggtggagccacgtagggtggcggccggtcccagcggcgtcgtggggcggtcccggcagaacctctcagcagcaggtgagcctcgtagcttgggggcccgggccgccgacctccccagggccccgcccacgccgaccctgggtcgctctgcggctgcgcggatggacggggcgctcgccccacaggcgccaggcgctccggccgcaagggagcagggagccctgccagctgggccacccgaggggcgttgcggggctccgggcggggtcgacccggggggctccgtcgggccccaccagccttgcgcctttttcgctcggtctccttggcctcccgctcctgcgacgccgctttccttttctcttgctcccgagctcggacctcggccaggggccccgcccgccagttggtcgcctcctgcagcaccctggaggcccagggccggcggggcggcggctgtggggatcccgggcgcggcccacacctgggacaatgagcaggaacccaggtgagcagtttgtgggggaagggagccgaggtccggggagctgggagcactggagaccacttgg

SEQ ID NO: 107609 - DNA, 39 bp, Homo sapiens; identical to SEQ ID NO: 74751
  chr12:49392597-49392636
  Hyper

SEQ ID NO: 107610 - DNA, 71 bp, Homo sapiens; identical to SEQ ID NO: 74752
  chr12:49393665-49393736
  Hyper

SEQ ID NO: 107611 - DNA, 30 bp, Homo sapiens; identical to SEQ ID NO: 74753
  chr12:49443844-49443874
  Hypo

SEQ ID NO: 107612 - DNA, 541 bp, Homo sapiens; identical to SEQ ID NO: 74754
  chr12:49483686-49484227
  Hyper

SEQ ID NO: 107613 - DNA, 198 bp, Homo sapiens; identical to SEQ ID NO: 74755
  chr12:49485716-49485914
  Hyper

SEQ ID NO: 107614 - DNA, 92 bp, Homo sapiens; identical to SEQ ID NO: 74756
  chr12:49486186-49486278
  Hyper

SEQ ID NO: 107615 - DNA, 30 bp, Homo sapiens; identical to SEQ ID NO: 34360
  chr12:49487666-49487696
  Hyper

SEQ ID NO: 107616 - DNA, 34 bp, Homo sapiens; identical to SEQ ID NO: 74758
  chr12:49515539-49515573
  Hypo

SEQ ID NO: 107617 - DNA, 37 bp, Homo sapiens; identical to SEQ ID NO: 74760
  chr12:49596183-49596220
  Hypo

SEQ ID NO: 107618 - DNA, 150 bp, Homo sapiens; identical to SEQ ID NO: 74761
  chr12:49657572-49657722
  Hypo

SEQ ID NO: 107619 - DNA, 17 bp, Homo sapiens
  chr12:49661147-49661164
  Hypo
aggtaaacatgatgccg

SEQ ID NO: 107620 - DNA, 30 bp, Homo sapiens; identical to SEQ ID NO: 34361
  chr12:49688858-49688888
  Hyper

SEQ ID NO: 107621 - DNA, 38 bp, Homo sapiens; identical to SEQ ID NO: 74764
  chr12:49690563-49690601
  Hyper

SEQ ID NO: 107622 - DNA, 109 bp, Homo sapiens; identical to SEQ ID NO: 74765
  chr12:49690983-49691092
  Hyper

SEQ ID NO: 107623 - DNA, 283 bp, Homo sapiens
  chr12:49726844-49727127
  Hyper
ggtagatgatgaagccggagaaggtgctgtacttgttggtgttgccgccgtgcactttcccgccgtccagcttgatgaagacctcgtcgcccacgtccaggtgcagaatgacgctgttgctggcgtagtcgtagttctggtccgcgtcctgagcaatggcgctggcccggacctatcgagggagaagaacctgctcatgctctgtgtggagctggggtgacgagaggggtcggggcggctgggcgtgcgaaggcggccgggcagccgccgcaggggctgggga

SEQ ID NO: 107624 - DNA, 667 bp, Homo sapiens; identical to SEQ ID NO: 74769
  chr12:49729713-49730380
  Hyper

SEQ ID NO: 107625 - DNA, 117 bp, Homo sapiens; identical to SEQ ID NO: 74770
  chr12:49735966-49736083
  Hyper

SEQ ID NO: 107626 - DNA, 36 bp, Homo sapiens; identical to SEQ ID NO: 34366
  chr12:49736792-49736828
  Hyper

SEQ ID NO: 107627 - DNA, 108 bp, Homo sapiens; identical to SEQ ID NO: 74772
  chr12:49931485-49931593
  Hyper

SEQ ID NO: 107628 - DNA, 30 bp, Homo sapiens; identical to SEQ ID NO: 74773
  chr12:49932996-49933026
  Hyper

SEQ ID NO: 107629 - DNA, 67 bp, Homo sapiens; identical to SEQ ID NO: 74774
  chr12:49933430-49933497
  Hyper

SEQ ID NO: 107630 - DNA, 36 bp, Homo sapiens; identical to SEQ ID NO: 74775
  chr12:49944080-49944116
  Hypo

SEQ ID NO: 107631 - DNA, 35 bp, Homo sapiens; identical to SEQ ID NO: 74776
  chr12:50036399-50036434
  Hypo

SEQ ID NO: 107632 - DNA, 54 bp, Homo sapiens; identical to SEQ ID NO: 74777
  chr12:50052209-50052263
  Hypo

SEQ ID NO: 107633 - DNA, 30 bp, Homo sapiens; identical to SEQ ID NO: 74779
  chr12:50186522-50186552
  Hypo

SEQ ID NO: 107634 - DNA, 627 bp, Homo sapiens
  chr12:50297461-50298088
  Hyper
aggggaggatgctttcgtggtccagagggcttgctgaggatgacagggagccgggagccggaggatggaggatggtgcaggctggggagatgccggtacctttccctgggtcatggtgccgtctctcggggaaggggtccctgaggcccgggtggccgcttgggtaaccgcagcctgcctgcgtctcttccttcctccgcgtgggttctagcaacatccactgcagccgggccaggcgagccggcgcgtaccatcggcgcggggggaggagagggccgggcctgggaagatgctgcggaggacgctgcggattcgcgagcccggggtaaggcggcggcgcaccgccccctcccgccgcttcccccccaccccgccccccaccgccgcccttagccctcccccgggatgagagagagtcgcgctgcggagcaaccccagtggatgggtccgcgggggctgagcgggcggaggacgcgggaactccgtgacaccgaccagctgacgctgcccgcgtgaaaccagagccgggcatcagggcctcatctccactgtctctgcacctctctgcagctccagctgcgcctctgccttttcctcctccctctttggatgcggccctgatttctg

SEQ ID NO: 107635 - DNA, 905 bp, Homo sapiens
  chr12:50354892-50355797
  Hyper
gcgcctccggggatccgttgcctagtccaggtactgcccagctaccgggcgtcgaggattgcgaagcgtcggggcaggctggcacggtgcccacttttcccaaaacgccagccttccaagcccagaagctcgcccggcccaggccgggagcggcccacgtcggacggccggaccgccctgcaggacccagcccggccgcccgcccccgccgccggcggtgagggaggtgagcggcgccgacctgcgggacgagcatcactccgacccagccgggggtgaggcgggtcaggatgctccggtcgcaggaggaaaaggaggagctggaccaaaagcccgaagagaagaaaaggggaaggccgcgcacggagcgcggtaaaggccggcggagctagacgccccgaggtcggagtgaagcgccgggaccgagccccgtctcccagggagtccggggcgcacggcaccgaggagagcgcgggagccaacctgggcgcatcatgcgcagggcccgggacgctgggccggtctacaccgccgcctgggtcacgtggcccggacgggccggcggctgccccggccggggggcgggggtcgcgccggggttgcgctggacgacggagagcggcgggcccgcagcggcctggagcctcccaacccgcgcgccgcgctggcccccgagcgtaggagccgccccctgcccccccgcgccggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggcc

SEQ ID NO: 107636 - DNA, 146 bp, Homo sapiens; identical to SEQ ID NO: 74789
  chr12:50426748-50426894
  Hyper

SEQ ID NO: 107637 - DNA, 241 bp, Homo sapiens; identical to SEQ ID NO: 34371
  chr12:50444182-50444423
  Hyper

SEQ ID NO: 107638 - DNA, 30 bp, Homo sapiens; identical to SEQ ID NO: 74791
  chr12:50444626-50444656
  Hyper

SEQ ID NO: 107639 - DNA, 41 bp, Homo sapiens; identical to SEQ ID NO: 74792
  chr12:50508302-50508343
  Hypo

SEQ ID NO: 107640 - DNA, 30 bp, Homo sapiens; identical to SEQ ID NO: 74793
  chr12:50575698-50575728
  Hypo

SEQ ID NO: 107641 - DNA, 19 bp, Homo sapiens
  chr12:50664625-50664644
  Hypo
agcactttgggaggccgag

SEQ ID NO: 107642 - DNA, 30 bp, Homo sapiens; identical to SEQ ID NO: 43452
  chr12:50790622-50790652
  Hypo

SEQ ID NO: 107643 - DNA, 24 bp, Homo sapiens
  chr12:50897742-50897766
  Hypo
tttcttttctttagacggagtgtt

SEQ ID NO: 107644 - DNA, 30 bp, Homo sapiens; identical to SEQ ID NO: 74797
  chr12:50938109-50938139
  Hypo

SEQ ID NO: 107645 - DNA, 30 bp, Homo sapiens; identical to SEQ ID NO: 74798
  chr12:51070876-51070906
  Hypo

SEQ ID NO: 107646 - DNA, 30 bp, Homo sapiens; identical to SEQ ID NO: 74799
  chr12:51237808-51237838
  Hypo

SEQ ID NO: 107647 - DNA, 520 bp, Homo sapiens; identical to SEQ ID NO: 74801
  chr12:51421126-51421646
  Hypo

SEQ ID NO: 107648 - DNA, 104 bp, Homo sapiens; identical to SEQ ID NO: 74802
  chr12:51441353-51441457
  Hypo

SEQ ID NO: 107649 - DNA, 32 bp, Homo sapiens; identical to SEQ ID NO: 74806
  chr12:51565442-51565474
  Hypo

SEQ ID NO: 107650 - DNA, 41 bp, Homo sapiens; identical to SEQ ID NO: 74807
  chr12:51749684-51749725
  Hypo

SEQ ID NO: 107651 - DNA, 30 bp, Homo sapiens; identical to SEQ ID NO: 74808
  chr12:51819149-51819179
  Hyper

SEQ ID NO: 107652 - DNA, 86 bp, Homo sapiens; identical to SEQ ID NO: 74809
  chr12:51930708-51930794
  Hypo

SEQ ID NO: 107653 - DNA, 59 bp, Homo sapiens; identical to SEQ ID NO: 74810
  chr12:51985238-51985297
  Hyper

SEQ ID NO: 107654 - DNA, 30 bp, Homo sapiens; identical to SEQ ID NO: 74811
  chr12:52074429-52074459
  Hypo

SEQ ID NO: 107655 - DNA, 523 bp, Homo sapiens
  chr12:52207881-52208404
  Hyper
agccctgcactgtggcgagcgggccggggctgccgggcgacgcccggtcgccgtcgccgccagtgatccatagcgtgagcaggacgaccagcgccccggtgcccagcgcccccacgaagccggtgaggaggccgagcgccagcggccccgcccaacccatggggctccgctcgtacaggggctgcggcaggcgctccacgatcagctgcagggcgtcccagtccggcgcggggaccgcggcgcgccgggggcgcggggccggggcaaagggcacgcgggcggcggcgccgggccgcggcaggaagcgctgcccgaacttgcgcagctgcagcgtcgcctgctggtggaggttcttgcccagctccctggccacgtccgggcggccgctgcgccgcagggcccgagccaggcggtcccaggacagggacgcggcctggggggccagccaggccgccagcgcctcccggcagccgtcggacacctctccaggcccggctaccctgcccgccgggtcctcggccgc

SEQ ID NO: 107656 - DNA, 85 bp, Homo sapiens; identical to SEQ ID NO: 34372
  chr12:52208668-52208753
  Hyper

SEQ ID NO: 107657 - DNA, 30 bp, Homo sapiens; identical to SEQ ID NO: 74815
  chr12:52241437-52241467
  Hyper

SEQ ID NO: 107658 - DNA, 128 bp, Homo sapiens; identical to SEQ ID NO: 74816
  chr12:52241703-52241831
  Hyper

SEQ ID NO: 107659 - DNA, 307 bp, Homo sapiens; identical to SEQ ID NO: 74817
  chr12:52242119-52242426
  Hyper

SEQ ID NO: 107660 - DNA, 152 bp, Homo sapiens; identical to SEQ ID NO: 74818
  chr12:52258092-52258244
  Hyper

SEQ ID NO: 107661 - DNA, 625 bp, Homo sapiens; identical to SEQ ID NO: 74819
  chr12:52262788-52263413
  Hyper

SEQ ID NO: 107662 - DNA, 495 bp, Homo sapiens
  chr12:52301024-52301519
  Hyper
gccccctcggggaggcggatgtgggaggcccggcccgggtgcgggccagcgacccgggagctgcgggcggctgggaggggaggccgccctgaggggctgggagcggcgcgggggtgggtcccggtcctgcagccccagcgaggggcgagcggcggccagtcggcgagctgggcaataaggaaacggtttattaggagggagtggtggagctgggccaggcaggaagacgctggaataagaaacatttttgctccagcccccatcccagtcccgggaggctgccgcgccagctgcgccgagcgagcccctccccggctccagcccggtccggggccgcgcccggaccccagcccgccgtccagcgctggcggtgcaactgcggccgcgcggtggaggggaggtggccccggtccgccgaaggctagcgccccgccacccgcagagcgggcccagaggtgagtcgaggtccgcggacgggaccgggtggcgggcggc

SEQ ID NO: 107663 - DNA, 37 bp, Homo sapiens; identical to SEQ ID NO: 74822
  chr12:52309137-52309174
  Hypo

SEQ ID NO: 107664 - DNA, 72 bp, Homo sapiens; identical to SEQ ID NO: 74823
  chr12:52317378-52317450
  Hyper

SEQ ID NO: 107665 - DNA, 206 bp, Homo sapiens; identical to SEQ ID NO: 74824
  chr12:52387854-52388060
  Hypo

SEQ ID NO: 107666 - DNA, 198 bp, Homo sapiens; identical to SEQ ID NO: 74825
  chr12:52388300-52388498
  Hypo

SEQ ID NO: 107667 - DNA, 1282 bp, Homo sapiens
  chr12:52400255-52401537
  Hyper
ccacccctactcctgcgcagccccgctgccgctctccctgccctggagtctcctgcagccccttggatctccgtgactctccctacctccccgactccccaggcttcttacagtgacctcttaccgtgccccactccatgaatcgccagagctattcgtccctaaatttcaaaccttgcgcaatgtcccttcacagacccctccaggtatcacgcagccccgagccccgagccccgccccgggggcctcatcccgccccttcgcgtccgcggctcgttttcccccactgagcgcccagctcccgcagtttccccggccgtcgagcgccgtgggcggggctccagggcggcggcgcctcgcggggagggtcctccgtgctgggggcgaggccacccgaggcagctccccgcccgcccccaaccccgccccgctctcggagcctataaagggaggcgacccgcggcccgcccggctggcatcccccagccgccgccagccccgccgaggggagccagcgccgtctctgaggggcgtccggcgccggagccatgaccctccgccgactcaggaagctgcagcagaaggaggaggcggcggccaccccggaccccgccgcccggactcccgactcggaagtcgcgcccgccgctccggtcccgaccccgggaccccctgccgcagccgccacccctgggcccccagcggacgagctgtacgcggcgctggaggactatcaccctgccgagctgtaccgcgcgctcgccgtgtccgggggcaccctgccccgccgaaaggtgcgtcccccgcccgccttcaggatctgctcagcccctctccgactccctacagggcctgctgactccgcagtgccctctcctcggcgtccgcggagtcccccaccttcttccccggcccgctgggtgcctcgactccccgcgttccccgctgctgcgaaggccgtggccctcgcctgcacaccgcgcccaggctcggtggctcttaactccgcgccccatgcacgccccctctctccctccttgactcctcccagcaccccccttctcctacccgctccatctggctttctgccccccatgccccgcctccccgtggccaggtgtcctgggtccccaggagcccctcgcccgagggacagagacagccccaggcaagttgaaggtccgagagcccccggtgggagaagcgggccggtggctgcgccgcgtgcgttctcactctgaggaagtgcgtggggagccgctgactccggatagcacaccct

SEQ ID NO: 107668 - DNA, 32 bp, Homo sapiens; identical to SEQ ID NO: 74829
  chr12:52416953-52416985
  Hyper

SEQ ID NO: 107669 - DNA, 39 bp, Homo sapiens; identical to SEQ ID NO: 74830
  chr12:52467638-52467677
  Hypo

SEQ ID NO: 107670 - DNA, 53 bp, Homo sapiens; identical to SEQ ID NO: 74831
  chr12:52491074-52491127
  Hypo

SEQ ID NO: 107671 - DNA, 30 bp, Homo sapiens; identical to SEQ ID NO: 74832
  chr12:52514449-52514479
  Hypo

SEQ ID NO: 107672 - DNA, 172 bp, Homo sapiens; identical to SEQ ID NO: 74834
  chr12:52524463-52524635
  Hypo

SEQ ID NO: 107673 - DNA, 30 bp, Homo sapiens; identical to SEQ ID NO: 34381
  chr12:52615930-52615960
  Hyper

SEQ ID NO: 107674 - DNA, 471 bp, Homo sapiens
  chr12:52626815-52627286
  Hyper
gccgtctagggatggcgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggcgcggagtgtccccgaggtcagcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcacggccgcgcgtggccgtgcgctctgcctatgggggcccggtgggcgccggcatccgcgaggtcaccattaa

SEQ ID NO: 107675 - DNA, 517 bp, Homo sapiens
  chr12:52652138-52652655
  Hyper
tgcgtccgcaggagccggcgcggaagcccccgcacacgctgtggctgccgaagcctccggtgaggccgcggtagcaggagacgccgcggtagggggcggcggtgatgcagcagcggccgggccggggcccgcaggccgagatgcagctgaaggcgcggaccccgcagggggcgctgaggcgggagtagaggcaggacatggtgcggtggcggcaggggcgggcggctggaccccaagccggcgctgcgccttatatgacggcccgcgggcccggggagggagctcgcggccaaggcgtttacgagcttggagggctcggccctcgcgcctcgcggagccgggaatgaaagcgagccaggccgcccggccgcctgcataaaacggcgttcgcctcccgcccgagttttatggggccgggaagcgcctggtcagccccgctgcccgtgcgctgcggtcagtgcgagtggaacccctccacctgtccgcccctccgccgggactccgagctttgccttgt

SEQ ID NO: 107676 - DNA, 76 bp, Homo sapiens; identical to SEQ ID NO: 74840
  chr12:52701967-52702043
  Hyper

SEQ ID NO: 107677 - DNA, 211 bp, Homo sapiens; identical to SEQ ID NO: 11234
  chr12:52702362-52702573
  Hyper

SEQ ID NO: 107678 - DNA, 30 bp, Homo sapiens; identical to SEQ ID NO: 43460
  chr12:52913808-52913838
  Hypo

SEQ ID NO: 107679 - DNA, 30 bp, Homo sapiens; identical to SEQ ID NO: 43461
  chr12:52914057-52914087
  Hypo

SEQ ID NO: 107680 - DNA, 41 bp, Homo sapiens; identical to SEQ ID NO: 74844
  chr12:53004285-53004326
  Hyper

SEQ ID NO: 107681 - DNA, 102 bp, Homo sapiens; identical to SEQ ID NO: 43462
  chr12:53069161-53069263
  Hypo

SEQ ID NO: 107682 - DNA, 196 bp, Homo sapiens; identical to SEQ ID NO: 74846
  chr12:53084865-53085061
  Hyper

SEQ ID NO: 107683 - DNA, 30 bp, Homo sapiens; identical to SEQ ID NO: 74847
  chr12:53088494-53088524
  Hypo

SEQ ID NO: 107684 - DNA, 615 bp, Homo sapiens; identical to SEQ ID NO: 74848
  chr12:53107999-53108614
  Hyper

SEQ ID NO: 107685 - DNA, 210 bp, Homo sapiens; identical to SEQ ID NO: 43463
  chr12:53189513-53189723
  Hypo

SEQ ID NO: 107686 - DNA, 78 bp, Homo sapiens; identical to SEQ ID NO: 74852
  chr12:53241495-53241573
  Hypo

SEQ ID NO: 107687 - DNA, 32 bp, Homo sapiens; identical to SEQ ID NO: 74853
  chr12:53342879-53342911
  Hyper

SEQ ID NO: 107688 - DNA, 320 bp, Homo sapiens
  chr12:53359275-53359595
  Hyper
cctccttaaagatctcgcagtgaggttagggagctgctccccggctctgggaagccgctatcctgcccataccctcctttctctccgctgctgcccctgcctcgctcccgcgcgctcccattgggtggtgcctgggtgtccccggctcggcagctgcggctgcttcccagccccggggtctcagggccgtcccgccggtcccagggcaccgctcctgtgccccacgccgccgcttccccagttgccccctgactgcaagagtctcctggttttcggcttgtcctgggactcctgggagagcccaccgagagttctggggc

SEQ ID NO: 107689 - DNA, 21 bp, Homo sapiens
  chr12:53402530-53402551
  Hypo
ttcttaaaggccgggcgcggt

SEQ ID NO: 107690 - DNA, 223 bp, Homo sapiens; identical to SEQ ID NO: 74858
  chr12:53454914-53455137
  Hypo

SEQ ID NO: 107691 - DNA, 30 bp, Homo sapiens; identical to SEQ ID NO: 43464
  chr12:53455806-53455836
  Hypo

SEQ ID NO: 107692 - DNA, 38 bp, Homo sapiens; identical to SEQ ID NO: 74860
  chr12:53456042-53456080
  Hypo

SEQ ID NO: 107693 - DNA, 50 bp, Homo sapiens; identical to SEQ ID NO: 74861
  chr12:53509507-53509557
  Hypo

SEQ ID NO: 107694 - DNA, 15 bp, Homo sapiens
  chr12:53535782-53535797
  Hypo
cggttggagtgtgtg

SEQ ID NO: 107695 - DNA, 240 bp, Homo sapiens; identical to SEQ ID NO: 43466
  chr12:53662984-53663224
  Hypo

SEQ ID NO: 107696 - DNA, 35 bp, Homo sapiens; identical to SEQ ID NO: 74864
  chr12:53668208-53668243
  Hypo

SEQ ID NO: 107697 - DNA, 330 bp, Homo sapiens; identical to SEQ ID NO: 74866
  chr12:53719553-53719883
  Hyper

SEQ ID NO: 107698 - DNA, 120 bp, Homo sapiens; identical to SEQ ID NO: 74867
  chr12:53763895-53764015
  Hypo

SEQ ID NO: 107699 - DNA, 36 bp, Homo sapiens; identical to SEQ ID NO: 74868
  chr12:53785467-53785503
  Hypo

SEQ ID NO: 107700 - DNA, 16 bp, Homo sapiens
  chr12:53810619-53810635
  Hypo
aggtgtggtggctcac

SEQ ID NO: 107701 - DNA, 30 bp, Homo sapiens; identical to SEQ ID NO: 43467
  chr12:53813830-53813860
  Hypo

SEQ ID NO: 107702 - DNA, 42 bp, Homo sapiens; identical to SEQ ID NO: 74871
  chr12:53832375-53832417
  Hypo

SEQ ID NO: 107703 - DNA, 120 bp, Homo sapiens; identical to SEQ ID NO: 43468
  chr12:53885488-53885608
  Hypo

SEQ ID NO: 107704 - DNA, 30 bp, Homo sapiens; identical to SEQ ID NO: 74874
  chr12:54021415-54021445
  Hypo

SEQ ID NO: 107705 - DNA, 564 bp, Homo sapiens; identical to SEQ ID NO: 34393
  chr12:54089081-54089645
  Hyper

SEQ ID NO: 107706 - DNA, 287 bp, Homo sapiens; identical to SEQ ID NO: 74876
  chr12:54132239-54132526
  Hyper

SEQ ID NO: 107707 - DNA, 52 bp, Homo sapiens; identical to SEQ ID NO: 74877
  chr12:54133602-54133654
  Hyper

SEQ ID NO: 107708 - DNA, 1133 bp, Homo sapiens
  chr12:54144839-54145972
  Hyper
tcacacacacacacacgcacacactcactcctgcgcacacaggctgctccgcggacacgcttcacggagcaggtgtgcccacgcgcaataccctcctggcccacaggcctccgcacgcacaggacacacacacacactctctcctggcctccctcccgccgcccctcctctgagccctgcggcccggccttccgcacctcccaacgcctgcaggggttgggggcgctggggctcggggcgctcactcggacctcggagccaatcgccagagatctaatggctcctttggcagtgggaaggggtgtgcgtgggtgtcctctccttcactctttccccagccctgtcgcctcccaccccccttccggccgcggcagtttccgaaatcgcccggcggccgcgaattcattagtggggggcggatgtaaacgcagcgcggtggaacgttttaattaggcctgaacaataaacaagctaaacgaggcgcgcaggactccctggtgggccctcagcctcctccgcgcggcgcggactcattacggctgcagccaatttcatgccagcgccgagcactggctgggccgggagtggggtcgggggtgcgtgcgggtgcgatccgggcctgcagggtgcggagcgggggcgtcccggggcgagggcagcgggccggttcccgcccgcccggggccgcggcttccgcatttctgcaccatccacctgcctttttcagtgtccttgagatgacgctccctccccacaccagagcggccggctggagagtctagcttgctttttagggtctctctcccgcctcttttcctcccccgctccctctctccttgcggctgactccagctccccctcggtgcccgtaaccctcctttcctctttttgccgcagtctccgtctctcttccacagggtctctccctccccctctccccgtggttgtcagactttctcctggactttctccgccccgcaccgcccgccccggatgccgagcgtggtagactctgcagccgggctcctcgctgcccgctggcgctgcctacacccccttgggctcccctccaaggtcccctccgctcgcccctctctgcccgctgccgccgccgccgccgccttccaggcctc

SEQ ID NO: 107709 - DNA, 964 bp, Homo sapiens; identical to SEQ ID NO: 74880
  chr12:54321250-54322214
  Hyper

SEQ ID NO: 107710 - DNA, 433 bp, Homo sapiens; identical to SEQ ID NO: 74881
  chr12:54324532-54324965
  Hyper

SEQ ID NO: 107711 - DNA, 661 bp, Homo sapiens
  chr12:54329256-54329917
  Hyper
gcacgcaagcgcacgcgcacacgcacatacacagacgcttcccgtgaaaaagcatattaaatatctcctttctgtgttggatcatttaaaagaaaacatttcagagttgaacttagccgagagcttggttcatgagctgtagctgagggcagagtggcttctgccgctccgcggttgtagaagtccctttgaaaaagcagccgagagcagagccggggcttcccgacgaggctgaggagccgttttccattttcctttcgtataattaaatgctccgtctttctccgcataccagcagctggattttctctaaacttcatccacagtcaaacctcactgcctcatccccgaaggccggcggggcgcgcccgggtgagcaccgcagccgagggtttcagcgccaggccctggaaaggctttctagggcgagatcgccttggagatgtaattactacgtttctagtggtgcatattctcctggagtgtttaatttgattttacttgtgtctcagcgagatccacatttttttttcgggggagggggaagaaaccaccccaggcttaaagttaattaaccagcaaggctttactttccaccgccctcctgcaggctcttgcctcggcgcctcccttcccgatcccggctcgccccagacttgga

SEQ ID NO: 107712 - DNA, 292 bp, Homo sapiens; identical to SEQ ID NO: 74884
  chr12:54330283-54330575
  Hyper

SEQ ID NO: 107713 - DNA, 345 bp, Homo sapiens; identical to SEQ ID NO: 74885
  chr12:54330790-54331135
  Hyper

SEQ ID NO: 107714 - DNA, 42 bp, Homo sapiens; identical to SEQ ID NO: 74886
  chr12:54331998-54332040
  Hyper

SEQ ID NO: 107715 - DNA, 1114 bp, Homo sapiens; identical to SEQ ID NO: 74887
  chr12:54332740-54333854
  Hyper

SEQ ID NO: 107716 - DNA, 923 bp, Homo sapiens
  chr12:54338666-54339589
  Hyper
gcaatcctctggccccgttgagcccctgccagaactctgtgcctaggcagcctcgggtcctctatctcagtccagccgcttgcctcacttcttcccgcttgccttatctccccgcagacgtggttcccctgcagcccgaggtgagcagctaccggcgcgggcgcaagaaacgcgtgccctacactaaggtgcagctgaaggagctagagaaggaatacgcggctagcaagttcatcaccaaagagaagcgccggcgcatctccgccaccacgaacctctctgagcgccaggtaaccatctggttccagaaccggcgggtcaaagagaagaaggtggtcagcaaatcgaaagcgcctcatctccactccacctgaccacccacccgctgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaattcttgcctcatcctatgaccaggcttttagaggaccttccctaagggcgcagcttcggagcaggatctgtccagctcatactttccttcgctgtccctcccgcactccttaggcaagatttcccagtaaagattttctgtgcgtattttaaaagtcgtgttaatactcat

SEQ ID NO: 107717 - DNA, 292 bp, Homo sapiens
  chr12:54343569-54343861
  Hyper
aaggccttgatcttccggtggccagcgaaggggagggctgcttgcccccttgacgcgccatcccccttcccgcaggagcccgccgcctctgtttacacacagaggaggtgtcgtctccagtctagacaagggcgctaataacgcccataaaaggcggcctctccagagatgctctggcaactccgctcccgcgcgcctgccgctggccgctttctccacctccccccgccccgcccttctctgataccttggcgaggccggcgcacgggcctggggacggggaatccagaag

SEQ ID NO: 107718 - DNA, 196 bp, Homo sapiens; identical to SEQ ID NO: 74891
  chr12:54345040-54345236
  Hyper

SEQ ID NO: 107719 - DNA, 465 bp, Homo sapiens
  chr12:54345567-54346032
  Hyper
agagttcgcaccaatcgctccacggtttgggtgcctcggcctgaccacctatagttttgcgcatggtcagcgaagtgccggcgggttaagcccggctagacacggctgccccgactccttgggatgcgagtccctcgcccagccccagcctgctcccggcgaacagctctcgccgaggctggatttagattttaagcgtctcacccgagcctcccgccggccccggggacccagactgggagctgcatttttgtccgagcccggttaaaaaacgggtgcctgagttgcgtgtgtcgcggggttccttaaccacaaacggagcctcggtggtgcaccggaaggctggacgcttagattacctgggtccttgccagagtcctgaaaacccctaggttcccggtgggtctcagggagcaggacaccggggatgcgaattttgctagtggttgtcgacagctctccctg

SEQ ID NO: 107720 - DNA, 653 bp, Homo sapiens
  chr12:54348738-54349391
  Hyper
ccgggtttgtggggccgctggtaaacatccacacgggagacaccttctacttccccaacttccgcgcgtccggggcgcagcttcccgggctgccttcgctgtcctacccacgccgcgacaacgtgtgctccctgtcctggccgtcggcggagccgtgcaatggctacccgcagccctacctcggcagcccagtgtctctcaaccctcccttcggccgcacgtgcgagctggcgcgcgtggaggacggcaagggttactaccgcgagccgtgcgccgagggtggcggcgggggcctgaagcgtgaggagcgcgggcgcgacccgggagccgggcccggggcagcgctgctcccgctggagccgtcggggccgcctgcgctcggcttcaagtacgactacgcggcgggcggcggcggtggcgacggcggcggcggcgcaggacctccgcacgacccgccctcctgccagtcgctggaatccgactccagttcgtccctgctcaacgagggcaacaagggcgccggcgcaggcgaccccggcagcttggtatcgccgttgaaccccggcggcgggctctcggccagcggtaaggaccccggccactcaagcggcggattcaaacccgacctcttaccagggcgggcagaacaggac

SEQ ID NO: 107721 - DNA, 998 bp, Homo sapiens
  chr12:54354476-54355474
  Hyper
tctgctccactctgacgtgcacagacgaaattgagtatttaaagccactaagccgctatcgagccggcaggtgatgggtccggccgtctgggttctgtgggtgctaatgtagccggaaatccggcgcgatcgatggctgagacccagagcagagcagggaccgctggccccggtccgcgaacaaagcaaactccggggacttggggttccggccaggccggagcccctgcccaccctccctgctatatccaggaaagcagaagcggtttttcggccccaggccgcgcgagaaacgcactctggagccgccaatcctctctgcatggcacctggaggcgcggaaggttccggtgtaattcagcgggaggtggaaggcaggccccgatcccacagcgcgcctatgctcagcctttggtccgagcggccgccctcctgcgtgtgcctcggtccagacggcgctgccgattttccaaggagaggccgtggcccgcgtccgccgctgcaggactccccagcttcgccctccgctccgcgctgcagccctgcgcggtgctctcggttgccactctagccgaggcctcgagacaaagacgcgccgggcactggtggacgacccgggcgcctgggacactccctgactcgcgcctggagtgctcagcatcccggccctgtggcgaaggttgtgagaccttggtccaattccccgaccgtcgtggtcccggctgcggtcctctccagggtccagggagaggaaacccggcgcgcccacagccccggctgactcgagcagctcccgcgcccgacagcgccggcagctctggtctcctccggagggctgctgtgcccccgcgaaggacgagatgacccctgctggccggagctgtggaggttgcctcgccgagacccggatctgtccagtcgctcgtccctgagcaccctaggcgttggggggacgccctgtgagtgtgagagacctccaagagcggctggagtctgag

SEQ ID NO: 107722 - DNA, 465 bp, Homo sapiens
  chr12:54359619-54360084
  Hyper
aaagataaaaagaggcgggagggaggcagaagcaagggtcggctgttgctctccctcgcccgggcgcctgcagcagtctgggtgggcgggggcgccatgacaaagtgaaggtcaagttagcatcgtaccttataaggaaggcgccggtcctccatttcagccttttctctgccaggacgcggccgtggcatttctggtcttgtaaacatcagactctttggggccttaaaaaaataaagacgcccctccttcctttaccgggggtgagccggccggggaaagcggcggacagggaaatcaactaatgaagactccgggaaacttttctctctttttctctctctggctccgctccccgccagctggggacccttccctccctccttcctccccctcccttcccccgcctctctttttctctatctcccagtcttctgtacctctcgccgccgtctgtaactctgg

SEQ ID NO: 107723 - DNA, 80 bp, Homo sapiens; identical to SEQ ID NO: 74900
  chr12:54360569-54360649
  Hyper

SEQ ID NO: 107724 - DNA, 120 bp, Homo sapiens; identical to SEQ ID NO: 74901
  chr12:54363641-54363761
  Hyper

SEQ ID NO: 107725 - DNA, 781 bp, Homo sapiens
  chr12:54366849-54367630
  Hyper
cccctcctacgtctgcgaagtgctccgaactgatatatgacaatatctactttggatcacgtgctcagagagagagagactaagacggataacgcgtcatctcgccttcccaaattttcccccctcgctagaccgggtccaaaacctccatccggagccggcaggagaggagaacgatgtttaactcggtcaacctgggcaacttctgctctccgtcgcgcaaggagaggggcgcagatttcggcgagcgagggagctgcgcctccaacctctatctgcccagttgcacttactacatgcccgagttctccacggtctcctccttcctgccccaggccccctctcgtcagatctcctatccctactcggcccaagtgcccccggtccgggaggtctcctacggcctggagccatccggcaagtggcaccatcggaacagctactcctcctgctatgcggcggccgacgagcttatgcaccgggagtgcctgcctccttccaccgtcaccgagatcctcatgaaaaacgaaggctcctacggcggccaccaccaccccagcgccccgcacgcaacccccgccggcttctactcctcagtcaacaagaacagcgtcctgcctcaagccttcgaccgtttcttcgacaacgcctactgcggtggcggcgacccgcccgccgagcccccctgctccggcaagggcgaggccaagggggagcccgaggcacccccggcctcgggactggcgtcccgggctgaggcgggtgccgaggcggaggctga

SEQ ID NO: 107726 - DNA, 135 bp, Homo sapiens; identical to SEQ ID NO: 74904
  chr12:54368297-54368432
  Hyper

SEQ ID NO: 107727 - DNA, 355 bp, Homo sapiens; identical to SEQ ID NO: 34422
  chr12:54368647-54369002
  Hyper

SEQ ID NO: 107728 - DNA, 44 bp, Homo sapiens; identical to SEQ ID NO: 74906
  chr12:54369259-54369303
  Hyper

SEQ ID NO: 107729 - DNA, 154 bp, Homo sapiens; identical to SEQ ID NO: 74907
  chr12:54377085-54377239
  Hyper

SEQ ID NO: 107730 - DNA, 474 bp, Homo sapiens
  chr12:54377853-54378327
  Hyper
tgtgtgctggtttcccgtgtgatacgtgactcctccaaactgaccgaggctccgcaggttccctctttctttcccggaatattccctgttttagcgggggcaaggtcaagcggaaagcgaggaccgccagggcctgaagtaaagcagcagaaccggctccaaggccaaagccttgtgggcccctgagatggtgacccaggagccgcccaccctgccaggcccaggccacagctctcgggtcggggatcgggtgcctctggtctctggcttcctctttcccctaccccgcgtccattcggaacctccttttccgagcagccatgaagtgaccgtgaccccctccctggcccaccctagaggctggagattcccagtcaacccccacaggaaacttgcaactccagcgccgcggcccccaagcttccagccccgagggccaagcccggggaaaagaggaggcgggagagcagaaac

SEQ ID NO: 107731 - DNA, 1672 bp, Homo sapiens
  chr12:54378720-54380392
  Hyper
cgcggggaagggctccggtgcccctaccccgaggcagctgctagatggcgctgttactccactctgcgcgctccgcctgccgacaacttgaccccgctgacgtcacggccgtctgaatcatcaaggccattttcaaatcccattggtctagccgtcacatggtgagaaccgaatgcgcggataattacggagctgatatttccccccctccccttctttttcctccctcccctccaaccgcgccccccctcccggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaaggtaaggccgcctgggccgcgggcgccactgggacgttccggcacttggtcttcgcggccggggaggggggcaggggagagggttgggcccaggaggccccagaccatttcgggaatgcgaccctggctttcgactagcgtccgctgagctccaggctggtggcgcgtcacttagctggggaaggtaagcggcgacgtggaggtgtcggccctgccccggccatgggtgctaaggcgggggcggtgcgcaccgcgggccgcctgcaggcgcagtgtgctgcaccggacgggtggctgctcccaggcgcgtgctggctgtggtttgctttctcaatgctggtgtcctggggagctgacgtcccccagctcaggtcaggggcttgcaaaaagcctaaaatggcgatcttgggccagggactagggaaggctggggagatggggggagttctctttactgcgttttcccagttgaaaattgtttcctgcgaaacgcgatttgttgtttgtgggtctgatttgtgcgtgcggcttgggctcctgcggcttttggctcggccgggggccttgggcagcgaggctggagccggaagaggtggagg

SEQ ID NO: 107732 - DNA, 191 bp, Homo sapiens
  chr12:54384576-54384767
  Hyper
aggaggaggaggcagcgacaaggtaagagaagcggtttcttgttcttctcttggcggcggagtggggatgagcggtgtccccaggtgtccggcgtgcagcggacagagcctggaggaaggtgtttagggcatccgtgcttgccgagaacccaggctttcctagtggccgctggcagcggagggcagcgact

SEQ ID NO: 107733 - DNA, 536 bp, Homo sapiens; identical to SEQ ID NO: 74914
  chr12:54387818-54388354
  Hyper

SEQ ID NO: 107734 - DNA, 251 bp, Homo sapiens; identical to SEQ ID NO: 74915
  chr12:54388604-54388855
  Hyper

SEQ ID NO: 107735 - DNA, 210 bp, Homo sapiens; identical to SEQ ID NO: 74916
  chr12:54389111-54389321
  Hyper

SEQ ID NO: 107736 - DNA, 497 bp, Homo sapiens
  chr12:54391267-54391764
  Hyper
gacagaagtggccgccgcgcccggagccggtcccgcggcaaaggcccggcaagccagcgggctgcacaatgccacggctgctccgccagctcgcccctgccccgtcctgcctgcctacggccgcccttcctccgcctccctctctgcacgcctgcctttcccggctctcctatctcttttcatcttgccttccttcttttaattctcccccttttttccctttattctaatgctccgcttccttctttcctctcttgggcctgactccatgtttcagttggtctgtcccaggctgtctcgggttcagtctctctcaggctctgtcccctgatgtcctcttggtctcagtctggccccgggccccgctgagggctaaacgtctctgctcatcgctgccagcagccgcccaagtgccgggcccggtcctcagccgccctgggctgggggaggtgctggctgtactggggatttggagaaagcctcggcagggggactgg

SEQ ID NO: 107737 - DNA, 30 bp, Homo sapiens; identical to SEQ ID NO: 74919
  chr12:54392718-54392748
  Hyper

SEQ ID NO: 107738 - DNA, 1375 bp, Homo sapiens
  chr12:54393359-54394734
  Hyper
cacactatttaaaaacgcatttttaaaagccacgttccgaactgacaatcgctgatctcggctcgcgcagagactgcgggagcgtcggggccgacagagacggattacgtcaagaaatagttcctccacctacctcggtcggcctccccgcccctgcggggctcccgcgcccagctcggccctgggggtccgagaaccctggcttcggggactggcattttcaccccattaaaaaatcctcatggttggggggaggccatctgcttatgggtggacatgggcacaggggcttctcagatgagctaggagccgtcctgagggggtgaccggtgccttgggtccagagttccggacccccaggaaatcgcaggtcgcggggagcagcagagagaagggggtgggagagggggaaaagaaggcaaggaaaaaaaagcccctgcgcattgatccgcgccgtatttttgggtaaatacgatcacgtgggggccggggagccaatgagctgtggggaaaaggctggaaaaataattacctgacttgattgttctgtgagcagataaaaagtacatatacagttcatacaataatcttatgtatgtaaaaccccgttacgatgtcggcgacggggcccatcagtaactattacgtggactcgctcatctctcacgacaatgaagacctcctagcgtccaggtttccggccaccggggctcatcccgccgccgccagacccagcggtttggtgccggactgtagcgattttccgtcctgtagcttcgcgcccaagccggcagtgttcagcacgtcgtgggcgcccgtgccctctcagtcgtccgtggtatatcacccgtacggcccccagccccacctcggcgccgacacgcgctacatgcggacttggctcgagccgctgtccggcgccgtctccttccccagcttcccggccgggggccgtcactacgccctcaagccggacgcctaccccgggcgccgcgcggactgcggcccaggggagggccgcagctacccggactacatgtacggctcgcccggggagctgcgcgaccgcgccccgcagacactgccctcgcccgaggcggacgcgctcgccggcagcaagcacaaagaggagaaggccgacctggaccccagtaagttgggagcaattttcctttacaaccggcgcgggaggggaggggaggacgggcgggggcagccgaattacagccctcccgaaccgtgcagggagcgcgggagaggggcgagggggcgaggactcaataaaagcgaattaccttggggagctttcaggggcaggaggtctgagaatggggcccagggagacaggttgggagagggccgaggggagctcctc

SEQ ID NO: 107739 - DNA, 958 bp, Homo sapiens
  chr12:54398709-54399667
  Hyper
cctctctcccctggtcgggagcgctgggatgcgggcttctctcccagaccgagagcggcgtttccgggcttccaccccgcccctgctcccaggccctgtcgcctcccctcagcgtccatcagcgcggcctgcttcctgcagccggcctgagcggccttactgcgggcaggaaggagggccgcgggcttggaggaccctgaggaaagcatgggatgcagaacaggcccacccggcccggcccactgttcaatcccagcccagcctgcaggtcaggattggaatcattttttattcgctatcatttacgaattaacaacacaacacgcatctggggaaagaaatgaaagctgggggtagagaggggctagcaaacgccctcttcccctaatcttcccctcccacctctcctctgctcctttgtcagaatcacaaaaccctaaagattgttccacttgagaaggcagcggataggtacatttccgcagccccgaaatgccacttttatggcgctgtttgtctccctgttctgggttctcaatggggccgaacaaaacagcagcgcggagctggctagacgtctgggcttaattgttttatggtttaaataaggtggacactttcctttgaaatcggattataggaatgttttgtctatggcccacggagaacaggacctcactggctgagagggagaggtggagagcgcgcgcgcgagagggatgggctacaaaccaggggtcaaacagcctggagaagtccgagtcccaccccaaagtcctgcaggcggcggcggaatagtcggtgcggggccagcatcagggtaagaggagggaggactttagggtgcgcgccgcgggcaagccgtcgtgggagcctcggagcgtgcatccgcgttcgcggagatgttccaagcccagaaatgcgcctgaatggggggagatcgcggcagttgctttgc

SEQ ID NO: 107740 - DNA, 160 bp, Homo sapiens; identical to SEQ ID NO: 74926
  chr12:54402652-54402812
  Hyper

SEQ ID NO: 107741 - DNA, 820 bp, Homo sapiens; identical to SEQ ID NO: 74927
  chr12:54402872-54403692
  Hyper

SEQ ID NO: 107742 - DNA, 30 bp, Homo sapiens; identical to SEQ ID NO: 74928
  chr12:54404826-54404856
  Hyper

SEQ ID NO: 107743 - DNA, 476 bp, Homo sapiens; identical to SEQ ID NO: 74929
  chr12:54408316-54408792
  Hyper

SEQ ID NO: 107744 - DNA, 78 bp, Homo sapiens; identical to SEQ ID NO: 74930
  chr12:54410286-54410364
  Hyper

SEQ ID NO: 107745 - DNA, 30 bp, Homo sapiens
  chr12:54420671-54420701
  Hyper
aaagatcataaaatccggcgacatccgggt

SEQ ID NO: 107746 - DNA, 30 bp, Homo sapiens; identical to SEQ ID NO: 74931
  chr12:54422111-54422141
  Hyper

SEQ ID NO: 107747 - DNA, 94 bp, Homo sapiens; identical to SEQ ID NO: 74932
  chr12:54422431-54422525
  Hyper

SEQ ID NO: 107748 - DNA, 434 bp, Homo sapiens
  chr12:54424752-54425186
  Hyper
ccttctgttcgttctcgcgatcgcactgaggggctgggaggcctctctgggctccctgcgcggagcaacacacacaccctgcgggaaaaagccgcgtaggattttgttgcggggggagctgggatcagtcggtttgggcaccaaccccacgcaggcctttcttcctgcctgtggcagccggtgtcctcggcgtccgaaccctgaggcgccccgaaagaccagtaaagaagcactatccaggcaccagggtctcctccacccactcccgggagttggaggcggggggcgccgtgagagcaagccccaggcccgcgccaagctggctgttgcgaaacgtagcggaggcggagagcggagggaaagagaagaccgcgggactggagccctgtcggcagggattgagcgattcaaggacatctcgagagagaaagcct

SEQ ID NO: 107749 - DNA, 49 bp, Homo sapiens
  chr12:54427258-54427307
  Hyper
tcaaagaggagcaggcgcagacagggcagcccgccggactgagccagcc

SEQ ID NO: 107750 - DNA, 51 bp, Homo sapiens
  chr12:54427910-54427961
  Hyper
gggctggcccgcctgcggcccgcgtggcctgtcttgcggctctcgcctcct

SEQ ID NO: 107751 - DNA, 161 bp, Homo sapiens
  chr12:54428267-54428428
  Hyper
gctctttagaggcagcgggggaggcccgcagagcgcgcccctagccggttcctgtccctgcgcctttccttttcgcctttcctctctatatttcgggtcgggggcaggtgctggagcactgggctcccgggccccacagacaaaagcgcttttccttggca

SEQ ID NO: 107752 - DNA, 356 bp, Homo sapiens
  chr12:54440843-54441199
  Hyper
tcttctggtgcttctcgcccgccagcgcagggcccaggtgtttgaggcgaaggggctctagctccccgcaagcctggagccaggcgtcgcgcttcctccgggcttaatccagacctttcaacacacacctcattcgggggaggagaaaagcacaggaccgcggagagcccagctttgaggccaggcctgaagggataacccacacagggaacgttttcctatcagagaataatggagcacaaaataattcagaaagcgaatgggcaggaccacagcctgagagtcccgcgccgcggggccgctgcagagccggtctcccgagcaccgcggcaggaccatttcgttggaatgtaggg

SEQ ID NO: 107753 - DNA, 30 bp, Homo sapiens; identical to SEQ ID NO: 34445
  chr12:54446784-54446814
  Hyper

SEQ ID NO: 107754 - DNA, 30 bp, Homo sapiens
  chr12:54447414-54447444
  Hyper
gggttgtcagtctggcgggatgtgcactgg

SEQ ID NO: 107755 - DNA, 223 bp, Homo sapiens
  chr12:54447818-54448041
  Hyper
gccggaccagggaatcgggattccagcatcaccaccaggagctgtacccaccaccgcctccgcgccctagctaccctgagcgccagtatagctgcaccagtctccaggggcccggcaattcgcgaggccacgggccggcccaggcgggccaccaccaccccgagaaatcacagtcgctctgcgagccggcgcctctctcaggcgcctccgcctccccgtcccc

SEQ ID NO: 107756 - DNA, 30 bp, Homo sapiens; identical to SEQ ID NO: 74940
  chr12:54475536-54475566
  Hyper

SEQ ID NO: 107757 - DNA, 228 bp, Homo sapiens
  chr12:54484237-54484465
  Hyper
ggagggagggactcccgggctcgccaaacagcggggcctcgggcaagagcgtcgccagcgcgtcctcattctgcgattactgtcaggggaccatccatcagcgccgcccgggacgctgggccagactgcccgccgcccgcccgggtctctccagatcgcattagcgtggggcgagggcgcagtgcggcaccggctgctgagggagaggcgtggcggggaggggggcgg

SEQ ID NO: 107758 - DNA, 102 bp, Homo sapiens; identical to SEQ ID NO: 74943
  chr12:54500112-54500214
  Hyper

SEQ ID NO: 107759 - DNA, 30 bp, Homo sapiens
  chr12:54500684-54500714
  Hyper
ccgcgagatccctgccgctccagttcggaa

SEQ ID NO: 107760 - DNA, 1081 bp, Homo sapiens
  chr12:54519930-54521011
  Hyper
ttcaccctcccttttcgccatgtgggggccctgagcgccgccccagaagaggtcgagggaatgttgtgggctggggcacaccagcacggcagaaactggagaaagcgagagacgtcgccagggacccagggacctctccctccagttccccgggcccgcccggccctgatggccactcacgctatagcgcccactctgtcctgggccatcccgcgccagcagtgtagcccccagcccgggcgcctgaatgctctccctccggatcgctgctcgggtccccactttggcgaccgtgcccccgagtcctgcttccccggggcctgctctgtatcaggcgcctgcgccttcaagggtacccggcccgcctgccctccccaagagccgagtttgcgctcctcccggaatcgtttgagagaaggacaaacttttggcaggatggaaatctagatgagcctgtccggagcaggtaagctgggcccgggacgggtgcgattcagcccgagaacaatctgtctctccccgtcccggtctctccctccccttacccctgtttcccctgcaggctgacatattaatctgccttcccccgggagaaatttgggctggggttgggcttctgtcagatgcatggggtcagagcagctttcctccccgagtttagggactaaggtggtagctggcaggggagggggagggttgcttccgaaactgaggattgaggggagggttaggggccgagaaacccagagtctgagggagacgacttctttcctcaaacgcaacttgggggaacttcggaaaagttttttgaggggagatggagaagggagcggagttggggtttcgagggctaaagtgggagagagggtgctccgcttcccgtactgaaggaaggatgtgtgtgcttattccccagtcgggaccgattaccagcctagaaaaacccagccgcgtcccaaacccgctcaccccagcaggcccttagagacgcttggagatccccagacacgccccgcggaaagggaaggaaatgccagcccgagttgccgactctgccgggacggggcgggggatccgccca

SEQ ID NO: 107761 - DNA, 188 bp, Homo sapiens; identical to SEQ ID NO: 74946
  chr12:54567315-54567503
  Hyper

SEQ ID NO: 107762 - DNA, 30 bp, Homo sapiens; identical to SEQ ID NO: 74947
  chr12:54609854-54609884
  Hyper

SEQ ID NO: 107763 - DNA, 94 bp, Homo sapiens; identical to SEQ ID NO: 74948
  chr12:54611458-54611552
  Hyper

SEQ ID NO: 107764 - DNA, 83 bp, Homo sapiens; identical to SEQ ID NO: 74949
  chr12:54720220-54720303
  Hypo

SEQ ID NO: 107765 - DNA, 37 bp, Homo sapiens; identical to SEQ ID NO: 74950
  chr12:54767860-54767897
  Hypo

SEQ ID NO: 107766 - DNA, 640 bp, Homo sapiens; identical to SEQ ID NO: 74951
  chr12:54811982-54812622
  Hyper

SEQ ID NO: 107767 - DNA, 50 bp, Homo sapiens; identical to SEQ ID NO: 74952
  chr12:54812829-54812879
  Hyper

SEQ ID NO: 107768 - DNA, 164 bp, Homo sapiens; identical to SEQ ID NO: 74953
  chr12:54914315-54914479
  Hypo

SEQ ID NO: 107769 - DNA, 94 bp, Homo sapiens; identical to SEQ ID NO: 74954
  chr12:54936727-54936821
  Hypo

SEQ ID NO: 107770 - DNA, 95 bp, Homo sapiens; identical to SEQ ID NO: 74955
  chr12:54942993-54943088
  Hyper

SEQ ID NO: 107771 - DNA, 72 bp, Homo sapiens; identical to SEQ ID NO: 74956
  chr12:54943351-54943423
  Hyper

SEQ ID NO: 107772 - DNA, 125 bp, Homo sapiens; identical to SEQ ID NO: 74957
  chr12:54982532-54982657
  Hyper

SEQ ID NO: 107773 - DNA, 111 bp, Homo sapiens; identical to SEQ ID NO: 43470
  chr12:55356770-55356881
  Hypo

SEQ ID NO: 107774 - DNA, 30 bp, Homo sapiens; identical to SEQ ID NO: 74959
  chr12:55390771-55390801
  Hypo

SEQ ID NO: 107775 - DNA, 30 bp, Homo sapiens; identical to SEQ ID NO: 74961
  chr12:55413842-55413872
  Hyper

SEQ ID NO: 107776 - DNA, 30 bp, Homo sapiens; identical to SEQ ID NO: 74964
  chr12:55632656-55632686
  Hypo

SEQ ID NO: 107777 - DNA, 86 bp, Homo sapiens; identical to SEQ ID NO: 74965
  chr12:55786340-55786426
  Hypo

SEQ ID NO: 107778 - DNA, 51 bp, Homo sapiens; identical to SEQ ID NO: 74966
  chr12:56031566-56031617
  Hypo

SEQ ID NO: 107779 - DNA, 30 bp, Homo sapiens; identical to SEQ ID NO: 43472
  chr12:56094359-56094389
  Hypo

SEQ ID NO: 107780 - DNA, 41 bp, Homo sapiens; identical to SEQ ID NO: 74968
  chr12:56441277-56441318
  Hypo

SEQ ID NO: 107781 - DNA, 120 bp, Homo sapiens; identical to SEQ ID NO: 74969
  chr12:56881719-56881839
  Hyper

SEQ ID NO: 107782 - DNA, 30 bp, Homo sapiens; identical to SEQ ID NO: 74970
  chr12:56882439-56882469
  Hyper

SEQ ID NO: 107783 - DNA, 39 bp, Homo sapiens; identical to SEQ ID NO: 74972
  chr12:57054141-57054180
  Hypo

SEQ ID NO: 107784 - DNA, 30 bp, Homo sapiens; identical to SEQ ID NO: 74973
  chr12:57054388-57054418
  Hypo

SEQ ID NO: 107785 - DNA, 38 bp, Homo sapiens; identical to SEQ ID NO: 74974
  chr12:57120619-57120657
  Hypo

SEQ ID NO: 107786 - DNA, 30 bp, Homo sapiens; identical to SEQ ID NO: 74977
  chr12:57423345-57423375
  Hypo

SEQ ID NO: 107787 - DNA, 152 bp, Homo sapiens; identical to SEQ ID NO: 74978
  chr12:57483850-57484002
  Hyper

SEQ ID NO: 107788 - DNA, 30 bp, Homo sapiens; identical to SEQ ID NO: 43474
  chr12:57493886-57493916
  Hypo

SEQ ID NO: 107789 - DNA, 285 bp, Homo sapiens; identical to SEQ ID NO: 74980
  chr12:57504479-57504764
  Hyper

SEQ ID NO: 107790 - DNA, 33 bp, Homo sapiens; identical to SEQ ID NO: 74981
  chr12:57522742-57522775
  Hyper

SEQ ID NO: 107791 - DNA, 56 bp, Homo sapiens; identical to SEQ ID NO: 43475
  chr12:57559766-57559822
  Hypo

SEQ ID NO: 107792 - DNA, 152 bp, Homo sapiens; identical to SEQ ID NO: 74983
  chr12:57570049-57570201
  Hypo

SEQ ID NO: 107793 - DNA, 78 bp, Homo sapiens; identical to SEQ ID NO: 74984
  chr12:57576610-57576688
  Hypo

SEQ ID NO: 107794 - DNA, 146 bp, Homo sapiens; identical to SEQ ID NO: 74985
  chr12:57587641-57587787
  Hypo

SEQ ID NO: 107795 - DNA, 30 bp, Homo sapiens; identical to SEQ ID NO: 74986
  chr12:57604796-57604826
  Hypo

SEQ ID NO: 107796 - DNA, 601 bp, Homo sapiens; identical to SEQ ID NO: 74987
  chr12:57613840-57614441
  Hyper

SEQ ID NO: 107797 - DNA, 583 bp, Homo sapiens
  chr12:57618574-57619157
  Hyper
gtggaaagggactggcgtcgatagggctctggcaggatggcgggggacaaccccagcgtctctctctcctctttcttcgtgcacaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggt

SEQ ID NO: 107798 - DNA, 30 bp, Homo sapiens; identical to SEQ ID NO: 74990
  chr12:57620559-57620589
  Hyper

SEQ ID NO: 107799 - DNA, 88 bp, Homo sapiens; identical to SEQ ID NO: 74991
  chr12:57632036-57632124
  Hyper

SEQ ID NO: 107800 - DNA, 64 bp, Homo sapiens; identical to SEQ ID NO: 34460
  chr12:57632479-57632543
  Hyper

SEQ ID NO: 107801 - DNA, 103 bp, Homo sapiens; identical to SEQ ID NO: 74993
  chr12:57635003-57635106
  Hyper

SEQ ID NO: 107802 - DNA, 30 bp, Homo sapiens; identical to SEQ ID NO: 74994
  chr12:57635463-57635493
  Hyper

SEQ ID NO: 107803 - DNA, 30 bp, Homo sapiens; identical to SEQ ID NO: 74996
  chr12:57857277-57857307
  Hypo

SEQ ID NO: 107804 - DNA, 30 bp, Homo sapiens; identical to SEQ ID NO: 74997
  chr12:57862418-57862448
  Hypo

SEQ ID NO: 107805 - DNA, 343 bp, Homo sapiens; identical to SEQ ID NO: 74998
  chr12:57869912-57870255
  Hyper

SEQ ID NO: 107806 - DNA, 341 bp, Homo sapiens; identical to SEQ ID NO: 74999
  chr12:57881038-57881379
  Hypo

SEQ ID NO: 107807 - DNA, 30 bp, Homo sapiens; identical to SEQ ID NO: 75000
  chr12:57939956-57939986
  Hypo

SEQ ID NO: 107808 - DNA, 442 bp, Homo sapiens; identical to SEQ ID NO: 75001
  chr12:57943746-57944188
  Hyper

SEQ ID NO: 107809 - DNA, 62 bp, Homo sapiens; identical to SEQ ID NO: 75002
  chr12:57963777-57963839
  Hypo

SEQ ID NO: 107810 - DNA, 405 bp, Homo sapiens
  chr12:58004542-58004947
  Hyper
tattagcataaagttcgcatctaatttgcatgagacccatttaatcgcagagacctccactcttcttgccttcgagtccaatgtgtgtcccccatcccagtcgatcccgagccctcgcaggcagagtgtccccgcgccccacccctggcccctcgccagcccgggctccaggacttcgccttaattggcgattagtcttagctggagtcccggggcctggaggaaagaagggtcctgagagagggcggcatctgggttgtgttcacccacaaaagactccccatacacgcaccccgtaccagggggcctctgtccactcggccggggacagccccaaacccagaacatcttcgcacaggccaaggccccatccactgagtcctccttcatcgcagaggccaaggg

SEQ ID NO: 107811 - DNA, 574 bp, Homo sapiens
  chr12:58014693-58015267
  Hyper
tctgcatttgtcccccggcggcaggaactttcgccatactcagcctcatgacaggctcggccgtcgagcggctggtgccggaacccctcgtggggaatctgagcggaatcgagaaggagcagctggacgctcaacgggttggggtagccgcggccgtggccttcgggagcggggcgttgatggtgagggaggacccggggaggaacccggggggatccctgctgaggggccagggaaattgggccggggaagagggagggaccagctttcggcttgggttcgggagggcggaggtgcgcggggttggtttgctcctcctctagatggtgacagcgcgtcttctcccccacagctggggatgttcgtgctgcagctcggcgtcttgtccacctttttgtccgagcctgtggtcaaggcgctgaccagcggggccgcgctgcacgtgctcttgtcccagctgccgagcctcttggggttgtccctcccgcgccagatcggctgcttctctctcttcaaggtgggggtggaagaagaaaggagaaggggcttctagaggtcccgtgaatagggaaac

SEQ ID NO: 107812 - DNA, 69 bp, Homo sapiens; identical to SEQ ID NO: 75006
  chr12:58015479-58015548
  Hyper

SEQ ID NO: 107813 - DNA, 700 bp, Homo sapiens
  chr12:58021293-58021993
  Hyper
ccgctggcggctgggcgcgggtgcagcctaggaggagaggcgcgtgaccgtgcgccagctccccgtggggctcctgccagggtcgaccgggagggggtgccactcacccagatgagccacgcggctgaggcgggggtcgaaaccgacctcgcgcaccttgtcagtccgcgccaggaagaagttaaccacgccgtcggtgaccacgcagcctgggaagccgacgagctcgtggtggaagccgcgcctttgccggaggcagttcccgaggcctggggcgccgggctccacgctcagcagctgccgataagtggtggcaaagccggagatctcgcgcaccgcgccccccacctgcagggagagggaggttgcctccaggcgggcctgggataggggacccgaaggggtcaaggtctgcgctccggtgccttcgggggtacccctgccccatcctcttccgcttcacccctgcaggacccagacagttcccaggccccacttcgtggttctctctttgtcctagggctggccgttcctggccgcagcgcccccgctgtggccttagcctgttcaaggcccttctccacccccacatcctgcagcccctgccctaccaggtccagcggcgtccgctccagcacgtccacaagcctctccagccgcgtccgcgccgtgaagacgaagtcgtcgtccacccacagca

SEQ ID NO: 107814 - DNA, 735 bp, Homo sapiens
  chr12:58025580-58026315
  Hyper
tcactccacacagcccgttaggagaatgcaggcatctgagcccagcagtggagaaaacaaaagcccccagaccacccccagcgagcgctgcgctgcgccgccgcggtcggcactcaccccactacttgctccttgatcctgaccgggatgtgtgcgtagcggggctcaggagcaagatctggcagctcgggcctgcgggggctttgcgggggcgcccacggcgcaagaggtagccggaggccgggcgcgtcccgggtgctcgcgtacaggagccccagcgaggcgcaggcgagcagaaggaccagagcgcacagggcccggcggcccagccacatcctaggtgggggtagggtggggagtgagaaagggagggaagaagggagggcaagggatggggcccttggcccccgcgtcctcagaggctcctgccggctcccaagagcgctctccactccacacatcgcgctagggtttgcactgccagccgcggttttcccggtacccctcccctcacttcccaggccccagggtctcccggcctcctttcttctcgccctctcctgcatctcggtttcctcacacacccgaggcctggcatcttaatgctgaagacatttggatgccgcggtttcgacgcggccgtgcgtaagcggaaaagccccgctctatcagggcagtggcagtccccaagcccgccgcccgccctggccggcgcgcccccgactcctcagtctg

SEQ ID NO: 107815 - DNA, 160 bp, Homo sapiens; identical to SEQ ID NO: 75012
  chr12:58125465-58125625
  Hypo

SEQ ID NO: 107816 - DNA, 35 bp, Homo sapiens; identical to SEQ ID NO: 75013
  chr12:58144980-58145015
  Hypo

SEQ ID NO: 107817 - DNA, 87 bp, Homo sapiens; identical to SEQ ID NO: 75014
  chr12:58158951-58159038
  Hyper

SEQ ID NO: 107818 - DNA, 57 bp, Homo sapiens; identical to SEQ ID NO: 75015
  chr12:58159289-58159346
  Hyper

SEQ ID NO: 107819 - DNA, 97 bp, Homo sapiens; identical to SEQ ID NO: 34472
  chr12:58159773-58159870
  Hyper

SEQ ID NO: 107820 - DNA, 124 bp, Homo sapiens; identical to SEQ ID NO: 75017
  chr12:58160215-58160339
  Hyper

SEQ ID NO: 107821 - DNA, 24 bp, Homo sapiens
  chr12:58177383-58177407
  Hypo
tttttttttttcagacggagtctt

SEQ ID NO: 107822 - DNA, 120 bp, Homo sapiens; identical to SEQ ID NO: 75019
  chr12:58204698-58204818
  Hypo

SEQ ID NO: 107823 - DNA, 90 bp, Homo sapiens; identical to SEQ ID NO: 43477
  chr12:58241509-58241599
  Hypo

SEQ ID NO: 107824 - DNA, 30 bp, Homo sapiens; identical to SEQ ID NO: 75022
  chr12:58517132-58517162
  Hypo

SEQ ID NO: 107825 - DNA, 281 bp, Homo sapiens; identical to SEQ ID NO: 75023
  chr12:59313662-59313943
  Hyper

SEQ ID NO: 107826 - DNA, 72 bp, Homo sapiens; identical to SEQ ID NO: 75024
  chr12:59924125-59924197
  Hypo

SEQ ID NO: 107827 - DNA, 46 bp, Homo sapiens; identical to SEQ ID NO: 75025
  chr12:59989556-59989602
  Hyper

SEQ ID NO: 107828 - DNA, 491 bp, Homo sapiens; identical to SEQ ID NO: 75026
  chr12:59990053-59990544
  Hyper

SEQ ID NO: 107829 - DNA, 21 bp, Homo sapiens
  chr12:60167632-60167653
  Hypo
cactcccggcctaaatcaatg

SEQ ID NO: 107830 - DNA, 30 bp, Homo sapiens; identical to SEQ ID NO: 75029
  chr12:62075123-62075153
  Hypo

SEQ ID NO: 107831 - DNA, 42 bp, Homo sapiens; identical to SEQ ID NO: 75030
  chr12:62253491-62253533
  Hypo

SEQ ID NO: 107832 - DNA, 17 bp, Homo sapiens
  chr12:62384406-62384423
  Hypo
cccggcccactgtgcca

SEQ ID NO: 107833 - DNA, 31 bp, Homo sapiens; identical to SEQ ID NO: 43479
  chr12:62539074-62539105
  Hypo

SEQ ID NO: 107834 - DNA, 31 bp, Homo sapiens; identical to SEQ ID NO: 43480
  chr12:62539225-62539256
  Hypo

SEQ ID NO: 107835 - DNA, 42 bp, Homo sapiens; identical to SEQ ID NO: 43481
  chr12:62563338-62563380
  Hypo

SEQ ID NO: 107836 - DNA, 168 bp, Homo sapiens; identical to SEQ ID NO: 43482
  chr12:62580835-62581003
  Hypo

SEQ ID NO: 107837 - DNA, 2088 bp, Homo sapiens
  chr12:62584250-62586338
  Hyper
actagtagcaagatccgggagacatctaaccggaaagaaataaaaaaccattagtttcccgaagccattcttattctgaacgctgttcgttaagagaatcatttactaaagctctcttgtagtagcctttacaaaagctttatttcattcagtaagaaagcgccccgtcccaaatctaaataaaccttacatagatgaggctccggaaattatcagcttgattctttatgaagatagttagaggtggataaatcaatagactcgctgaaacacccaccttctgcaaacaggcctgagaattaactaatcagaagtggacaaaaagtagggatttcagaaagatgacctgacacatcccattgatcttccctggaatgcgacccccaactccttattaagagtccaaaatggttaccagccaggatgggtctgggtgaggaatcgaattacaacccacttcaatcctcgacctggtcgtttgctgttattaggagaaatggggcagagagggagggcaccgctcacggagcctcatttcgcatgctccgatcccctctcggcgtccctctactccgcccctaccctgaccgcccgcgagggagacgccggccgatggacccgcatctgccctcacctctcgccttccccgggcgatccctctacagtcccggacccccgagaaaggggaagggagacgtgtgcacacgggggcttccgggaccgcggtcctgcagttgccgctccggtccccagcgctggccggcgacccgaggcgcggctcgcacctacctgcagccccgcttcccggtggcggcaacacctagcgatgctcctgcagcttttgcgggccggcgccagccttatcgctctcgcatcgcttccaagatgccaatccgccgtcaccatccaggggcatagggaaccgaagtctggtgctgtgtgatcgtggagggcggcgtgtgagtgtggccctgagcgtgcgagtgtgcgcgcgcgtgtgtggatgtgtttcctcctccgatggcaaagacggttcaggaatctgacatccaagctggaatccccctgaagcgggtgaaggtgagcctgatccttctccccgcttctttattccacagtgtcaaagtaatcaaaagatttgtttactgaggaaaagccaaagtcccgcagcccttggcagcgcccgcggtcgcctcctgtcctcgccggatgcgcgcggtgcgctcagctccctggactgcaagaatcaaggcggtcttgctgcaattaccgctcttattccatctctgatttgtttgcttttaaggccgactaaagacttttcctctcgcctcacgtcgtctctccctctcacacacacacacactcacacatcctccgttccctctctcccgccctccctcttgttctctggggaaaggcaattggacagaatgattcaccttcaggaaagcagcctcggccacgcacttctcgagttccctggctctcgcaggtaccgggtctccaacgtggcggagttgctgggaagctcgggacaggaaggaggagaggctctgagctcagccgatgtcccccctccagacgcccgcgttcctccgtccaggtgcccctgttcccactgctcgcagataggtccccgctggtgccctcgcggagacttggcgccttccactcgaatccacttagcagcaactcctggccagcttcagcccctcaatcccgcctcgaagtgctgcgggcagagccccacgcagcccacccgctgcccttctaggcatcgtgggctggaaggaagggaaacccgccgatgtccccctggtagcagtgccctggcaccgtcaccaccgaggaggtgcgagttccaacatcgaacacaagcgagcaggtgtcgcctgtgtcactttgctaaaggcgggaggggagaaagaaaggagcggggggagggggccgaggaaacaaatccagatcaccggcggagaaagaagccgtttagcaagcaaagcctcctctccgcgtcccaccccagatgctatactgtcaaaagacactgatgctaatcttttagaaagtcgccataaagggcag

SEQ ID NO: 107838 - DNA, 22 bp, Homo sapiens
  chr12:62603703-62603725
  Hypo
aggcgcaggggctcacgcctgt

SEQ ID NO: 107839 - DNA, 24 bp, Homo sapiens
  chr12:62630991-62631015
  Hypo
atgatccattctgttcgccgggcg

SEQ ID NO: 107840 - DNA, 175 bp, Homo sapiens; identical to SEQ ID NO: 75040
  chr12:62829159-62829334
  Hyper

SEQ ID NO: 107841 - DNA, 30 bp, Homo sapiens; identical to SEQ ID NO: 75041
  chr12:62862175-62862205
  Hypo

SEQ ID NO: 107842 - DNA, 565 bp, Homo sapiens; identical to SEQ ID NO: 75042
  chr12:63025691-63026256
  Hyper

SEQ ID NO: 107843 - DNA, 40 bp, Homo sapiens; identical to SEQ ID NO: 75043
  chr12:63033701-63033741
  Hypo

SEQ ID NO: 107844 - DNA, 78 bp, Homo sapiens; identical to SEQ ID NO: 75046
  chr12:63195735-63195813
  Hypo

SEQ ID NO: 107845 - DNA, 139 bp, Homo sapiens; identical to SEQ ID NO: 75047
  chr12:63327187-63327326
  Hyper

SEQ ID NO: 107846 - DNA, 1256 bp, Homo sapiens
  chr12:63543750-63545006
  Hyper
gtgcggatcttggcccgggaaatggacttcacgctgctgacacagggtgcgagcaggaaccccttttggaaggccacacccgcttgctctgcacccttgctctggcgcgacgccgtcttcccgcggacgttgcaccagatgttgtagcagatgaagccgtagcaggtacccaagatgaccacgggcgccacaaagatgccgcccgtcatccaggtcacgtaggcacgagaaccccagggctggatgaaggtggcccagcagtcgcgggccttggtgacattgttcacctcgatcatggagaagacgaagtactgcggcgtgctcagcacgaagctcagcacccaggcggccgcgatcatgaggcgcgagcggcgcgcgggctgttgcagagtcttgagcgggtggcacaccgcgatgtagcggtcggctgtcatgactaccagcatgtaggccgacgcaaacatgccgaacacctgcaggtgcttcaccacgcggcacagccagtcggggccgcggaagcggtaggtgatgtcccagcacatttgcggcagcacctggaagaatgccacggccaggtcggccaggctgaggtgtcggatgaagaggtgcatgcgggacgtcttgcgcggcgtccggtgcagagccagcagtacgctgctgttgcccagcacggccaccgcgaaagtcaccgccagcacggcgatctccagtttggccagctcctcgttgcgcacgtccctcggtgggccgttgccctccccgagggcttcggcctcccggcttgtgttgccagcgccggtggccagaggccaccatgggctggagttgcccgagggccccgcgtcgggaccggcggagagacgcatgctgtccatgcagctcctactcggccctcttcggagctccagccctcgcgggccgctccctccccgtctcggaggacttgggctcctcgtccgaagcgcagggtctttggcgcgctcgcagcttgccgggctctgcgatccctccagtgggcgtctcccggagcagcgtcccgcctgcccactgagcagctctcagcagggtgagctggcccctctccctgctctgccttttttcaacttcggcgaggtcgggaaggtgagctccgagcttccggaagcactgggttcccaactcaagtatttatgcggtgcttgtttccttgggacgcgctccctcccgccctattgccggaagactgctggttgcctactccccgctccctggagttt

SEQ ID NO: 107847 - DNA, 319 bp, Homo sapiens
  chr12:63545267-63545586
  Hyper
gaaacctccagtccacgcaccggcgtccacgcatctagctcctgcacctgaacctggctctcgacctcacctcctccagtccgggtttcttccttctcaccgagctcacccgtgcagcagtctggcaaattttattccccaggcaaattttcccggggcaaacatttctccccgctcgtgacttaaagagctatctcttcctagtaacgtctttgatgcatgctatttattaccctatgtttgcgacgggaagaacgcactcatcactttgcagccccagtggctgctgtgcctgtattcacagcggggtttgggggga

SEQ ID NO: 107848 - DNA, 30 bp, Homo sapiens; identical to SEQ ID NO: 43485
  chr12:63788043-63788073
  Hypo

SEQ ID NO: 107849 - DNA, 1373 bp, Homo sapiens
  chr12:64061778-64063151
  Hyper
aagactcaagaaaagcgccatgcggctccctcctagggctctcctgccctctcctcaccgatgccgagagtggttctgctggagaaccgccgcgcctgcagttcctgcaccttttcccggagctgcgccagggaattacggacgaactggaaggggccgagaagaaaggtcttggccaccacctctagctccaagccttttcgctctttcagactttggatcctccccggggaggacctccaggagccccttggcagtttcccgccgcctagggccgacttttccatctcctcctctacctccggctcccgggcgagggaggccccgcgccgccccttagactggctgcggccggaagattgcagccgctttgagcttactccttgttttctcataatcaaggagtatggtggagctgggtcaatttcaggcacagcccagccgagtcaggcgaggtccagagagacctgactcgcctggcagcctcaacggacttgtccccgcagccgttgcggacctcccggtcgtcatggcgactgtgaaatgtggggtggggcgcatgcgttggaagccattcgcgcgggcagtccctgagtgtcccctcacgtgctccccagcgcgagcagcacccccgcctctgcgcttcccagagcgtgcagcttccggtgagggcagccccacgcacagccccccacaccctccccagcgcctgcagcctccggtgcgcgcaggccccaagcccacatgcgcagtcctcaccttgcgcgcagccccatgtacagccccggacgggctcccagccccactggcgcagaacccatcaccgcttgcccttcacgcgcttcattgggagtgcagcccccaccccgagcgcgcagctccacgcagcctctccacactctccccagcgcctgcagcacccccagtgcgcacagctctgccagtcgcttccccgggcgccgcccctgcaccacttcggcccataaccttgcggcgactgtctgaagaacttcccgtggtttcattcttttcttcgggtttagtcttagctgtgacattttaaccaaaagattacacgttaattaacgaggtattaaagggaaagatctcagctgaaagaaatgactgtaggaagtgtgtcagggaagccaacggaaccgccggcccgccggcggtgcgcccggcattaggaacgtctctactcccctacgatcgctgaggtatcggacagtcagtgcccgttgccaacgcagagggaacgggccgagactgcgggcaacaagtggcagagccggcgtgagtccggtgggtctgatcccagagcctcaggttgacgccacttccttggcacgggacagcgtttactgaatctt

SEQ ID NO: 107850 - DNA, 137 bp, Homo sapiens; identical to SEQ ID NO: 75065
  chr12:64783185-64783322
  Hypo

SEQ ID NO: 107851 - DNA, 17 bp, Homo sapiens
  chr12:64783562-64783579
  Hypo
cacggcacccggcctta

SEQ ID NO: 107852 - DNA, 608 bp, Homo sapiens
  chr12:64784092-64784700
  Hyper
ccaggtcaatggccacgacgtcccgcagagccactacccgccggatggacttgggcgggttctcggttaggtagacgagccggtcgcttagcaccacatacttgaggatgtggttctcagagttggacaccacgatgcatggctcgtaggcgcggaccgcgtcgtagacctcgggcggcagatgccgccgcaggaacacatccaggcggctgttcctgcgcgcggggaagccggacggcaaggggctggccatgcccggcgcccgcagcgtggcggagtgctgggactcgaggccctcagctcgccctctccccgcccccgcgctggaacccgcgcgccacaaagccgccggccacgcgtcgcctcctctccaggcgcggggacccgggccgcaactgcaggaatcgacgctaggtcggcttccctggagcgccctccccagccctgtccagcctctcgatctttgtcctaacctcagacggcgatgggcggggcaagacgctggtccttcaggcccgagttgatgggcacctcgggctcatcaccgtgaagtcccctgcggccgaagggcggtggatttttagggtctctcccgcccacccctaatg

SEQ ID NO: 107853 - DNA, 30 bp, Homo sapiens; identical to SEQ ID NO: 75068
  chr12:64797450-64797480
  Hypo

SEQ ID NO: 107854 - DNA, 20 bp, Homo sapiens
  chr12:64799707-64799727
  Hypo
ttgatcgtccaaatgccttc

SEQ ID NO: 107855 - DNA, 24 bp, Homo sapiens
  chr12:65152388-65152412
  Hypo
caccgcgcccggcccaggcttatt

SEQ ID NO: 107856 - DNA, 1890 bp, Homo sapiens
  chr12:65218003-65219893
  Hyper
ttccttcattttctccgcgcctctctaatctgccaggaaataattcaacgcaattcgggctgaagcgtgtgcctcgccgcctgcggttgggtcatggccccttctgagactgctcggaagtgggagaggatgcttgcccttacgggtgttctgcccctgagactggcgccccttggtgctccctctgttccctcccagatcttgggagaagcacggacatctctgtttctgcttttggtccccgaacgcagttacgcgcccactggctccctgtctctggcgcttctgggcacgggggagctggggcggccccgcctgcgcacggcggtgccgggattgggggcgggcacgccgcctccgtctcccacgcgctcgctcgctcgctcgctcccgccctccccgcctcgagcgatctcctgcctcagccttgcaggctccgcactgcagatgcctgctggcttccctgcgctcggcggctcccgcggtgccccgtaagtccccgtgaccctccagcaccagccggctgtgcgctccctgctcccacgggccggtcagccgcagacactcacccagctccgcgagctcagccgctcagcgagtggggtagcggggaccgagacggacggtagccgtgccagagcccggggcgctctcggatgcggcaggacaagctgaccgggtctctgaggcgcggggggagatgcctgaagcggcagggcggcggcgtgggcaccatcctgagcaatgtgctcaagaagcgcagctgcatttcccggaccgcgccccggctgctgtgcaccctggagccgggtgaggaccccagggctgcagatggggcgctgtaaagtagcgccggggctgcccgcgcttctgccttagcctgactccgtctaggccggggagctctggggaaagtccgcgtgccacctggtgcggggcaccgcgttggcacctgcagggagcgattggtctggaagggtagagggcagacgggggcctgggtggggcagcggccaccccaggcgcggagaacccgctgcttccaccctctccccgcggacccccaccctgcggcctgtgtgctcggctttctccgcgtggcggggaagtgcgggtggctgcccgggccctcagaggccgcaccacctattgtgttccaggctcgcaggaagccagaccttgcgagaggtgtgtgggggcggagagtggcacaggtttgacactgcaggtcggaggaggaagacagtggctgcaaaggcaaaatcgggtgttattttcccaagagtcccttcagcgtgagtgccggggtcagctcgaactggagcctgtaatttgtgagtgcgagtggggagcagcaggagatccttttcataggtgaggtccaggaacgagcctggtcgtgctaggcaaggcccttcccactgtcagcctgtgtttacccatccctgcttctccagactgcataactccgtgtcggctccatcacccggcatccctccccgggattttaagagcctggccctagcgcgggctcctgggcacggaggtttctggcaaggagtggctgcagagggagttggctgtactctcactggtgcttggcgctcacctgttccctggagtggcaccggctgcgttccaggcgggttcacggtccccggcccccgccccccagcgccagcgccttggggacctgctgtagagccgcaggagaatcgagctgcagagtcccaaagggtgggatgcggcactgcctttcccaacctcgtggtttctttgttgttctcccctaggaagtgtctagttgcagaggctgtagtatttattcaccatcttcctttacctcttttttttttcttttaaatctccttcccacgttaaaagtaagtg

SEQ ID NO: 107857 - DNA, 327 bp, Homo sapiens; identical to SEQ ID NO: 3911
  chr12:65220112-65220439
  Hyper

SEQ ID NO: 107858 - DNA, 761 bp, Homo sapiens; identical to SEQ ID NO: 75078
  chr12:65514835-65515596
  Hyper

SEQ ID NO: 107859 - DNA, 209 bp, Homo sapiens; identical to SEQ ID NO: 75079
  chr12:65516338-65516547
  Hypo

SEQ ID NO: 107860 - DNA, 29 bp, Homo sapiens
  chr12:65530856-65530885
  Hypo
ctagaaaaggccaggcgtggtggcctttt

SEQ ID NO: 107861 - DNA, 22 bp, Homo sapiens
  chr12:65557212-65557234
  Hypo
gagaagtgatagcatcggccgg

SEQ ID NO: 107862 - DNA, 23 bp, Homo sapiens
  chr12:65562063-65562086
  Hypo
ttgactaacgtttttctgtacag

SEQ ID NO: 107863 - DNA, 99 bp, Homo sapiens; identical to SEQ ID NO: 75083
  chr12:65672426-65672525
  Hyper

SEQ ID NO: 107864 - DNA, 524 bp, Homo sapiens; identical to SEQ ID NO: 75084
  chr12:65672776-65673300
  Hyper

SEQ ID NO: 107865 - DNA, 30 bp, Homo sapiens; identical to SEQ ID NO: 43493
  chr12:65787081-65787111
  Hypo

SEQ ID NO: 107866 - DNA, 151 bp, Homo sapiens; identical to SEQ ID NO: 11310
  chr12:66122419-66122570
  Hyper

SEQ ID NO: 107867 - DNA, 793 bp, Homo sapiens
  chr12:66122773-66123566
  Hyper
ccaatctcccttcctcgagaggtgtctgggcgcaatactctccggcccgaagcaaggggacgtttgcgaggagggagaaatttaaacccccttcgctccgcgccacctgggagcactttggcgccgcagactcaggagccgacgccatctccaggacggcctcggtggcctcggcaggaggcaccttcggggagcggtcccgcactcctccttcctcagtccccggtcctctgcaccgctccctctctgctgccagaggacctgtccgcgagctccccgcgctgccctggggacggaaaagtttgtttctccaacgcgcaactttcccgctccaggcggcggggaccccgagccggagttttggccaaaaaatcccagagtcctatacctcctgcgcgcccagacctcgggggcgaagggcggctcccccggcgcgccccgatccccgccgcaaagaggacttggtggactagaggtgcaccccgcgggcagcccttggcgccccgctctgcgcccgccggcatgaggactcgtgcgtggcgtttcgaccctccgcctgaactgagactgggtggggaaaggggcagactgctgtctgtgactctgcgggaggtggagcacgaaacacaaaagctgtttgaaccacaaacgccaggctggacacccaacgaatattaatgacctgcagcctccacccacccgcaaacataatattatgtgtacgtgcttaccggttagcttaacagacttgccatcataaattcctttttcactgcagcgccactagatttgt

SEQ ID NO: 107868 - DNA, 22 bp, Homo sapiens
  chr12:66133735-66133757
  Hypo
aaagatgttcttggccgggcac

SEQ ID NO: 107869 - DNA, 1179 bp, Homo sapiens; identical to SEQ ID NO: 75090
  chr12:66135064-66136243
  Hyper

SEQ ID NO: 107870 - DNA, 30 bp, Homo sapiens; identical to SEQ ID NO: 75091
  chr12:66188703-66188733
  Hypo

SEQ ID NO: 107871 - DNA, 33 bp, Homo sapiens; identical to SEQ ID NO: 75092
  chr12:66208320-66208353
  Hypo

SEQ ID NO: 107872 - DNA, 30 bp, Homo sapiens; identical to SEQ ID NO: 43495
  chr12:66211140-66211170
  Hypo

SEQ ID NO: 107873 - DNA, 60 bp, Homo sapiens; identical to SEQ ID NO: 75094
  chr12:66216864-66216924
  Hyper

SEQ ID NO: 107874 - DNA, 148 bp, Homo sapiens; identical to SEQ ID NO: 75095
  chr12:66217502-66217650
  Hyper

SEQ ID NO: 107875 - DNA, 33 bp, Homo sapiens; identical to SEQ ID NO: 75096
  chr12:66217887-66217920
  Hyper

SEQ ID NO: 107876 - DNA, 544 bp, Homo sapiens; identical to SEQ ID NO: 75097
  chr12:66218783-66219327
  Hyper

SEQ ID NO: 107877 - DNA, 506 bp, Homo sapiens; identical to SEQ ID NO: 75098
  chr12:66219688-66220194
  Hyper

SEQ ID NO: 107878 - DNA, 22 bp, Homo sapiens
  chr12:66242342-66242364
  Hypo
ttaaaagtttaaggccgggtgc

SEQ ID NO: 107879 - DNA, 28 bp, Homo sapiens
  chr12:66255902-66255930
  Hypo
gtgtgagccaccacgcctggctgtgcaa

SEQ ID NO: 107880 - DNA, 76 bp, Homo sapiens; identical to SEQ ID NO: 75102
  chr12:66282638-66282714
  Hypo

SEQ ID NO: 107881 - DNA, 30 bp, Homo sapiens; identical to SEQ ID NO: 75103
  chr12:66317501-66317531
  Hypo

SEQ ID NO: 107882 - DNA, 22 bp, Homo sapiens
  chr12:66340919-66340941
  Hypo
ggcagagtcttgctccgtcacc

SEQ ID NO: 107883 - DNA, 22 bp, Homo sapiens
  chr12:66341181-66341203
  Hypo
acagtttcgttttaacatctgt

SEQ ID NO: 107884 - DNA, 30 bp, Homo sapiens; identical to SEQ ID NO: 75106
  chr12:66343834-66343864
  Hypo

SEQ ID NO: 107885 - DNA, 37 bp, Homo sapiens; identical to SEQ ID NO: 75107
  chr12:66523437-66523474
  Hypo

SEQ ID NO: 107886 - DNA, 724 bp, Homo sapiens
  chr12:66582721-66583445
  Hyper
cctagccgtggggcacggtgggctcctgggagctctgagctctgggctttctccagttcgcactctgcttgtctcggcagctccgtccccaccgcagaggtgtgaaggggcgcaaagccagcgaagggagaacccgggtcgggtaacccccaggcctggccaggcggacgcaggggcatctcgggcgaggcgcgccttgcgtcacgtgggcaccgcccctgcagtgaccggagaacggcgtgttcctagggctctgctgccgtcgtggaagcaggatttccgcggttgtgtaacggcctgtcgcaggcgtgcagggacctggactccgcctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctgggtgagtcggcggggaccggccgggggcggcgggggagcccagcgcgccgcggggcccgctcggcgtcgccctgcatggctggggtccctcgcggggctggcgcggcctccgggaagttcccgccagggagccggccccctcctttcctgggttggatgcagagactccctgggacccagatgccttccctcccttctctttcaaagaattttgggtatcgctgcaaagtcaag

SEQ ID NO: 107887 - DNA, 427 bp, Homo sapiens; identical to SEQ ID NO: 75111
  chr12:66628990-66629417
  Hyper

SEQ ID NO: 107888 - DNA, 78 bp, Homo sapiens; identical to SEQ ID NO: 75120
  chr12:68759053-68759131
  Hyper

SEQ ID NO: 107889 - DNA, 78 bp, Homo sapiens; identical to SEQ ID NO: 75121
  chr12:68978219-68978297
  Hypo

SEQ ID NO: 107890 - DNA, 78 bp, Homo sapiens; identical to SEQ ID NO: 75122
  chr12:68978597-68978675
  Hypo

SEQ ID NO: 107891 - DNA, 30 bp, Homo sapiens; identical to SEQ ID NO: 75123
  chr12:69128689-69128719
  Hypo

SEQ ID NO: 107892 - DNA, 39 bp, Homo sapiens; identical to SEQ ID NO: 75124
  chr12:69203803-69203842
  Hypo

SEQ ID NO: 107893 - DNA, 95 bp, Homo sapiens; identical to SEQ ID NO: 75125
  chr12:69225853-69225948
  Hypo

SEQ ID NO: 107894 - DNA, 30 bp, Homo sapiens; identical to SEQ ID NO: 75126
  chr12:69326349-69326379
  Hyper

SEQ ID NO: 107895 - DNA, 868 bp, Homo sapiens; identical to SEQ ID NO: 75127
  chr12:69326653-69327521
  Hyper

SEQ ID NO: 107896 - DNA, 46 bp, Homo sapiens; identical to SEQ ID NO: 75128
  chr12:69551179-69551225
  Hyper

SEQ ID NO: 107897 - DNA, 22 bp, Homo sapiens
  chr12:69751028-69751050
  Hypo
tttttgtttttgagacggagtc

SEQ ID NO: 107898 - DNA, 102 bp, Homo sapiens; identical to SEQ ID NO: 75130
  chr12:69754377-69754479
  Hypo

SEQ ID NO: 107899 - DNA, 120 bp, Homo sapiens; identical to SEQ ID NO: 75131
  chr12:69754599-69754719
  Hypo

SEQ ID NO: 107900 - DNA, 30 bp, Homo sapiens; identical to SEQ ID NO: 75132
  chr12:69799375-69799405
  Hypo

SEQ ID NO: 107901 - DNA, 30 bp, Homo sapiens; identical to SEQ ID NO: 75133
  chr12:69810460-69810490
  Hypo

SEQ ID NO: 107902 - DNA, 239 bp, Homo sapiens; identical to SEQ ID NO: 75134
  chr12:69964051-69964290
  Hypo

SEQ ID NO: 107903 - DNA, 43 bp, Homo sapiens; identical to SEQ ID NO: 75135
  chr12:69999350-69999393
  Hypo

SEQ ID NO: 107904 - DNA, 30 bp, Homo sapiens; identical to SEQ ID NO: 43504
  chr12:70024017-70024047
  Hypo

SEQ ID NO: 107905 - DNA, 22 bp, Homo sapiens
  chr12:70030627-70030649
  Hypo
ccgcgcccggccccctcagact

SEQ ID NO: 107906 - DNA, 254 bp, Homo sapiens; identical to SEQ ID NO: 43505
  chr12:70087493-70087747
  Hypo

SEQ ID NO: 107907 - DNA, 41 bp, Homo sapiens; identical to SEQ ID NO: 75139
  chr12:70173234-70173275
  Hypo

SEQ ID NO: 107908 - DNA, 16 bp, Homo sapiens
  chr12:70651436-70651452
  Hypo
gcgcccggccccaact

SEQ ID NO: 107909 - DNA, 173 bp, Homo sapiens; identical to SEQ ID NO: 75141
  chr12:70760956-70761129
  Hyper

SEQ ID NO: 107910 - DNA, 87 bp, Homo sapiens; identical to SEQ ID NO: 75143
  chr12:70931093-70931180
  Hypo

SEQ ID NO: 107911 - DNA, 568 bp, Homo sapiens; identical to SEQ ID NO: 75144
  chr12:71003477-71004045
  Hyper

SEQ ID NO: 107912 - DNA, 308 bp, Homo sapiens
  chr12:71314368-71314676
  Hyper
agcagtaggaggttgcgggtaaggggaacagaagcgctcagaggcggcaaatgcctggccttctggacgcccagaagccaaggcggagacggcagggtggactccgcgccagcccagcagcccagcagcagcgccgcggctactgagcatgcccagcgccggccctcacgaggcaagggaatttcaaagtgaaattccgcttctccgggtcttagcggcggcttggagcagagtaggctccatcgctggggtggtggttgggggtgggggtgggggtggggaagggggaagtgcgggggagacacttg

SEQ ID NO: 107913 - DNA, 171 bp, Homo sapiens; identical to SEQ ID NO: 75147
  chr12:71403294-71403465
  Hyper

SEQ ID NO: 107914 - DNA, 137 bp, Homo sapiens; identical to SEQ ID NO: 43507
  chr12:71626492-71626629
  Hypo

SEQ ID NO: 107915 - DNA, 30 bp, Homo sapiens; identical to SEQ ID NO: 34516
  chr12:71832897-71832927
  Hyper

SEQ ID NO: 107916 - DNA, 617 bp, Homo sapiens; identical to SEQ ID NO: 75150
  chr12:71833313-71833930
  Hyper

SEQ ID NO: 107917 - DNA, 152 bp, Homo sapiens; identical to SEQ ID NO: 75151
  chr12:71834137-71834289
  Hyper

SEQ ID NO: 107918 - DNA, 301 bp, Homo sapiens; identical to SEQ ID NO: 75152
  chr12:71834789-71835090
  Hyper

SEQ ID NO: 107919 - DNA, 37 bp, Homo sapiens; identical to SEQ ID NO: 43508
  chr12:72054795-72054832
  Hypo

SEQ ID NO: 107920 - DNA, 18 bp, Homo sapiens
  chr12:72077594-72077612
  Hypo
gatatgctagataaacgg

SEQ ID NO: 107921 - DNA, 30 bp, Homo sapiens; identical to SEQ ID NO: 75155
  chr12:72165406-72165436
  Hypo

SEQ ID NO: 107922 - DNA, 30 bp, Homo sapiens; identical to SEQ ID NO: 75156
  chr12:72232195-72232225
  Hypo

SEQ ID NO: 107923 - DNA, 55 bp, Homo sapiens; identical to SEQ ID NO: 34519
  chr12:72332641-72332696
  Hyper

SEQ ID NO: 107924 - DNA, 87 bp, Homo sapiens; identical to SEQ ID NO: 75159
  chr12:72634614-72634701
  Hypo

SEQ ID NO: 107925 - DNA, 160 bp, Homo sapiens; identical to SEQ ID NO: 34520
  chr12:72665266-72665426
  Hyper

SEQ ID NO: 107926 - DNA, 797 bp, Homo sapiens
  chr12:72665668-72666465
  Hyper
ggaatgagggagtctcgctgtcgggtctgcaacctcctgccgtttgccgccaccgccgcttaaagtgcccagggtggagaaggcttttccaggacggatctccgtcgtagcttcgcggccctgggacttcctcctgctggttcactctagtctctcccacctcggccatccttttctctccagctgcagggtgtatggctcgggtgcctcccgtgctgtggccgccgtcactgctgctgcgagcacattccacccagaggaccgaacgccgccgctggagtggggggagaaagcgaaagccctaacttccctctctacaccctcgctcttcccaccgctcccgtccttctccctagccgagaaccggttggaaggctcccgcggaaagcgaggcgagagcgcggcgcaggggagggagagccgggagccgcaggcgcgcaggggcgggggcagcatgtgccccgccgccgggtgctcgtccgagaagtagcgcgcgctgggcaagcaagacgctttccaagttgggcgcgtcccagagctcacagcccggtgtccagagtgaggcggggctgatgggggtcgcggaagctgccgtcgcttgtgtccagaacccgtcttaaaagaacccgggccagcatccccagtcgcgcgccctcggcccgcgtgagctctccgatgcctgctctggctgtggcccgggtggcccgcccgcggggggtgccagagggggcgggggaggaggaggaggcggtgtgatggccctggacggcgagctgggggagcaagaggaggagaag

SEQ ID NO: 107927 - DNA, 1157 bp, Homo sapiens
  chr12:72666525-72667682
  Hyper
gccgagaagagcagctcacccttcgcagccgcgatgggggaagacgacgccgcgcttcgggctggcagcagggggctctccgacccgtgggcagactcagtgggagtgcgaccccgcaccacggagcgccacatcgccgtacacaagcggcttgtgctggccttcgctgtgtccctcgtggcattgctcgcggtcacaatgctcgctgtgctgctcagcctgcgcttcgacgagtgcggggcgagtgccacgccaggcgccgacggtggcccctcaggctttccggagcgcggcggcaacgggagcctccctggatcggcccggcgcaaccaccacgcaggcggggactcctggcagcccgaggcgggtggggtggccagtccggggaccacgtcggcccagccgccgtcggaggaggagcgggagccgtgggagccgtggacgcagctgcgcctgtcgggccacctgaagccgctgcactacaatctgatgctcaccgccttcatggagaacttcaccttctccggggaggtcaacgtggagatcgcgtgccggaacgccacccgctacgtagtgctgcacgcttcccgagtggcggtggagaaagtgcagctggccgaggaccgggcgttcggggctgtccctgtagccggttttttcctctacccgcaaacccaggtcttagtggtggtgctgaataggacactggacgcgcagaggaattacaatctgaagattatctacaacgcgctcatcgagaatgagctcctgggcttcttccgcagctcctatgtgctccacggggagagaaggtatggagggaggcggtgccccgcgctgccccaccccggcgcgcggctcgaacctctgggcggcctgcgaccccggggacccagctggcttccaatacccgggaagccaggggtggggggaaggaaacgaaagcggagtagggcagtcagaactccggggtctcccagatgcctcggggtctcgctgccgccaacttcgcaaactgactcaccggtgccaaaagatgaatgctgccccctcctctagtcgggacctctcctcttcctgtcagagttccttagccatcgaaacgcagggctctttttctgaagggtagctgataatctgagcgatgccagagtgac

SEQ ID NO: 107928 - DNA, 23 bp, Homo sapiens
  chr12:73732465-73732488
  Hypo
actgcgcccggccatttactggt

SEQ ID NO: 107929 - DNA, 30 bp, Homo sapiens; identical to SEQ ID NO: 43512
  chr12:74092079-74092109
  Hypo

SEQ ID NO: 107930 - DNA, 36 bp, Homo sapiens; identical to SEQ ID NO: 75170
  chr12:74930406-74930442
  Hypo

SEQ ID NO: 107931 - DNA, 30 bp, Homo sapiens; identical to SEQ ID NO: 75172
  chr12:75518961-75518991
  Hypo

SEQ ID NO: 107932 - DNA, 885 bp, Homo sapiens
  chr12:75601171-75602056
  Hyper
gccccgccgcgtcctcgatgcccagcctcttggccgccaggtcctcgtcgtcgccggggtcgccgccaatgaggtcgggggtctcgaagatgtccagcgcctcctcggcgtcgcggtgctgccggtaggtcatccagcagcagggctccacgtcggtctcgtcgatgccccagaaggccagctcctcctcgaagagcggcccgcacacgtctgcggggcagtgcagcttgccggtgcggtagtaattgagcacataggcgaagacgcccgggtgccggtcgaagaagaactcgcggccgccaccgggatggtcgctggccctgccgccgcgggaactgcagttgcccgcgccgccctcgaagcagccgcctggcccgggggacagcgggggcgctctcggcggcggcgacagtggaggcggcgacggctgcagcttgtcgcccgccgtggtcaagcagtcgcctgggggctcggaggaggcaagaagggccaggcgtgttccaggcagggtcttgagggtgctgcggtaggtttcgtgccgggtgcccccgacattgaggatcaccctctcgttgttctcgatcttgcccatctctgtgactcagacatgactagggggaggcaaacacagcgccgagttaaagatcttagccgtcaaagacacaccatgacccccaccaccaacccagagcgagtccagggatgcagagttggcagacaggcacggggcaaagaccctccccgggaggggatcagcgtccagcgctgtccccgcctcttgcatcaaacctttcccaggtttccagagaactacagagatagcagtcctagtctttcttgacctttcatgacaccgttttccctgcctcccgctttcctttcttt

SEQ ID NO: 107933 - DNA, 619 bp, Homo sapiens; identical to SEQ ID NO: 34530
  chr12:75602875-75603494
  Hyper

SEQ ID NO: 107934 - DNA, 426 bp, Homo sapiens; identical to SEQ ID NO: 75178
  chr12:75728077-75728503
  Hyper

SEQ ID NO: 107935 - DNA, 60 bp, Homo sapiens; identical to SEQ ID NO: 75179
  chr12:76742449-76742509
  Hyper

SEQ ID NO: 107936 - DNA, 53 bp, Homo sapiens; identical to SEQ ID NO: 75180
  chr12:76807087-76807140
  Hypo

SEQ ID NO: 107937 - DNA, 29 bp, Homo sapiens
  chr12:76848726-76848755
  Hypo
agcagaggccgggcgcggtggctcaagcc

SEQ ID NO: 107938 - DNA, 94 bp, Homo sapiens; identical to SEQ ID NO: 75182
  chr12:77085821-77085915
  Hypo

SEQ ID NO: 107939 - DNA, 30 bp, Homo sapiens; identical to SEQ ID NO: 15677
  chr12:77150018-77150048
  Hypo

SEQ ID NO: 107940 - DNA, 36 bp, Homo sapiens; identical to SEQ ID NO: 75184
  chr12:77436981-77437017
  Hypo

SEQ ID NO: 107941 - DNA, 36 bp, Homo sapiens; identical to SEQ ID NO: 75186
  chr12:77718450-77718486
  Hyper

SEQ ID NO: 107942 - DNA, 342 bp, Homo sapiens; identical to SEQ ID NO: 75187
  chr12:77719271-77719613
  Hyper

SEQ ID NO: 107943 - DNA, 34 bp, Homo sapiens; identical to SEQ ID NO: 75194
  chr12:79198065-79198099
  Hypo

SEQ ID NO: 107944 - DNA, 288 bp, Homo sapiens; identical to SEQ ID NO: 75196
  chr12:79257222-79257510
  Hyper

SEQ ID NO: 107945 - DNA, 383 bp, Homo sapiens; identical to SEQ ID NO: 75197
  chr12:79257714-79258097
  Hyper

SEQ ID NO: 107946 - DNA, 802 bp, Homo sapiens
  chr12:79258297-79259099
  Hyper
aacccgcctccaccccgcttcccaggtccctgtccgctgtggggatggagagacactaacagaactgggatgggcgatgttggctgaacggatccacctattattagtgcgcggggattggctccttggcgcagcgtacccgaggtggagccaatcaggatgctggggctcggagatgatgggcggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtccgccctccaggtaaggaagcgggactggcggcgcggccacctcggcggtgcctatctgctcgaatccatcccaaagattttcttctcgatacacttgggttttagtggtgggagtctgagacctagggagggatccccgggtggcctattgtgagaaatatgagactacatgtgcatctcctggaaaagcactttgcacagcgcccgtgatttagagcct

SEQ ID NO: 107947 - DNA, 30 bp, Homo sapiens; identical to SEQ ID NO: 43516
  chr12:79842607-79842637
  Hypo

SEQ ID NO: 107948 - DNA, 96 bp, Homo sapiens; identical to SEQ ID NO: 43517
  chr12:80488160-80488256
  Hypo

SEQ ID NO: 107949 - DNA, 348 bp, Homo sapiens
  chr12:81102159-81102507
  Hyper
gtgacccaagaagaccgggtgcttgcaataggcaggaaatgcgtacccggcccgaggaagcaggaaagccgccccccaccccaccccaaccccggaaccgatgtttctttcctaatctgccgctgccttggttttccctccagcttgagggtgcggatttcctgcgcacctgcagctcccagtggccaagtgtttccgatcattccagggggctcgtgataacggctaaggaaggtaaagtaaaagggctctgggccgcaccagagaaaatccgggaggtggataggatgcttgggccgagagggctcgaagcgagagcagggacgcgccctgcgaaaagggcgctct

SEQ ID NO: 107950 - DNA, 30 bp, Homo sapiens
  chr12:81107995-81108025
  Hyper
gcgcttgtgttttctcggcttctttagttc

SEQ ID NO: 107951 - DNA, 134 bp, Homo sapiens; identical to SEQ ID NO: 75225
  chr12:81330218-81330352
  Hyper

SEQ ID NO: 107952 - DNA, 582 bp, Homo sapiens; identical to SEQ ID NO: 75226
  chr12:81330737-81331319
  Hyper

SEQ ID NO: 107953 - DNA, 246 bp, Homo sapiens; identical to SEQ ID NO: 75227
  chr12:81331631-81331877
  Hyper

SEQ ID NO: 107954 - DNA, 677 bp, Homo sapiens
  chr12:81471455-81472132
  Hyper
tgccacctccaccaacgaccttccaaagattaaaccagccgtgtacaaactgctggattgaaaattgagagatgggccgttggcctcctcctaggagtacttgtgtgttgaaatcggaaggacgttctggagtttgagcgcgatttttcccggaaggctgcggggttggaagtgcatgttggggtttggatctcgtgcagcagcgcaactaacctgctgcaacggcgctgtgacacccctgtcccggggcccccactttagcctgttgcttctctggtcgctccaggtcggtttttcccggcgactctagtgtggcttccaaacttctgggctctgggctcacttcggaatttgcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctgggg

SEQ ID NO: 107955 - DNA, 37 bp, Homo sapiens; identical to SEQ ID NO: 75235
  chr12:82032738-82032775
  Hypo

SEQ ID NO: 107956 - DNA, 93 bp, Homo sapiens; identical to SEQ ID NO: 75237
  chr12:82152505-82152598
  Hyper

SEQ ID NO: 107957 - DNA, 486 bp, Homo sapiens
  chr12:82152992-82153478
  Hyper
ccatttttctcctcccggcctttctgcaagcctctttgcttgcttcaattggccggaagaaccaacctgctggcagccggtgaggacgctacagcatcttctctcctcacttgcctcgtgcggtggctgctactcctcctcctccgtctcctcccctcctcctccttggcagccaccacctcctcttcctctggaacaagggcttcccctggaagctgctgcagtggtttccaccggcccttaaataaattctgaagtaatcacgtctttgctctcctcctcacgcacacgcgcccgcggatacactcgtctcccccagagccgctcccgggctgccgaggctcgctctgctcccagtgccccctgcgaaggcgagggccagggatgggcaaagtgggaagggggcacacgcttccccgcctgggcttctttcacacaatgggctctacagccttcgcttgtgtcagcctgcgctggtggggatgg

SEQ ID NO: 107958 - DNA, 30 bp, Homo sapiens; identical to SEQ ID NO: 75244
  chr12:84953382-84953412
  Hypo

SEQ ID NO: 107959 - DNA, 191 bp, Homo sapiens; identical to SEQ ID NO: 11344
  chr12:85305054-85305245
  Hyper

SEQ ID NO: 107960 - DNA, 323 bp, Homo sapiens; identical to SEQ ID NO: 75246
  chr12:85305657-85305980
  Hyper

SEQ ID NO: 107961 - DNA, 331 bp, Homo sapiens
  chr12:85306234-85306565
  Hyper
ctgggtggctaatggcgagccccacctcacccccagttgtgcccttagcgtaggcgcttgccattaccgtcagtgtgtcttgaccaagcgcctcttgctgcttccacgtccgggcagcagcagcagcagtcgcgaaagggtagggtccaggtggctgtgacggaggccgaagaggagctgttggcagagaagcagcttcttgcctaggttgggacccggagctgggttttgggggtcgccgccctgcaggctggcaaggagagactcgtgagcgcctgtgtgtctgccagggaaacagcacgggatacaggcgcgcgggtgcgggtgcgcg

SEQ ID NO: 107962 - DNA, 331 bp, Homo sapiens
  chr12:85306625-85306956
  Hyper
gcgcccacgtgctcggcccgcccgtgttacggccgcctaccggctgcagaggagaagggtaggctgtgggcggcggcggggcgcggaggggtagccaggagcgcaggctgggctccgcacctccctgccccaaaacccattgatgcagcggccactgcggctgccgagcggcgtcttcccagagcccggggctgtgcccgcccgatgcaggatgcaactgaggaagcccgctccaaagcaaaacaaaacaaattcctccagccatgccgtctttctccaacccactcaagcgaaagaatggacaccagttaccagccgctgacttttgtct

SEQ ID NO: 107963 - DNA, 30 bp, Homo sapiens; identical to SEQ ID NO: 75251
  chr12:85430069-85430099
  Hyper

SEQ ID NO: 107964 - DNA, 718 bp, Homo sapiens; identical to SEQ ID NO: 75252
  chr12:85667044-85667762
  Hyper

SEQ ID NO: 107965 - DNA, 42 bp, Homo sapiens; identical to SEQ ID NO: 75253
  chr12:85671757-85671799
  Hyper

SEQ ID NO: 107966 - DNA, 30 bp, Homo sapiens; identical to SEQ ID NO: 75254
  chr12:85672332-85672362
  Hyper

SEQ ID NO: 107967 - DNA, 2154 bp, Homo sapiens
  chr12:85672730-85674884
  Hyper
cgcatttcccccaagcgccgcgggctcctaggaagccaagagtcgtgccaaaagtcacacagaagggctttcaacctagcagtgctgtcctgcctgccctaccatcccctctggtggaaatggaggccttggacctgtccgcgcccaggacgccgcgccgcgagtgcccgcagctccgcgcgctcaccactcactcccagagcgcttttcggagtaactccacagcaactctttaaaattaaaagtaatttctgtaaaaatatgcagacattcctcttcttcataaacccctatttgtaacaatcctcactttggcattagagtaaaagcctttcaaaggcactgatcctaacgggttttcttaaaataatttgggtctaatgataaaatcgtggaccaaagggaagggtggcgaagagggtgtagggaattggttggcattagtataatggcttcattgcctcttgctcggcttctctctcccacccatcgccaccgcgtccacactccgccgcattccagagaaaaagaaaaggccacggcctcgtaaagctcccagctggcccggaccccgagctcctcccggttagaagccgaagcggcccctctactacggcggctgcgattaacagttgccaatgcatctggttccttgggcttcggattaatgtgaatcttccacgtaaacgatttacggatgaaataaaagccttttagagcaatatttcctttcaagttcttaagacgcctctaaatctttctggtagtgagtggccggcatgggggcggggtggggacgggtggctcaggaaggcgcaggcagtagggagtggaggtttaactgctttgcgatctcaccaagatcttccgaaatgccagtccactgtcacggcggcaatgaatctgggtgtcaggggctcgtctctcctggcatttgtctgaaatggagctgtctgtctgtctatcctaggcctggacgccctctgcccgggtaagtggggaaaatgggggtggggtaggggcggagggggacctggggtggagttagtcgcccgcctattttcatattcattagaactgggaggctgcccgaggaggccagctgagtttcaagatataaaagcaacttcgggtgctccttttccagccgggacgtattaaagggaccggagcggggcagttcccgacgccgcagcgctcgctttcccttccctcctctctggccctccctcctcccacccactggctccctcccccagcgctctccagtttctgtgccccaggagctacgcgacagtcttccaggattatggagtttctgagcgagaagtttgccctcaagagccctccgagtaaaaacagtgacttttacatgggcgcaggaggtcctctggagcacgttatggagacgctggacaatgagtccttttacagcaaagcgtctgcaggcaaatgcgtgcaggccttcggacccctgccccgcgccgagcatcacgtgcgcttggagaggacctcgccctgtcaggacagcagcggtgagtcgctagcgccccagccggagccgccgcagcccttccgcaatcgaaaatgcaggatcggtctgatcaggcagggagggagaaaggagaaaagtgggagcgagggacctggaaggtggaggaaggtagtggaaggtgctcgctttatgaagcggtgttactgctgctgcagcctttgggggcggagggcggagggagggagagatccagcaccgggttgcctctgagcgattctcctttcgctgtagggtctggtcgcctacggatccctgagtccttctgtaatattggttcctggagtaaactgatagggcgctaaatagagcgtaattgagtcaagacagaacgcttcctctgcgagcccgccttgcagtccgggcggtaggaactgaaatcgatcacagctcgttagagtacgtcactgtcgtcacgagtagggaaaaaaaaaccggaaaacaaaaacaaaaaacaaaaaaccctttgagctcctttaggtaaagataaatctttttaattttccaagacgtggcgatatattttcaaagtttgaggatccctagatttctagcgtgtgtgaatttgtaatttctgcttttttttgcgtttgcaatacaac

SEQ ID NO: 107968 - DNA, 30 bp, Homo sapiens; identical to SEQ ID NO: 75273
  chr12:88820631-88820661
  Hypo

SEQ ID NO: 107969 - DNA, 30 bp, Homo sapiens; identical to SEQ ID NO: 75274
  chr12:88861136-88861166
  Hypo

SEQ ID NO: 107970 - DNA, 249 bp, Homo sapiens; identical to SEQ ID NO: 75275
  chr12:88974430-88974679
  Hyper

SEQ ID NO: 107971 - DNA, 30 bp, Homo sapiens; identical to SEQ ID NO: 43518
  chr12:89794228-89794258
  Hypo

SEQ ID NO: 107972 - DNA, 30 bp, Homo sapiens; identical to SEQ ID NO: 75284
  chr12:89953769-89953799
  Hypo

SEQ ID NO: 107973 - DNA, 30 bp, Homo sapiens; identical to SEQ ID NO: 75286
  chr12:90025918-90025948
  Hypo

SEQ ID NO: 107974 - DNA, 30 bp, Homo sapiens; identical to SEQ ID NO: 75292
  chr12:90219938-90219968
  Hypo

SEQ ID NO: 107975 - DNA, 189 bp, Homo sapiens; identical to SEQ ID NO: 75294
  chr12:90313512-90313701
  Hypo

SEQ ID NO: 107976 - DNA, 36 bp, Homo sapiens; identical to SEQ ID NO: 75299
  chr12:93436029-93436065
  Hypo

SEQ ID NO: 107977 - DNA, 33 bp, Homo sapiens; identical to SEQ ID NO: 43520
  chr12:93711081-93711114
  Hypo

SEQ ID NO: 107978 - DNA, 30 bp, Homo sapiens; identical to SEQ ID NO: 43521
  chr12:93797551-93797581
  Hypo

SEQ ID NO: 107979 - DNA, 938 bp, Homo sapiens
  chr12:93966301-93967239
  Hyper
agagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccagg

SEQ ID NO: 107980 - DNA, 525 bp, Homo sapiens; identical to SEQ ID NO: 75304
  chr12:93985095-93985620
  Hyper

SEQ ID NO: 107981 - DNA, 30 bp, Homo sapiens; identical to SEQ ID NO: 75305
  chr12:94019213-94019243
  Hypo

SEQ ID NO: 107982 - DNA, 30 bp, Homo sapiens; identical to SEQ ID NO: 75306
  chr12:94233462-94233492
  Hypo

SEQ ID NO: 107983 - DNA, 201 bp, Homo sapiens; identical to SEQ ID NO: 75307
  chr12:94501597-94501798
  Hypo

SEQ ID NO: 107984 - DNA, 60 bp, Homo sapiens; identical to SEQ ID NO: 75308
  chr12:94541897-94541957
  Hyper

SEQ ID NO: 107985 - DNA, 904 bp, Homo sapiens
  chr12:94543088-94543992
  Hyper
gggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgccgccgccgaggcagaacgagctgggggcgagcggcggggcgggggtacagccgggtgacatttaccaggtctcaggttcacaccgcgggcggccgtccgaaggctcctctcggacggtccccgagacct

SEQ ID NO: 107986 - DNA, 30 bp, Homo sapiens; identical to SEQ ID NO: 75311
  chr12:94544301-94544331
  Hyper

SEQ ID NO: 107987 - DNA, 90 bp, Homo sapiens; identical to SEQ ID NO: 75312
  chr12:94641622-94641712
  Hypo

SEQ ID NO: 107988 - DNA, 30 bp, Homo sapiens; identical to SEQ ID NO: 75313
  chr12:94642514-94642544
  Hypo

SEQ ID NO: 107989 - DNA, 100 bp, Homo sapiens; identical to SEQ ID NO: 75314
  chr12:94891920-94892020
  Hypo

SEQ ID NO: 107990 - DNA, 83 bp, Homo sapiens; identical to SEQ ID NO: 75315
  chr12:95008472-95008555
  Hypo

SEQ ID NO: 107991 - DNA, 22 bp, Homo sapiens
  chr12:95008675-95008697
  Hypo
ttacagacgctgctaccactcc

SEQ ID NO: 107992 - DNA, 1183 bp, Homo sapiens
  chr12:95266817-95268000
  Hyper
gagggtgggggtgagcgcgggctccctggcacctgccggtaaagcagcagccgcagcccccgagggcgccccaggccaggagctgcgcgccgtcggcgggccgtgcctggaggaggctcgcgccttccaaatgccggagtgcaggcatccttcctctccccaaccccagccccggcctcgacctgtcgcccacctggcccggacctggggctggctccgtctctggggtgtgcgccaagggagccccaccgacgcccagcagagctgcccgggctcccaaagaaggaccggggctttgggcagaattctggcagccaggcgggcgtcaggggagccggagaaggggctcgccagcaggcgtggggcggagtgccgggcgcagcccacctcgcaagcgcgggcccagggctccgacgtgccagcgcagccccgaagagtgcgggcccggggtccccgcggcgccccttcccctcctcagtcccccgggggcgaccgcgctccccgccgaggtccgtccccgccgcaccctcactattcccgctgggaggaccccggcgcacgcccccgcccccgcaccccggggcgacggcgcactcaccctccgcatggtgtctgggccgtccgggcggggctcggcgacttgggcgcgagaagggctgggccggcggcgacgctcggccggccgggagctccgcgctgccccctcctgcacacgcctgcgccgcggccgccaagccggcgggggcggggcggggtagcgctggccgcggggtccccggggctctcccgggctgcggcggaggcgcggagccggccaagggcgcactgagctcgcggagctccggggccccggggcctttctgccgccgtcgcagcgtccccgcctcctcgggccgcttcgcccctctcctcttcctcgagttctggccccaccaggagcggagcgagtctccgatgcctgccccgcggcccccagaactgagctggagaagctttggggtgaaagctgggcccaccctacagggaccccaagtttgcggagcaagagtggattggcggagagcgcagatggcaattctcacccgccttaaaagtaccaccttaaaattctccccatgggatgggaaggtggcccgctaatgtccgttcctactcttcgttttctttttaatttttcagacag

SEQ ID NO: 107993 - DNA, 34 bp, Homo sapiens; identical to SEQ ID NO: 75321
  chr12:95467953-95467987
  Hypo

SEQ ID NO: 107994 - DNA, 40 bp, Homo sapiens; identical to SEQ ID NO: 75322
  chr12:95826267-95826307
  Hypo

SEQ ID NO: 107995 - DNA, 1149 bp, Homo sapiens
  chr12:95941843-95942992
  Hyper
ggcattctttcccatcgaaggccatcgggaatggctttaggaagctgattttcaagctttaagcggcagcaggtgccggcagcgcggggaccgatcgatggagagaaggcgggcaagacgccgggaagcgcattcctcctcaaccgagtgccacaaccgccctcccgaagtgccccggggcttcgagcatcacctcgcggtaatccgggagggtggagggatgcggctggacccgggcgttgcgtgctccacacagcgcccagcccgtgccagccccgcgcccacctctccacgacgctcgtgccgggatcagcgcgaagccccttccagtccccgaagccctcgcccgcgcccgttctcccccagctcgccccctccagcccgctgcgccttgccgcagcatctccgggcactctgaggctgccgccgggacagggtcggagcgccgcagaacccaccgaaacttcccaggggggcaattcaaaattcgccggacgcgtcgccgccgcgcgcccctcggctcattcccttccgcgcgcccgcagccccaggctctccctctctcaggaccccccagcgccctgcgcggcgagaataggcccccaggtgcctcccggccccgggggctgccgtcgcacgtccgctcccgcaggggtcctcactccgccaatcgccgcggccgcgcgccctcgcgcacactcaccagcccgagccggggcggccatcttagcgctcaccccggccccccgccccccggttcggcggccgcgacgacccggtgcggcggctacgacagccgtgacgcgcagcaggccccgccccctcccacagccccacccctgcgccggctcttcgcgggcaccgagaacctgccggtggccgccttccgcgcctcgtgggggggtcggggccacggacggtccccggcgccgcaagtgggtctgcgcgaacaacaagcactgcctccccgggcgggcttcgcacctgtagtgccgtcgggacacgggagggtaaacccagcgtgtcctgtgtgcctgtgagccgcagaatcatccacggacgtcgttagtccttcctggaatttctgcgatttacacaacgtcgaattgtttggcagaaacgcgtggcaaactccgttatctttaaaac

SEQ ID NO: 107996 - DNA, 84 bp, Homo sapiens; identical to SEQ ID NO: 75324
  chr12:96185037-96185121
  Hyper

SEQ ID NO: 107997 - DNA, 30 bp, Homo sapiens; identical to SEQ ID NO: 75325
  chr12:96817042-96817072
  Hypo

SEQ ID NO: 107998 - DNA, 15 bp, Homo sapiens
  chr12:96844259-96844274
  Hypo
cgtctcaaaaaaaaa

SEQ ID NO: 107999 - DNA, 20 bp, Homo sapiens
  chr12:96881018-96881038
  Hypo
agccacgacacccagccaat

SEQ ID NO: 108000 - DNA, 746 bp, Homo sapiens; identical to SEQ ID NO: 75328
  chr12:96883069-96883815
  Hyper

SEQ ID NO: 108001 - DNA, 30 bp, Homo sapiens; identical to SEQ ID NO: 43525
  chr12:97073402-97073432
  Hypo

SEQ ID NO: 108002 - DNA, 56 bp, Homo sapiens
  chr12:97379987-97380043
  Hyper
agtcccgcctggcagcgcaggccgtgcactccccgcgcttccgggaacctgtttgc

SEQ ID NO: 108003 - DNA, 212 bp, Homo sapiens; identical to SEQ ID NO: 75331
  chr12:98763870-98764082
  Hypo

SEQ ID NO: 108004 - DNA, 87 bp, Homo sapiens; identical to SEQ ID NO: 75332
  chr12:98849530-98849617
  Hypo

SEQ ID NO: 108005 - DNA, 143 bp, Homo sapiens; identical to SEQ ID NO: 75333
  chr12:98895762-98895905
  Hypo

SEQ ID NO: 108006 - DNA, 98 bp, Homo sapiens; identical to SEQ ID NO: 75334
  chr12:98896397-98896495
  Hypo

SEQ ID NO: 108007 - DNA, 38 bp, Homo sapiens; identical to SEQ ID NO: 43527
  chr12:98947863-98947901
  Hypo

SEQ ID NO: 108008 - DNA, 42 bp, Homo sapiens; identical to SEQ ID NO: 15681
  chr12:98948376-98948418
  Hypo

SEQ ID NO: 108009 - DNA, 30 bp, Homo sapiens; identical to SEQ ID NO: 75337
  chr12:98951496-98951526
  Hypo

SEQ ID NO: 108010 - DNA, 43 bp, Homo sapiens; identical to SEQ ID NO: 75338
  chr12:98986165-98986208
  Hypo

SEQ ID NO: 108011 - DNA, 81 bp, Homo sapiens; identical to SEQ ID NO: 75340
  chr12:99287423-99287504
  Hyper

SEQ ID NO: 108012 - DNA, 1199 bp, Homo sapiens
  chr12:99288150-99289349
  Hyper
aaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctc

SEQ ID NO: 108013 - DNA, 30 bp, Homo sapiens; identical to SEQ ID NO: 75346
  chr12:99809435-99809465
  Hypo

SEQ ID NO: 108014 - DNA, 33 bp, Homo sapiens; identical to SEQ ID NO: 73609
  chr12:100595448-100595481
  Hypo

SEQ ID NO: 108015 - DNA, 26 bp, Homo sapiens
  chr12:100969543-100969569
  Hypo
ccgcgcctggccgttatctctatttt

SEQ ID NO: 108016 - DNA, 151 bp, Homo sapiens; identical to SEQ ID NO: 73613
  chr12:101025396-101025547
  Hypo

SEQ ID NO: 108017 - DNA, 30 bp, Homo sapiens; identical to SEQ ID NO: 73614
  chr12:101109113-101109143
  Hypo

SEQ ID NO: 108018 - DNA, 858 bp, Homo sapiens; identical to SEQ ID NO: 73615
  chr12:101110839-101111697
  Hyper

SEQ ID NO: 108019 - DNA, 21 bp, Homo sapiens
  chr12:101254680-101254701
  Hypo
cttcaagaatggggccgcgga

SEQ ID NO: 108020 - DNA, 30 bp, Homo sapiens; identical to SEQ ID NO: 43532
  chr12:102158693-102158723
  Hypo

SEQ ID NO: 108021 - DNA, 91 bp, Homo sapiens; identical to SEQ ID NO: 73624
  chr12:103100245-103100336
  Hypo

SEQ ID NO: 108022 - DNA, 361 bp, Homo sapiens; identical to SEQ ID NO: 73625
  chr12:103218204-103218565
  Hyper

SEQ ID NO: 108023 - DNA, 130 bp, Homo sapiens; identical to SEQ ID NO: 73626
  chr12:103311160-103311290
  Hyper

SEQ ID NO: 108024 - DNA, 115 bp, Homo sapiens; identical to SEQ ID NO: 73627
  chr12:103344593-103344708
  Hyper

SEQ ID NO: 108025 - DNA, 424 bp, Homo sapiens
  chr12:103350198-103350622
  Hyper
agcgacggctgcaagcgcctccccctccctctcggcgccagcacgcggccccgccgggctccgctcccagtcgcctgccaccgggccgccgggcacacgcctggggcgggatggtggctgcgccaaggccgccgaggtgcccgcggcggcgccgaagaaccaggaatccccaccagtgccctaagcgccatcactcaacccccgccccgcatctttcttctccgagggtctgggagtatcccagagcactcccttctttatgatatccgctaagctggtccggaaataatctttatggggagggggtggcggtagggggcgatggtacagggggccagaggtcatcctagggggacgtccctgccatatacacccacctacaggacggctcacaaccactcctcggtgtcgcttccccgcggcc

SEQ ID NO: 108026 - DNA, 1421 bp, Homo sapiens
  chr12:103351416-103352837
  Hyper
gtcccattgaaaaggcggacgcactccggcagcccagcactctctcacttctggccagggaacgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggatcgctctgattccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcaggtaggttgcattttggggtgggcaggggggtattcttgccttcgtcctccctctgag

SEQ ID NO: 108027 - DNA, 312 bp, Homo sapiens; identical to SEQ ID NO: 73635
  chr12:103358661-103358973
  Hyper

SEQ ID NO: 108028 - DNA, 485 bp, Homo sapiens
  chr12:103359233-103359718
  Hyper
gagacaggagtgggacgcgctcccagaacgtcccgcgtgcgcccccctctaggcagccagcgggcggccgcttacaaagccgcctttgatgctctggctaccagggctattttggggacgagatgggggaaagccgccaacccacactccttggagggagtcactttctgcaaagtgcgttggagaggactgggccctgggtccgggctgtcgaagcaggaagtggatgtaggggacaaaagctccgcacctgccaaatgcgagaccttagagagagcctccccctcgccgctccctgctcccccgcgggcccgggaagcttgcactaccgggctcagcgcagccagccccaccgcctccggactcgaccccaccatagccccgccgtccgaatcgtctctgaaccaaactacttctgcctgcctttctttggatctgtctttctctgtcatctgagtcactttctctctcgcctctcttttctt

SEQ ID NO: 108029 - DNA, 860 bp, Homo sapiens
  chr12:103889165-103890025
  Hyper
cgcccccaaccgctccgcccggcccctcccccgctccctcccccacccctcccccttcctgtattagcatgcgggcggcggcgagccggccgggtggggagggcggcggtggcatcgctgcgcggggcgcattgtgggccgcgctcgcctccgcgggggaccatctgctcgctgtcaatgcatcacctgctcgtctgggccgtcgccggggcaacggggggcgggggattaaggagcgtgtgcgtctcggtccgggccgaggcggcgaggtgggggttggggcgggggaggagagctccttggccccccacccccctgccccgagacgggtcgacccgctcgggggccggcgaccaccgcgacgggttccgccgcttgcctccgctccttggcctttgctgccgtgctgcctcttctcacgggcgcggctggagtcccggggagcagcagagagcaaacggtccggctctacctcaccctgccagggggcgagtcccgcgctccctgcgtctacctggagctgcagggtccctatcccggggcgccgcccgcagcctcctccgcgggagctggagcactctgctgggtcctggggacgcggcgcagcgtggttccaagcgctccgcagtcgccgggcaaccacaatggggctgccttgccgtgagaccctcccccgcgactgccaccaaagtcacagaaaactttcacacctctcatctgacactgtggcctgtgcacgactccaagcactggggaagccttcgacatcagaatatgaatggcacctgttcttccgggggcggcaagggggatcccgatgtttatcaaaatgggttgattttccacggagggggtacttc

SEQ ID NO: 108030 - DNA, 30 bp, Homo sapiens; identical to SEQ ID NO: 73644
  chr12:103897121-103897151
  Hypo

SEQ ID NO: 108031 - DNA, 207 bp, Homo sapiens; identical to SEQ ID NO: 73645
  chr12:103922840-103923047
  Hypo

SEQ ID NO: 108032 - DNA, 175 bp, Homo sapiens; identical to SEQ ID NO: 73646
  chr12:104322966-104323141
  Hyper

SEQ ID NO: 108033 - DNA, 18 bp, Homo sapiens
  chr12:104354143-104354161
  Hypo
acccggccaatctgtacc

SEQ ID NO: 108034 - DNA, 30 bp, Homo sapiens; identical to SEQ ID NO: 73648
  chr12:104539506-104539536
  Hypo

SEQ ID NO: 108035 - DNA, 823 bp, Homo sapiens
  chr12:104609336-104610159
  Hyper
ggattttgggtggtgcgctcttttctcctttccatttctgcattttccaatttacctttagcgaccgttctttcctgttaaaaaaaaaaaattcacgaccttgaagaagatacacgggctatgacttcgctgttgtcaccgagcgccccgcccaccgcgttctccgacccgcggccggcagggggctcgcggcctccgccaggcgtccttcggctccgtcagttcccacagggccttgtgcgacatgggctgcgccgagggcaaggcagtggcggcggccgccccaacggagctgcagacgaaaggcaagaacggcgatggccgccgtaggtcaggtacgaccgagggcgaaggcctggtccccaggtcgacgggccgaagcgggccttccggccggggttggggataaagtgccccggagccctggccttgaagcccctcactggagtcagtgactgaccgcgcgccacgctggagaccccagaaacgctcccccaggtcaccccgggagacggaggccggcggccggccgagggctgccccgcccgctggctgtgagagaggtgggaggtggaaggaggagcgggcccgccgcgaggacctgcccggaaacctgtcggaaaccgaaccgagatctcggcagcgacccgcctgatttcgctcagggcccgttagggcgtcctcttcctacaagcaccgtgtttccaatgaaaggttacgggggaagcgaccaaaccgacagccgagtccgggggtgccccttcacctctccagaagcccccggcccactcccagcatcctcctccatcgagaatcttgtccg

SEQ ID NO: 108036 - DNA, 158 bp, Homo sapiens; identical to SEQ ID NO: 73651
  chr12:104671514-104671672
  Hypo

SEQ ID NO: 108037 - DNA, 30 bp, Homo sapiens; identical to SEQ ID NO: 15682
  chr12:104690709-104690739
  Hypo

SEQ ID NO: 108038 - DNA, 84 bp, Homo sapiens; identical to SEQ ID NO: 73653
  chr12:104695390-104695474
  Hypo

SEQ ID NO: 108039 - DNA, 102 bp, Homo sapiens; identical to SEQ ID NO: 43535
  chr12:104696536-104696638
  Hypo

SEQ ID NO: 108040 - DNA, 30 bp, Homo sapiens; identical to SEQ ID NO: 43536
  chr12:104698273-104698303
  Hypo

SEQ ID NO: 108041 - DNA, 1301 bp, Homo sapiens
  chr12:104850244-104851545
  Hyper
aaagaaaaacgaaaccgcccagttctgagcgtcggaaaatgggcactcgctccctgggggtttggggcaacttccccgctacgtcgcccagggattttaaataattgccagccaccagaaaccccctaacccttaattcttccctccgagacccagcccgctgcttgccacttccctctccaaacgctggcgggggtgggtggcagcaccgaggcgattttcttcgtctttttttcctccgggttttgtcatggaaacgctgacacaacctccagacggcggccgagcccggccggggactgagggcttttgggaccctgcgggagcgcggcgcgcacaccgcactccccgggcaacagctggacgcgaccatatcccgggtaggggcggggggagcgcgacgctccgccccggcgctagggtccctccctcctcccggctctccgcaggcgccctcccctcgccgggggccgcgagttgcatttggtaaaacccagccccggaatatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaagtatgttgcacccaggtagggggcgcgttagcgtggttttgttggatattttcttctctctcgcgctctagctcgctccgcctgatttctgcctcttccaaccctacctctccgccttcggcctcttcggggctcctggctgcccagagctcctggctgcccagatctacccgggtcaccgcgtcgggatggggaggagaagggaaggtgtgcttcgccctcttcttcctaccggctccgggctggaggatgg

SEQ ID NO: 108042 - DNA, 939 bp, Homo sapiens
  chr12:104851893-104852832
  Hyper
ggtgtggagagtggtcgggtgcccagcgttgcccctccaccacgcgccggccgtttgcccccggggtccgggtccgcagtgaccttgcggctggtgccccggggcctgctccagcccccagccctgagctggaaactccgagctcctgggtcacgccttgaccactgcagttttggaggaaactttggccaggtcctgggctgaccgtccgtttgcatcccccacttctgggatccgagcaacgggaatcccccgggcggcgtgggaatgaaccccattcctccggtcccttgtggctcaggcaaagttccacgtccgaaatctggactgggggagggacgaggctcgtcgcttcctaggggtgcgagggaaagtttgggttctggagagggaggggcgccctcgagcgcggcggccgggggtgagcagctcggctgcgaagcccaacaggtagaacgttccgagaagccttccgggtaacgcgggtctccccgccaagccgtggctcccctgctcccttttaccctcccttagcagccccctgccgggccacgttggctcagaaatccattttctacgcctccgagttgcctttctcagcgtagtcacagcaataatttgcttttctaattgcaaggaggagggaggtggaaacgcatttccttccagggaagtggggttggtgtttttcatttttgcctcccgccttctcctttcactgtgtatctaacactttaaacagacgcagtcccgaattcatcaagcctgcgtttgggtcgatggcagaggaataaagctgttctttccatcaaacaggcagggctgcaggctgcagattccttgacagcgcagggacagacggcccctttgccccactcggtctggagcagttgttaaggcagccacactgccaaggatatggtccgactctaccacatg

SEQ ID NO: 108043 - DNA, 30 bp, Homo sapiens; identical to SEQ ID NO: 73662
  chr12:104858624-104858654
  Hypo

SEQ ID NO: 108044 - DNA, 39 bp, Homo sapiens; identical to SEQ ID NO: 73663
  chr12:104975776-104975815
  Hypo

SEQ ID NO: 108045 - DNA, 76 bp, Homo sapiens; identical to SEQ ID NO: 73664
  chr12:104983800-104983876
  Hypo

SEQ ID NO: 108046 - DNA, 78 bp, Homo sapiens; identical to SEQ ID NO: 43538
  chr12:105018625-105018703
  Hypo

SEQ ID NO: 108047 - DNA, 39 bp, Homo sapiens; identical to SEQ ID NO: 73666
  chr12:105025106-105025145
  Hypo

SEQ ID NO: 108048 - DNA, 96 bp, Homo sapiens; identical to SEQ ID NO: 73667
  chr12:105029202-105029298
  Hypo

SEQ ID NO: 108049 - DNA, 96 bp, Homo sapiens; identical to SEQ ID NO: 73668
  chr12:105056873-105056969
  Hypo

SEQ ID NO: 108050 - DNA, 153 bp, Homo sapiens; identical to SEQ ID NO: 73669
  chr12:105069312-105069465
  Hypo

SEQ ID NO: 108051 - DNA, 88 bp, Homo sapiens; identical to SEQ ID NO: 73670
  chr12:105100669-105100757
  Hypo

SEQ ID NO: 108052 - DNA, 30 bp, Homo sapiens; identical to SEQ ID NO: 73671
  chr12:105103480-105103510
  Hypo

SEQ ID NO: 108053 - DNA, 42 bp, Homo sapiens; identical to SEQ ID NO: 73672
  chr12:105104150-105104192
  Hypo

SEQ ID NO: 108054 - DNA, 119 bp, Homo sapiens; identical to SEQ ID NO: 73673
  chr12:105140973-105141092
  Hypo

SEQ ID NO: 108055 - DNA, 30 bp, Homo sapiens; identical to SEQ ID NO: 73674
  chr12:105147152-105147182
  Hypo

SEQ ID NO: 108056 - DNA, 30 bp, Homo sapiens; identical to SEQ ID NO: 73675
  chr12:105150821-105150851
  Hypo

SEQ ID NO: 108057 - DNA, 30 bp, Homo sapiens; identical to SEQ ID NO: 73676
  chr12:105392811-105392841
  Hypo

SEQ ID NO: 108058 - DNA, 30 bp, Homo sapiens; identical to SEQ ID NO: 73677
  chr12:105393128-105393158
  Hypo

SEQ ID NO: 108059 - DNA, 333 bp, Homo sapiens; identical to SEQ ID NO: 73678
  chr12:105478020-105478353
  Hyper

SEQ ID NO: 108060 - DNA, 30 bp, Homo sapiens; identical to SEQ ID NO: 73679
  chr12:105673102-105673132
  Hypo

SEQ ID NO: 108061 - DNA, 189 bp, Homo sapiens; identical to SEQ ID NO: 73682
  chr12:106532217-106532406
  Hyper

SEQ ID NO: 108062 - DNA, 30 bp, Homo sapiens; identical to SEQ ID NO: 73683
  chr12:106533379-106533409
  Hyper

SEQ ID NO: 108063 - DNA, 696 bp, Homo sapiens; identical to SEQ ID NO: 73685
  chr12:106974297-106974993
  Hyper

SEQ ID NO: 108064 - DNA, 481 bp, Homo sapiens; identical to SEQ ID NO: 73686
  chr12:106975246-106975727
  Hyper

SEQ ID NO: 108065 - DNA, 484 bp, Homo sapiens
  chr12:106976403-106976887
  Hyper
cccggcctgccagcacggcgcggggcccgatggtggggaagggccgggagggggagggggccacatctaagccaattttgatttcgcctataatgagtgccgggcgaaggctggagaaggcctctggaactttaaataagaaaaacgttgctaatgctataatagaagggggaagtcggagggctgggattgcgtcgctctgagccccccttttcggaggcggcttttcttattcaaaacaggcccacaatgggcttcacagtgcgcctcgccacggccccatctgacgagcggccattcatcaggccggctggcctatcaatgacattgctcccatcggggctcctataaaatgatgctttttcccatgaaacatccgcaaacattttgacgggtttggctttgcccggctggattactgagtgtccccttgctcgctcgctttttctctctcccccttctccgagctcgctcccttctctcc

SEQ ID NO: 108066 - DNA, 459 bp, Homo sapiens; identical to SEQ ID NO: 73689
  chr12:106977393-106977852
  Hyper

SEQ ID NO: 108067 - DNA, 72 bp, Homo sapiens; identical to SEQ ID NO: 73690
  chr12:106978702-106978774
  Hyper

SEQ ID NO: 108068 - DNA, 2619 bp, Homo sapiens
  chr12:106979033-106981652
  Hyper
gctgtggattcgtggcgttttctgttctcgatgcaactggtgctcgtgggggcaccgggtcctcttcacctcaactgcaaacactccagagacgttctgaaatgaaatcctttccccatccacttctctcccttttgtatatccgagacatccctaggtcaccaccctgaacgcaaaatcaaaagttttggtacacgacagtgtgaagaaatgacactagacgcaccaggtgacatttcactccgacttgcaaaaccgacgacaagggaagtgcggctcggcgtggtccagtccagaagccttccctcacctcccttccagagaatttaatccaattagcctttcttctgagtttcccttgttatgtaaagggtcttttctcctggcttgcagagacgcgcgctccatggagcagttcgattctgctccttttgtataagatcgcgcgcgatcagaaccaggaatattgctgttattatatcattccgaaaggactggaacaaccgactcacagcaagtgctggggcgaagtaggaaacgtccaggataagagaggccggcgagcggggccaccgtcccttactcttaaaaggaaaatccccgcgaagtgcctcgggcccgggagaacagttttgcaggggccagggctctagtggcctgctttggggccacttcagcatgacctgcggaaacgcgcccctttgttccgcacactgagccagtaatatattcctcgggtttccccaaaatactcaacaagtgtggagctaagacaatggcccggtcgggggaagctgggcagccggcgcgcgcctcctgggccctaggcgctctcgctgccgagcccgacaaagcaaagcccctctcggaggcaaagccccagcttgccgcgcgccgcggtgctccggcaggaggcaaaggcgacaggcgcgcgcaggggcagtcgacgcaccttctggccggtgcgcggtttgcagtaagcgcaggcgcgcgtcccgctcggcccgcgctacagccccacgccgcgcaaaagtgggtgctgagccccgcgtggcctgcgctccccacgcgggccaccggcagctacgtgtttgtggccgccgggtccaatcagggctgctctgcccgggtgatcgttgctcagttactcaagttatccggaaattcgagaacgatgggggaaagtgggtagaattttaggccaccgagaacttgtgcaaagtgggccgggccgggtcggtcgcctacgcaacagaaggatcatttcttttaaaacgggatggcgcgttagagagggccactgccaagctggagctggaaacttctgcctccatccactttccgctcccatctccagaacccagagctgaggcggccaaagtacttcctggagccggatttgagttccccgggccgcatcggtgggagggcacgctagtttacaggcccccagctcagcacaaattctttctaaaattctaccaccaaattaattatatgcctttgtgggcccggggtagggatgtccagtggccttggcgccgtgcccacaaggcaaagtgcgtcctggagggaacagggcccgagcctcctccattcttgcccaggcacagccctggggaaggagccactgtctgcgggcttgggagagcaaggagccggaggtccgagccttgctccagcgcccaaaccagacagtctcgccctccccgggcgtgtgtgtgtgcgcgcgcgcgggcgaacggggcatgtgcgcccccatctctgccacctgctaagcgccggcgtctggatttggcagcggggtcaagtgagagccgcatggtaccagggttccgagtccccgaggctgcagcccttgatggcgcggaggctgcacgcaggctgggtcctcggagtcccggattcagcacgcgactctgtgcggcagcctgggacagcgcgctttcctacccggcctgcaggtcccagagactcggaaaagtttgcaggggccgcccggcgcctcgggcctgggatttccaaagccgctcccgcccccgtccccagcgcgtcaccatggagactgctggaagttggtggtggaaaacagacctggcgcaaagcaaaatattatgagtgcagttggggtgacttcagggggcggggggaccggagggcaggagcgggagccagaggcagaggccgacaacaaagggcccagtgcgaggaagagagaggagtttgcacggggcctccccgccgctgtgtgagtgctggaccatcctgcttcccagaggctccgaggtctctaatttctctccagcagctataccttttctcagcccgccttggagcccttgctccctccctcctctccgggttctcttccagcctcccccctcacccgtccggaggttaggcgccagctgggcagtgcgcccgcctccccaggagccacaggctcaccaacgtgaaaggttctggcttttcttccccacgacccgtgggtcgcccagggtgagtttctcaccccctatctcaaacccgatctgaaagggtgatgggttagaataaggtgggaacggaacgggaagagaagggagcgtctggccagaaatcttgcgagtggggatgggt

SEQ ID NO: 108069 - DNA, 200 bp, Homo sapiens; identical to SEQ ID NO: 43542
  chr12:107138858-107139058
  Hypo

SEQ ID NO: 108070 - DNA, 47 bp, Homo sapiens; identical to SEQ ID NO: 73696
  chr12:107297268-107297315
  Hyper

SEQ ID NO: 108071 - DNA, 30 bp, Homo sapiens; identical to SEQ ID NO: 73698
  chr12:107432746-107432776
  Hypo

SEQ ID NO: 108072 - DNA, 146 bp, Homo sapiens; identical to SEQ ID NO: 34616
  chr12:107486450-107486596
  Hyper

SEQ ID NO: 108073 - DNA, 645 bp, Homo sapiens; identical to SEQ ID NO: 73700
  chr12:107487210-107487855
  Hyper

SEQ ID NO: 108074 - DNA, 387 bp, Homo sapiens; identical to SEQ ID NO: 73701
  chr12:107711950-107712337
  Hyper

SEQ ID NO: 108075 - DNA, 222 bp, Homo sapiens; identical to SEQ ID NO: 73702
  chr12:107713205-107713427
  Hyper

SEQ ID NO: 108076 - DNA, 40 bp, Homo sapiens; identical to SEQ ID NO: 73703
  chr12:107714075-107714115
  Hyper

SEQ ID NO: 108077 - DNA, 657 bp, Homo sapiens; identical to SEQ ID NO: 73704
  chr12:107714660-107715317
  Hyper

SEQ ID NO: 108078 - DNA, 682 bp, Homo sapiens
  chr12:108168922-108169604
  Hyper
tctaagattctgtttcgtcttcttctattgagagattgacctcttgagtgatttgtgtgctttccggcaaatgatggagacgcgtaaaccggcggaacggctggccttgccatactcgctgcgcaccgcgcccctgggcgttccggggaccctgcccggactcccgcggagggaccccctcagggtcgccctgcgtctggacgccgcgtgctgggagtgggcgcgcagcggctgcgcacggggatggcagtacttgcccgtgccgctggacagcgccttcgagcccgccttcctccgcaagcgcaacgagcgcgagcggcagcgggtgcgctgcgtgaacgagggctatgcgcgcctccgagaccacctgccccgggagctggcagacaagcgcctcagcaaagtggagacgctccgcgctgccatcgactacatcaagcacctgcaggagctgctggagcgccaggcctgggggctcgagggcgcggccggcgccgtcccccagcgcagggcggaatgcaacagcgacggggagtccaaggcctcttcggcgccttcgcccagcagcgagcccgaggaggggggcagctagcgagcgcccgaactggccaggacccccgcgcccgccgcacagcgcgcagccgggcgctcaacctaaggtcctcttcgaaggtggtttgca

SEQ ID NO: 108079 - DNA, 30 bp, Homo sapiens; identical to SEQ ID NO: 73709
  chr12:108199937-108199967
  Hypo

SEQ ID NO: 108080 - DNA, 447 bp, Homo sapiens
  chr12:108237347-108237794
  Hyper
gtgctaccaggaatccgagtagaagtggtcagggatggagcccagggccacctcatccttcttcctcctggagccaaacagcttcttcatcgcggcagcttcggagaagcctcagctaccctgcagctccccttcgccttttcgcggaatccggagtccagtcacaattagctaagcccggggcaccaaagcctttagcagcgaaaccgccgcttccgacctctcggacctagtgagccaggcagagcctttaggcccacgcctgggcaccacagccagcccgaggcccaggaagccgctcccaggctgcgcgcggctggcgctgggcttccagtgccggactgccagaacaggctgggagcgctggggtcttggcgctctgcagccaccagagatctggccgagtgggtctggttacccccacccctgtgccgccacagcccggca

SEQ ID NO: 108081 - DNA, 536 bp, Homo sapiens
  chr12:108238125-108238661
  Hyper
gcccccagctctgtgcgcccgctgaggaggagacagccagcagcgtggtcaggcaggctctcgcgctgaggaggcagtgcactcaggatactgaggccgcccagagcacgccccgccaacccacctaggcgcctgagctgcagcctctgcgccgtctctgccgcggtccggcaggccgcctggattggccgccgccgctgctgccaccacggtgtccacccaacgactctaatgtgggaagtctggcggtggagggtgtcgcgggctctccggcagacccgtagctggtggtggagctgagggccctggggcatggcgggcagggacttgaggcccgcaggaggagggggccgtgccgatgctggctgtgccggggctgcctgagaacccgcggaggctggggggcgaagacgcgcggcacaggtgcgcaggaacgcggtggtggcagggtcccagactgcccagcctaggacgggcgggataccggactgtagagcagacgaagggcggggtctcagctacggagctatggaccc

SEQ ID NO: 108082 - DNA, 433 bp, Homo sapiens; identical to SEQ ID NO: 34625
  chr12:108297323-108297756
  Hyper

SEQ ID NO: 108083 - DNA, 231 bp, Homo sapiens; identical to SEQ ID NO: 73715
  chr12:108523208-108523439
  Hyper

SEQ ID NO: 108084 - DNA, 36 bp, Homo sapiens; identical to SEQ ID NO: 73716
  chr12:108523736-108523772
  Hyper

SEQ ID NO: 108085 - DNA, 22 bp, Homo sapiens
  chr12:108569903-108569925
  Hypo
ccacgcccggcctattgttata

SEQ ID NO: 108086 - DNA, 76 bp, Homo sapiens; identical to SEQ ID NO: 73719
  chr12:108603987-108604063
  Hypo

SEQ ID NO: 108087 - DNA, 55 bp, Homo sapiens; identical to SEQ ID NO: 73721
  chr12:108871619-108871674
  Hypo

SEQ ID NO: 108088 - DNA, 97 bp, Homo sapiens; identical to SEQ ID NO: 73722
  chr12:108891814-108891911
  Hypo

SEQ ID NO: 108089 - DNA, 161 bp, Homo sapiens; identical to SEQ ID NO: 73723
  chr12:108898965-108899126
  Hypo

SEQ ID NO: 108090 - DNA, 30 bp, Homo sapiens; identical to SEQ ID NO: 73724
  chr12:108926148-108926178
  Hypo

SEQ ID NO: 108091 - DNA, 193 bp, Homo sapiens; identical to SEQ ID NO: 73725
  chr12:108982619-108982812
  Hypo

SEQ ID NO: 108092 - DNA, 30 bp, Homo sapiens
  chr12:109162468-109162498
  Hyper
ggccggcagacactccgggcctgcagcggg

SEQ ID NO: 108093 - DNA, 30 bp, Homo sapiens; identical to SEQ ID NO: 73727
  chr12:109162732-109162762
  Hyper

SEQ ID NO: 108094 - DNA, 58 bp, Homo sapiens; identical to SEQ ID NO: 43544
  chr12:109208616-109208674
  Hypo

SEQ ID NO: 108095 - DNA, 30 bp, Homo sapiens; identical to SEQ ID NO: 73729
  chr12:109305521-109305551
  Hypo

SEQ ID NO: 108096 - DNA, 191 bp, Homo sapiens; identical to SEQ ID NO: 73730
  chr12:109343498-109343689
  Hypo

SEQ ID NO: 108097 - DNA, 30 bp, Homo sapiens; identical to SEQ ID NO: 43546
  chr12:109719635-109719665
  Hypo

SEQ ID NO: 108098 - DNA, 30 bp, Homo sapiens; identical to SEQ ID NO: 34627
  chr12:109746889-109746919
  Hyper

SEQ ID NO: 108099 - DNA, 36 bp, Homo sapiens; identical to SEQ ID NO: 73733
  chr12:109873504-109873540
  Hypo

SEQ ID NO: 108100 - DNA, 36 bp, Homo sapiens; identical to SEQ ID NO: 73734
  chr12:109886472-109886508
  Hypo

SEQ ID NO: 108101 - DNA, 30 bp, Homo sapiens; identical to SEQ ID NO: 73735
  chr12:109970653-109970683
  Hypo

SEQ ID NO: 108102 - DNA, 78 bp, Homo sapiens; identical to SEQ ID NO: 73736
  chr12:110030802-110030880
  Hypo

SEQ ID NO: 108103 - DNA, 30 bp, Homo sapiens; identical to SEQ ID NO: 73737
  chr12:110039080-110039110
  Hypo

SEQ ID NO: 108104 - DNA, 156 bp, Homo sapiens; identical to SEQ ID NO: 73738
  chr12:110240870-110241026
  Hypo

SEQ ID NO: 108105 - DNA, 228 bp, Homo sapiens; identical to SEQ ID NO: 73739
  chr12:110258634-110258862
  Hypo

SEQ ID NO: 108106 - DNA, 136 bp, Homo sapiens; identical to SEQ ID NO: 73740
  chr12:110271059-110271195
  Hyper

SEQ ID NO: 108107 - DNA, 30 bp, Homo sapiens; identical to SEQ ID NO: 73741
  chr12:110271432-110271462
  Hyper

SEQ ID NO: 108108 - DNA, 30 bp, Homo sapiens; identical to SEQ ID NO: 73742
  chr12:110299819-110299849
  Hypo

SEQ ID NO: 108109 - DNA, 40 bp, Homo sapiens; identical to SEQ ID NO: 73743
  chr12:110353414-110353454
  Hypo

SEQ ID NO: 108110 - DNA, 153 bp, Homo sapiens; identical to SEQ ID NO: 73744
  chr12:110367786-110367939
  Hypo

SEQ ID NO: 108111 - DNA, 17 bp, Homo sapiens
  chr12:110506948-110506965
  Hypo
aaaatcatggctcatcg

SEQ ID NO: 108112 - DNA, 98 bp, Homo sapiens; identical to SEQ ID NO: 73746
  chr12:110563148-110563246
  Hypo

SEQ ID NO: 108113 - DNA, 34 bp, Homo sapiens; identical to SEQ ID NO: 73747
  chr12:110563785-110563819
  Hypo

SEQ ID NO: 108114 - DNA, 468 bp, Homo sapiens; identical to SEQ ID NO: 73748
  chr12:110717498-110717966
  Hypo

SEQ ID NO: 108115 - DNA, 181 bp, Homo sapiens; identical to SEQ ID NO: 73749
  chr12:110782679-110782860
  Hypo

SEQ ID NO: 108116 - DNA, 179 bp, Homo sapiens; identical to SEQ ID NO: 73750
  chr12:110784092-110784271
  Hypo

SEQ ID NO: 108117 - DNA, 29 bp, Homo sapiens
  chr12:110840419-110840448
  Hypo
tgagccactacgcccggccaataaaggat

SEQ ID NO: 108118 - DNA, 153 bp, Homo sapiens; identical to SEQ ID NO: 73752
  chr12:110886947-110887100
  Hypo

SEQ ID NO: 108119 - DNA, 39 bp, Homo sapiens; identical to SEQ ID NO: 43552
  chr12:110908132-110908171
  Hypo

SEQ ID NO: 108120 - DNA, 205 bp, Homo sapiens; identical to SEQ ID NO: 73754
  chr12:111127155-111127360
  Hyper

SEQ ID NO: 108121 - DNA, 23 bp, Homo sapiens
  chr12:111153712-111153735
  Hypo
accgtgcccggccagtatgctac

SEQ ID NO: 108122 - DNA, 430 bp, Homo sapiens; identical to SEQ ID NO: 73756
  chr12:111284604-111285034
  Hyper

SEQ ID NO: 108123 - DNA, 30 bp, Homo sapiens; identical to SEQ ID NO: 15686
  chr12:111296630-111296660
  Hypo

SEQ ID NO: 108124 - DNA, 30 bp, Homo sapiens; identical to SEQ ID NO: 43555
  chr12:111355976-111356006
  Hypo

SEQ ID NO: 108125 - DNA, 30 bp, Homo sapiens; identical to SEQ ID NO: 73759
  chr12:111358838-111358868
  Hypo

SEQ ID NO: 108126 - DNA, 352 bp, Homo sapiens; identical to SEQ ID NO: 73760
  chr12:111369069-111369421
  Hypo

SEQ ID NO: 108127 - DNA, 127 bp, Homo sapiens; identical to SEQ ID NO: 73761
  chr12:111375004-111375131
  Hyper

SEQ ID NO: 108128 - DNA, 1346 bp, Homo sapiens
  chr12:111471165-111472511
  Hyper
tggtgacatttcccacgactcagtggcgcccccgggcggctcccaccctccctccggccggcgcgtctacgcagccccaagtgctggctgcgaccctcggatcccaagcatatctggcgatggagcggcggcagcccgaggcacgtgttgtgtgtgctccgattgcaaaagaaaaaaaaatgcatttcaaactattaacttttttttaagcgtgcaatgccgggagctgggggtagacaggtgcaagcgggggtaggcgccccgcgcgcccgcctcccgcagcgccccctcccaaacttccctttgcattgatcagcacgttacgtcagtattgataagtttgcaaaaagccaaagtcaagtgcaatcgcgcggcacaccgaccccggacttgggggggagatgcagcgagcgctccgcgggcccgggagccggcggcaggcagggcagcggcggcgccggcgcctctcggagaggctgcctccccccaacccctcccctcccaccccatccccggctgcctcccccgggcgggcgccgagctccccgcccggcgcgctccgcccgcgccctccgggggtcgggggggcgcacggctcccgggcccgttggcggcggcggcggcggcggcgcggcggcggcgaggggcagcgggtggcaggaggccggagggcgcccgaggggccccgggccgcggcgctcagggcccgggcggccggcggcggccccggggctggggggagtccagcccggatattgagtgcagccattgagaaaagccaaactcttgtgtgtgcgcgtctcgatagcccccaagatggccgccaatgtgggatcgatgtttcaatattggaagcgatttgatctacggcgactccaggttagtgcgggcagcgccggccgcgcggccgtgaggagcccccgggcgcgccctgggcgcattggggaggtccccgggcgggcaggcggacgccctggggcggcgggcggcggctgccggggctcgccggggctcggccgcccgctgcccatcgataggtattaggaattgatctcgccgctgctctttgttcggttcagtcatcgattagctgccgcgaccatggagaagcgctagtgagccctcggtcggcggagcggccgagcggccaggcggccgggcgaggagcggggaaggcaggggctacggcctcgggcagggggctgctggcgggaacccccggcggtcccccctgagccgcactttgcgcgcctcccaacttcgcggcgcccggggaggccgcggagcgcgccgcttgccagtccgcacccggctggggctccggcgagggagggagggagctggcg

SEQ ID NO: 108129 - DNA, 446 bp, Homo sapiens
  chr12:111472571-111473017
  Hyper
ggcgaggaggcggctccgcgccccgccgctcgccggcacctcagccttcgccgcccgcctggctgcgcagcccggacgcgccgccacccgggggccgccgccgccgccgccagagccgccgccgccggactggccgcaagcgccggcagacctcttctcctcgggccggggtcttggggttcgtcttgcttcttgcctttacccccccgccccttccatccccttcccaagtctagatgcagacgggcggtggaggtgggcccgggcgctcgcaagtttgcgctcctgcctccagggcggtggagagccgggagcggcgcagagcaggtgactcccagccctcgggcccaagggaacttttaaatgagagatttccttgcttgttctgcctcctgcgtttctccccgctgctcccctcgtctcctctctcccgtctctgcttttct

SEQ ID NO: 108130 - DNA, 90 bp, Homo sapiens; identical to SEQ ID NO: 73768
  chr12:111535426-111535516
  Hypo

SEQ ID NO: 108131 - DNA, 30 bp, Homo sapiens; identical to SEQ ID NO: 73769
  chr12:111590629-111590659
  Hypo

SEQ ID NO: 108132 - DNA, 246 bp, Homo sapiens
  chr12:111664495-111664741
  Hypo
ttgatctttttgacacgaattgctttttggccttgtgcgaatgttgtaagctttccgcctgcagaggaatgggctggcgtctgggccgggctgggaagagtgatcgctccagccgcgtggcagtaacattcccgcacatttaacaacaattagtctgtgccgacgccatggtaggctttcgtgtatgaaaatttacaaggcttttaatggactgcattatggaaggccgtgcggggccagtcggtg

SEQ ID NO: 108133 - DNA, 30 bp, Homo sapiens; identical to SEQ ID NO: 73770
  chr12:111692613-111692643
  Hypo

SEQ ID NO: 108134 - DNA, 30 bp, Homo sapiens; identical to SEQ ID NO: 73771
  chr12:111706217-111706247
  Hypo

SEQ ID NO: 108135 - DNA, 54 bp, Homo sapiens; identical to SEQ ID NO: 73772
  chr12:111725510-111725564
  Hypo

SEQ ID NO: 108136 - DNA, 30 bp, Homo sapiens; identical to SEQ ID NO: 73773
  chr12:111760419-111760449
  Hypo

SEQ ID NO: 108137 - DNA, 17 bp, Homo sapiens
  chr12:111763135-111763152
  Hypo
accgctgccacttacca

SEQ ID NO: 108138 - DNA, 30 bp, Homo sapiens; identical to SEQ ID NO: 73775
  chr12:111783547-111783577
  Hypo

SEQ ID NO: 108139 - DNA, 80 bp, Homo sapiens; identical to SEQ ID NO: 73776
  chr12:111844610-111844690
  Hyper

SEQ ID NO: 108140 - DNA, 133 bp, Homo sapiens; identical to SEQ ID NO: 73777
  chr12:111872804-111872937
  Hyper

SEQ ID NO: 108141 - DNA, 30 bp, Homo sapiens; identical to SEQ ID NO: 73778
  chr12:112083284-112083314
  Hypo

SEQ ID NO: 108142 - DNA, 37 bp, Homo sapiens; identical to SEQ ID NO: 73779
  chr12:112149584-112149621
  Hypo

SEQ ID NO: 108143 - DNA, 91 bp, Homo sapiens; identical to SEQ ID NO: 73780
  chr12:112196381-112196472
  Hypo

SEQ ID NO: 108144 - DNA, 34 bp, Homo sapiens; identical to SEQ ID NO: 73781
  chr12:112204378-112204412
  Hyper

SEQ ID NO: 108145 - DNA, 73 bp, Homo sapiens; identical to SEQ ID NO: 73782
  chr12:112204919-112204992
  Hyper

SEQ ID NO: 108146 - DNA, 19 bp, Homo sapiens
  chr12:112281623-112281642
  Hypo
tgtttgtttttgagacgga

SEQ ID NO: 108147 - DNA, 30 bp, Homo sapiens; identical to SEQ ID NO: 73784
  chr12:112591860-112591890
  Hypo

SEQ ID NO: 108148 - DNA, 351 bp, Homo sapiens; identical to SEQ ID NO: 73785
  chr12:112605505-112605856
  Hypo

SEQ ID NO: 108149 - DNA, 91 bp, Homo sapiens; identical to SEQ ID NO: 43561
  chr12:112610355-112610446
  Hypo

SEQ ID NO: 108150 - DNA, 160 bp, Homo sapiens; identical to SEQ ID NO: 73787
  chr12:112628549-112628709
  Hypo

SEQ ID NO: 108151 - DNA, 91 bp, Homo sapiens; identical to SEQ ID NO: 73788
  chr12:112630855-112630946
  Hypo

SEQ ID NO: 108152 - DNA, 30 bp, Homo sapiens; identical to SEQ ID NO: 43564
  chr12:112820695-112820725
  Hypo

SEQ ID NO: 108153 - DNA, 157 bp, Homo sapiens; identical to SEQ ID NO: 73790
  chr12:112825977-112826134
  Hypo

SEQ ID NO: 108154 - DNA, 146 bp, Homo sapiens; identical to SEQ ID NO: 73791
  chr12:112919565-112919711
  Hypo

SEQ ID NO: 108155 - DNA, 513 bp, Homo sapiens
  chr12:113012954-113013467
  Hyper
ggggatgaggatggtcggctgtttccacatttaagggcagagctgggtgaagggtggtgttagtgctcgagggtcacgcgcgggtggctttgccgcggtggtggcagcggtggcagaggcgacaccgctggaggcggcggagggacgggcccaccaacgctgcaggccggtaaggcgggcgggggctgcgggccaccaggtcctgccctcccaagctgcagcacgcgctggctggggggtcgtgggggctcccgtgggggcgcggccggacgcgggacgctgcctccgggaatggggctgctggagcgggaggatgcgctagaaccgggggtggggcgacgagggacttgggggcggggagacccgcgcaggacccgtgctatcctttgggattttgaggggcgggtccggcaaggccccccaaagtggctgctcctgcgagtctccgagaggggaacaggtggtcgcggggtggctgcggcgaaggtagctcctctccggtagccacggggt

SEQ ID NO: 108156 - DNA, 30 bp, Homo sapiens; identical to SEQ ID NO: 73794
  chr12:113229160-113229190
  Hyper

SEQ ID NO: 108157 - DNA, 74 bp, Homo sapiens; identical to SEQ ID NO: 73795
  chr12:113229420-113229494
  Hyper

SEQ ID NO: 108158 - DNA, 821 bp, Homo sapiens
  chr12:113494306-113495127
  Hyper
gacaaagattcaagccggtgactcctaaacatcccactccctgcctcacgctctgcttggggtcagaaggccccttggggtctcgggagggcctggccgaggatttggggcgccccgagactcgcgtgtcagcgccggtggcgctcagggccgagatctgtctcctccccttcctcctcctccgccccctcccctctccctcccggagcacggccgaggcctcctcccacccgcgagatcccggcggccgccagccggctcctgcgtccgtccgtcggccgggcagtctgtccacgcgcggaaagctcggcgcggcggccgaggggcctgggagggaacgggcgcggaggcgggaccgcggctccctcccactccggggggagcccaggaggcggcggtgctggagcgcgagccggagccggagccggagacgaagagaggcggtgagaacgcgggtgcttagggaccccacccccggctcccgctgggggcccgcgagcggctcggggacgtctgggctggggaagcggggctgttacccccagggcgggaggcagagacgatccagctcctggcttcgccccctccgcgacgcgacccccgaggggccctgggccgcgcctgcagcgccgcgcatccccgtgcttcccggcgcaccccagcgcacccggcatccccccggcagggcgagggccccgggggaagggaaggctccgggagccaaggagggcgccccccaggcggagagtctcggaaaaccgcgcccccggcccctgccttccctccaggcctgccccaagggaaagcgggcggggcgaccc

SEQ ID NO: 108159 - DNA, 632 bp, Homo sapiens; identical to SEQ ID NO: 73799
  chr12:113541503-113542135
  Hyper

SEQ ID NO: 108160 - DNA, 385 bp, Homo sapiens; identical to SEQ ID NO: 73800
  chr12:113592078-113592463
  Hyper

SEQ ID NO: 108161 - DNA, 36 bp, Homo sapiens; identical to SEQ ID NO: 43567
  chr12:113677751-113677787
  Hypo

SEQ ID NO: 108162 - DNA, 30 bp, Homo sapiens; identical to SEQ ID NO: 73802
  chr12:113690294-113690324
  Hypo

SEQ ID NO: 108163 - DNA, 155 bp, Homo sapiens; identical to SEQ ID NO: 73803
  chr12:113725857-113726012
  Hypo

SEQ ID NO: 108164 - DNA, 36 bp, Homo sapiens; identical to SEQ ID NO: 43569
  chr12:113795723-113795759
  Hypo

SEQ ID NO: 108165 - DNA, 30 bp, Homo sapiens; identical to SEQ ID NO: 73805
  chr12:113835162-113835192
  Hypo

SEQ ID NO: 108166 - DNA, 149 bp, Homo sapiens; identical to SEQ ID NO: 73806
  chr12:113849535-113849684
  Hypo

SEQ ID NO: 108167 - DNA, 2188 bp, Homo sapiens
  chr12:113900165-113902353
  Hyper
gcccagcaatcctggcgccccacccagggggagagcaggatgtgtgcgtgttcgagtccggcctgctccctcgggctcaacataaacgtcaaagtaaggaagagcgggagctggacccggctggccacttcctgacccacagccctattcctagagaagctgaccttgagcctcaagattggccaccagggagcgccagcgtgcaggtggctcggtctccctctcggtggctcccggttcacgcgagttcctcgctcgctctccgtcttctccctctggctgacgctgtctctccatctcctcctcatcttgccccctttcctctccctctctttcaatctctctccttttcttatcatctttttttttaaagacggggaaagcacagcgagaaataagattacaaaatgccactcggattgcagagagagggaaaaacaccgtctccgccccttggcctcaccctctctcagtccaaagaggtggcggtggctgggtgggtgggtgggggcccggggaaagtctagagcgtgctcgaaatctcttgaccctccggagtattgactttggtcccaagaaattgctcgcggttgctgggagagtactggcggtgggctgaggctcctggagagcccgcggggtggagatgggggtcggccccccctcggcgcccagccgaggagcagctgccagttgagtgcggacccgagagagaacccccgagggacacccacgtctcccaccgcgtctgcgtcgggcgttttggtttcaggaggctgcttcggggcggggcccccgggggccgagcgcggggggcggcccggcggccttaccacacggcggcttcgttgagctcggggttgggatgcgacaggggtccgctgtagccgctggtgccgctcattgggaagggcgggctgggcccgccgctgaatacctcgccgggcatggggtgcagcgtgcccggcaggcctggctcggggctcggtgtgtccgggtgcgagatcatgtcggtgaacctggggttgtccgcggcgtgcgggccggcgagcggcggttccagcgctcccagcggcgtcgagccggggccagaggccgccaggaagctggagtcggccggggactgcgcctgcgaaggcgggccgtgcgcgaagaagtcgtagttgcttcccggcgcgtagtagtcgccttggtagtctgcggagggggagcgggaaggagacagggcgcggtgagagaaggcgaagtaggcgggggacccgggacccggggaggggacccgggcgggcgagagaggggagcgcgcgacaccgacccaaggttagagagacctgcggaggccggcgccccttgagacggtggacgtcgcaggctcacggggagggttggggagagagacaatgagagatctcgaaagggcaagagactcagactgccagagaccacacacagagacgggagagactccgagaccgtgggggacacacgcggcaaaaactcggagacttcagtcacaggttccctgacacctagagatggagagagacagaggcggccagagacgcagagacagacaatgattcctaagtgtcttagggtcggtgagagacacagagatgcgggacagcgagagacagacggagagatcggcagaggggcagagagaaaggcggaaaagagacccagagacgcggagtccgcggctgagacccgaaagcccgagacatcggagggtcgcggaggagtcgaggagacgcagagagaggaaagacggccgcggttagagacacgcgtggaaacccccgggggcggcagcgagggagtcaggagtgagcccgaagatggagagaagtcgatgcgcccagagaacgcaagacggtggatcagagatgagtcccaggaacctccagagaagcggaggctgacaggcccggggagaggaaccgggcagggacaaaccagcggacagagcagagcgcgaaatggttgagaccgggaagcgacctggccgggggaaactggatccgggccgcggcaggagcgactggtgggttgggccgggcggggcggccttggcgccctaaactcggtccctgcgccctaccaacccagtccaagtccttcgcctcgccaagtacggccgccgcgtcgatcccggtgagaccatttgtaccggcctagcctagcc

SEQ ID NO: 108168 - DNA, 963 bp, Homo sapiens; identical to SEQ ID NO: 73811
  chr12:113902608-113903571
  Hyper

SEQ ID NO: 108169 - DNA, 30 bp, Homo sapiens; identical to SEQ ID NO: 73812
  chr12:113903957-113903987
  Hyper

SEQ ID NO: 108170 - DNA, 346 bp, Homo sapiens; identical to SEQ ID NO: 73813
  chr12:113904732-113905078
  Hyper

SEQ ID NO: 108171 - DNA, 1054 bp, Homo sapiens; identical to SEQ ID NO: 73814
  chr12:113905380-113906434
  Hyper

SEQ ID NO: 108172 - DNA, 62 bp, Homo sapiens
  chr12:113906828-113906890
  Hyper
gcacagacagcacaccgggggccaagtagggagtgccaggctgggcacggtgggagggtgct

SEQ ID NO: 108173 - DNA, 58 bp, Homo sapiens; identical to SEQ ID NO: 73816
  chr12:113907104-113907162
  Hyper

SEQ ID NO: 108174 - DNA, 42 bp, Homo sapiens; identical to SEQ ID NO: 73817
  chr12:113908232-113908274
  Hyper

SEQ ID NO: 108175 - DNA, 1955 bp, Homo sapiens
  chr12:113908739-113910694
  Hyper
cgagaagccttcaggcgtctctaactcatgcaaaaatccttcctctctctcgggacggggcttgaagcttctgtcttggggttgcagctgcttggaaggggcggagaggagtggatagcaagtttgtcagggcttcctccctctgccccgccagcgctctgagccggcctcgagccaacgtgaggcagcgaagcagcgtccttcttcctccgcctgggctcgggacctttcctggaccaaggacaggaggagagcaaagtgctgcccgctccccatctaagcttgtgatccggggaggctgggatggggatgggggtatccccttccccagcgccccagtggagcgcgcgcagggtgggcgcgcaggcagcagagcggcgcggcctcttacctgaaaaagtcatttttgcagtagagcttgccctcgcgcgagaagcacttctccgagaggttggttttgcactcgcagcactgaacacatttgatgtgccacgcgcggtccagcacgttcagcagaaagcggtcgaggatgggccgctcgcaaccggcgcagtgcaccatcatagccccgcgccccggcggcttcggccgccttgccctccctttgggcccctggccctcgggcctgccgggccctccgctgcccttcgcctcttgtctcagcagctgcagggcgagtctggtccggaccaagactcagccggtccagtccttgggcaatctctggcctggcgctgggctgcccggagtggggtggtggggggcgggtggcgttcacaacctcatgccacgggccgcacgccccggcgcctgttccgggcttccccaggtatctcgggtggctgctggcctcggcgctgcggagcggctttccccggtggcggaggcgccggcactttcccccactttcaagcggtccggatcctcatctttgtctggtcgccgcgtaattcgcgcatccttattcagatttggtgacgtggcgctgcacgtagggggcccagcggccaatgggcgcaccgtggccatggcaacctcttaaatttatagcatatctaaattggctacagcgttgctgtccggacagagcaaaaaaaacaaggcatcagtattgttgagtattagcttgtacctggttcggaggctaagtaagtatttaccttccagtttggggctgacggggcgggggcagcgcgaaacgaaaattgcgtctctcttcctctctctttctcctcacaaatatttgggggtcacgggttccaaggcctagtccgggaggtacccctgcccccttcgccatccctggaacttgcagaagttgccccacgccccacacttcgctccccttctccagcccagccagcccagattggattcccccacccccgcgccccctctgcgccctgaagctgcgtcagcgcggttctcccggctcctggagccggccccggcttctttttgtcatacacggggctggggcccagccgggcctttctcatggagagagctagtggagaccgcgcggcctgggtagttttccccgcccggccgccgagcccaggcccaggcccagggtggggaggcgggggagcaggaggggtgccatttggcctggtcccgaactccagagtttcaggcctgagtgcgctgctcacggggctctgagggagatgtggacagggggagattcagggtggacgggtcttcccgcagacagctcggaggtggcactcaccacgtctctcctttcctcgctgcaccttccagattccaggtcagcctatggggcactgtggtgagtgggtcgtacggctgaggcgggggacaccagcgactatgagagcgctgtttgtattcacgccgtgcgggctgggtgtgcaagttcgtcccctcattgggcgcaggagaagcggcgcacgtatgttccgtgctcggcagggcgcccagagtgtgag

SEQ ID NO: 108176 - DNA, 1699 bp, Homo sapiens
  chr12:113912829-113914528
  Hyper
agtcccctagagttgcgttgggggcctcatcctcagtacagctcagccccagttcgagaactccctggacctgggctcagccaagctgcccagaacccgcccggccttctctagcccaccaccttccccggtgcacagcatcggaaaatgccagcagaccagctattagactcatcccgacctaacagcgctaacagatggcgaccaggcagcgaaatcccctcctatatgtaactaataaaccgcttgtgtcttaacagggtaatgcatggagacgcaatgtcacttatacaagatgttgatggaatttactatataaaaatcttcctcctagagtaaagagtatcaacattacaactcgacagacggcggcgggataagtaaaacagacaaaagacaaacaagataataatctgtttccaatcacttaagccctgtagagttagtaatatgcggtttgcatattcccccttgagttcggtaattaattactggcgaggaggcgcacactagcctggggtgggagttttggggagcgctgagctggggcgtggggcatacctctcttgagttctccagcccgggacaccgggcagcggccggaatgagggcgcttccagaggtttggagctgacccacccgcgggttgaagaggtcgtttcagttgcacctccctattcctcaccggaaagcctccggcctgggagattctgcagccaagcaggaaagggggtcttctctggcagccagtgtctctcctggctcctcttaaagcatcctctccttcgaacggccgggagtggcagctttattgggaaacgcgcgctctgggggcccaggtggctggggggaccggagaggcgcgcgctttgcccacttctcttggtggcatcttgtgcgacccagcccgtcctctcccgacttcgatcattaccgctcccaccccaacacgcatacttcccccaccccacccccaagagccagcgcggctttaacattaaacaaacgcagcgagcgcctccgagctgcgctctcggccgggtctgcgcggcggcggcggcgttacaaattgtaaatttaaattgctcgccggattcattacctcccctctttgatttcagccagccgtgaaaaattatactggtgtaccactgagaaactgttttgccgcaaagagcctacgcctaatcactggctttctccctccgacaaaagtgtaattattttgtttggggtgtaaatataggccgcgcctcgcacacacactcagcgtcccgcagcgccgcagagcaccgcccgccgccggaaggaatcgggcccccgagtaggagcgggcgtgaaggctgagccccgctgtctggaggccggaggagagcggctggtgtggcgctccggcgagacccagcgagcccagcctctgccctccgcagttcgggtttgcccgagaacctcgggaccgcgcgctcccaggcgggccagagaggacgccggcggggtgcaatgggtgctcaggcctagacatccgggcagggatgcgagagggatggcgggggtgggagtggggtgggtggggggtggtggtgaattttctggggaacccttgggggtggccgtctgagagcggcccggagcccaggcggggagagtgtcctggcctgggtggaaccctgggaggcgggggcgtcgtggctggtgtgcc

SEQ ID NO: 108177 - DNA, 44 bp, Homo sapiens; identical to SEQ ID NO: 34663
  chr12:113916222-113916266
  Hyper

SEQ ID NO: 108178 - DNA, 404 bp, Homo sapiens; identical to SEQ ID NO: 34664
  chr12:113916326-113916730
  Hyper

SEQ ID NO: 108179 - DNA, 40 bp, Homo sapiens; identical to SEQ ID NO: 73828
  chr12:113916972-113917012
  Hyper

SEQ ID NO: 108180 - DNA, 1079 bp, Homo sapiens
  chr12:113917226-113918305
  Hyper
ttggcgagtgagcttcgtgcacggcatttttcaccctctggaagaagccagatttcgggcaaggtagaacgtgagaagaatcccttttatactggctcctacgaaaggaaccagaaaaaaaaataatacacattttgagcagcctctgtgggtgcagcttgttgaactcggagccagacgctttttctggcgaaacggagaaaaaacgccgcggaaacggtgcgcagggttggggagtataggttctgattgcaacataattccgcaagcttttttattttttatttttcccgggacgcggttgcgtcggaagaaacgctttctaatctttctagctccctggatttgaagttgcgggtcttggggcgaggcttagctggtctgggggtccttgcgtgtccacagccccggatacgcacccgcgaaacgttcgacatcgccgcttttttgttttgttttgctttgtttttttagtcgaaggcgaggcgttgtttggggacagatcgcggccggctggggcctcgggcagtgacagtgaaacgaattccaaacccattctgaactcgccatggcgctctcctgccctccaacacccaccccaaacaccgtgtaggcagaagcgaggttccccgtgaagccgggttaaaatcggcagctgagatgcggtgggatgggatcatagccgagttcggaggatgcggggagagaatagaaaaatctccatcgttctgctctgctctctttctttctcctctaagcaggtttgccggagaaggcaggggtgagccacggtggctgcccggctgtgcaccggcgccggagtttggaccaagacaaagacaggagctgtccgcggtgctgaatcggcggcgccgtcgccggagcaagggggcttctgtaaccagccctctgctcatttactccccatccttctagctccccttcgctctgtgactcttgccttcccctgaatttatttcccttttgggggactcaccttagaacctgcgccctgtacacaggtgtatatacatatatcaaagaacaaaacgattgattgaaaacggtgtcttctcctt

SEQ ID NO: 108181 - DNA, 254 bp, Homo sapiens; identical to SEQ ID NO: 73832
  chr12:113952930-113953184
  Hyper

SEQ ID NO: 108182 - DNA, 42 bp, Homo sapiens; identical to SEQ ID NO: 34670
  chr12:113953467-113953509
  Hyper

SEQ ID NO: 108183 - DNA, 425 bp, Homo sapiens; identical to SEQ ID NO: 73834
  chr12:113957582-113958007
  Hyper

SEQ ID NO: 108184 - DNA, 30 bp, Homo sapiens; identical to SEQ ID NO: 73835
  chr12:113972789-113972819
  Hypo

SEQ ID NO: 108185 - DNA, 61 bp, Homo sapiens; identical to SEQ ID NO: 73836
  chr12:114029358-114029419
  Hyper

SEQ ID NO: 108186 - DNA, 249 bp, Homo sapiens; identical to SEQ ID NO: 73837
  chr12:114029630-114029879
  Hyper

SEQ ID NO: 108187 - DNA, 313 bp, Homo sapiens
  chr12:114075780-114076093
  Hyper
gctcgagttcaaggacgcagagaggacgggagggggttaaagcccattcaaacgcgcagccccccgcccccggctcgccccccactccccgccggccgcccgcatctgggcgcgcagaggaacagatttcgcgtttcacacagcgcacaatggccgccctcaaaggcgcgccgcccgcattgttcgggccggcgcccgcgcgtcctacctccgcgcgcgaattaacccccgtcaccccgccattgtcaccgcgcacttcggggccggccacaaaggcgccagaaaaccctgccgtgttcggaagggtgggggg

SEQ ID NO: 108188 - DNA, 84 bp, Homo sapiens; identical to SEQ ID NO: 73840
  chr12:114107345-114107429
  Hypo

SEQ ID NO: 108189 - DNA, 153 bp, Homo sapiens; identical to SEQ ID NO: 73841
  chr12:114130067-114130220
  Hypo

SEQ ID NO: 108190 - DNA, 109 bp, Homo sapiens; identical to SEQ ID NO: 73842
  chr12:114236423-114236532
  Hypo

SEQ ID NO: 108191 - DNA, 242 bp, Homo sapiens; identical to SEQ ID NO: 73843
  chr12:114240196-114240438
  Hypo

SEQ ID NO: 108192 - DNA, 84 bp, Homo sapiens; identical to SEQ ID NO: 73844
  chr12:114273766-114273850
  Hypo

SEQ ID NO: 108193 - DNA, 44 bp, Homo sapiens; identical to SEQ ID NO: 73845
  chr12:114282443-114282487
  Hypo

SEQ ID NO: 108194 - DNA, 249 bp, Homo sapiens; identical to SEQ ID NO: 73846
  chr12:114290668-114290917
  Hypo

SEQ ID NO: 108195 - DNA, 44 bp, Homo sapiens; identical to SEQ ID NO: 73847
  chr12:114295503-114295547
  Hypo

SEQ ID NO: 108196 - DNA, 152 bp, Homo sapiens; identical to SEQ ID NO: 43574
  chr12:114329563-114329715
  Hypo

SEQ ID NO: 108197 - DNA, 30 bp, Homo sapiens; identical to SEQ ID NO: 73849
  chr12:114337104-114337134
  Hypo

SEQ ID NO: 108198 - DNA, 58 bp, Homo sapiens; identical to SEQ ID NO: 73850
  chr12:114337939-114337997
  Hypo

SEQ ID NO: 108199 - DNA, 32 bp, Homo sapiens; identical to SEQ ID NO: 73851
  chr12:114402798-114402830
  Hypo

SEQ ID NO: 108200 - DNA, 390 bp, Homo sapiens; identical to SEQ ID NO: 73852
  chr12:114833759-114834149
  Hyper

SEQ ID NO: 108201 - DNA, 30 bp, Homo sapiens; identical to SEQ ID NO: 34676
  chr12:114834466-114834496
  Hyper

SEQ ID NO: 108202 - DNA, 577 bp, Homo sapiens
  chr12:114838325-114838902
  Hyper
caagttggcagatctcggctcactcagcgatggcgggaacggtcgaatggaggcctctccctccgagccccggagccaaagcctcgcagtgtttatcagcctgagcgagcgcgcccggaggcggaggcgcagaagacttcgcaggccttttatagttaaatcctcacggctcaggctcggggggaaagagggactcggacgtgtctttccttcctgggggaataggaagaggactgcagttcgttgatataaacagaacgcgcctcctagttcactcaggccttgggccgagcggggagcagactttgtttaattttaaataataataaatgtcactgttgtcagtttattgagggaggcttcggctggagaacgggggcggggggcgtctggaaaggcggctccaccctcccccttcacacactcggtggcttgggcctaccgttcgcctgctccacacgcctgctcggggcatcctctggctttttgctttgcgggacgcggaagacccgtccagcacgggtagggatgtggccaggacgtccccaggcctgggcgcgcgcgtgcacatgctcac

SEQ ID NO: 108203 - DNA, 154 bp, Homo sapiens; identical to SEQ ID NO: 73855
  chr12:114841029-114841183
  Hyper

SEQ ID NO: 108204 - DNA, 324 bp, Homo sapiens; identical to SEQ ID NO: 73856
  chr12:114841672-114841996
  Hyper

SEQ ID NO: 108205 - DNA, 845 bp, Homo sapiens
  chr12:114842960-114843805
  Hyper
atctagaaatggggccgaggagaaggacagcttctgaggcctgacttgcaagcagctttcttcgcctcgttctcggggcttcagggaggcggcgactggagccccgctgcctactcacaacaaaagaaagcagggctggcgcccctacacgcgctcccattcactgccggccgcggggagaatcctaccccgcgccctcgccagggtcccggggagctctgggctggcggaggcgaacaagatgcggtttgacagaaccaggccgtgcttctgcaaacctcaatgccgctccgccagccgcggcggcctcccagactccatttgccggggagctccgagccgcgcaaaatctctgcaagctgtgctctgcagaatgcaaagccgggctggaatccgccattcccgccgccccagccgactcggccgacgagctccctcctgagcctcccgggccatctgccgggacggttacctcgttcggtgaagccggtgcattcaccacatcctctgctgctcctagcagggaagccggcggtgaggcgggggagcaggcatggtggctccggggtttatgcggggtttactgcttacccagaatagcggctactgctgcctactagggcgcacctaccgctggagcctccgcggcgactgcccacctccaacacacacctcctctgctgtgcgcttgctctccctaaatacttcccagttggcaagcgccaaagaacacaaaatagcctccaagagcaccggcaaccatataatctcagtgccccgctcctcctttacacccccagggagggaaagttggaagcccagtgaatggtcgaagtcctttctga

SEQ ID NO: 108206 - DNA, 193 bp, Homo sapiens; identical to SEQ ID NO: 73859
  chr12:114844184-114844377
  Hyper

SEQ ID NO: 108207 - DNA, 1809 bp, Homo sapiens
  chr12:114845846-114847655
  Hyper
aaagaggcaaccaggcgatagcgactatctcaccagccgctgcacctataggacttggagacgtcacgagtcacgcaaccggcccgcgcgctgtcacgtttggctggggggcagcggcgggaggtaaatttctctccgtcttcgcctatcagtgccgggtctgcgcagccacaggttccggacgtcttggccccgggaataaataaagacataaaccaacccggctttctccggaggaatgagggtgatgaacataagacacaaatagagccaagatcgactttcttaggaagggggagaggagggaactcttcacgaagggaggtgggagtccacctcagacctctattggaaggaaatcgagttgttccgggggactgaggtctcttgcataaggcatgggatccttattattattattattatttttaaatcccccgcggaggagctctgggcaaatgaataccgaggcgccgctctagctggttaggcttgggatgcgataactcagtgccctcttgcagacttgcatagaaataattactgggttgtcgtggaggggacacgagacagagggagttctccgtaatgtgccttgcggagagaaaggtccaagaatgcaattcgtcccagagtggcccggcaggggcggggtgcgagtgggtggtggagtaggggtgggagtggagagaggtggtttctgtagagaataattattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttgagttgcaaaacgtaccgcgtagacgcccctggtggcgccgagagaagagctaggcctgcccagcacagagccggagagcgtcgggccttccggaagggtaagttctccgccaaggggtcccgagggagctggacgtctgaatctggacttgcccccagcttcggggttcgattctgggttttgcgcgtccccaacccccagggctttccgaagcatggcctggctccaggcccggtcctgtaaggactggaacggcagcaaaatgtgcagggaggcagtcggccggcagagctgcggcgggagccaaggtcaggcccgcggggagagcgggcagcttccagcgccggccacaagctcccaggccagctgggccgcagacccctttgcttccagagagcacaacccgcgtcctttctctcagccaggctgcagtggctgccccgagcttcgctttcgtttcccaagctgttaataacgatatgtccccaaatccgaggctcgtgtttgctcccagatgccaagaacgcaacccgaaatccttctcccaaaccctaggtcgacgagatgagttcctacttgacctctgagccgaggtgggccggaaaccgaggcctaggccccgccggggctgcaaggaaaaggggaaactccgagcgtagcgtcttttccttgtggttcctttctccggcatcccggactgcgggccctgcagccacctggaccggcattcaaaggattctgcaagtccagcttcacagactggctttcccagacgctccgaagcccgcaccacgaacagaataaaggagagacgagagatcgcaactagatttgagaatcctcgttcttttccccaatcgttcgggcagtaaactccggagccggctacagcgcgcatcctcccttcctcctttcggagaactgtcgctttcccgaagct

SEQ ID NO: 108208 - DNA, 142 bp, Homo sapiens; identical to SEQ ID NO: 73864
  chr12:114852047-114852189
  Hyper

SEQ ID NO: 108209 - DNA, 244 bp, Homo sapiens; identical to SEQ ID NO: 73865
  chr12:114877144-114877388
  Hyper

SEQ ID NO: 108210 - DNA, 768 bp, Homo sapiens
  chr12:114878244-114879012
  Hyper
caaataatgtgtgtgcgcaaagacgtttctgtctacagataattacgcgtaaattatccgtggcaaacaacatatgcaaacgacatatgcaaacaacatatgcaaacgattatctatgtgcagataattccatgcccacgagccgacagatttgcaattctcaagtacttctatgtgcatgtaattctacgggcaaattgttccgagtgcaagggatttggtgtgtgtgtcagtgattgcaccgctgaaaacaattctgtagatgtgtcgatgcctttagaagaaagggctccaaagaatcgtgtctcgatggttggtcagcgcgcgcatctgcggcactggctaaatcccgggaagcagcgcggagaaacaaaaagtgcttttcttccagccatgccttctccctgcggaaaccgcctgctccctgcgccgcacggaaagcagaaggcggaagggtgggttaggtgttctgggttctccggcctcctccaagcttcgtgctcggtgaggtacggcgcgttcaggttgctgcatcagtttgcacagcgctgtgccgcgctcagtcgggaattgccacagacgcccgatttcctcggtgccatgtgggctcctagctgccgccacagagcggccggatcctaccagggtttcccagtgcccgggtacctgcaagaatcttcccaggacgggagcagtgggcactgagcagcgctgccgggagaaagatgttgcgttttgccaagcgctcacccgcgcttcaaaacccca

SEQ ID NO: 108211 - DNA, 542 bp, Homo sapiens; identical to SEQ ID NO: 73868
  chr12:114881542-114882084
  Hyper

SEQ ID NO: 108212 - DNA, 78 bp, Homo sapiens; identical to SEQ ID NO: 73869
  chr12:114882568-114882646
  Hyper

SEQ ID NO: 108213 - DNA, 30 bp, Homo sapiens; identical to SEQ ID NO: 73870
  chr12:114883016-114883046
  Hyper

SEQ ID NO: 108214 - DNA, 83 bp, Homo sapiens; identical to SEQ ID NO: 34694
  chr12:114883452-114883535
  Hyper

SEQ ID NO: 108215 - DNA, 91 bp, Homo sapiens; identical to SEQ ID NO: 73872
  chr12:114883793-114883884
  Hyper

SEQ ID NO: 108216 - DNA, 568 bp, Homo sapiens
  chr12:114885098-114885666
  Hyper
gagaagccgcctcagcgagcctctgggctccgggccatgtgagccggttggccagagcctggcgggttccgtgcttggctagccagcggagcggggtgagagggtgagagaaggacgcttctcctttgattcgcagacccgggcgcagccggagaccgcccggcaccgcggcgtctgtctgtctgagcgcctactcgcgggtcctctgctgccccgagtgaactctaggcgcagctggaccggggtgagggcgcgcggtgagcccaggccaagcgctggaagaaacgaactgggggccgagttcgggcggcgatctgccggggacccagtcctgagcggcttgtttgggatactgggattaaggcctcagaggagcacatggctagcctctgcagccctcggagggtcactgacgccccctgcttttccttccaaatgtctttccccgaggctggggacacctgttctgagcagaagagggcaatggttcaacctgtttgaccccgcccgggtctccttctgcgggaacatacgccccagtcagctgaggtgccggctgactttcccc

SEQ ID NO: 108217 - DNA, 420 bp, Homo sapiens
  chr12:114886043-114886463
  Hyper
agagaaaatgcggatcggaggtcaggtgcacccttaccggcaacttggggtacacaaccggggtcccagcatcacctcccctcgccccgcgctcatgtccccactctgaggcccgtgggcactgaggtggcaccgacctcccaggacccctgcattgcctcacactttcacttccctccctgctccgcagtgtccataaaataccagccgttcacctgcctatagcgaacggatccgagggtggaggcaatgacttacctggttgtgggtggatggatgaagaaggcctttacttggagcctaagccctggcgcgcgcgcaccacggcgcgaactgctccatcaagcatccactggcctccagccgcgtttccggttgtagcactgggcgcccccagagtggacccgataagctatcggc

SEQ ID NO: 108218 - DNA, 421 bp, Homo sapiens; identical to SEQ ID NO: 34699
  chr12:114917674-114918095
  Hyper

SEQ ID NO: 108219 - DNA, 150 bp, Homo sapiens; identical to SEQ ID NO: 73877
  chr12:114918587-114918737
  Hyper

SEQ ID NO: 108220 - DNA, 66 bp, Homo sapiens; identical to SEQ ID NO: 73878
  chr12:114939117-114939183
  Hyper

SEQ ID NO: 108221 - DNA, 30 bp, Homo sapiens; identical to SEQ ID NO: 73879
  chr12:115106216-115106246
  Hyper

SEQ ID NO: 108222 - DNA, 38 bp, Homo sapiens; identical to SEQ ID NO: 11459
  chr12:115106464-115106502
  Hyper

SEQ ID NO: 108223 - DNA, 38 bp, Homo sapiens; identical to SEQ ID NO: 73881
  chr12:115120626-115120664
  Hyper

SEQ ID NO: 108224 - DNA, 39 bp, Homo sapiens; identical to SEQ ID NO: 73882
  chr12:115121505-115121544
  Hyper

SEQ ID NO: 108225 - DNA, 130 bp, Homo sapiens; identical to SEQ ID NO: 34702
  chr12:115121885-115122015
  Hyper

SEQ ID NO: 108226 - DNA, 288 bp, Homo sapiens; identical to SEQ ID NO: 73884
  chr12:115122236-115122524
  Hyper

SEQ ID NO: 108227 - DNA, 102 bp, Homo sapiens; identical to SEQ ID NO: 73885
  chr12:115130675-115130777
  Hyper

SEQ ID NO: 108228 - DNA, 65 bp, Homo sapiens; identical to SEQ ID NO: 73886
  chr12:115135302-115135367
  Hyper

SEQ ID NO: 108229 - DNA, 123 bp, Homo sapiens; identical to SEQ ID NO: 73887
  chr12:115136240-115136363
  Hyper

SEQ ID NO: 108230 - DNA, 73 bp, Homo sapiens; identical to SEQ ID NO: 34704
  chr12:115889703-115889776
  Hyper

SEQ ID NO: 108231 - DNA, 352 bp, Homo sapiens; identical to SEQ ID NO: 73891
  chr12:116755878-116756230
  Hypo

SEQ ID NO: 108232 - DNA, 142 bp, Homo sapiens; identical to SEQ ID NO: 73892
  chr12:116842262-116842404
  Hypo

SEQ ID NO: 108233 - DNA, 186 bp, Homo sapiens; identical to SEQ ID NO: 73893
  chr12:116941184-116941370
  Hypo

SEQ ID NO: 108234 - DNA, 462 bp, Homo sapiens
  chr12:116946086-116946548
  Hyper
tctgcaagctctcagcggctccagcgttttcaaggagcggggtcaaggtcaaagggcccctcccaggctgcccgggcggggctgtagtgggatgctggtccccaggctgcgcctcggttctccagggcgaaacgcaggggcggggccgtgcaggggctgggcgtcgccgccggagagggtcccagcgcgcccaggcctcccgcaggcgggacgcggcgtcggggggctgctgcgctgctcggccccagcgggcccgccgcgccgccgcggctctggctgcctcctgcatgccaattaggccctaatttgatttctgttctatctgtgcgaaccccattaaaacccaattccgcttattaccaacagctttcttgcaacgcgacgcctctccctcccagggccgctgctcaggcgcgccgaggagccaggctccgcgcaccaggctggcggggacaccttccc

SEQ ID NO: 108235 - DNA, 39 bp, Homo sapiens; identical to SEQ ID NO: 73896
  chr12:117155588-117155627
  Hypo

SEQ ID NO: 108236 - DNA, 30 bp, Homo sapiens; identical to SEQ ID NO: 73897
  chr12:117157142-117157172
  Hypo

SEQ ID NO: 108237 - DNA, 41 bp, Homo sapiens; identical to SEQ ID NO: 73898
  chr12:117300848-117300889
  Hypo

SEQ ID NO: 108238 - DNA, 29 bp, Homo sapiens
  chr12:117316475-117316504
  Hyper
gctgggaagccgagcggggcatcctgagg

SEQ ID NO: 108239 - DNA, 30 bp, Homo sapiens; identical to SEQ ID NO: 73899
  chr12:117316744-117316774
  Hyper

SEQ ID NO: 108240 - DNA, 32 bp, Homo sapiens; identical to SEQ ID NO: 73900
  chr12:117317256-117317288
  Hyper

SEQ ID NO: 108241 - DNA, 47 bp, Homo sapiens; identical to SEQ ID NO: 73901
  chr12:117318318-117318365
  Hyper

SEQ ID NO: 108242 - DNA, 110 bp, Homo sapiens; identical to SEQ ID NO: 73902
  chr12:117319409-117319519
  Hyper

SEQ ID NO: 108243 - DNA, 338 bp, Homo sapiens; identical to SEQ ID NO: 73903
  chr12:117319758-117320096
  Hyper

SEQ ID NO: 108244 - DNA, 30 bp, Homo sapiens; identical to SEQ ID NO: 73904
  chr12:117408106-117408136
  Hypo

SEQ ID NO: 108245 - DNA, 502 bp, Homo sapiens; identical to SEQ ID NO: 73906
  chr12:117472595-117473097
  Hypo

SEQ ID NO: 108246 - DNA, 211 bp, Homo sapiens; identical to SEQ ID NO: 43581
  chr12:117473987-117474198
  Hypo

SEQ ID NO: 108247 - DNA, 198 bp, Homo sapiens; identical to SEQ ID NO: 43582
  chr12:117474577-117474775
  Hypo

SEQ ID NO: 108248 - DNA, 30 bp, Homo sapiens; identical to SEQ ID NO: 43583
  chr12:117484341-117484371
  Hypo

SEQ ID NO: 108249 - DNA, 89 bp, Homo sapiens; identical to SEQ ID NO: 73910
  chr12:117498335-117498424
  Hypo

SEQ ID NO: 108250 - DNA, 38 bp, Homo sapiens; identical to SEQ ID NO: 73911
  chr12:117512545-117512583
  Hypo

SEQ ID NO: 108251 - DNA, 30 bp, Homo sapiens; identical to SEQ ID NO: 73912
  chr12:117512972-117513002
  Hypo

SEQ ID NO: 108252 - DNA, 523 bp, Homo sapiens; identical to SEQ ID NO: 73913
  chr12:117529736-117530259
  Hypo

SEQ ID NO: 108253 - DNA, 136 bp, Homo sapiens; identical to SEQ ID NO: 73914
  chr12:117530986-117531122
  Hypo

SEQ ID NO: 108254 - DNA, 141 bp, Homo sapiens; identical to SEQ ID NO: 73915
  chr12:117532388-117532529
  Hypo

SEQ ID NO: 108255 - DNA, 148 bp, Homo sapiens; identical to SEQ ID NO: 73916
  chr12:117533174-117533322
  Hypo

SEQ ID NO: 108256 - DNA, 67 bp, Homo sapiens; identical to SEQ ID NO: 43588
  chr12:117544227-117544294
  Hypo

SEQ ID NO: 108257 - DNA, 82 bp, Homo sapiens; identical to SEQ ID NO: 73918
  chr12:117563218-117563300
  Hypo

SEQ ID NO: 108258 - DNA, 100 bp, Homo sapiens; identical to SEQ ID NO: 73919
  chr12:117564823-117564923
  Hypo

SEQ ID NO: 108259 - DNA, 30 bp, Homo sapiens; identical to SEQ ID NO: 73920
  chr12:117669835-117669865
  Hypo

SEQ ID NO: 108260 - DNA, 24 bp, Homo sapiens
  chr12:117716889-117716913
  Hypo
aaatgatcaatgggccgggcgcgg

SEQ ID NO: 108261 - DNA, 152 bp, Homo sapiens; identical to SEQ ID NO: 73922
  chr12:117718680-117718832
  Hypo

SEQ ID NO: 108262 - DNA, 34 bp, Homo sapiens; identical to SEQ ID NO: 73923
  chr12:117796936-117796970
  Hyper

SEQ ID NO: 108263 - DNA, 36 bp, Homo sapiens; identical to SEQ ID NO: 73924
  chr12:117797434-117797470
  Hyper

SEQ ID NO: 108264 - DNA, 1507 bp, Homo sapiens
  chr12:117798084-117799591
  Hyper
tggcgtcctctggggcgcagtcccgagagagccccttccgggacctcggacgcaaggcccctgagtggccctggaagttggatcccccggggaccctgctccgaaccctggccacctggaagcaacctcatcgagcgctccttccactgcccagccccgaaccgtggcggaacgcgcccctcggcctccctagagcctcctttgcgggagaagcacaactttcccaggttttggagacggcgctcttacaccccaatctcgcccagacggaagaagtgagaggtgcgggcggccccgccatgaccgcgggaggagagcgcaaggaggctcctcgcaaagttggaggccaggccggagcgatgttccgggagcggagccctcccagcctcgggcccccagccgcggacagctggcagtgccaaagactccgccattacctgcggctcgcagttgcgattcggccgcagagtcgggcaccgaggaaggcgtaaagttgagcttgggcaggtacaacggtccccagggactggcatcccccagcccgggctgcccgcgggagggtagcgagctgtgccaagggctccgccattaccgccagcgcacagctcggagccaagcgcgcggctgaggaacgactagggtcttgcaaagttggagcctgggcgcgtagacccccggaccggagcccccggcctgaggccgcccgctaggaggaaaatgaggccgcccgaaccaagttgggacgcgcagcaaagcccgagccttccgcgcacaccaggggctcgggcgggagcggggagccctggggacggagaaggggcgcgggacgcctggatcaggaactcacctgacgccgagccgggcagcgccgaggctgcctcttcgcgctgcgcacccgcccgcccgcctcgtactcctcctcttcctcccgggcgcccgcggccgccgcgctccgggttctgaatcctccgagtccgccgccccgcgcggctggagggcgccggttgcacccactcgcctcctggtaggagccgcgcgcgtccctccccttcccctccgctttgtgcctccaagatccctccccaccccctctcccctagcccccactcctcccttctcttcttccctccccttgcgtcccctccctcagcctcagcgaacccaagttcgggacggaggctgcgggcttccccggcgcagtgctgggcgccccgcgcgcgcccctggctcaccccgtccgctcggccgctgctcgctgcccggccgcccctcggaggagccgcggcgctaagtagctcctcacccagcggctggaaacgcggcataaatatgtagggactgagccgtgagctcagcgagggtcgtgagggggaatttatttcttaatgtccctcctttatcctatcatcactgaaacgaattagcagtgacgtccaacccgactggtttatgggtgtggggagggagacgtcgcaaccctcattaaaagagccgctctgggctccaa

SEQ ID NO: 108265 - DNA, 36 bp, Homo sapiens; identical to SEQ ID NO: 73928
  chr12:118177132-118177168
  Hypo

SEQ ID NO: 108266 - DNA, 265 bp, Homo sapiens; identical to SEQ ID NO: 73929
  chr12:118198608-118198873
  Hypo

SEQ ID NO: 108267 - DNA, 45 bp, Homo sapiens; identical to SEQ ID NO: 73930
  chr12:118324438-118324483
  Hypo

SEQ ID NO: 108268 - DNA, 30 bp, Homo sapiens; identical to SEQ ID NO: 73931
  chr12:118331639-118331669
  Hypo

SEQ ID NO: 108269 - DNA, 16 bp, Homo sapiens
  chr12:118711017-118711033
  Hypo
aaaaaatagggccagc

SEQ ID NO: 108270 - DNA, 157 bp, Homo sapiens; identical to SEQ ID NO: 73933
  chr12:118795285-118795442
  Hyper

SEQ ID NO: 108271 - DNA, 30 bp, Homo sapiens; identical to SEQ ID NO: 73934
  chr12:118830447-118830477
  Hypo

SEQ ID NO: 108272 - DNA, 39 bp, Homo sapiens; identical to SEQ ID NO: 43592
  chr12:118860397-118860436
  Hypo

SEQ ID NO: 108273 - DNA, 294 bp, Homo sapiens
  chr12:119212112-119212406
  Hyper
cggggcgtttgaacacgaatttggaggtccttgtttgtccttgaacgcggcagggagtggaggaaggcgccgggaggaggcacaaaatcgctttgtgcgacagcgcccgacagcttctccgcccggagccggctccgccgtgaatgggccgcggacaaaggcgtcccctcccaagtacctgtaattggagcgtccatgtgcgcgggcgctgctgaaatgcaatggacaaaagggagaggaatggccgcatcttccggctgcccgttgctatggtttccgcggagctggtgaagg

SEQ ID NO: 108274 - DNA, 99 bp, Homo sapiens; identical to SEQ ID NO: 73938
  chr12:119417727-119417826
  Hyper

SEQ ID NO: 108275 - DNA, 1307 bp, Homo sapiens
  chr12:119418516-119419823
  Hyper
aaaagtggctgcaggcggattccccaggagtggatgggggtggggtggggtgagatgggaactctttcctctggacggggttggcggcggggacgctgggcaggccggctgtgagacacaaaagagatacccttgacagctccgcatgcacagatgtaacgctgcgccccttggcgggcgggggccctgctcggcagatggcgagaagccgaattggtgagggattgtctatcaaatggcactttctgggtggtggagacctcgctaacccccggcgcaaagaggaacgcagggcaccctctgtaccggcctaggccgtgtctcccaaaagtgagggtctgggggaggccggctggggtggatagattaagttttttacgagcccccccaaccccccccccccccccacgcagaagatcagctacaagacttgcgaaggggctggaaagaaaggtggcctggcccaaagggggcacccaggaaagggctgaggaaggccagcgatgatgggagaggagaggggcctgggaagcaggatctcctgcctggcgcagattggggtgccaggatggcttctcagagggatcagcgctgcaactcggtcgccgcggggccctggtgacaggcgcacgccccgccctttctcctcccaagacctgcgggcttttgttatgcagatggcggcaggaggctgagcctgaggaggagggggttggtggggaggaggagagacggagaggggggaggaaagtgcagctcgcgcgaccagcctcctcttccaacgtcacattgtgcgagagacaaaacccgggcgcgccggagctcacacgcgcacgcacacacatccgaccccgtcgcctcttctctcctggtgctgcccagaaagccagccctcccttcccttcttggggcgcagaggctcagccagctcagagcgcagcctggagccgacccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctttttgagaagttctggcgaggaaccttcaaagcggtggccaccccccgtcccgagagcatcattgtcgccagtatcacggcccgcaagccgctgccaaggtaat

SEQ ID NO: 108276 - DNA, 80 bp, Homo sapiens; identical to SEQ ID NO: 73941
  chr12:119446570-119446650
  Hyper

SEQ ID NO: 108277 - DNA, 91 bp, Homo sapiens; identical to SEQ ID NO: 34717
  chr12:119458719-119458810
  Hyper

SEQ ID NO: 108278 - DNA, 318 bp, Homo sapiens; identical to SEQ ID NO: 73943
  chr12:119499049-119499367
  Hyper

SEQ ID NO: 108279 - DNA, 83 bp, Homo sapiens; identical to SEQ ID NO: 73944
  chr12:119616507-119616590
  Hyper

SEQ ID NO: 108280 - DNA, 32 bp, Homo sapiens; identical to SEQ ID NO: 73945
  chr12:119730037-119730069
  Hypo

SEQ ID NO: 108281 - DNA, 36 bp, Homo sapiens; identical to SEQ ID NO: 73946
  chr12:120001632-120001668
  Hypo

SEQ ID NO: 108282 - DNA, 380 bp, Homo sapiens; identical to SEQ ID NO: 73947
  chr12:120031519-120031899
  Hyper

SEQ ID NO: 108283 - DNA, 1064 bp, Homo sapiens
  chr12:120032256-120033320
  Hyper
agcatgcaggctctacgttcctttccctgccgctccgggggctcctgctctccagcgcccaggactgtctctatctcagcctgtgctcccttctctctttgctgcgcccaagggcaccgcttccgccactctccggggggtccccaggcgattcctgatgccccctccttgatcccgtttccgcgctttggcacggcacgctctgtccaggcaacagtttcctctcgcttcttcctacacccaacttcctctccttgcctccctccggcgccccctttttaacgcgcccgaggctggctcacacccactacctctttaggcctttcttaggctccccgtgtgcccccctcaccagcaaagtgggtgcgcctctcttactctttctacccagcgcgtcgtagttcctccccgtttgctgcgcactggccctaacctctcttctcttggtgtcccccagagctcccaggcgcccctccaccgctctgtcctgcgcccggggctctcccgggaatgaactaggggattccacgcaacgtgcggctccgcccgccctctgcgctcagacctcccgagctgcccgcctctctaggagtggccgctggggcctctagtccgcccttccggagctcagctccctagccctcttcaaccctggtaggaacacccgagcgaaccccaccaggagggcgacgagcgcctgctaggccctcgccttattgactgcagcagctggcccgggggtggcggcggggtgaggttcgtaccggcactgtcccgggacaacccttgcagttgcgctccctcccccaccggctcacctcgcctgcagctgggccacggaactccccggccacagacgcagagccctgattcagcgctgtgaaaatcgctagccacccgtcccccatcaagtccgcccacacttgcccacgggtggtggcaccatattcgattcgtgggcacctgcaaggctccatttgcacccgtaacttgccctttcccaaacccggtttgtggacagcgtctgcaccgatatgaaagcgtgcagccgctgaagttcagac

SEQ ID NO: 108284 - DNA, 25 bp, Homo sapiens
  chr12:120087669-120087694
  Hypo
aaaaaaaaaaagggccgggcgcgtt

SEQ ID NO: 108285 - DNA, 184 bp, Homo sapiens; identical to SEQ ID NO: 73952
  chr12:120148212-120148396
  Hypo

SEQ ID NO: 108286 - DNA, 380 bp, Homo sapiens; identical to SEQ ID NO: 73953
  chr12:120148731-120149111
  Hypo

SEQ ID NO: 108287 - DNA, 54 bp, Homo sapiens; identical to SEQ ID NO: 73954
  chr12:120152051-120152105
  Hypo

SEQ ID NO: 108288 - DNA, 81 bp, Homo sapiens; identical to SEQ ID NO: 73955
  chr12:120173056-120173137
  Hypo

SEQ ID NO: 108289 - DNA, 30 bp, Homo sapiens; identical to SEQ ID NO: 73956
  chr12:120353676-120353706
  Hypo

SEQ ID NO: 108290 - DNA, 22 bp, Homo sapiens
  chr12:120411854-120411876
  Hypo
aggcgcggtggctcacgcctgt

SEQ ID NO: 108291 - DNA, 67 bp, Homo sapiens; identical to SEQ ID NO: 73958
  chr12:120574326-120574393
  Hypo

SEQ ID NO: 108292 - DNA, 63 bp, Homo sapiens; identical to SEQ ID NO: 43596
  chr12:120580446-120580509
  Hypo

SEQ ID NO: 108293 - DNA, 30 bp, Homo sapiens; identical to SEQ ID NO: 73960
  chr12:120620325-120620355
  Hypo

SEQ ID NO: 108294 - DNA, 30 bp, Homo sapiens; identical to SEQ ID NO: 73961
  chr12:120661930-120661960
  Hypo

SEQ ID NO: 108295 - DNA, 30 bp, Homo sapiens; identical to SEQ ID NO: 73962
  chr12:120724619-120724649
  Hypo

SEQ ID NO: 108296 - DNA, 42 bp, Homo sapiens; identical to SEQ ID NO: 73963
  chr12:120728061-120728103
  Hypo

SEQ ID NO: 108297 - DNA, 30 bp, Homo sapiens; identical to SEQ ID NO: 43597
  chr12:120740933-120740963
  Hypo

SEQ ID NO: 108298 - DNA, 30 bp, Homo sapiens; identical to SEQ ID NO: 73965
  chr12:120750504-120750534
  Hypo

SEQ ID NO: 108299 - DNA, 26 bp, Homo sapiens
  chr12:120758797-120758823
  Hypo
tttagaaaagaaagtcgtggccgtgt

SEQ ID NO: 108300 - DNA, 444 bp, Homo sapiens; identical to SEQ ID NO: 73967
  chr12:120806287-120806731
  Hyper

SEQ ID NO: 108301 - DNA, 580 bp, Homo sapiens; identical to SEQ ID NO: 73968
  chr12:120807457-120808037
  Hyper

SEQ ID NO: 108302 - DNA, 165 bp, Homo sapiens; identical to SEQ ID NO: 73969
  chr12:120826806-120826971
  Hyper

SEQ ID NO: 108303 - DNA, 26 bp, Homo sapiens
  chr12:120868614-120868640
  Hypo
tttttttttttgagacggagtttcgc

SEQ ID NO: 108304 - DNA, 20 bp, Homo sapiens
  chr12:120877324-120877344
  Hypo
aactccgtctcaaaaaaaaa

SEQ ID NO: 108305 - DNA, 27 bp, Homo sapiens
  chr12:120885154-120885181
  Hypo
ggtgtgagccaccgcgcctggcctaat

SEQ ID NO: 108306 - DNA, 42 bp, Homo sapiens; identical to SEQ ID NO: 43598
  chr12:120932999-120933041
  Hypo

SEQ ID NO: 108307 - DNA, 62 bp, Homo sapiens; identical to SEQ ID NO: 73974
  chr12:121163445-121163507
  Hyper

SEQ ID NO: 108308 - DNA, 30 bp, Homo sapiens; identical to SEQ ID NO: 73975
  chr12:121163726-121163756
  Hyper

SEQ ID NO: 108309 - DNA, 30 bp, Homo sapiens; identical to SEQ ID NO: 73976
  chr12:121197853-121197883
  Hypo

SEQ ID NO: 108310 - DNA, 30 bp, Homo sapiens; identical to SEQ ID NO: 73977
  chr12:121204975-121205005
  Hypo

SEQ ID NO: 108311 - DNA, 30 bp, Homo sapiens; identical to SEQ ID NO: 73978
  chr12:121211742-121211772
  Hypo

SEQ ID NO: 108312 - DNA, 209 bp, Homo sapiens; identical to SEQ ID NO: 73979
  chr12:121366974-121367183
  Hypo

SEQ ID NO: 108313 - DNA, 169 bp, Homo sapiens; identical to SEQ ID NO: 73980
  chr12:121394362-121394531
  Hypo

SEQ ID NO: 108314 - DNA, 191 bp, Homo sapiens; identical to SEQ ID NO: 34727
  chr12:121566850-121567041
  Hyper

SEQ ID NO: 108315 - DNA, 93 bp, Homo sapiens; identical to SEQ ID NO: 73982
  chr12:121622470-121622563
  Hypo

SEQ ID NO: 108316 - DNA, 30 bp, Homo sapiens; identical to SEQ ID NO: 43600
  chr12:121641645-121641675
  Hypo

SEQ ID NO: 108317 - DNA, 30 bp, Homo sapiens; identical to SEQ ID NO: 73984
  chr12:121653407-121653437
  Hypo

SEQ ID NO: 108318 - DNA, 44 bp, Homo sapiens; identical to SEQ ID NO: 73985
  chr12:121667860-121667904
  Hypo

SEQ ID NO: 108319 - DNA, 30 bp, Homo sapiens; identical to SEQ ID NO: 43601
  chr12:121688301-121688331
  Hypo

SEQ ID NO: 108320 - DNA, 30 bp, Homo sapiens; identical to SEQ ID NO: 73987
  chr12:121740282-121740312
  Hypo

SEQ ID NO: 108321 - DNA, 82 bp, Homo sapiens; identical to SEQ ID NO: 43602
  chr12:122107201-122107283
  Hypo

SEQ ID NO: 108322 - DNA, 46 bp, Homo sapiens; identical to SEQ ID NO: 15700
  chr12:122141060-122141106
  Hypo

SEQ ID NO: 108323 - DNA, 30 bp, Homo sapiens; identical to SEQ ID NO: 73990
  chr12:122186181-122186211
  Hypo

SEQ ID NO: 108324 - DNA, 30 bp, Homo sapiens; identical to SEQ ID NO: 73991
  chr12:122192959-122192989
  Hypo

SEQ ID NO: 108325 - DNA, 81 bp, Homo sapiens; identical to SEQ ID NO: 73992
  chr12:122204974-122205055
  Hypo

SEQ ID NO: 108326 - DNA, 200 bp, Homo sapiens; identical to SEQ ID NO: 73993
  chr12:122205355-122205555
  Hypo

SEQ ID NO: 108327 - DNA, 66 bp, Homo sapiens; identical to SEQ ID NO: 73994
  chr12:122208388-122208454
  Hypo

SEQ ID NO: 108328 - DNA, 30 bp, Homo sapiens; identical to SEQ ID NO: 73995
  chr12:122208777-122208807
  Hypo

SEQ ID NO: 108329 - DNA, 123 bp, Homo sapiens; identical to SEQ ID NO: 73996
  chr12:122212425-122212548
  Hypo

SEQ ID NO: 108330 - DNA, 85 bp, Homo sapiens; identical to SEQ ID NO: 43605
  chr12:122213608-122213693
  Hypo

SEQ ID NO: 108331 - DNA, 30 bp, Homo sapiens; identical to SEQ ID NO: 73998
  chr12:122219029-122219059
  Hypo

SEQ ID NO: 108332 - DNA, 176 bp, Homo sapiens; identical to SEQ ID NO: 73999
  chr12:122231347-122231523
  Hyper

SEQ ID NO: 108333 - DNA, 166 bp, Homo sapiens; identical to SEQ ID NO: 43606
  chr12:122281163-122281329
  Hypo

SEQ ID NO: 108334 - DNA, 139 bp, Homo sapiens; identical to SEQ ID NO: 74001
  chr12:122284969-122285108
  Hypo

SEQ ID NO: 108335 - DNA, 30 bp, Homo sapiens; identical to SEQ ID NO: 15703
  chr12:122292767-122292797
  Hypo

SEQ ID NO: 108336 - DNA, 21 bp, Homo sapiens
  chr12:122301174-122301195
  Hypo
ccactgcgcccagccagctct

SEQ ID NO: 108337 - DNA, 140 bp, Homo sapiens; identical to SEQ ID NO: 74004
  chr12:122343727-122343867
  Hypo

SEQ ID NO: 108338 - DNA, 112 bp, Homo sapiens; identical to SEQ ID NO: 43609
  chr12:122439399-122439511
  Hypo

SEQ ID NO: 108339 - DNA, 53 bp, Homo sapiens; identical to SEQ ID NO: 43610
  chr12:122458643-122458696
  Hypo

SEQ ID NO: 108340 - DNA, 30 bp, Homo sapiens; identical to SEQ ID NO: 74007
  chr12:122487551-122487581
  Hypo

SEQ ID NO: 108341 - DNA, 68 bp, Homo sapiens; identical to SEQ ID NO: 74008
  chr12:122591572-122591640
  Hypo

SEQ ID NO: 108342 - DNA, 23 bp, Homo sapiens
  chr12:122596891-122596914
  Hypo
aatgtatgtacaggccgggcgtg

SEQ ID NO: 108343 - DNA, 86 bp, Homo sapiens; identical to SEQ ID NO: 74010
  chr12:122602862-122602948
  Hypo

SEQ ID NO: 108344 - DNA, 352 bp, Homo sapiens; identical to SEQ ID NO: 74011
  chr12:122622033-122622385
  Hypo

SEQ ID NO: 108345 - DNA, 48 bp, Homo sapiens; identical to SEQ ID NO: 74012
  chr12:122622594-122622642
  Hypo

SEQ ID NO: 108346 - DNA, 114 bp, Homo sapiens; identical to SEQ ID NO: 74013
  chr12:122623990-122624104
  Hypo

SEQ ID NO: 108347 - DNA, 30 bp, Homo sapiens; identical to SEQ ID NO: 74014
  chr12:122643546-122643576
  Hypo

SEQ ID NO: 108348 - DNA, 33 bp, Homo sapiens; identical to SEQ ID NO: 74015
  chr12:122658513-122658546
  Hypo

SEQ ID NO: 108349 - DNA, 163 bp, Homo sapiens; identical to SEQ ID NO: 74016
  chr12:122667736-122667899
  Hyper

SEQ ID NO: 108350 - DNA, 573 bp, Homo sapiens; identical to SEQ ID NO: 74017
  chr12:122688648-122689221
  Hyper

SEQ ID NO: 108351 - DNA, 42 bp, Homo sapiens; identical to SEQ ID NO: 74018
  chr12:122691182-122691224
  Hypo

SEQ ID NO: 108352 - DNA, 30 bp, Homo sapiens; identical to SEQ ID NO: 74019
  chr12:122958549-122958579
  Hypo

SEQ ID NO: 108353 - DNA, 180 bp, Homo sapiens; identical to SEQ ID NO: 74020
  chr12:123128959-123129139
  Hypo

SEQ ID NO: 108354 - DNA, 29 bp, Homo sapiens
  chr12:123233817-123233846
  Hypo
tcagccaccgcgcccgccctattactatt

SEQ ID NO: 108355 - DNA, 171 bp, Homo sapiens; identical to SEQ ID NO: 74022
  chr12:123333222-123333393
  Hypo

SEQ ID NO: 108356 - DNA, 16 bp, Homo sapiens
  chr12:123373979-123373995
  Hypo
cagtttcaggccgggc

SEQ ID NO: 108357 - DNA, 30 bp, Homo sapiens; identical to SEQ ID NO: 74024
  chr12:123428902-123428932
  Hypo

SEQ ID NO: 108358 - DNA, 216 bp, Homo sapiens; identical to SEQ ID NO: 74025
  chr12:123436083-123436299
  Hypo

SEQ ID NO: 108359 - DNA, 30 bp, Homo sapiens; identical to SEQ ID NO: 74026
  chr12:123636606-123636636
  Hypo

SEQ ID NO: 108360 - DNA, 123 bp, Homo sapiens; identical to SEQ ID NO: 74027
  chr12:123753196-123753319
  Hyper

SEQ ID NO: 108361 - DNA, 38 bp, Homo sapiens; identical to SEQ ID NO: 43619
  chr12:123881693-123881731
  Hypo

SEQ ID NO: 108362 - DNA, 214 bp, Homo sapiens; identical to SEQ ID NO: 74029
  chr12:123920513-123920727
  Hyper

SEQ ID NO: 108363 - DNA, 34 bp, Homo sapiens; identical to SEQ ID NO: 74030
  chr12:123921841-123921875
  Hypo

SEQ ID NO: 108364 - DNA, 84 bp, Homo sapiens; identical to SEQ ID NO: 74032
  chr12:123998069-123998153
  Hypo

SEQ ID NO: 108365 - DNA, 30 bp, Homo sapiens; identical to SEQ ID NO: 74033
  chr12:124092980-124093010
  Hypo

SEQ ID NO: 108366 - DNA, 38 bp, Homo sapiens; identical to SEQ ID NO: 74034
  chr12:124117199-124117237
  Hypo

SEQ ID NO: 108367 - DNA, 30 bp, Homo sapiens; identical to SEQ ID NO: 74035
  chr12:124152701-124152731
  Hypo

SEQ ID NO: 108368 - DNA, 78 bp, Homo sapiens; identical to SEQ ID NO: 74037
  chr12:124195871-124195949
  Hypo

SEQ ID NO: 108369 - DNA, 30 bp, Homo sapiens; identical to SEQ ID NO: 43621
  chr12:124284067-124284097
  Hypo

SEQ ID NO: 108370 - DNA, 30 bp, Homo sapiens; identical to SEQ ID NO: 74039
  chr12:124285872-124285902
  Hypo

SEQ ID NO: 108371 - DNA, 30 bp, Homo sapiens; identical to SEQ ID NO: 74040
  chr12:124323044-124323074
  Hypo

SEQ ID NO: 108372 - DNA, 44 bp, Homo sapiens; identical to SEQ ID NO: 74041
  chr12:124393560-124393604
  Hypo

SEQ ID NO: 108373 - DNA, 30 bp, Homo sapiens; identical to SEQ ID NO: 43623
  chr12:124397588-124397618
  Hypo

SEQ ID NO: 108374 - DNA, 92 bp, Homo sapiens; identical to SEQ ID NO: 43624
  chr12:124404180-124404272
  Hypo

SEQ ID NO: 108375 - DNA, 30 bp, Homo sapiens; identical to SEQ ID NO: 74044
  chr12:124566628-124566658
  Hypo

SEQ ID NO: 108376 - DNA, 78 bp, Homo sapiens; identical to SEQ ID NO: 74045
  chr12:124651773-124651851
  Hypo

SEQ ID NO: 108377 - DNA, 207 bp, Homo sapiens; identical to SEQ ID NO: 43626
  chr12:124716795-124717002
  Hypo

SEQ ID NO: 108378 - DNA, 30 bp, Homo sapiens; identical to SEQ ID NO: 74047
  chr12:124723968-124723998
  Hypo

SEQ ID NO: 108379 - DNA, 169 bp, Homo sapiens; identical to SEQ ID NO: 74048
  chr12:124726523-124726692
  Hypo

SEQ ID NO: 108380 - DNA, 283 bp, Homo sapiens; identical to SEQ ID NO: 74049
  chr12:124778114-124778397
  Hypo

SEQ ID NO: 108381 - DNA, 88 bp, Homo sapiens; identical to SEQ ID NO: 74050
  chr12:124779505-124779593
  Hyper

SEQ ID NO: 108382 - DNA, 36 bp, Homo sapiens; identical to SEQ ID NO: 74051
  chr12:124780202-124780238
  Hyper

SEQ ID NO: 108383 - DNA, 143 bp, Homo sapiens; identical to SEQ ID NO: 74052
  chr12:124780828-124780971
  Hyper

SEQ ID NO: 108384 - DNA, 30 bp, Homo sapiens; identical to SEQ ID NO: 43628
  chr12:124782655-124782685
  Hypo

SEQ ID NO: 108385 - DNA, 223 bp, Homo sapiens; identical to SEQ ID NO: 43629
  chr12:124788775-124788998
  Hypo

SEQ ID NO: 108386 - DNA, 52 bp, Homo sapiens; identical to SEQ ID NO: 74055
  chr12:124799068-124799120
  Hypo

SEQ ID NO: 108387 - DNA, 30 bp, Homo sapiens; identical to SEQ ID NO: 74056
  chr12:124832960-124832990
  Hypo

SEQ ID NO: 108388 - DNA, 33 bp, Homo sapiens; identical to SEQ ID NO: 43630
  chr12:124843830-124843863
  Hypo

SEQ ID NO: 108389 - DNA, 276 bp, Homo sapiens; identical to SEQ ID NO: 74058
  chr12:124869876-124870152
  Hypo

SEQ ID NO: 108390 - DNA, 239 bp, Homo sapiens; identical to SEQ ID NO: 74059
  chr12:124880121-124880360
  Hypo

SEQ ID NO: 108391 - DNA, 108 bp, Homo sapiens; identical to SEQ ID NO: 74060
  chr12:124890812-124890920
  Hypo

SEQ ID NO: 108392 - DNA, 168 bp, Homo sapiens; identical to SEQ ID NO: 74061
  chr12:124893402-124893570
  Hypo

SEQ ID NO: 108393 - DNA, 30 bp, Homo sapiens; identical to SEQ ID NO: 74062
  chr12:124985749-124985779
  Hypo

SEQ ID NO: 108394 - DNA, 165 bp, Homo sapiens; identical to SEQ ID NO: 74063
  chr12:124989245-124989410
  Hypo

SEQ ID NO: 108395 - DNA, 30 bp, Homo sapiens; identical to SEQ ID NO: 74064
  chr12:125001347-125001377
  Hypo

SEQ ID NO: 108396 - DNA, 54 bp, Homo sapiens; identical to SEQ ID NO: 15714
  chr12:125009346-125009400
  Hypo

SEQ ID NO: 108397 - DNA, 40 bp, Homo sapiens; identical to SEQ ID NO: 74066
  chr12:125027278-125027318
  Hypo

SEQ ID NO: 108398 - DNA, 51 bp, Homo sapiens; identical to SEQ ID NO: 74068
  chr12:125062836-125062887
  Hypo

SEQ ID NO: 108399 - DNA, 30 bp, Homo sapiens; identical to SEQ ID NO: 74069
  chr12:125091024-125091054
  Hypo

SEQ ID NO: 108400 - DNA, 84 bp, Homo sapiens; identical to SEQ ID NO: 74070
  chr12:125092412-125092496
  Hypo

SEQ ID NO: 108401 - DNA, 493 bp, Homo sapiens; identical to SEQ ID NO: 74071
  chr12:125102096-125102589
  Hypo

SEQ ID NO: 108402 - DNA, 65 bp, Homo sapiens; identical to SEQ ID NO: 43638
  chr12:125102819-125102884
  Hypo

SEQ ID NO: 108403 - DNA, 58 bp, Homo sapiens; identical to SEQ ID NO: 43639
  chr12:125119323-125119381
  Hypo

SEQ ID NO: 108404 - DNA, 232 bp, Homo sapiens; identical to SEQ ID NO: 74074
  chr12:125122425-125122657
  Hypo

SEQ ID NO: 108405 - DNA, 146 bp, Homo sapiens; identical to SEQ ID NO: 43640
  chr12:125152108-125152254
  Hypo

SEQ ID NO: 108406 - DNA, 85 bp, Homo sapiens; identical to SEQ ID NO: 74076
  chr12:125167660-125167745
  Hypo

SEQ ID NO: 108407 - DNA, 30 bp, Homo sapiens; identical to SEQ ID NO: 74077
  chr12:125184551-125184581
  Hypo

SEQ ID NO: 108408 - DNA, 30 bp, Homo sapiens; identical to SEQ ID NO: 43642
  chr12:125200849-125200879
  Hypo

SEQ ID NO: 108409 - DNA, 30 bp, Homo sapiens; identical to SEQ ID NO: 74079
  chr12:125336074-125336104
  Hypo

SEQ ID NO: 108410 - DNA, 485 bp, Homo sapiens; identical to SEQ ID NO: 74080
  chr12:125533937-125534422
  Hyper

SEQ ID NO: 108411 - DNA, 191 bp, Homo sapiens; identical to SEQ ID NO: 74081
  chr12:125565948-125566139
  Hypo

SEQ ID NO: 108412 - DNA, 159 bp, Homo sapiens; identical to SEQ ID NO: 74082
  chr12:125578406-125578565
  Hypo

SEQ ID NO: 108413 - DNA, 98 bp, Homo sapiens; identical to SEQ ID NO: 74083
  chr12:125609670-125609768
  Hypo

SEQ ID NO: 108414 - DNA, 343 bp, Homo sapiens
  chr12:125670102-125670445
  Hyper
ctggatggaagaattcgaccacctagtacccggccctgcgcaacacctccgctccgtcactgcctgaccctgcgctgggaactcattcccgggaccgccagggaatctgcccttcccaggagaactcctggctgcctccgcgtgctcctagggcctgcgcgaaatgggaaggcgcatcctctagcctgggtaaataagggaccctgcctcacccgggtggccatccccaggccgccttcgctgtgtttcaggtcaccgcacccagcctgcgcacccctagcccccatcccggtgccgtgcagaggctctgcacacagcctcggcctcccggaggccctcccct

SEQ ID NO: 108415 - DNA, 551 bp, Homo sapiens; identical to SEQ ID NO: 74086
  chr12:125671499-125672050
  Hyper

SEQ ID NO: 108416 - DNA, 268 bp, Homo sapiens; identical to SEQ ID NO: 34736
  chr12:125672764-125673032
  Hyper

SEQ ID NO: 108417 - DNA, 199 bp, Homo sapiens; identical to SEQ ID NO: 74088
  chr12:125812590-125812789
  Hypo

SEQ ID NO: 108418 - DNA, 186 bp, Homo sapiens; identical to SEQ ID NO: 43645
  chr12:125813536-125813722
  Hypo

SEQ ID NO: 108419 - DNA, 161 bp, Homo sapiens; identical to SEQ ID NO: 74090
  chr12:125977237-125977398
  Hypo

SEQ ID NO: 108420 - DNA, 114 bp, Homo sapiens
  chr12:126018151-126018265
  Hyper
gggcgatggtcctggcgcacccgctagatggcgccgcagaccggcttgtacaggccgcgcgccctcccctccccggcggaggctcctggagcccctgcccggcctgactggctg

SEQ ID NO: 108421 - DNA, 246 bp, Homo sapiens; identical to SEQ ID NO: 74093
  chr12:126168425-126168671
  Hyper

SEQ ID NO: 108422 - DNA, 29 bp, Homo sapiens
  chr12:126243099-126243128
  Hypo
tgagccaccgcgcccggctgatgattgtg

SEQ ID NO: 108423 - DNA, 45 bp, Homo sapiens; identical to SEQ ID NO: 74095
  chr12:126288373-126288418
  Hypo

SEQ ID NO: 108424 - DNA, 280 bp, Homo sapiens; identical to SEQ ID NO: 74096
  chr12:126675639-126675919
  Hyper

SEQ ID NO: 108425 - DNA, 139 bp, Homo sapiens; identical to SEQ ID NO: 74097
  chr12:127051874-127052013
  Hypo

SEQ ID NO: 108426 - DNA, 367 bp, Homo sapiens
  chr12:127211018-127211385
  Hyper
gggagtctgcagacacggagtttccgtgccagaggagcgggtccacgcggacaggcagttccagctccgggtaagtgcggccccatctcctctccgtccccggctccgccagcagcagtcccggagagatttcccctccccgccgcccgcgctctctctcctcctgcgcccaggccggtctccggctccggagtcggacggcgacggtgcagatgagggcgcacaggggacggtcctggagcccgggaagggtgcgagatggagacggcggttcagaaaagttgtcaggtctccagcccgggcagtggcgggagctggagccgcggtggagacgactcgaggggacgcagcccgcctggcacaaagg

SEQ ID NO: 108427 - DNA, 60 bp, Homo sapiens; identical to SEQ ID NO: 74099
  chr12:127212512-127212572
  Hyper

SEQ ID NO: 108428 - DNA, 30 bp, Homo sapiens; identical to SEQ ID NO: 74100
  chr12:127519655-127519685
  Hypo

SEQ ID NO: 108429 - DNA, 387 bp, Homo sapiens; identical to SEQ ID NO: 74101
  chr12:127765141-127765528
  Hyper

SEQ ID NO: 108430 - DNA, 192 bp, Homo sapiens
  chr12:127865670-127865862
  Hyper
ggaaggcctggaaatcgcaggtcctgaggacgcggcgagttcacggagaggacctgccgggcaggggctctgggagcctccgcggggaggggagggcgcgcggccggcgcggccacaacccggtctgcggcgccatctagcgggcgcgccgggaccgtcgcccactaggcccttttccggaggagaagctga

SEQ ID NO: 108431 - DNA, 165 bp, Homo sapiens; identical to SEQ ID NO: 74104
  chr12:127939926-127940091
  Hyper

SEQ ID NO: 108432 - DNA, 187 bp, Homo sapiens
  chr12:127940356-127940543
  Hyper
ccggggccggaaaggcgaggcggggctggggctggggcggctgcggggcgcgggggagatgccgaggggctgggctggggcagggtctgcaggtgcggcgggcggatcagcggcacccgctgcagacgcggtcggcgaaacgtcgtcccggccccagctcgagcagcggctccgggtggacctcgca

SEQ ID NO: 108433 - DNA, 30 bp, Homo sapiens; identical to SEQ ID NO: 74107
  chr12:128142127-128142157
  Hypo

SEQ ID NO: 108434 - DNA, 30 bp, Homo sapiens; identical to SEQ ID NO: 74108
  chr12:128245440-128245470
  Hypo

SEQ ID NO: 108435 - DNA, 81 bp, Homo sapiens; identical to SEQ ID NO: 74109
  chr12:128310374-128310455
  Hypo

SEQ ID NO: 108436 - DNA, 28 bp, Homo sapiens
  chr12:128310875-128310903
  Hypo
cttcaggaaggaagccgggaccctcgcg

SEQ ID NO: 108437 - DNA, 28 bp, Homo sapiens
  chr12:128311023-128311051
  Hypo
ccttcgcagtgaacgttacagctcttaa

SEQ ID NO: 108438 - DNA, 2122 bp, Homo sapiens
  chr12:128751118-128753240
  Hyper
catctgtcttgagcccgcaccccgccttcacgctccgctgcgcgctgcttttccgcgctcagtgatccagttaggagctctccccgcagcagctgcgcgggactttgcattccagatgtccccagccctccaggctaaagcagcggccacctgaagttgaggaatggggcgtgacgaccaccaggtcccgcagtgaccacgggagggtggggagaaggagtccagctccgccttgagcgtcgggtccctgggcaggaccctccgggccacgggccgctgtccgttgggcacccgggcaggagtctgcgaacgctgagtttctctggaaaggcgcggacccccggaggagccgtcccagccgcctggggagacgccccctcctctcccggtcttctttcccgggcacaccctccctagcccgggcgggggggttctccatctgccgcccctcccggcgggcaggcgaactctctcctaccgcaccctcaatctgtccgcggtcgcggggctcggcgggggcggggcccgggcgggggcgggggcggggccgggggcggggcgggccggcggctgcggaggctgcggaggctgcgggagaaaagttgtcccggccggagcgcgagcagcggcggagccggagccgccagagccagagccggagctgcggcggcgtggacccggcaggggcgggcctcggacagcagagacgcagcgggcccggccgaccgggctgcgggagtggccccgggcatggggcggccggcgggggccgcgggcgggcgctgcgcttcgggctggcggcgggctgcgtgagcggccgggacgcaggatgcgctccgagggtgcggcccccgggccggcggcgccgctgtgcggggcgctgagcctgctgctgggcgcgctgctgggcaaaggtaaggccggggcgggtgcctggcgcgccgacgcatgcgaacttcccggttccgggggagctcggggtgagggcagccgaagcgaggggtgcggcgggggcctcggcgggggctcggatcccatcaacagcgcctctgcgggtgccgagccgcccctaatccagaagggcgctcccagctgggcgccgggatccgggcaagttaggctggtcccgagtcccgaatctcccaccccggaccccccagacccagagctgccccgcggatgaggagggggcgtggctgagggacacggtgtttgttccccatccctgagttccgtgcggacctgccccagccccagcacagtcaccctgtggaactggcatccaggagaggtgctccgctctgtgcgctccttcctcccggctgtgtgctccctgtccacagctccccatccacagcttcggcactgtggggctggtgctccaggagggaaggcccggttctttgcatcccctttccgcaaccgctagggtctctgtgcgggccctagaggaacgctcactcatcgcgcagctcaccagggaccccagcttggcagaaaccaggggctctctgcgggttctctcaaatgagtcctttgcggtgggggagcgcggatggggaggtgggtgcgtccctcgcgacgggaactacctcaccagcggtcctgtccggggctccttcacctcagtgtcctcttctctacaatgggagtgacggccctgctttgggttggaggaatttaaaggagttaacgtatggcgcccgcagggctcacgaaaggtagccgtgtggtttttccgaccttttttattatgtgcgtgtgcggccgagtggccgcgcggatgcggcggcgggaagggcggggagaggcggtctccagccccaggagccgcggggcaggcggggagcaaggcctaggctctgccagggcagcagctgcccgagtcccggggcgcgcccagggcgtagaaaaaggagagcgtcgctttcctgctccccgcgccctggcgaaggtctcgggttcatttggttaaacggaggtgcgcacatgggtgccctgagccttcgcgcggcgccgcgggtccagtatcggccccaggctctgagcagagaacactcaaagccacccttctcccgcctaatgctctgaggctgagctagaaatgcgttcagagagacaa

SEQ ID NO: 108439 - DNA, 234 bp, Homo sapiens
  chr12:128850534-128850768
  Hyper
aaactcagctggatccgcgggccgtgattaaacacattgcccgctttgttgccgagatggtgtttcggaaggcgctgtgaatgcacttccctttgcggggctcacacagacaagatgtgtgttgcaaggatgaggcgcctgctcggcctccagcccagggccgggaagggagaaggtgctgtgcgtcgctgcctgtgtcgcccgcggctctcctcccagcgacagactccagac

SEQ ID NO: 108440 - DNA, 166 bp, Homo sapiens; identical to SEQ ID NO: 43651
  chr12:128899701-128899867
  Hypo

SEQ ID NO: 108441 - DNA, 91 bp, Homo sapiens; identical to SEQ ID NO: 74119
  chr12:128944040-128944131
  Hypo

SEQ ID NO: 108442 - DNA, 193 bp, Homo sapiens; identical to SEQ ID NO: 43652
  chr12:128964823-128965016
  Hypo

SEQ ID NO: 108443 - DNA, 30 bp, Homo sapiens; identical to SEQ ID NO: 43653
  chr12:129028675-129028705
  Hypo

SEQ ID NO: 108444 - DNA, 30 bp, Homo sapiens; identical to SEQ ID NO: 74122
  chr12:129189879-129189909
  Hypo

SEQ ID NO: 108445 - DNA, 30 bp, Homo sapiens; identical to SEQ ID NO: 74123
  chr12:129190114-129190144
  Hypo

SEQ ID NO: 108446 - DNA, 1114 bp, Homo sapiens
  chr12:129337805-129338919
  Hyper
gatggtcctggtccccgtggaagggactgtggtcaccgctggtcctggtccaggtggaaacagaccgcggctaccctggtgatggaccccacggggcacacccgcgccaccccgcacccagggctcgcgccgcccgaggcccccggttcctgtccccctccccgcctggcgccggaacctgcgagctggggcgcggcctcggggaggggcgggcgggacagacccagccgccccggctcccccgccgtccgcgtctgcgccggccccggggcctggtcggcggcggcggggccggtcgatggcccgggcggcggcggcggcatgcggctcctgttcctggcggtgctgcggccacacaccggcaacgcggtcacggcccagcgcgttcggtaggtgcagggcgccggggcctacgaagcctgggccgggggccggggggcggggacgcgggacccggggacgcggggcgctcagccaggccccctccagccgcgccggggccgtcccgagccgcgcgcacaaacggatgggccggtgccgcctgccgggcgcgcgggggtcggtgccttctgcgtggcgcgcgtgtccccgggtctccgtgcggccggcgcattggcctcgcgctctccggaggggactgagcaggtgaacaggcccggagcctgtcgtggaggggcccgggaaggcctcgctgcagaagcaggatgggagcaggatccgcagggatgcgcagcggggtccgcggagctcccggcgggggcgcgtttccaggccggggaccgcggtgccagccctgccctcgcggatcgggtctcggctgtgtgccggcgtccggggtcctgtccccgaagtccctttcccacctcccctctgccctgtctattctcgtcttcctggctggttagctccttcacactcatctttttctgcctttgtcttatttgtttacttgttggtctgtgttctggtcgctggaacgcaagcccggcgggggcccggggaggggccgccgcgttaatcccgccgcctcccacccgcacagcgggcgctcggcctgtattagccggataaacatattccttgaggcgaagcctgggaagtgccaggattagag

SEQ ID NO: 108447 - DNA, 30 bp, Homo sapiens; identical to SEQ ID NO: 43654
  chr12:129441934-129441964
  Hypo

SEQ ID NO: 108448 - DNA, 120 bp, Homo sapiens; identical to SEQ ID NO: 74128
  chr12:129520236-129520356
  Hypo

SEQ ID NO: 108449 - DNA, 77 bp, Homo sapiens; identical to SEQ ID NO: 74129
  chr12:129615016-129615093
  Hypo

SEQ ID NO: 108450 - DNA, 30 bp, Homo sapiens; identical to SEQ ID NO: 74130
  chr12:129728999-129729029
  Hypo

SEQ ID NO: 108451 - DNA, 170 bp, Homo sapiens; identical to SEQ ID NO: 74131
  chr12:129821969-129822139
  Hypo

SEQ ID NO: 108452 - DNA, 194 bp, Homo sapiens; identical to SEQ ID NO: 74132
  chr12:130037653-130037847
  Hypo

SEQ ID NO: 108453 - DNA, 30 bp, Homo sapiens; identical to SEQ ID NO: 74133
  chr12:130184730-130184760
  Hypo

SEQ ID NO: 108454 - DNA, 34 bp, Homo sapiens; identical to SEQ ID NO: 74134
  chr12:130195436-130195470
  Hypo

SEQ ID NO: 108455 - DNA, 52 bp, Homo sapiens; identical to SEQ ID NO: 74135
  chr12:130216130-130216182
  Hypo

SEQ ID NO: 108456 - DNA, 30 bp, Homo sapiens; identical to SEQ ID NO: 43658
  chr12:130308451-130308481
  Hypo

SEQ ID NO: 108457 - DNA, 74 bp, Homo sapiens; identical to SEQ ID NO: 74139
  chr12:130325114-130325188
  Hypo

SEQ ID NO: 108458 - DNA, 216 bp, Homo sapiens
  chr12:130387439-130387655
  Hyper
tcctcccccgacagccggctcggccctccagaggccacctttcctctcaagggtccccacgccctctccctttacagaaaaggctttcaggaaacagccttcctttcctttcggctccttagtagtctcacctaaggcctcccacccaagtgctccaggacaagcaccttcggccaaggggcgtccgaggagcttggctgccgcacgagcgcacgt

SEQ ID NO: 108459 - DNA, 336 bp, Homo sapiens
  chr12:130387715-130388051
  Hyper
tctcccggccgcccccatcctccacacactcccacacactcactccaggcgaagttagtccccgggccctggcggccgcggcgtcctcacctttggaaaacagggcggccaggctgatgagtaccggcgaccagtggtgccacagcgtccccatctcagacgggcacatcctggagacccggagcgcagatcctccgctccccggcgccgtccaggcgaacaagagaccgtctcagtcccctagaggcccgcagcggggccggtggcgagggagcgcccggctaggggcccgagcagcccgggcgccctgctccctcttcccgccagtccatggcc

SEQ ID NO: 108460 - DNA, 883 bp, Homo sapiens
  chr12:130388269-130389152
  Hyper
tcccgggctggctagcgggcgctggcgcaggcggcgccggggtggcggggctgcggagcccgggacgcgggcagaggcggctcggagccccccgggcgggtggccgggctcgctgggcggcccggggctccctggcccgcagcccccatcccaggccggccgctgcgcctcggggctcgggcgcgcgcgcgctccggcacccaaagtttggcgggtgcggctgctccccggccgccgcctcggcccgcccggccccgggcccggctggggctcgcggggctctacgcgcgccgagcgcactgcaggctccggagacgcggggctcccccctgcgcccgggggaggcgggccagatgtgcgcggaggagggcccgccggctcggggacgcggccgagcaacgcagctgcctcctgccagcaggcgcgggggctccgctccgcaaggaccgcatccggaacggaacggaggcgatcgccacggtgcccggagccggctggggctttcgccttaaaaatttgtctgcttttaaaaagccccaccctttcggagtgacagctgtgagccccaatccgcaaagtaaatcccacctccccctggccgccccacgcccagcctcccggccaccctccctgcgagcgcggacgcgcggtggcggcgggcgagggctcccagcgcgggcgcaccccggggacggagccacccactctcccaacaggtgtccagctggccaccggcctctcgtcgtcatcaaaacctcaggcccaggggaggtcctccagcccgggggcacctgaggctcttcgccagggagagcgcaaggatggctggagaagggccctcgccccgccctgcgcatctcccagggatcgcagtgaggaagtc

SEQ ID NO: 108461 - DNA, 30 bp, Homo sapiens; identical to SEQ ID NO: 74145
  chr12:130414807-130414837
  Hypo

SEQ ID NO: 108462 - DNA, 30 bp, Homo sapiens; identical to SEQ ID NO: 34754
  chr12:130498725-130498755
  Hyper

SEQ ID NO: 108463 - DNA, 30 bp, Homo sapiens; identical to SEQ ID NO: 74147
  chr12:130499052-130499082
  Hyper

SEQ ID NO: 108464 - DNA, 109 bp, Homo sapiens; identical to SEQ ID NO: 74148
  chr12:130501672-130501781
  Hypo

SEQ ID NO: 108465 - DNA, 310 bp, Homo sapiens
  chr12:130526820-130527130
  Hyper
cacacagatgtgggtcgctgccttcccaacaggctcctgcccggttcacctggggaagcgcagggctgcgggcacaggattctcccatcagacaccgggagagcatctccgcggcagcttgcagggcccgctgtctccactagggggcggcgtacgcgcgtctctcgaagccgggacccgcgcggggaggctgcactggctggaaacagcgcctgggcgctcccgcggctcccacctcagagatgtccccaggtgccccacgccccccgcgcgagccccgacacgcgagccccaccgcactcctcaaggg

SEQ ID NO: 108466 - DNA, 125 bp, Homo sapiens; identical to SEQ ID NO: 74152
  chr12:130589202-130589327
  Hyper

SEQ ID NO: 108467 - DNA, 130 bp, Homo sapiens; identical to SEQ ID NO: 74153
  chr12:130604031-130604161
  Hypo

SEQ ID NO: 108468 - DNA, 620 bp, Homo sapiens; identical to SEQ ID NO: 74154
  chr12:130645186-130645806
  Hyper

SEQ ID NO: 108469 - DNA, 260 bp, Homo sapiens; identical to SEQ ID NO: 74155
  chr12:130646084-130646344
  Hyper

SEQ ID NO: 108470 - DNA, 527 bp, Homo sapiens
  chr12:130646555-130647082
  Hyper
ccaaaccccttctcccgccagtccccgaacttcccgtaacctcggcgtcctcggggtgccggggaccatcccggggaccgccgggaaagggggcgccggcggagaggatagcgagaggcaaagttggaggccaggcagagagagggcgaggagaggcgggcgggactgccggggagggtcgcagcgcgcagagccccgcgcgccaggcgggctgtcccggggctggcgggcgacgcgggcgggactaggcgctgcgccccccgcaggctgggctgcaggccgggggggatcggcccccgcggggcccgggagcccgcggcggggcggcggggaggaggctgccccgggccgctgcgctttctcatgcaaagcagcggcggggcggggcgcgcggcccgggggcggggcctgtcagcgctcggcttttctgcccccctttgcctttttgcgagtcttctcatcccgggacgcaaacctcgaaacagctgccggctggtcccggccgaggccggcgcagggagggagga

SEQ ID NO: 108471 - DNA, 1142 bp, Homo sapiens
  chr12:130647351-130648493
  Hyper
gcgctcgggccaggccgggcgggcatgggcgggggcccgagcaggggtggagagccggggccagcagcagcccgtgcccgggagcggcggcgctgaggggcgcggagctccccgcgaggacacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcc

SEQ ID NO: 108472 - DNA, 72 bp, Homo sapiens; identical to SEQ ID NO: 74161
  chr12:130726962-130727034
  Hypo

SEQ ID NO: 108473 - DNA, 301 bp, Homo sapiens; identical to SEQ ID NO: 5141
  chr12:130821371-130821672
  Hypo

SEQ ID NO: 108474 - DNA, 30 bp, Homo sapiens; identical to SEQ ID NO: 74164
  chr12:130889105-130889135
  Hypo

SEQ ID NO: 108475 - DNA, 153 bp, Homo sapiens; identical to SEQ ID NO: 74165
  chr12:130909584-130909737
  Hypo

SEQ ID NO: 108476 - DNA, 30 bp, Homo sapiens; identical to SEQ ID NO: 74166
  chr12:130910571-130910601
  Hypo

SEQ ID NO: 108477 - DNA, 177 bp, Homo sapiens; identical to SEQ ID NO: 74167
  chr12:130918507-130918684
  Hypo

SEQ ID NO: 108478 - DNA, 188 bp, Homo sapiens; identical to SEQ ID NO: 74168
  chr12:130920592-130920780
  Hypo

SEQ ID NO: 108479 - DNA, 35 bp, Homo sapiens; identical to SEQ ID NO: 74169
  chr12:130921348-130921383
  Hypo

SEQ ID NO: 108480 - DNA, 30 bp, Homo sapiens; identical to SEQ ID NO: 74170
  chr12:130941083-130941113
  Hypo

SEQ ID NO: 108481 - DNA, 30 bp, Homo sapiens; identical to SEQ ID NO: 74171
  chr12:130947017-130947047
  Hypo

SEQ ID NO: 108482 - DNA, 30 bp, Homo sapiens; identical to SEQ ID NO: 43663
  chr12:130947254-130947284
  Hypo

SEQ ID NO: 108483 - DNA, 112 bp, Homo sapiens; identical to SEQ ID NO: 74173
  chr12:130956148-130956260
  Hypo

SEQ ID NO: 108484 - DNA, 30 bp, Homo sapiens; identical to SEQ ID NO: 74174
  chr12:130968660-130968690
  Hypo

SEQ ID NO: 108485 - DNA, 251 bp, Homo sapiens; identical to SEQ ID NO: 74175
  chr12:131042217-131042468
  Hypo

SEQ ID NO: 108486 - DNA, 237 bp, Homo sapiens; identical to SEQ ID NO: 74176
  chr12:131060814-131061051
  Hypo

SEQ ID NO: 108487 - DNA, 39 bp, Homo sapiens; identical to SEQ ID NO: 43664
  chr12:131077323-131077362
  Hypo

SEQ ID NO: 108488 - DNA, 30 bp, Homo sapiens; identical to SEQ ID NO: 74178
  chr12:131088329-131088359
  Hypo

SEQ ID NO: 108489 - DNA, 63 bp, Homo sapiens; identical to SEQ ID NO: 74179
  chr12:131098650-131098713
  Hypo

SEQ ID NO: 108490 - DNA, 85 bp, Homo sapiens; identical to SEQ ID NO: 74180
  chr12:131159445-131159530
  Hypo

SEQ ID NO: 108491 - DNA, 30 bp, Homo sapiens; identical to SEQ ID NO: 43665
  chr12:131159790-131159820
  Hypo

SEQ ID NO: 108492 - DNA, 254 bp, Homo sapiens; identical to SEQ ID NO: 74182
  chr12:131199288-131199542
  Hyper

SEQ ID NO: 108493 - DNA, 148 bp, Homo sapiens
  chr12:131199859-131200007
  Hyper
ggccagtgaccaggccgggaggtgaagcagtcctccctccctccggccagccgccaccccgacctcagccagcgtgcgctccccggggacaggagggaggctgcttccaccgaggcctctgctgacagatgtccgggcccccacctgg

SEQ ID NO: 108494 - DNA, 215 bp, Homo sapiens; identical to SEQ ID NO: 74185
  chr12:131200331-131200546
  Hyper

SEQ ID NO: 108495 - DNA, 30 bp, Homo sapiens; identical to SEQ ID NO: 74186
  chr12:131201356-131201386
  Hyper

SEQ ID NO: 108496 - DNA, 30 bp, Homo sapiens; identical to SEQ ID NO: 43666
  chr12:131229952-131229982
  Hypo

SEQ ID NO: 108497 - DNA, 30 bp, Homo sapiens; identical to SEQ ID NO: 74188
  chr12:131261499-131261529
  Hypo

SEQ ID NO: 108498 - DNA, 123 bp, Homo sapiens; identical to SEQ ID NO: 43667
  chr12:131268359-131268482
  Hypo

SEQ ID NO: 108499 - DNA, 56 bp, Homo sapiens; identical to SEQ ID NO: 43668
  chr12:131271976-131272032
  Hypo

SEQ ID NO: 108500 - DNA, 37 bp, Homo sapiens; identical to SEQ ID NO: 74191
  chr12:131272330-131272367
  Hypo

SEQ ID NO: 108501 - DNA, 245 bp, Homo sapiens; identical to SEQ ID NO: 74192
  chr12:131290735-131290980
  Hypo

SEQ ID NO: 108502 - DNA, 134 bp, Homo sapiens; identical to SEQ ID NO: 74193
  chr12:131335189-131335323
  Hypo

SEQ ID NO: 108503 - DNA, 166 bp, Homo sapiens; identical to SEQ ID NO: 43670
  chr12:131383570-131383736
  Hypo

SEQ ID NO: 108504 - DNA, 30 bp, Homo sapiens; identical to SEQ ID NO: 43671
  chr12:131387248-131387278
  Hypo

SEQ ID NO: 108505 - DNA, 44 bp, Homo sapiens; identical to SEQ ID NO: 74196
  chr12:131389290-131389334
  Hypo

SEQ ID NO: 108506 - DNA, 103 bp, Homo sapiens; identical to SEQ ID NO: 74197
  chr12:131400816-131400919
  Hyper

SEQ ID NO: 108507 - DNA, 76 bp, Homo sapiens; identical to SEQ ID NO: 74198
  chr12:131402548-131402624
  Hypo

SEQ ID NO: 108508 - DNA, 179 bp, Homo sapiens; identical to SEQ ID NO: 74199
  chr12:131403032-131403211
  Hypo

SEQ ID NO: 108509 - DNA, 30 bp, Homo sapiens; identical to SEQ ID NO: 74200
  chr12:131417941-131417971
  Hypo

SEQ ID NO: 108510 - DNA, 42 bp, Homo sapiens; identical to SEQ ID NO: 74201
  chr12:131418388-131418430
  Hypo

SEQ ID NO: 108511 - DNA, 310 bp, Homo sapiens; identical to SEQ ID NO: 74202
  chr12:131433135-131433445
  Hypo

SEQ ID NO: 108512 - DNA, 30 bp, Homo sapiens; identical to SEQ ID NO: 74203
  chr12:131434432-131434462
  Hypo

SEQ ID NO: 108513 - DNA, 30 bp, Homo sapiens; identical to SEQ ID NO: 74204
  chr12:131436515-131436545
  Hypo

SEQ ID NO: 108514 - DNA, 30 bp, Homo sapiens; identical to SEQ ID NO: 74205
  chr12:131438610-131438640
  Hyper

SEQ ID NO: 108515 - DNA, 66 bp, Homo sapiens; identical to SEQ ID NO: 74206
  chr12:131499103-131499169
  Hypo

SEQ ID NO: 108516 - DNA, 53 bp, Homo sapiens; identical to SEQ ID NO: 43675
  chr12:131500873-131500926
  Hypo

SEQ ID NO: 108517 - DNA, 248 bp, Homo sapiens; identical to SEQ ID NO: 74208
  chr12:131513257-131513505
  Hypo

SEQ ID NO: 108518 - DNA, 56 bp, Homo sapiens; identical to SEQ ID NO: 74209
  chr12:131518701-131518757
  Hypo

SEQ ID NO: 108519 - DNA, 70 bp, Homo sapiens; identical to SEQ ID NO: 74210
  chr12:131535487-131535557
  Hypo

SEQ ID NO: 108520 - DNA, 30 bp, Homo sapiens; identical to SEQ ID NO: 74211
  chr12:131544833-131544863
  Hypo

SEQ ID NO: 108521 - DNA, 27 bp, Homo sapiens
  chr12:131547329-131547356
  Hypo
atacaagggtcacgtggtaaatatatt

SEQ ID NO: 108522 - DNA, 38 bp, Homo sapiens; identical to SEQ ID NO: 74214
  chr12:131556190-131556228
  Hypo

SEQ ID NO: 108523 - DNA, 115 bp, Homo sapiens; identical to SEQ ID NO: 74215
  chr12:131569132-131569247
  Hypo

SEQ ID NO: 108524 - DNA, 30 bp, Homo sapiens; identical to SEQ ID NO: 74216
  chr12:131579447-131579477
  Hypo

SEQ ID NO: 108525 - DNA, 33 bp, Homo sapiens; identical to SEQ ID NO: 74217
  chr12:131588532-131588565
  Hypo

SEQ ID NO: 108526 - DNA, 119 bp, Homo sapiens; identical to SEQ ID NO: 74218
  chr12:131615224-131615343
  Hypo

SEQ ID NO: 108527 - DNA, 198 bp, Homo sapiens; identical to SEQ ID NO: 74219
  chr12:131619032-131619230
  Hypo

SEQ ID NO: 108528 - DNA, 62 bp, Homo sapiens; identical to SEQ ID NO: 74220
  chr12:131620158-131620220
  Hypo

SEQ ID NO: 108529 - DNA, 171 bp, Homo sapiens; identical to SEQ ID NO: 74221
  chr12:131621480-131621651
  Hypo

SEQ ID NO: 108530 - DNA, 73 bp, Homo sapiens; identical to SEQ ID NO: 74222
  chr12:131623324-131623397
  Hypo

SEQ ID NO: 108531 - DNA, 30 bp, Homo sapiens; identical to SEQ ID NO: 43683
  chr12:131624881-131624911
  Hypo

SEQ ID NO: 108532 - DNA, 53 bp, Homo sapiens; identical to SEQ ID NO: 74224
  chr12:131649098-131649151
  Hypo

SEQ ID NO: 108533 - DNA, 42 bp, Homo sapiens; identical to SEQ ID NO: 43684
  chr12:131687270-131687312
  Hypo

SEQ ID NO: 108534 - DNA, 91 bp, Homo sapiens; identical to SEQ ID NO: 74226
  chr12:131699434-131699525
  Hypo

SEQ ID NO: 108535 - DNA, 122 bp, Homo sapiens; identical to SEQ ID NO: 74227
  chr12:131700501-131700623
  Hypo

SEQ ID NO: 108536 - DNA, 87 bp, Homo sapiens; identical to SEQ ID NO: 43685
  chr12:131725445-131725532
  Hypo

SEQ ID NO: 108537 - DNA, 30 bp, Homo sapiens; identical to SEQ ID NO: 74229
  chr12:131746673-131746703
  Hypo

SEQ ID NO: 108538 - DNA, 36 bp, Homo sapiens; identical to SEQ ID NO: 74230
  chr12:131750463-131750499
  Hypo

SEQ ID NO: 108539 - DNA, 33 bp, Homo sapiens; identical to SEQ ID NO: 43686
  chr12:131767017-131767050
  Hypo

SEQ ID NO: 108540 - DNA, 266 bp, Homo sapiens; identical to SEQ ID NO: 74232
  chr12:131768368-131768634
  Hypo

SEQ ID NO: 108541 - DNA, 30 bp, Homo sapiens; identical to SEQ ID NO: 43688
  chr12:131769387-131769417
  Hypo

SEQ ID NO: 108542 - DNA, 37 bp, Homo sapiens; identical to SEQ ID NO: 43689
  chr12:131772177-131772214
  Hypo

SEQ ID NO: 108543 - DNA, 71 bp, Homo sapiens; identical to SEQ ID NO: 74235
  chr12:131780201-131780272
  Hypo

SEQ ID NO: 108544 - DNA, 201 bp, Homo sapiens; identical to SEQ ID NO: 74236
  chr12:131801478-131801679
  Hypo

SEQ ID NO: 108545 - DNA, 67 bp, Homo sapiens; identical to SEQ ID NO: 74237
  chr12:131834197-131834264
  Hypo

SEQ ID NO: 108546 - DNA, 30 bp, Homo sapiens; identical to SEQ ID NO: 74238
  chr12:131836813-131836843
  Hypo

SEQ ID NO: 108547 - DNA, 30 bp, Homo sapiens; identical to SEQ ID NO: 43691
  chr12:131850690-131850720
  Hypo

SEQ ID NO: 108548 - DNA, 259 bp, Homo sapiens; identical to SEQ ID NO: 74240
  chr12:131852223-131852482
  Hypo

SEQ ID NO: 108549 - DNA, 30 bp, Homo sapiens; identical to SEQ ID NO: 74241
  chr12:131856761-131856791
  Hypo

SEQ ID NO: 108550 - DNA, 34 bp, Homo sapiens; identical to SEQ ID NO: 74242
  chr12:131927584-131927618
  Hypo

SEQ ID NO: 108551 - DNA, 329 bp, Homo sapiens; identical to SEQ ID NO: 74243
  chr12:131928780-131929109
  Hypo

SEQ ID NO: 108552 - DNA, 127 bp, Homo sapiens; identical to SEQ ID NO: 74244
  chr12:131943696-131943823
  Hypo

SEQ ID NO: 108553 - DNA, 30 bp, Homo sapiens; identical to SEQ ID NO: 74245
  chr12:131966801-131966831
  Hypo

SEQ ID NO: 108554 - DNA, 83 bp, Homo sapiens; identical to SEQ ID NO: 74246
  chr12:131977760-131977843
  Hypo

SEQ ID NO: 108555 - DNA, 436 bp, Homo sapiens; identical to SEQ ID NO: 74247
  chr12:131978755-131979191
  Hypo

SEQ ID NO: 108556 - DNA, 34 bp, Homo sapiens; identical to SEQ ID NO: 74250
  chr12:132025011-132025045
  Hypo

SEQ ID NO: 108557 - DNA, 286 bp, Homo sapiens; identical to SEQ ID NO: 74251
  chr12:132044061-132044347
  Hypo

SEQ ID NO: 108558 - DNA, 211 bp, Homo sapiens; identical to SEQ ID NO: 74252
  chr12:132057357-132057568
  Hypo

SEQ ID NO: 108559 - DNA, 99 bp, Homo sapiens; identical to SEQ ID NO: 74253
  chr12:132060675-132060774
  Hypo

SEQ ID NO: 108560 - DNA, 30 bp, Homo sapiens; identical to SEQ ID NO: 43696
  chr12:132068982-132069012
  Hypo

SEQ ID NO: 108561 - DNA, 30 bp, Homo sapiens; identical to SEQ ID NO: 74255
  chr12:132076155-132076185
  Hypo

SEQ ID NO: 108562 - DNA, 402 bp, Homo sapiens; identical to SEQ ID NO: 74256
  chr12:132076426-132076828
  Hypo

SEQ ID NO: 108563 - DNA, 66 bp, Homo sapiens; identical to SEQ ID NO: 74257
  chr12:132097008-132097074
  Hypo

SEQ ID NO: 108564 - DNA, 30 bp, Homo sapiens; identical to SEQ ID NO: 74258
  chr12:132104755-132104785
  Hypo

SEQ ID NO: 108565 - DNA, 160 bp, Homo sapiens; identical to SEQ ID NO: 74259
  chr12:132106063-132106223
  Hypo

SEQ ID NO: 108566 - DNA, 155 bp, Homo sapiens; identical to SEQ ID NO: 74261
  chr12:132168266-132168421
  Hypo

SEQ ID NO: 108567 - DNA, 103 bp, Homo sapiens; identical to SEQ ID NO: 74262
  chr12:132169254-132169357
  Hypo

SEQ ID NO: 108568 - DNA, 139 bp, Homo sapiens; identical to SEQ ID NO: 74263
  chr12:132171649-132171788
  Hypo

SEQ ID NO: 108569 - DNA, 83 bp, Homo sapiens; identical to SEQ ID NO: 74264
  chr12:132197162-132197245
  Hypo

SEQ ID NO: 108570 - DNA, 628 bp, Homo sapiens; identical to SEQ ID NO: 74265
  chr12:132221496-132222124
  Hypo

SEQ ID NO: 108571 - DNA, 161 bp, Homo sapiens; identical to SEQ ID NO: 74266
  chr12:132240161-132240322
  Hypo

SEQ ID NO: 108572 - DNA, 30 bp, Homo sapiens; identical to SEQ ID NO: 74267
  chr12:132242801-132242831
  Hypo

SEQ ID NO: 108573 - DNA, 21 bp, Homo sapiens
  chr12:132244054-132244075
  Hypo
aaatagtaggccgggcgcggt

SEQ ID NO: 108574 - DNA, 30 bp, Homo sapiens; identical to SEQ ID NO: 74269
  chr12:132259853-132259883
  Hypo

SEQ ID NO: 108575 - DNA, 30 bp, Homo sapiens; identical to SEQ ID NO: 43704
  chr12:132279981-132280011
  Hypo

SEQ ID NO: 108576 - DNA, 173 bp, Homo sapiens; identical to SEQ ID NO: 74271
  chr12:132280837-132281010
  Hypo

SEQ ID NO: 108577 - DNA, 227 bp, Homo sapiens; identical to SEQ ID NO: 74272
  chr12:132284411-132284638
  Hypo

SEQ ID NO: 108578 - DNA, 221 bp, Homo sapiens; identical to SEQ ID NO: 74273
  chr12:132286008-132286229
  Hypo

SEQ ID NO: 108579 - DNA, 30 bp, Homo sapiens; identical to SEQ ID NO: 74275
  chr12:132291006-132291036
  Hypo

SEQ ID NO: 108580 - DNA, 1101 bp, Homo sapiens
  chr12:132312558-132313659
  Hyper
gcgggctccaccaagcgcccacctgctgcgctgcggcggcggctccggggcctgaacccgggtctgaacccgggcctcggcgccgtggggggtggacccgggagcgcggccggagaggggagtcagggtcagctccccgcaggcgccccgacccccgcctccgcgcccatcccgcgcgtccccgccgccccaagagcgtcctaagacacccggggaaacgccttccctgtgatgccgcggacccagtcccgtcgcggacacggcggggcgggcgggggtggcagcgtccgaggcggcgcgggccctttaaggcggccggcctcgttagcatacatttgcatggccccgccccgccgcttgaggctgccgcgcggggctcagtccggcgggggcgccgcggagagcggagggcgccgggctgcggaacgcgaagcggagggcgcgggaccctgcacgccgcccgcgggcccatgtgagcgccatgcggcgccgcgcagcccggggacccggcccgccgcccccagggcccggactctcgcggctgccgctgccgctgctgctgctgctggcgctggggacccgcgggggctgcgccgcgcccgcacccgcgccgcgcgccgaggacctcagcctgggagtggtgagcgcgcgggcgggacgggcgcggagctcctgggccggagccgggggtctccgcgggccgggtggcggggaccgggaagaccccagcagtgcacgtcggcgtcgcgcgggagccctggcgccctggacccatttcctgggtggggagactgaggcagggacgcgggctgagcgaccgggcgagcgcacgcgagtcctggggaggcgccggctgccgtcccggctccgtgcgctgggagcgcgccgcagccgcaggagcccgtggagttgtgagggggtcgcccacccggagcccgggtcgccggcttgcagcagccccggagcagccgggctgggcgagagcaggcatcgcggccgccccgagctctgcgcgctgcgtgcgttccgggtgggagtggcgggggcaggagcacgcacccacaaagcgaggaagggcaggggctacggagtgggggcacc

SEQ ID NO: 108581 - DNA, 30 bp, Homo sapiens; identical to SEQ ID NO: 34771
  chr12:132314800-132314830
  Hyper

SEQ ID NO: 108582 - DNA, 30 bp, Homo sapiens; identical to SEQ ID NO: 34772
  chr12:132315470-132315500
  Hyper

SEQ ID NO: 108583 - DNA, 47 bp, Homo sapiens; identical to SEQ ID NO: 74280
  chr12:132323460-132323507
  Hypo

SEQ ID NO: 108584 - DNA, 321 bp, Homo sapiens; identical to SEQ ID NO: 74281
  chr12:132325069-132325390
  Hypo

SEQ ID NO: 108585 - DNA, 511 bp, Homo sapiens; identical to SEQ ID NO: 74282
  chr12:132329560-132330071
  Hypo

SEQ ID NO: 108586 - DNA, 197 bp, Homo sapiens; identical to SEQ ID NO: 74283
  chr12:132332952-132333149
  Hypo

SEQ ID NO: 108587 - DNA, 32 bp, Homo sapiens; identical to SEQ ID NO: 74284
  chr12:132333386-132333418
  Hypo

SEQ ID NO: 108588 - DNA, 211 bp, Homo sapiens; identical to SEQ ID NO: 74285
  chr12:132333478-132333689
  Hypo

SEQ ID NO: 108589 - DNA, 30 bp, Homo sapiens; identical to SEQ ID NO: 74286
  chr12:132334483-132334513
  Hypo

SEQ ID NO: 108590 - DNA, 224 bp, Homo sapiens; identical to SEQ ID NO: 74287
  chr12:132335471-132335695
  Hypo

SEQ ID NO: 108591 - DNA, 393 bp, Homo sapiens; identical to SEQ ID NO: 74288
  chr12:132336227-132336620
  Hypo

SEQ ID NO: 108592 - DNA, 35 bp, Homo sapiens; identical to SEQ ID NO: 74289
  chr12:132338738-132338773
  Hypo

SEQ ID NO: 108593 - DNA, 176 bp, Homo sapiens; identical to SEQ ID NO: 74290
  chr12:132348560-132348736
  Hypo

SEQ ID NO: 108594 - DNA, 376 bp, Homo sapiens; identical to SEQ ID NO: 74291
  chr12:132349603-132349979
  Hypo

SEQ ID NO: 108595 - DNA, 49 bp, Homo sapiens; identical to SEQ ID NO: 74292
  chr12:132377450-132377499
  Hypo

SEQ ID NO: 108596 - DNA, 129 bp, Homo sapiens; identical to SEQ ID NO: 74293
  chr12:132377954-132378083
  Hypo

SEQ ID NO: 108597 - DNA, 30 bp, Homo sapiens; identical to SEQ ID NO: 74294
  chr12:132406501-132406531
  Hypo

SEQ ID NO: 108598 - DNA, 37 bp, Homo sapiens; identical to SEQ ID NO: 43716
  chr12:132415173-132415210
  Hypo

SEQ ID NO: 108599 - DNA, 37 bp, Homo sapiens; identical to SEQ ID NO: 43717
  chr12:132415270-132415307
  Hypo

SEQ ID NO: 108600 - DNA, 157 bp, Homo sapiens; identical to SEQ ID NO: 43718
  chr12:132423589-132423746
  Hypo

SEQ ID NO: 108601 - DNA, 30 bp, Homo sapiens; identical to SEQ ID NO: 74298
  chr12:132429244-132429274
  Hypo

SEQ ID NO: 108602 - DNA, 44 bp, Homo sapiens; identical to SEQ ID NO: 74299
  chr12:132566992-132567036
  Hypo

SEQ ID NO: 108603 - DNA, 249 bp, Homo sapiens; identical to SEQ ID NO: 74300
  chr12:132593124-132593373
  Hypo

SEQ ID NO: 108604 - DNA, 38 bp, Homo sapiens; identical to SEQ ID NO: 74301
  chr12:132616617-132616655
  Hypo

SEQ ID NO: 108605 - DNA, 522 bp, Homo sapiens; identical to SEQ ID NO: 74302
  chr12:132617183-132617705
  Hypo

SEQ ID NO: 108606 - DNA, 150 bp, Homo sapiens; identical to SEQ ID NO: 74303
  chr12:132619054-132619204
  Hypo

SEQ ID NO: 108607 - DNA, 70 bp, Homo sapiens; identical to SEQ ID NO: 74304
  chr12:132643455-132643525
  Hypo

SEQ ID NO: 108608 - DNA, 163 bp, Homo sapiens; identical to SEQ ID NO: 74305
  chr12:132643845-132644008
  Hypo

SEQ ID NO: 108609 - DNA, 30 bp, Homo sapiens; identical to SEQ ID NO: 74306
  chr12:132644527-132644557
  Hypo

SEQ ID NO: 108610 - DNA, 337 bp, Homo sapiens; identical to SEQ ID NO: 74307
  chr12:132648196-132648533
  Hypo

SEQ ID NO: 108611 - DNA, 30 bp, Homo sapiens; identical to SEQ ID NO: 74308
  chr12:132651886-132651916
  Hypo

SEQ ID NO: 108612 - DNA, 231 bp, Homo sapiens; identical to SEQ ID NO: 74309
  chr12:132652953-132653184
  Hypo

SEQ ID NO: 108613 - DNA, 30 bp, Homo sapiens; identical to SEQ ID NO: 74310
  chr12:132654109-132654139
  Hypo

SEQ ID NO: 108614 - DNA, 30 bp, Homo sapiens; identical to SEQ ID NO: 74311
  chr12:132656988-132657018
  Hypo

SEQ ID NO: 108615 - DNA, 30 bp, Homo sapiens; identical to SEQ ID NO: 74312
  chr12:132658236-132658266
  Hypo

SEQ ID NO: 108616 - DNA, 125 bp, Homo sapiens; identical to SEQ ID NO: 74313
  chr12:132666377-132666502
  Hypo

SEQ ID NO: 108617 - DNA, 30 bp, Homo sapiens; identical to SEQ ID NO: 74314
  chr12:132672104-132672134
  Hypo

SEQ ID NO: 108618 - DNA, 30 bp, Homo sapiens; identical to SEQ ID NO: 74315
  chr12:132675830-132675860
  Hypo

SEQ ID NO: 108619 - DNA, 219 bp, Homo sapiens; identical to SEQ ID NO: 74316
  chr12:132677480-132677699
  Hypo

SEQ ID NO: 108620 - DNA, 123 bp, Homo sapiens; identical to SEQ ID NO: 74317
  chr12:132682557-132682680
  Hypo

SEQ ID NO: 108621 - DNA, 157 bp, Homo sapiens; identical to SEQ ID NO: 74318
  chr12:132683736-132683893
  Hypo

SEQ ID NO: 108622 - DNA, 288 bp, Homo sapiens; identical to SEQ ID NO: 43726
  chr12:132687989-132688277
  Hypo

SEQ ID NO: 108623 - DNA, 198 bp, Homo sapiens; identical to SEQ ID NO: 74320
  chr12:132691172-132691370
  Hypo

SEQ ID NO: 108624 - DNA, 232 bp, Homo sapiens; identical to SEQ ID NO: 74321
  chr12:132694804-132695036
  Hypo

SEQ ID NO: 108625 - DNA, 64 bp, Homo sapiens; identical to SEQ ID NO: 74322
  chr12:132699804-132699868
  Hypo

SEQ ID NO: 108626 - DNA, 373 bp, Homo sapiens; identical to SEQ ID NO: 74323
  chr12:132983393-132983766
  Hypo

SEQ ID NO: 108627 - DNA, 48 bp, Homo sapiens; identical to SEQ ID NO: 43730
  chr12:132985665-132985713
  Hypo

SEQ ID NO: 108628 - DNA, 250 bp, Homo sapiens; identical to SEQ ID NO: 74325
  chr12:132986451-132986701
  Hypo

SEQ ID NO: 108629 - DNA, 211 bp, Homo sapiens; identical to SEQ ID NO: 74326
  chr12:132987301-132987512
  Hypo

SEQ ID NO: 108630 - DNA, 106 bp, Homo sapiens; identical to SEQ ID NO: 74327
  chr12:132988517-132988623
  Hypo

SEQ ID NO: 108631 - DNA, 30 bp, Homo sapiens; identical to SEQ ID NO: 74328
  chr12:132993581-132993611
  Hypo

SEQ ID NO: 108632 - DNA, 30 bp, Homo sapiens; identical to SEQ ID NO: 74329
  chr12:133000092-133000122
  Hypo

SEQ ID NO: 108633 - DNA, 583 bp, Homo sapiens; identical to SEQ ID NO: 74330
  chr12:133002792-133003375
  Hypo

SEQ ID NO: 108634 - DNA, 318 bp, Homo sapiens; identical to SEQ ID NO: 74331
  chr12:133019701-133020019
  Hypo

SEQ ID NO: 108635 - DNA, 30 bp, Homo sapiens; identical to SEQ ID NO: 74332
  chr12:133035008-133035038
  Hypo

SEQ ID NO: 108636 - DNA, 190 bp, Homo sapiens; identical to SEQ ID NO: 43736
  chr12:133035657-133035847
  Hypo

SEQ ID NO: 108637 - DNA, 30 bp, Homo sapiens; identical to SEQ ID NO: 74334
  chr12:133036250-133036280
  Hypo

SEQ ID NO: 108638 - DNA, 92 bp, Homo sapiens; identical to SEQ ID NO: 74335
  chr12:133056788-133056880
  Hypo

SEQ ID NO: 108639 - DNA, 30 bp, Homo sapiens; identical to SEQ ID NO: 74336
  chr12:133058946-133058976
  Hypo

SEQ ID NO: 108640 - DNA, 244 bp, Homo sapiens; identical to SEQ ID NO: 74337
  chr12:133060744-133060988
  Hypo

SEQ ID NO: 108641 - DNA, 179 bp, Homo sapiens; identical to SEQ ID NO: 74338
  chr12:133098374-133098553
  Hypo

SEQ ID NO: 108642 - DNA, 80 bp, Homo sapiens; identical to SEQ ID NO: 74339
  chr12:133100375-133100455
  Hypo

SEQ ID NO: 108643 - DNA, 264 bp, Homo sapiens; identical to SEQ ID NO: 74340
  chr12:133100756-133101020
  Hypo

SEQ ID NO: 108644 - DNA, 30 bp, Homo sapiens; identical to SEQ ID NO: 74341
  chr12:133101497-133101527
  Hypo

SEQ ID NO: 108645 - DNA, 40 bp, Homo sapiens; identical to SEQ ID NO: 74342
  chr12:133122176-133122216
  Hypo

SEQ ID NO: 108646 - DNA, 93 bp, Homo sapiens; identical to SEQ ID NO: 74343
  chr12:133130872-133130965
  Hypo

SEQ ID NO: 108647 - DNA, 30 bp, Homo sapiens; identical to SEQ ID NO: 74344
  chr12:133161681-133161711
  Hypo

SEQ ID NO: 108648 - DNA, 30 bp, Homo sapiens; identical to SEQ ID NO: 43741
  chr12:133167902-133167932
  Hypo

SEQ ID NO: 108649 - DNA, 95 bp, Homo sapiens; identical to SEQ ID NO: 74346
  chr12:133168198-133168293
  Hypo

SEQ ID NO: 108650 - DNA, 30 bp, Homo sapiens; identical to SEQ ID NO: 74347
  chr12:133168945-133168975
  Hypo

SEQ ID NO: 108651 - DNA, 256 bp, Homo sapiens; identical to SEQ ID NO: 43742
  chr12:133169847-133170103
  Hypo

SEQ ID NO: 108652 - DNA, 30 bp, Homo sapiens; identical to SEQ ID NO: 74349
  chr12:133172661-133172691
  Hypo

SEQ ID NO: 108653 - DNA, 24 bp, Homo sapiens
  chr12:133174537-133174561
  Hyper
cgcctcctctccgcgcgcccctcc

SEQ ID NO: 108654 - DNA, 87 bp, Homo sapiens; identical to SEQ ID NO: 74351
  chr12:133175277-133175364
  Hyper

SEQ ID NO: 108655 - DNA, 30 bp, Homo sapiens; identical to SEQ ID NO: 74352
  chr12:133178414-133178444
  Hypo

SEQ ID NO: 108656 - DNA, 170 bp, Homo sapiens; identical to SEQ ID NO: 74353
  chr12:133187664-133187834
  Hypo

SEQ ID NO: 108657 - DNA, 136 bp, Homo sapiens; identical to SEQ ID NO: 74354
  chr12:133188323-133188459
  Hypo

SEQ ID NO: 108658 - DNA, 775 bp, Homo sapiens
  chr12:133194853-133195628
  Hyper
ttgcaaagaagaaaacggatcggccgtggatccctctccagctcgagggctggagctgcggcggaggcaggagctggaagcgaggcgtctgctggcaaaggcgggagtgcaggttgcgctcgaagccccggcagccgcggcaggaaccggcctggacggggtggggggcgccgcggaggccggcgggacttcccatgtctttctcctcgagctcggaaaaagttcccacccggggaatcccgaccctccaacttcgagaccgccggttccgcgctcggcccccacctggaccaagagctggggctgggctgccgcgcccccggctctgtccccgcgaggccccgctcccagccccacctgggacacccgggactcccgggacacctgcggggcggggcggggccggggcgaggcggggcgggctcgaggccgcaccccggaggcggagccgcgagctacccgcccgccgcgcgccccccgctctcggtgcgcagcggggccgaccctcagccctgcagcgccttcctggaggtgggggccgcccgcgccatggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtgcgcggggcgcggggtgcggggcgcggggtgcggggcgcaggggaggggct

SEQ ID NO: 108659 - DNA, 106 bp, Homo sapiens
  chr12:133195878-133195984
  Hyper
ggctggggctgggaccgagggcgcggggcaggccccaagagccccgcagagcggacccgggtcgcgggagggcccctgccgtgcctgcgggcgggactcagccttc

SEQ ID NO: 108660 - DNA, 49 bp, Homo sapiens; identical to SEQ ID NO: 74360
  chr12:133199652-133199701
  Hypo

SEQ ID NO: 108661 - DNA, 89 bp, Homo sapiens; identical to SEQ ID NO: 74361
  chr12:133200001-133200090
  Hypo

SEQ ID NO: 108662 - DNA, 34 bp, Homo sapiens; identical to SEQ ID NO: 74362
  chr12:133262748-133262782
  Hypo

SEQ ID NO: 108663 - DNA, 30 bp, Homo sapiens; identical to SEQ ID NO: 74363
  chr12:133295960-133295990
  Hypo

SEQ ID NO: 108664 - DNA, 24 bp, Homo sapiens
  chr12:133334005-133334029
  Hypo
cacctgtcaccccagcgcttgggg

SEQ ID NO: 108665 - DNA, 363 bp, Homo sapiens; identical to SEQ ID NO: 74365
  chr12:133428083-133428446
  Hypo

SEQ ID NO: 108666 - DNA, 40 bp, Homo sapiens; identical to SEQ ID NO: 74366
  chr12:133453650-133453690
  Hypo

SEQ ID NO: 108667 - DNA, 85 bp, Homo sapiens; identical to SEQ ID NO: 74367
  chr12:133463015-133463100
  Hypo

SEQ ID NO: 108668 - DNA, 402 bp, Homo sapiens; identical to SEQ ID NO: 74368
  chr12:133463573-133463975
  Hyper

SEQ ID NO: 108669 - DNA, 152 bp, Homo sapiens; identical to SEQ ID NO: 74369
  chr12:133464403-133464555
  Hyper

SEQ ID NO: 108670 - DNA, 147 bp, Homo sapiens; identical to SEQ ID NO: 74370
  chr12:133464773-133464920
  Hyper

SEQ ID NO: 108671 - DNA, 287 bp, Homo sapiens
  chr12:133481368-133481655
  Hyper
gaagcttttcctcaccgaagacgcggcctcaagtcatccccaagccggggctcctgggtggcttctcaggaagccaagctccctcaccctgtggcgacgccgcgggcggaatgcgcatgcgcgccacgagccacaatcgtagggttgggcgcgccctgccggccaccaggggcagcgcaggagctgagcgcaccccatcagcgaaagaagcgcgcctccccgctcttttctgaaccgtatctcctaaactataattttggagatcaaaagtgcggtggagcctcctc

SEQ ID NO: 108672 - DNA, 34 bp, Homo sapiens; identical to SEQ ID NO: 74374
  chr12:133483182-133483216
  Hypo

SEQ ID NO: 108673 - DNA, 1284 bp, Homo sapiens
  chr12:133484586-133485870
  Hyper
cgcccggcctcagacgtttttctctaggtaaagccgcgggatgaaccagcccctgtggaaatttagaagtaacgacgtccgtcaatttctgtatgaaaaatatacagatcgtgtgacacgtcttctgggaatgaaagtctgctaaactcgccgtcacgagtagatgaacacatttaaagtttgtagttaagaggaaaacaacgccaacgacacaaatgccccaagcgctggatgaagcagcgacctaggatggggctggcctggaacgggaaccaagacgcccgcccggacgaaaacgagcagggaaacccgggccggggtcggccgccccacacgacgcactgcgcagagaccacgcggctccgggtctcgcctgcgccggcgcatccctcgcagacgcgctcctcccacgcgagggccccttccccgaagcgcacgcctaagactgcgcgccgcagcccgccctgtctagctgaggcgcagacccggatgggtcccagaggggcgggtcggggcggagagccgcgcccaaaggcaatgggagccgcacgctgctaggcaacatgctgtctcccggcaacgtagaggcggggaattcgccaacgtgtctgaaacagacaacaattttagccaacggctgcgtgggccttgggcgtcctggccaatgggaatagtgaggggcctgtcactaagaaacctgtccctgagcaacgcataggaggggtggaacccagcagcgctgactgagccgccgcgaagtgccggaacgtattacctgggagccaaatttcagagcgtcgtttgtcttcccaagcccaccagctttcagcgttctccagcctcgccacacccccgcctcgggccgtccccgcccagacgcttgtccccgcgagaagctgagcgcactgaagtgagcccggcggctgccgccggaggaggagcccggctctggacacggccgtcaggaagctcagaggctgcagcaccgcttctgcgttgatttccgcttgacttttactcttttcttgggttaaaaatcaaacgccgacccgaggcgtcagagatgggcggtcgttaggcgcagtggcggcccccggatgtttgcgatgggacggcgggctcggaacgtgtggacgtgggctttggaggtgcgagccccattgggccagggctgggtccgggcagtggtacggggtctcagctgtccgtcacaggagatgtgcaggcctcgtcatctggggtcttacgtgtcagtgatgtggggtctgccgggtcagtgagggg

SEQ ID NO: 108674 - DNA, 91 bp, Homo sapiens; identical to SEQ ID NO: 74379
  chr12:133705743-133705834
  Hypo

SEQ ID NO: 108675 - DNA, 231 bp, Homo sapiens; identical to SEQ ID NO: 74380
  chr12:133757970-133758201
  Hyper

SEQ ID NO: 108676 - DNA, 49 bp, Homo sapiens; identical to SEQ ID NO: 74381
  chr12:133758523-133758572
  Hyper

SEQ ID NO: 108677 - DNA, 30 bp, Homo sapiens; identical to SEQ ID NO: 74382
  chr12:133808200-133808230
  Hypo

SEQ ID NO: 108678 - DNA, 259 bp, Homo sapiens; identical to SEQ ID NO: 75729
  chr13:19517655-19517914
  Hypo

SEQ ID NO: 108679 - DNA, 44 bp, Homo sapiens; identical to SEQ ID NO: 75730
  chr13:19537201-19537245
  Hypo

SEQ ID NO: 108680 - DNA, 106 bp, Homo sapiens; identical to SEQ ID NO: 75731
  chr13:19756080-19756186
  Hypo

SEQ ID NO: 108681 - DNA, 30 bp, Homo sapiens; identical to SEQ ID NO: 75732
  chr13:19964867-19964897
  Hypo

SEQ ID NO: 108682 - DNA, 101 bp, Homo sapiens; identical to SEQ ID NO: 43749
  chr13:20078200-20078301
  Hypo

SEQ ID NO: 108683 - DNA, 30 bp, Homo sapiens; identical to SEQ ID NO: 75734
  chr13:20138821-20138851
  Hypo

SEQ ID NO: 108684 - DNA, 78 bp, Homo sapiens; identical to SEQ ID NO: 75735
  chr13:20312627-20312705
  Hypo

SEQ ID NO: 108685 - DNA, 87 bp, Homo sapiens; identical to SEQ ID NO: 43750
  chr13:20392358-20392445
  Hypo

SEQ ID NO: 108686 - DNA, 63 bp, Homo sapiens; identical to SEQ ID NO: 75737
  chr13:20500420-20500483
  Hypo

SEQ ID NO: 108687 - DNA, 30 bp, Homo sapiens; identical to SEQ ID NO: 75738
  chr13:20531916-20531946
  Hyper

SEQ ID NO: 108688 - DNA, 27 bp, Homo sapiens
  chr13:20692250-20692277
  Hypo
cgtgagccactgcgcctggccacattt

SEQ ID NO: 108689 - DNA, 166 bp, Homo sapiens; identical to SEQ ID NO: 75740
  chr13:20692809-20692975
  Hyper

SEQ ID NO: 108690 - DNA, 151 bp, Homo sapiens; identical to SEQ ID NO: 75741
  chr13:20701930-20702081
  Hyper

SEQ ID NO: 108691 - DNA, 129 bp, Homo sapiens; identical to SEQ ID NO: 75742
  chr13:20702784-20702913
  Hyper

SEQ ID NO: 108692 - DNA, 128 bp, Homo sapiens; identical to SEQ ID NO: 75743
  chr13:20734542-20734670
  Hyper

SEQ ID NO: 108693 - DNA, 678 bp, Homo sapiens
  chr13:20735432-20736110
  Hyper
ggggctcttccctgccgcctacgcactccggggcatgcccgcgcgggacgtgagaggagagccgagggctgttggggcgggcccgacccgcttgcggggcgcccaccgcacgcagatgcgccagcccgcgccccgctcgcgcctgtcctgggcttcgcaggcccggcgaggtagctgctctccgggcgctcccacggtcggaggcgcgtgggcgtcgggcacctaggtctcgcccgcctgcagccgcctggggacgcgggttccggacggctggcgcggggcggggcggggaccaccgagcaggaagtccccgcggaagcgccgccgggcacagcgtgggtgctgtcgaggagtggcgcccgggcggggcgggaggttataaatagcggccgccatcctgcttctcttcagacacacttaatttagccggcaggcacacggatgcttatttttaaaaaaagaacttgttttattgcgctcgaggtgaccgggaaggtgtccccgcgggtcactcgctccatctggtcctggagacgagatgccagggcgaggcctaacctgcctgctggcgcccaacgaagattttaacgttttctgttcccttcggggtggttttaccacgcttgagagggacgcctaccgcggaaggccgcggaccgagggcggcatcgcgtcctt

SEQ ID NO: 108694 - DNA, 90 bp, Homo sapiens; identical to SEQ ID NO: 75746
  chr13:20766251-20766341
  Hyper

SEQ ID NO: 108695 - DNA, 714 bp, Homo sapiens; identical to SEQ ID NO: 75747
  chr13:20805970-20806684
  Hyper

SEQ ID NO: 108696 - DNA, 332 bp, Homo sapiens
  chr13:20875611-20875943
  Hyper
gggctggtccgattgcgccggctgcgcagcgcttcccagaaaccgcgcttggtgatgttggaggcctggatcgggctctggtggagggtgtttaccaccaggccccacgccctgggtcttgccctctggaacggcagcaggcgcgctcccggcgaatctgcctgaatcgccgtgaatgcggtggggtgcagggcaggggctggttttctcagccggtcttggcttttctctttctctcctgctccaccagcagcccctccgcgggtcccatgggctccgcgctcagaacagcccggaaccaggcgccgctcgccgctcgctgggggccaccc

SEQ ID NO: 108697 - DNA, 154 bp, Homo sapiens; identical to SEQ ID NO: 75749
  chr13:21057336-21057490
  Hypo

SEQ ID NO: 108698 - DNA, 33 bp, Homo sapiens; identical to SEQ ID NO: 75750
  chr13:21057550-21057583
  Hypo

SEQ ID NO: 108699 - DNA, 30 bp, Homo sapiens; identical to SEQ ID NO: 75751
  chr13:21475790-21475820
  Hypo

SEQ ID NO: 108700 - DNA, 95 bp, Homo sapiens
  chr13:21520313-21520408
  Hyper
agggtgtgaagagatcgggagtcctctgcgaggctctggagcacccggcgcctaagaggctagtgcgccccgtgccgctgcggtaggacctggcg

SEQ ID NO: 108701 - DNA, 30 bp, Homo sapiens; identical to SEQ ID NO: 75753
  chr13:21549397-21549427
  Hypo

SEQ ID NO: 108702 - DNA, 181 bp, Homo sapiens; identical to SEQ ID NO: 75754
  chr13:21634356-21634537
  Hyper

SEQ ID NO: 108703 - DNA, 218 bp, Homo sapiens; identical to SEQ ID NO: 75755
  chr13:21634747-21634965
  Hyper

SEQ ID NO: 108704 - DNA, 419 bp, Homo sapiens; identical to SEQ ID NO: 11520
  chr13:21649623-21650042
  Hyper

SEQ ID NO: 108705 - DNA, 30 bp, Homo sapiens; identical to SEQ ID NO: 43753
  chr13:21711382-21711412
  Hypo

SEQ ID NO: 108706 - DNA, 34 bp, Homo sapiens; identical to SEQ ID NO: 75758
  chr13:21713712-21713746
  Hypo

SEQ ID NO: 108707 - DNA, 23 bp, Homo sapiens
  chr13:22049000-22049023
  Hypo
tttttttttttgagacggagtct

SEQ ID NO: 108708 - DNA, 23 bp, Homo sapiens
  chr13:22049278-22049301
  Hypo
accgcgcccggctgtttctgcat

SEQ ID NO: 108709 - DNA, 33 bp, Homo sapiens; identical to SEQ ID NO: 75761
  chr13:22122977-22123010
  Hypo

SEQ ID NO: 108710 - DNA, 620 bp, Homo sapiens; identical to SEQ ID NO: 75762
  chr13:22243244-22243864
  Hyper

SEQ ID NO: 108711 - DNA, 176 bp, Homo sapiens; identical to SEQ ID NO: 75763
  chr13:22247052-22247228
  Hyper

SEQ ID NO: 108712 - DNA, 42 bp, Homo sapiens; identical to SEQ ID NO: 75764
  chr13:22336937-22336979
  Hypo

SEQ ID NO: 108713 - DNA, 30 bp, Homo sapiens; identical to SEQ ID NO: 43756
  chr13:22391874-22391904
  Hypo

SEQ ID NO: 108714 - DNA, 16 bp, Homo sapiens
  chr13:22707389-22707405
  Hypo
gcgcctggccaggtta

SEQ ID NO: 108715 - DNA, 42 bp, Homo sapiens; identical to SEQ ID NO: 75767
  chr13:22766880-22766922
  Hypo

SEQ ID NO: 108716 - DNA, 31 bp, Homo sapiens; identical to SEQ ID NO: 75768
  chr13:23174977-23175008
  Hypo

SEQ ID NO: 108717 - DNA, 352 bp, Homo sapiens; identical to SEQ ID NO: 75769
  chr13:23489676-23490028
  Hyper

SEQ ID NO: 108718 - DNA, 108 bp, Homo sapiens; identical to SEQ ID NO: 75770
  chr13:23507321-23507429
  Hypo

SEQ ID NO: 108719 - DNA, 30 bp, Homo sapiens; identical to SEQ ID NO: 43757
  chr13:23717527-23717557
  Hypo

SEQ ID NO: 108720 - DNA, 1374 bp, Homo sapiens
  chr13:23733447-23734821
  Hyper
cactatttcccagctcgcctccaagagctaactaaagtgcagcataaactgcatgcagcattgttttcaccacagcaaacccttcggggtgcctcctagcggcggatggagaactagcattgcgcgagagtgagtaaactgtgataaacccaaggggtttgcgggggacaggctgggtggcaagacttttaaaggctcgcaaatggaaccactccctccagagggactatctaaatctcctcaggtgctgaccctttctgacagtaaaggacgagggccagaagtgtaaagattgtggtcccgcgctccaagcccaagatgcgttcagcaggagtagttgggttggaaagaaggcacccagcgtctgcagcgaaggactcgcgtgggagcgagaaatgtccctgcccagtgccccgcgcgctggatcgcgggggcgagtctgagggtggagaggccgccgggtggaggcgcgcaggggtgcgtgggtgggtgcggaaggagtgcagggtatggaggggaatcttggggcggcgcgaaggaggagcgcttggaaaggcgcggtgtttggtcacagaggggctcggagtgggagtgcaggggtgcggggagggagtgcagggacgcggggagggagtggaggggtggggacgtgctggaggggcgcgcctcgatagaactggagaaactggaaaagtggaggggcggggcagtggctggaggaacctctgaagcgacgcggggaatatgtgaaggagtgctatgttggaacttggaggggaggggggatgctggagaggcacacggtgatggacatggaaggacccgggaggtgtggagtggtgggcccggcccgtcgcgggaaggacacagagggacataggctgccctggagaggcgctttcggacatctggaggggcgcatagtgctgggacttggcggcgcctggggcggaggggcgcgccggatccagccgggcgcgctcgggggccgggcgcagtgggagttgacgggcgtccagccggcggcgccctgggctcggctaggcgcaggacggccctggcagcggtgcagcagcccaggctagttcctggggggtccctggtccccgcctccccgcgcgccccggccagcaccgcccggagtccgggcggggaagtgggcgcccgcggcttgggaagctgctcccccgccctggagcagagtcgtcgctgcggtcgctgaggaaggacggagcagaggcccgcgctgtctggggagaagactgtggtgtcatcccgtcgggaatgaagggaaatgcagcggctgtttgcgccccgggactccaagaagtacagcaggtaaagagaatagccacggcccgccacttcgccttc

SEQ ID NO: 108721 - DNA, 115 bp, Homo sapiens; identical to SEQ ID NO: 75774
  chr13:23896852-23896967
  Hypo

SEQ ID NO: 108722 - DNA, 20 bp, Homo sapiens
  chr13:23920566-23920586
  Hypo
gccaccgagcctggccccct

SEQ ID NO: 108723 - DNA, 288 bp, Homo sapiens; identical to SEQ ID NO: 75776
  chr13:23949125-23949413
  Hyper

SEQ ID NO: 108724 - DNA, 29 bp, Homo sapiens
  chr13:23961293-23961322
  Hypo
tcgatttgttaaaaacgaatgtcggccgg

SEQ ID NO: 108725 - DNA, 30 bp, Homo sapiens; identical to SEQ ID NO: 34801
  chr13:24007814-24007844
  Hyper

SEQ ID NO: 108726 - DNA, 641 bp, Homo sapiens; identical to SEQ ID NO: 75779
  chr13:24040375-24041016
  Hyper

SEQ ID NO: 108727 - DNA, 154 bp, Homo sapiens; identical to SEQ ID NO: 75780
  chr13:24153182-24153336
  Hyper

SEQ ID NO: 108728 - DNA, 213 bp, Homo sapiens; identical to SEQ ID NO: 75781
  chr13:24153538-24153751
  Hyper

SEQ ID NO: 108729 - DNA, 70 bp, Homo sapiens; identical to SEQ ID NO: 34805
  chr13:24154053-24154123
  Hyper

SEQ ID NO: 108730 - DNA, 30 bp, Homo sapiens; identical to SEQ ID NO: 75783
  chr13:24155137-24155167
  Hypo

SEQ ID NO: 108731 - DNA, 70 bp, Homo sapiens; identical to SEQ ID NO: 75784
  chr13:24289608-24289678
  Hypo

SEQ ID NO: 108732 - DNA, 607 bp, Homo sapiens
  chr13:24477427-24478034
  Hyper
ggtttccccagatgccgcggtgcaccgagcaggagcagaggccacgcgggagccgggtgtgcgggtgggtaccggccgcgcccctgctcggaggcggcgactccctcccccgccttactcacaccgtgcctcagtttccccgtcagtgcagcggacaagacaatgccgaggtcccaggcgggcggcaggatccaattagtccgtgtaaaatgagaggcatctggcttctcccgggcaccccgcagcctgccccgcctcttagtggctaaaggcagggagcccctgagtcccagcgcggctgggggctctcagcagttctggccgagctccctcccgcccgcgtcgcctggcctcgaaccgctgcaccgcgggcggccccgacgggttcccgacctcccgctggggacacctgtcccgccgcccggcccttccccgcctcccgcgcctccgccccaggggagctccgggacaggcccacctaggcagcctgccggcgcagacccagcgagggaaggccagtctcgggcctccaaccggacacgcgctccccattccgggctctcccacgtctgcacactccagcccagccacgcggagtggcttccag

SEQ ID NO: 108733 - DNA, 284 bp, Homo sapiens
  chr13:24553829-24554113
  Hyper
ctgagttctgctgggcggggagccagagactgattcgctgcggtcctgggcccagcggctgggaggtcccgccctggccgaggaaatgaagagggcgcagggcatgggggcggcgcgcacccgggacagtttccagtcggcttctccgtgaccttcctcccccttccagctcggagcgggatgctgggatccctccaaggaccctctgaggacgtaggagggatgctgagacaggcaagtgggatttctctacatattgtcacctcgcccgcacttttggagaa

SEQ ID NO: 108734 - DNA, 53 bp, Homo sapiens; identical to SEQ ID NO: 75788
  chr13:24554519-24554572
  Hyper

SEQ ID NO: 108735 - DNA, 68 bp, Homo sapiens; identical to SEQ ID NO: 75789
  chr13:24931992-24932060
  Hypo

SEQ ID NO: 108736 - DNA, 138 bp, Homo sapiens
  chr13:25115633-25115771
  Hyper
gtccagtctgtttcccgcggtcttcctccgtctgaccctggcagcccgctcctctggccccgggctgtgtggggaccgctttcccccaggcccgtcgtcagtgtcctgagctccgccgactcccgcccattggcgtcg

SEQ ID NO: 108737 - DNA, 250 bp, Homo sapiens; identical to SEQ ID NO: 75792
  chr13:25254947-25255197
  Hyper

SEQ ID NO: 108738 - DNA, 2401 bp, Homo sapiens
  chr13:25319824-25322225
  Hyper
tggcgaccagaacaacgagggcgacgaagacaggactgaggaacatgcgcccctgccgccctcacccggaaccagggctcccggctggcagcgccaacgtgctcaaccccaaggctcgctcttgggtctggccaaggaggtcccagagcctggctgcaggcgccggttagccccagcgctgcagcgggcggcctgcagggtgagccacgcggggaagtccaagatctggtggctgcctagggcagcctcgcgcccgcagggcccgcccaccgctttgcttacgccgctgcccgtgggccaccccggcgcgcagggtccccagcccgcgcctccgccacagccggctttcccgcgcagccacggactgcactgccgccacgccggcaagggctccagctggacggagggggccttcctcgctccgggatccctgtcccactgtgtggcttcccgaggcctccccttcctgcgccaccaccaccgcagccgcccgtcgcggtggtcaggggcgctccgcggagaccgagaccaggccccggcccgcagctccgcgcgttcccaggcgcagctcctgatgccaagttcacttggaccccggctgagattagagaggcctggcgaggtgtgggggtgcgcagggagaatgggctgtggtcgccatggtgcgtgttggtcttgtggagatggatgctcctccgggtcaatctctgccttctcggggtcgccctcagtgtcgctgctgaaaaggcctccgtcctcctggtccttgctgtgcgctccccacgtcaccgcgttctccttgaggggccggcgggcgttggcgaaggtggtggggactgtcgtgaggatcatcatgggcagggaagggcgcgcggcagtggcctcgagccctgggtcttctccttcctgaatttgcaaagccaggcgaaggccctcgtgctctcccagagagctgcgctccacccgcgggcctgcctgcgcgtggggagagcggggaggcggggacaggagacctgagcccctgggcgcccctaccacgtgtcccccgtcccaacactggacctcttcagattccttgccgagaggggcctcgtcccaaggctggatgcgccgcgcagcggtgaaagccgccctcgcagcccgcaggcgaccagtgggtgctgttggctttcgccccggggagggaacgggcttgggggcactggcggcggcggagcgcggcggggaagctgtgggggtcgtgcgatggttatggagagtgctccatccgccaggcctgggctctgggcgagctgaggagaccggagtttttccccaggagggagccgcgcaggccggcgacctcttcccaaggctctactgctggaccgcgcccgcggcgccgctcccgccccccttcagcgcactctgcgcctctcgctgggtatggccagctcgcagtgcgcgtttatgctgcggtaaacgcattgaaggaacgcacagcttatctaatagggttttgaaataattttcggtatgccagctggggtgtggtttgcccaattctgatcctgtttccagagaacacagctgcttagacaatctgttatcttcgcgtcctgtcttccttttgacgccagaacatcctagggatcaggggcctctcccatgccctggaaccatcctctcacggtgctgctcttcactggtgccaataacagagctcccgcaggcaggcctggatcagtggggactggggccctgaagtgagatggagcaagacagagcggcccttgggagaggggcatggggcggccctgtgctttagactcggcaccctatggcttgaggaggtgacactgtgtcgacgtgcgtttgaagggaggacggctgaaggtacatgcagtctcccggacgtcacaaactccgcggacgcgggtcacacccgcgcgcacgcgcagcaggggtcttagccacacaggcgcacggcggggcacggcggggcacgggccctgctgcaaacgggcgcgctcccttctgggcaagcaggtgcgaggcgcgcgccatggaacagcccttagctgagtttcggtttgcgcgcaaacggccggcctggccgcccaacgcagcatttccagccagggcgcacaaacctcgggagagaaggtggaagccgcaggggctctaaaggcagccccaggttggctaaagcggttcctggtacggacaccaaggcccccgtgctcgggccctacccagcctggttcaggtgagaggaggcaagcctcggcccggtaccggcgtcggaaccacagtcgggcctggccctgctgccggggcggggctgctggacttccctcccgctccgggctggacctgacatctgtctctcgcatccgcactgatccgagctttaacattt

SEQ ID NO: 108739 - DNA, 43 bp, Homo sapiens; identical to SEQ ID NO: 75798
  chr13:25561078-25561121
  Hypo

SEQ ID NO: 108740 - DNA, 382 bp, Homo sapiens
  chr13:25592243-25592625
  Hyper
cccgcccaacaggcccgaggcagagaaaccgccttagcagctctcgcggcgcccagtacaggcggcggttgctgcgcaggtgccgcgggctggcagggctccctggagccgcaaggcgcgccctgccccagggcctgtttgactgtggcccgcgccctcttctcctcttccaacggctcccgatgctcagagacccccgcgctgggccctctgcagcccagggatggggttgagtggtgcttctccacctggtgccgccgctgggcccacagcccgacttcgccactgcgtcgcccccggggtccgcgctgatgggcgcgaggcggaaggacgggatccggggttgccaccgctgcagtcagcccaccgcttgcaggtggca

SEQ ID NO: 108741 - DNA, 261 bp, Homo sapiens
  chr13:25592860-25593121
  Hyper
tccatgtgctggtggcggctgcagctgcagcgcccatgggctgatgtggcttaccggagctgcggccggccacgcccaagggcctcacaggctgcgctgcccttgccagctgctcctgacccgcgcccagagagcaggacctggcgcttggcactgtgcagccacggggatgaggctgagcgccggttatcggcctcgtggcgccactggggccacagcctgacttcacctccccgtcgcccaagtcgtgtgatgggcaca

SEQ ID NO: 108742 - DNA, 30 bp, Homo sapiens; identical to SEQ ID NO: 75803
  chr13:25607882-25607912
  Hypo

SEQ ID NO: 108743 - DNA, 751 bp, Homo sapiens
  chr13:25620899-25621650
  Hyper
attgagaaagagacccgggtccagtgaagcatcagacacgctggcgcatggggacgaggagccctggagactcagggcccgtctggtgcggcccgggctttgctccgcgctcgccccctgcagctgccggggccgccgcaacttttcaaacctcaccgcaccgacagctctgtcccttcttttatctggagacgctgagcctcatcaactctcacctgcgtttcaggaaaaataataataataataaatgttccacggacacaggatttcggccaaatgctgcttagctctaccttccccaaaagggcgggaggggtggcaaccagtagcgaaaccccgcttgcctgtctcagcaactctcccacgtccgcaggaggccttgcggggatccgagcatcccgctccgagatggaagtggtaggacagtccgggagaagccgacgggaaactgtcctgggcgcgcaccgcccccgtgccctgcgccctcctcatttgctcggccagcgcgggacctcccagccgctgggcccgcgaccgcggcgaatcagtctccgcttccccgcccagcagagctcagatctgctctggagggctctcgggatgtcgcctttccctggagatgagcagttctgcgtcaccctccgtggccagcgcggcttccagggctgggctggtctattgtttgctgttcttgaaaggacgtggggagggtgggagggtgggagggtgggagggccggggctgagccggg

SEQ ID NO: 108744 - DNA, 24 bp, Homo sapiens
  chr13:25642802-25642826
  Hypo
acatgcatgcatgcacgtggacac

SEQ ID NO: 108745 - DNA, 27 bp, Homo sapiens
  chr13:25668696-25668723
  Hypo
ctactctaggctaggcgcggcggctca

SEQ ID NO: 108746 - DNA, 38 bp, Homo sapiens; identical to SEQ ID NO: 75809
  chr13:25669254-25669292
  Hypo

SEQ ID NO: 108747 - DNA, 71 bp, Homo sapiens; identical to SEQ ID NO: 15753
  chr13:25670585-25670656
  Hypo

SEQ ID NO: 108748 - DNA, 1333 bp, Homo sapiens
  chr13:25744637-25745970
  Hyper
ttttcagtgaagtcacgtcagaaaacatcaaacaaatacgatctgccgacgggtctgagggtggatcgacagaggcagggtctggggcggcgggcgcccggccgctgccgccttcggagtcgacaagggggaccgtctttacgggaacggcccccgtcctggaagcgtcctctgccgtgcggacctccccgggccccggctcggcgcgccgatgccccgcggcgtcctctccccgggcgccggtgtcgccggggtgcgcgaggccctctgcctctcggcagctccgcgctggggcgcggtcggcgggggcgggcacctcctctccccctgcgggctcacctgctgggtctcgcggggcgtcctggctgggctcctccggctcgcgcgcggctctgggcgtctcctccttgacgcactccaggctggcggtgagcgagccgggtaggatcaagccgcccccgggcgcgcgcccctccgcggcctccgccttggcccgcttgtctttcctgtgccagcgcatgccgctgaacagcccccgcagcccccgcttttgtttgccgccggccttgctcgcgtccacaggctctcccttgccgttttccgagcgcccgttcttcttcagcagcgagaagaagctgtgcgacttggccaccgagctgctggcgagggagcccccgccgggccctgcggctctggggggccccgggttcggccgccccccgccgcccccgccgctgtcgcccccgccgcgcggctcctccttcctgccgctctccagcaccagcacctcggcaagtccgtcgtgggtcctgctcctcaccagccccgtcggacccgagcttttcccgtcccctttgtttttgaccccaaaaatgctgggcatggtgccacccgatttcctcttcttgaataatttgaaggcagctttattaatcttccccgacggcggctcggcggccggcgtttcggcggcacagtcacaatgcaagtccatgtctgccgcgagggtcccggtcccggccccggcctccgccttcctcctgcagacccccacggacgcgccagctccgccgcgctcgctgacagccccgccgccgccgcggctccggctcgtctccatggaaaccgcgcgggataagccgctttcgtcagcagtgggctcgcgccaggccactgtcacccgtattctaaatcaacctgagccgcgctcgccgccgccgctgcaaaagaaacacacataaaagaccatcttccctcccgcaagggcttatataataccctaacccacttccatccgacttggctcggcgctgcatggcgtttttgtggcagg

SEQ ID NO: 108749 - DNA, 67 bp, Homo sapiens; identical to SEQ ID NO: 75814
  chr13:25862385-25862452
  Hypo

SEQ ID NO: 108750 - DNA, 962 bp, Homo sapiens
  chr13:25945896-25946858
  Hyper
gacaggcagagactccgagtcccccaggtgcacccctctcctggaagagcccccgaaagtacaggcccaatctcccaccccaccaagccctccccatcgccttccccgacacctaaaagccccggtcctgcgtaatattgcggatccctcccagcctcccgtccgctcctcctcccgcggggctccgctcagggccggtcccccgcccccacgccgcagcccgggccagcggggcccgccgcggtggcgttcgcggatgctgccgcattggccgctgcggcacggacggcgcagcctcgggcgcggcccggcacaggcgccggcggtccccgccagctagcagcccggcgaggcgctggcccacccatggtcctcgggcggcggcccctgcgcccagccctgcgcgtagcctccgtctctcgcccggggccgccgagcccccgacacgggcgagatgctgaacggcgcaggcctggacaaagctcttaagatgtccctgccgcggaggtcgaggatccgctcgtccgtgggtgagctgggaggggcgcggcgagggagggtgggcccggggcgggggcggcgcggggcgcgcctgcggttatgcgacactgccccgcccgcgccccgctcccctccctgggctccctgggctctctgggctgcaggatccgccgacgcggcgcgctggccgcacgggggctgggcgtcgctgcacctgcggggccaaaaggctccaggccggggcgaggtgagcggcgggcgtcagagacccccggctcgtccctgtacagatgtgtgtgtgtgtgtgcggcctccctgtgcgcgtgcccgtgcgcccctacgcgcggatgcggctcagggatgcgacctaggcggcagtcaccgcgatggtgggcacggtttggcggcgcagagaagatgcagccttccctgccggcggccggcaccgctgtgctgcagag

SEQ ID NO: 108751 - DNA, 78 bp, Homo sapiens; identical to SEQ ID NO: 75818
  chr13:26041957-26042035
  Hypo

SEQ ID NO: 108752 - DNA, 899 bp, Homo sapiens
  chr13:26042600-26043499
  Hyper
tggctgcttgcagggcgcattcccattgctgctgtctctgttcctaaggaagatcaaaggatcccagaaaacccagttccagagctcagttcccgggactagagggtacgctcggccagatggctgggggtgccgctggccttggcgcccccgccgtccccgcgcggtcgcccaccccggcccgacaagcagcttgggcgtccagcccggcccggtccctgcagggagggagcgcaggagctgggggcggctctcccggggcggggctcgctccacaagcgccaggggccgcgcggggcgtgggcgtgggcggggccgggggcggggccggccttggctgccgcggcacaggcggcggcgtctccagggggagccaaggtacgtaggcggcgtccgcctcacccgagcatccttccccgccggtggccgcccgcccgcggcccgcgctcgcagcctcccgcctggcggttgacttctttgtgtcgtattctctgcctgcgccctgtctctgcaggacctgttcgttcttctttgggctataagaaggcagaggatgagatgtcccgggccacgtctgttggagaccagctggaggcacccgcccgcaccatttacctcaaccaaccgcatctcaacaaattccgcgacaaccagatcaggtaggagaaggcggccggctcgcgcggaaggcggtggagtcacagctgggaaggggctcgtcctcctgcgcggggcttggccgcgcacctggccggcccccgtccatctcccccagagccttcccctgccccctccccaccccactagcccgcggtgcagccccgcgcttccagtagggtcatgcgaatgcagccctcaccgttctctcctgcgcatccgttctgcgcccagcctgcctc

SEQ ID NO: 108753 - DNA, 30 bp, Homo sapiens; identical to SEQ ID NO: 75822
  chr13:26157703-26157733
  Hypo

SEQ ID NO: 108754 - DNA, 30 bp, Homo sapiens; identical to SEQ ID NO: 75823
  chr13:26317471-26317501
  Hypo

SEQ ID NO: 108755 - DNA, 30 bp, Homo sapiens; identical to SEQ ID NO: 75824
  chr13:26323546-26323576
  Hypo

SEQ ID NO: 108756 - DNA, 89 bp, Homo sapiens; identical to SEQ ID NO: 75825
  chr13:26355034-26355123
  Hypo

SEQ ID NO: 108757 - DNA, 322 bp, Homo sapiens; identical to SEQ ID NO: 75826
  chr13:26624595-26624917
  Hyper

SEQ ID NO: 108758 - DNA, 1191 bp, Homo sapiens
  chr13:26625198-26626389
  Hyper
cgtcactgactgtcccgcggcgctttccgcgcgggccactcccctctgccgcgacgcccaggaggcgacgacgccgggccctaggtccaggagctcctaagccatccccgtcctcagccggtggcccggtccccttagggactgccttatgagttgcactcgctgatggaaatctcgggatgcagtcagaaggcccccggggctgtcgtccggaagcctctggaggtttcactggcaaccggaccctccctgagcatccccgaagggatgctcactcgagccgaatgaccgctgggcgcgccgccgcggacctggagccagggctctgcgcagggtttaagcctcagggtcccgcgcgcgaatcagggcccgtctcccctcctttattccctcctcgggcgggtagaaggggcgaaggcgggcagtgcacgcaaggctctgggcagcaagtgacgcagccggccgcgctcagcctcctctgccccgaacttggtccgcatggctccggccgggccgcccgggcagcccacgggggtgcagccccgacgctccactcggcggggccgacggccaatcttcccagcacgtcgccgagggagcgctcctgaccccgggaacgtccaggacgcaggcgagggtcctgcgcgcccccagccgcagtcccgggagcctgcccagctggcggcggccgcggctgctgctgggcgcggatccaggcgggcggctcgccccggttccccttctccgcctccccggctgcagcgcggtcccacaggagcccggcagcctccggccggctctccctctcccggtcgctgcctcgccctcgggaggtgtgcgcaccgatggaagcctcccacggaagtttctttcctccgggctacgggagaagccgagcgcagcagccgcccacagcctcgcctcgccccgcccggcgccagaccagctccgactccgctcgctgccgcgctgagccgcgctcttatagaggccggcggctccccggcgcgcatgcgcgctgcgcggctcccccccacccccgacctcagggacgcccgcgggcgccgggcagcccctcactttcctaccccgggcaaggagaaaggtgtggccaagggcggggtctgcctgctggaataggcgcgggaggaaacccaacctaagcaatccaggcctcgctaacacaaataa

SEQ ID NO: 108759 - DNA, 30 bp, Homo sapiens; identical to SEQ ID NO: 75829
  chr13:26693061-26693091
  Hypo

SEQ ID NO: 108760 - DNA, 86 bp, Homo sapiens; identical to SEQ ID NO: 34830
  chr13:27050496-27050582
  Hyper

SEQ ID NO: 108761 - DNA, 1234 bp, Homo sapiens
  chr13:27131553-27132787
  Hyper
atccccacctctcctcgctggaaaggacgctgcctaagcctcatcccgagctgggggcggaggaccaagggtgagagccaccgcctccgcaatcccccgcccctcggcaccgtcgctcagcgcgctcgccggctccctattggccgaggcactcgccaatcctggtgaagcggccccgtgagttggccctggttggtggagccggcactgagcccccctcctgctccggccgagcccccccgccgggagggggcgtggccgcggccgtggacgggccggaggcggcgtcgctcgcgccgctgcgtgcggtgtggtgcgaggcgggtgcgccgggcggccgcggcgcggcgggaccatggagctcagagcgcagccccggcgccggcggcgggaccgcggaccggtgagtgagggctgcggtcgccccggctctccgctgtaggctgctgtggccctctcggctccgggccgggcggctgtcgggggaggggcggccccacggcgaactgaagttgctgcatcgccgcgcgctccggccgggcggcggggcccactgcgggctgcggcgccgcctcgcgcctatccctgcagcccggccgcattctcccggccggctcccgcgctggcaggggcttctcgccgtcacggcgcggccaggcggcccttctctcccgcgcctccgggcctccggccctttgccgtccggtgcgcgctccctggactcgggacagccacccgccctccccgccgtaagtggcgcccgggcctccgctcgcgccccacgcacgacgccccgggccgctccgcgtccgggaccttcgcatccgttcagtgtctgcgcgccctcgctggttctggtccagctccgcgtgccccccggccccattcggccctcgccgccctggcctgtgccctcttggtgcccgcgtgcgtgttggttgcgggcgtcctctccctcgaggctgcggtgccgcgtggctcccggcctcggagaccaggccggactcttggagtgcaggggaggaggtggggcggcccgcgagtgcgggggaccgcgcgcacggagccgcggcgcgcggggtatcatccccgggggtctttacccgcgcgcctgggctttagcgagggcagaagcttcctctcagtttgtggtgctgacgtgcaatggcgattgcttcttgatttggcccctctgcaagggagagttccctggtggagacgagagttcttaatt

SEQ ID NO: 108762 - DNA, 18 bp, Homo sapiens
  chr13:27144128-27144146
  Hypo
tataccttgatcagccgg

SEQ ID NO: 108763 - DNA, 30 bp, Homo sapiens; identical to SEQ ID NO: 43763
  chr13:27278150-27278180
  Hypo

SEQ ID NO: 108764 - DNA, 32 bp, Homo sapiens; identical to SEQ ID NO: 75836
  chr13:27319461-27319493
  Hypo

SEQ ID NO: 108765 - DNA, 769 bp, Homo sapiens
  chr13:27334211-27334980
  Hyper
acttcaaaacaccagcgtgagcgaggcaggcacacacggactcgcggcggtctgtttgcaacagcgctgggaatgcacattggaaaatcacatcttgcatgctgaaaacgaacaactgtttgacatctgggctgctgccgagaaaaccacgcggcagcggcaggtctcgagccaggggccgccatcctcgatggaatatttaaatcgcctatttccatcgaactcccaccctccaaacgcatcccccgcgcgcgtgcacatcctcaaacgcacccccgaccggaacaaagaggggctccagactccccccgtgcgcacggggcagtcgggagggccacgagagggaggtgtgtgcaatggaagtaccgagacagacagacagacagatgcccatgcactgctgccgattccctggcggcggggacgggagtcggacgcgagggggacagacagggtgcggggacaggcggcccgcgggggcgggggggtcatcgagggggtcaccttggctcgcccaggccgagggggctcctccggtgcttccgaagcgcgtgggctactcgtgtcgcatgtcggcgcagttgcccgctgtggcaaggggggggcggccgggctccggagcgggccgggagggcgcggggcgcgcactccgcggcaggtgagcggcgcggctgcaggtgagcagcagcctcggctcgcgcgcccagctttccccgccgcgcccgcccggcccacacgctccccgcgcgcgcgccgcccccgccccgcg

SEQ ID NO: 108766 - DNA, 30 bp, Homo sapiens; identical to SEQ ID NO: 75839
  chr13:27390853-27390883
  Hypo

SEQ ID NO: 108767 - DNA, 38 bp, Homo sapiens; identical to SEQ ID NO: 75840
  chr13:27553623-27553661
  Hypo

SEQ ID NO: 108768 - DNA, 208 bp, Homo sapiens; identical to SEQ ID NO: 75841
  chr13:27610050-27610258
  Hypo

SEQ ID NO: 108769 - DNA, 30 bp, Homo sapiens; identical to SEQ ID NO: 75842
  chr13:27811290-27811320
  Hypo

SEQ ID NO: 108770 - DNA, 67 bp, Homo sapiens; identical to SEQ ID NO: 75843
  chr13:27845541-27845608
  Hyper

SEQ ID NO: 108771 - DNA, 108 bp, Homo sapiens; identical to SEQ ID NO: 43764
  chr13:28239991-28240099
  Hypo

SEQ ID NO: 108772 - DNA, 609 bp, Homo sapiens
  chr13:28363673-28364282
  Hyper
gaaagaaggaaagcccgggacaacagaaattctttcaatgttgaactgtccctgatggacacttgaaaaccggctccggcagcagagccgacccgccaggcccaggggctcccgggcccctcctggggctgtcaggctaatccggcagccgcctcccaccccgccccgctctgggggacttttgctcgggtgactaaagttcaaactcggctaaagcaagccctgggaggcgctttaaacaggaaagtggcgcggccgcccgagagagcccgggtagcggcccccggaaaccaggcggcgggcagaggccgcggggtggggaggccgggttggctgggtggggaggccgggttggcggggcggcccggacctcccggctgcccgcgctagcacctgcccaaggctcgggtctctcagaggcacggagctttctctgcggaaatggccaggctcctgggcgcgctggcggccctggaccgccaagcagggagccccctctccggccgcggcccgccgggctgagagaccacagattaagtgcgccttggttctctcagggatgctattttgctccggcccgggtctctcccgcgccgagttgcacaacaa

SEQ ID NO: 108773 - DNA, 351 bp, Homo sapiens
  chr13:28364644-28364995
  Hyper
agctttggccttgctcgcattcaggggctcttaaccccttcctccccgggcacgcggggcggctgccagtggagctccacgctggccactcgcgggctcccagctccgggtgcagtgcccgccccttgcacccctgggccccgcccgcccttgcgcccctccagcctgcctctgcccagcggaaagcccctctccccgcccgggtctcgctcttcgcttcctctcagcgacccagcccagctcaaatttcccagagagcaattagaacgggaattaggctgcattgatgcgttccggctggtttgcaggcaccaccctagagtgggggagccttggcgctgagactctgtc

SEQ ID NO: 108774 - DNA, 609 bp, Homo sapiens; identical to SEQ ID NO: 75849
  chr13:28365486-28366095
  Hyper

SEQ ID NO: 108775 - DNA, 3674 bp, Homo sapiens
  chr13:28366393-28370067
  Hyper
agggagaggagggggcgagggcgcctgttacggcgtgggtggggttgacaagaatagagtacattatgcagttcatttagttaacaagtgaaataatgaggaagcgtgcagagtgaatgccaagagaaaaggcacaaaaaccctattgagaggccccggccgctcctggcgtagtccatcacatggcaatagtcctatttaagccgcgccgccggcgcctttcagcaccactagcgctggccagcaccccgcgctctttgggcggtgcccacggcagcagaggctactgtttcagcctaggtctcagccgcgcgttcagcctcctgggcagaggcagctgcgggataccgcggccagggaaagcgcgtggagagccgaaaggtgcggtgggcgcagagggcgggctggctgcggggcgaccgcgcgccggggccatgccgcgctccttcctggtggactcgctagtgctgcgcgaggcgggcgagaagaaggcgcccgagggcagcccgccgccgctcttcccctacgctgtgcccccgccgcacgcgctgcacggtctctcgcctggcgcctgccacgcgcgcaaggctgggctgctgtgcgtgtgcccgctctgcgtcaccgcctcgcagctgcatgggccccccgggccgcccgcgctgcctctactcaaggcttccttcccacccttcggctcgcagtactgccacgcgcccctgggccgccagcactctgctgtgtcgcccggggtcgctcacggcccggccgccgctgctgctgccgccgcgctctaccagacctcctacccgctgcctgaccccaggcagttccactgcatctctgtgggtaagcggggccgccgcgcagagggaccgggcagaggtgatccgaagcaggatggagagccagagatggaggaagagggaccctgggctttctgggggcggtgagggtcatgtcggggactaaggggggcgcttggggtggagtgaggatagagggccgggacacaacgccaggaggcggatgagggcagacgtccaggtcctggagtgtgggccggggtaagtgagggctgggatccaaggctctccatgaaggggaaggggttccagggctgcatgactccgggagaatcaggatctcggagctggacaaggagcgctcactgtagctctgctgtggattgtgttggggcgaagagatgggtaagaggtcaaagtcgtaggattctggcgaccgcctaccaagggattgggtccacagcacagaggtctgatcgcttccttctctgctctgccacctccagacagcagctctaaccagctgcccagcagcaagaggatgcgcacggctttcaccagcacgcagctgctagagctggagcgcgagttcgcttctaatatgtacctgtcccgcctacgtcgcatcgagatcgcgacctacctgaatctgtccgagaagcaggtgaagatctggtttcagaaccgccgagtgaagcacaagaaggagggcaagggcagcaaccatcgtggcggcggcggcgggggtgccggtggtggcgggagcgcaccgcaaggctgcaagtgcgcatcgctctcctcagccaagtgctccgaggatgacgacgaattgcccatgtctccgtcctcctcagggaaggacgaccgggatcttacggtcactccctaggcgcgtgtctccctaggtcgcccaccccaagacctccctgcgcctcggagactagtcctgggactcagcgctgattcccaggcacccgcagccaaaccactgcctggcatggatttggcactgctttgcagaggtcccgggcctgggcagggctgagagcttggcagagactggaccatggcgtccccgccccagggctcgctcgtgtccaaagccaactccaagctgtgaacactgtaagcgctcgagtcctcctgggcagtgcagcaccgcggcccccgcccgcaagcctgcttggcgcagcgccttgctggcagccggcgcctcctagcccgccctctctgggctggcttgggcttcctcgcttactctactctcctccgctctcggtcaaggtcggcggccttggatgctcgttcgcttctctttttaaaatgtctttttgtccctccccacctctttcctgtgatcatttattcactcggcccccgcccgccaacacacacatttatgaacccccactttttttttccttctccttttcccttcccctcctcagggagcctcctccttcagtcagtccatttgtcccttgatctggccttgctgtcctcagtccccacggctcctctcacagatgataaatttcgcccgtagtatccatattggggaaacagatttgctctgtttccaacacgctcttccttcctctaaacataggaccccgctctgcgccgctggcgaccccactcttccccctccagactctggcccgccccagcctagctgtgtaattgtacggcctctgcaatgccagaagatatttatttatttatttatgtacaaaattttaaataaacttttttttttcttagaaatgcccgtggctctgagcccagaggccttcgctctggagtagacaggcgccaacccggattgggcctcccttctgggaagggttggggatccagttgcagggtccgagccggctcctcgccttacagctcagccagtgcctctcggaaccctcagctccgctgagagcccgccttgcatgccagccaggtgcgcgctaacgattgtcccgctccggcgtggcgcacaagcgtcgcggagctcagagagctaagccggaagggaaggagagcgctctccttggactgcaccatgggtcccaacccctgcagcgcctccttctcacctgggatccagccccacctccatccctcaccatttcgctgtcctggccaacagccgggagggcagaaaccactccctccataagcacaagaaatccgtccttcactgcgcttggattgataacgattcgttagggacaaatttccattctgcgggatggtgcagacttctctcagagggccctcctctctttgttttaaggcaaattcccttagccgagtccctggtcgcggaacattccgggcaaggaatccgagaatccgaagtgatcctgccccagggagtccccgagagggactctgcatagctggagccagtggctctgggacctcatgttctcaccaattctcgttaaaatcctatatccccctacgacttagaatccacaccccagctccctttgaggacatatgcgggtttttttactctctaagatggatgaggagaaggaagtgcgtgaggttctgcagaaacggagagcgcacagctgcgggaggagtatttctgcagtcagtatttctgcagtcagacctgggaagctaatatccgcgttctcgccgctcccattctgtgtccaggaaacctgatagaccttcttttcctgccagacccctacacacacacacagacacacacacacatacacaccctggggagcgctgaactccccgtgtctaggcaaagcaaatgcgtcttttccagcaggaaagacggtccacctgaggttgcttaacatttttgaagctcatttcctcccccccacaaaacggctttattgagct

SEQ ID NO: 108776 - DNA, 1052 bp, Homo sapiens
  chr13:28370409-28371461
  Hyper
tagtcccagtctaaccggcctaagaaccagcggagccgatggtgtaactcctagtcggaggccaaaagcctgagaacctgggaagccgctaatcgaagacccagactacaaggccccggaaccaggagcttgtggggcttagttctaaaatcttccatcttttccttcaaatcaagctgaggatgggggtgggagggtctctctccagttcccctggaacaagggcaggcacgatctagctccccatggagaaactcttgccggttcttcctggagctaggcatctgagttgtgctctagactgatgaggatctccatcagtctgaacctcactttagacggggaccaattctccaccatcccaggaggcgacattgtgccaatctacggccaatctgaacgaagccaaggtgctttagtgcataccagtgaatagaatcacaactgttttactatcagtgatgaggctgatgcttgctgagttttgctcgtttgcatgttgctctagggccccagggtgagtgcagttgtgcactcttagctccagcaggaccggcccagcctccgtttggctgggatttgggggcgggcggcagcacgattttctggcaacgagttcgttgtgggtctgaaggaccggcttagaactagcacctctcctggattacaggagggggtggtcttgtgcacctgggaaaggccttcgccagcactcagtgtcaggcatcttgatcagaaatgcactttcgagcctgccagggaaccaagtttggaggggatggaaacggcggtgggagacatagaaaggatgaacacacacacccggctctccccgcactcgcctcttctccagctccccctcctctcccgcctaggagtccctcctgttcccagcttctccccagagtccgcagatccacagctgtgagccaggtccgcgtggggccagttttcccaggagtgcacgtttcctcctctcggcttcccagggattcatttccggaagaccaagctttcagctttctagtctgccttagcgagcagcgggagga

SEQ ID NO: 108777 - DNA, 305 bp, Homo sapiens; identical to SEQ ID NO: 75857
  chr13:28394662-28394967
  Hyper

SEQ ID NO: 108778 - DNA, 481 bp, Homo sapiens; identical to SEQ ID NO: 75858
  chr13:28395176-28395657
  Hyper

SEQ ID NO: 108779 - DNA, 75 bp, Homo sapiens; identical to SEQ ID NO: 34851
  chr13:28395998-28396073
  Hyper

SEQ ID NO: 108780 - DNA, 182 bp, Homo sapiens; identical to SEQ ID NO: 75860
  chr13:28396536-28396718
  Hyper

SEQ ID NO: 108781 - DNA, 292 bp, Homo sapiens; identical to SEQ ID NO: 34853
  chr13:28397177-28397469
  Hyper

SEQ ID NO: 108782 - DNA, 760 bp, Homo sapiens
  chr13:28491793-28492553
  Hyper
gtcccttctataggtcgcaggcagcagaaaatgctaattgtgaaagtgagaacgcgcctccatggaatacccccggcgatcccctcctcctcccccacagccgcgggtacccgggtttttgccggcgaccgcaaccggcggatttgctttctgctgagagcctcttttctttctgcagggccgagcaaaaatattaaatggaagcaaatgaagcatcgaaatggagaccaatttacagaaatgtgcaattagttgagaagtgcaaagtaaacactccgggggtggcaggcgaggcagggagcaggggagggagagtggggcgcagactgagtccagagtgggtgtaggggtgcccagggaggaggggaagggggaggaaaaggagggggaggggaaaagtggccgatctttgtcctgagcggagcttgccgtccgctcataaccgcgtcgccaagtcaaccctcggcgactcggcagattatctccaagggtcaacacgccgcggccaggcaaccccctccagcctgccctcctgatcgatgtggtcactcgcggccagggtgatagggtagagttctccgcggccgcagacaatggactcattgacgcgggcgcacagagattaggtgcccgggccccacggcctttcactctctgcccccaccaaaactgcaggtggcacttttccctgaagaaatcaccgaaactctccccgcccgccgccgtgcttcccttggcctgtcttcggtgacagcaaggg

SEQ ID NO: 108783 - DNA, 58 bp, Homo sapiens; identical to SEQ ID NO: 75864
  chr13:28494207-28494265
  Hyper

SEQ ID NO: 108784 - DNA, 981 bp, Homo sapiens
  chr13:28494773-28495754
  Hyper
cgccttggattatcccgggtcggactaaactacatcagggagctaccgagcccatccctcacagcagtgcttctctagtccagtttgaagcatctttcccacccagctctcctgggagtgtacactccttccttccctgttcgctgagcccatcttcgccccaggagcccgcgctcccagcgccatccttagagagccgaggctgagtcctgctcagggcttcggacactacagatcctcctccagcaggggatccgggaacccaggactccttggtagtgcacatcgaggaagccgagtagggacatgggtgcctcggacccaggccccagatcgccttcggagccccggagcccctcacttcccgcgcttcgttaaggaagggcaggcatctaggggcgccaggtaggtgcagaaaggcagggagggaaaggaaactgcacccaacccagcagtgtccggctgccctggttgtggaaacaggataggagtaaagaggaaggggctggggcaaggcgggggctcaccgcgaggctgaaagccggcctctcaacgtcagagcctggcagctaggagagcaatctgagaagcgaattcgtttttcaccaaccgaaagcaattgaagctgtctccccgcaccgcttcccaggaagtaatttttcaggagatgggcgctccctgcctagctggtggggaggcgagaggcctggttcctgcggccctccgcgccggcagagaacagaaggtctttcccggagccgggagccggaggcacggggtagcccccgggtcctttgcggccccgcgcgagcggcaagttccggcgcggcctgtgtcgtcgccgctactcactgtcatcgctgccgtgcctcagccacttctggtcacacctgcaccgcaaatagttgccttttcctttcaactggcagccgggagtagggggaagcagctcgagccggcgtcccccggcccaccccgaaa

SEQ ID NO: 108785 - DNA, 30 bp, Homo sapiens; identical to SEQ ID NO: 34857
  chr13:28503435-28503465
  Hyper

SEQ ID NO: 108786 - DNA, 145 bp, Homo sapiens; identical to SEQ ID NO: 34858
  chr13:28527239-28527384
  Hyper

SEQ ID NO: 108787 - DNA, 1150 bp, Homo sapiens; identical to SEQ ID NO: 75869
  chr13:28527845-28528995
  Hyper

SEQ ID NO: 108788 - DNA, 108 bp, Homo sapiens; identical to SEQ ID NO: 75870
  chr13:28534446-28534554
  Hyper

SEQ ID NO: 108789 - DNA, 313 bp, Homo sapiens
  chr13:28535260-28535573
  Hyper
cccgaccccacgccccgcactcctccctctggcttcgaggccaggcgcccgcgggccgggccaccggagcccctttcccaatcctggagctgtatacgccacccggaagggccgcggaattggagaggtgctgcagagggtctatacctcttgctgtttcccggctctgctcatcttccccaactgcccttaaggcgcctccgtgggcgcgctgattaggctctcggatgttggtgggaagatcgaaacgaagggctaagcccccctcgcccgggtcctgccggaaagttcagctcggcggcctccaggatca

SEQ ID NO: 108790 - DNA, 810 bp, Homo sapiens
  chr13:28540473-28541283
  Hyper
taacgcgactttctccgcggtggacgctcggacacgcgtgaccgcctcaaacccactccaggctgccattggtactcgcccctttttacagatgaggaaatggagaatcagaccgggtcacgcagatagtatcaggcggggttggcaccggagcctggctggagccacagaggacacctccggagctgaggcgcagggcagttccctcagccgaacaccccgggagggagactcgcctggaagtgtctcggagcgacccttgctcgggtgctgccccttcagtgtcccggacgtgccgggcaacgcgatgaccagaccctgagcgctcttcgacccatgccccaagggccttggaggcgccccacaccccctgggaacctaggagcggggctatggaggggagggatgagagggacttgtcagaattcattattgactgcgaaagtcaccaccctctttccgggccctaaaagagacaatggcagggctgggaaggtgtatatcaaagcaagccaggccgcgtccccccctccacccccacaccttgacagatgacgctccgcagaggagcccggctccggcccgcgggctgcggccaccccacattaacatcacaagggcacccggcgccgactgcggccttgccacctcggcgcaggacttcacagcggcctctcatctgctgaccccgcggcctgggctctggcggcttccctcccgcccccttcccggccctcaccccgcggccgctctcccgggacacgcaaaggtcttccttagggcgtgcgccacccccgccaaccgcgcccc

SEQ ID NO: 108791 - DNA, 172 bp, Homo sapiens; identical to SEQ ID NO: 75875
  chr13:28541956-28542128
  Hyper

SEQ ID NO: 108792 - DNA, 40 bp, Homo sapiens; identical to SEQ ID NO: 75876
  chr13:28542355-28542395
  Hyper

SEQ ID NO: 108793 - DNA, 783 bp, Homo sapiens
  chr13:28542653-28543436
  Hyper
tccgccgctggccgccgggagacagctgctcggcggcagcggtggcggcgggcccaggagggccggggttgagcgtttgcagcagcccagaagcgcaggaaggcgcggcggccgggtggtgcgggtggtgatgcgggtggtggtgcggatggtagtctgcggggctgctgtagcccatggctgcggccggggagccaccgttgaggccgtgagccacggcgttggcggcggccgcggcgcctccgggcgcgtagccattccagtcctcccggagtggggcgccatacgctgccggccaggatggccccggggactgcgcgctgtccaagttcgctgccgctgcagctgcggccgccacgtggtaaccgccgtagtccgggtactgcggggggctgacgaagttctgcggcgccaggttgaggccgccagagtggcgcacggagctagggtacatgctcacgtccttgtccaggaggtagctcacgtacatggtggcgagggtccgggagcagacctcaccatgctgcctggggaccgacgctggaggctgccggggggcacgaagggaaaggggcgaggggactcgaggagcggcgggtggctgcgccccagcccgcggtgctccgctggctcctcgcggctcttctgcctccgaggcggtccctccctctggcctgcctcctccctccctccctttcttccttctttcctcccacctccttcccactaggctgcagaggcggggaagacccgccacaggctggcgtgcggagccccaggccg

SEQ ID NO: 108794 - DNA, 734 bp, Homo sapiens
  chr13:28544169-28544903
  Hyper
gctagtggttattggcgtgcataactggaggcgagctaggggatcgttggtaaagcagtttcttaggctgctggttacacagaatgtcagtttgtgaaaattcattgagctacacttgtatgtttattatacttaaatataaggaaaagagaatttctgctaatgcttacctaggtatttatgtgtcttacatcatacctgtatctttaaaactctctgtcctttacaaagggaaacgttctccgaagaaatttatttctcatttccaggagatgataaggcaactcagggccattattaacgactgctaatgaaaagctctgagttgagaaaggatctctcttggtttgggaagcgctgcggccaaggggcctagggctggaagtggccgtcttggggaccgaagccgcgcagcccgggatcgggagctgccccgacaggagcgcggaggcggcgagattcggcccccgcgcgcgcccagctcggtttcagcaaccgcgtggagtgggcctgcggccgccgttcacctcctaatacaagcctttgacagcgctgccagattcgggaatgaggatcactgcggcgaggcccggcgggctgggcagcctgactcggcggctttgagcgctctcagaacccgcgggcgctcgcggcactcctggagacctgcacttgtctgttctcattgtcaagcgtttcgctcggatatttgtcaccatcgccttcatcctgtc

SEQ ID NO: 108795 - DNA, 30 bp, Homo sapiens; identical to SEQ ID NO: 34869
  chr13:28545247-28545277
  Hyper

SEQ ID NO: 108796 - DNA, 1055 bp, Homo sapiens
  chr13:28549497-28550552
  Hyper
gaggaggccccattccgtatcccagttaagttacacaggtgagtgacaagcccgggtcggctcctgagttctcatccggagctgcgctctcccgtctctttactgggagcgttctcctgccggggcttggacatttccaagggaagtgaaaatccacaaagctgcccccacttcgtaagggcctgtgcctggagggtcgtcgggttacagaaattgaaatcagctctttgccttccaactcttcttggccttgccaccgcgattggttttgttttctttgtttttaacgaattggtaagtaaaatattagttgttcaccctgaaatctgccctaaccacttccgtaccccctgaagctcgctgggcgcgccctgggctgtccttccctgagcagccgggcctagagtcaaggcgcgatgattgccgcgcaagctagggtccacgcggccggggctcctctcccgcctcgggcgcaccagaggccagaaagcggaaagcggctctgccaggccaaggccgacagaaaccgagagcatgtcgctatttgccggagagaactgccctgccaggctgccacaggtgacttgcccgcgcgagccacggcctctgcgcagagctcctcccgaaggggagagtcagagccacccgcgggtttggtcggggctcttcccagcccggcgtccacgccccgcgtcctgcgctcgcccttgcggctgcttatgctcaggtgtttcggaagaggcgccgcgcagccagctctctgtcccttcagctccagctccttctaaagggacagactcagcgtctgcccccatctgcaccccttcccgcaggaataaaatcattttccggacaagcttggaactgttgaaatgtaactatgtaattggagacaccggggtcgtgtctgggagattctgagctcatctacactcttgctaaactgcggggaacccagccctggtgggatctgtgcatctcacatgagcttttttacataaagagcacagacgctgcatttggggcctggtttatctaagcgtggggtttacccc

SEQ ID NO: 108797 - DNA, 2044 bp, Homo sapiens
  chr13:28551129-28553173
  Hyper
gccacctctggccttcgcctattaccttgtctttgttggggagaccatgggtgtttcatttctcctctgccaatagaagcctaagtagtatttgttggggctctttacaccttccctgtgttggggggggcgggggggtgtcgacgggtggtagaatgtggtgggctcctccgcaggatgctaatgtactttcccccagtggacagtctggctgctggtacaggaagctgcccagcctaataggggtctgaaactccagggctgacaagcaaagatttctatgggcacttccctccatttaatcgacactgcaatctcgcttcattctggggtccaaatacccagcgctgctcaatgttactattttaataactgatgggtttcccggggcagtcgagccacccccccaaagccgacctccgggagagatctttagctggacgcctcccgccttttaggagcgatggctgcaactattccgtccgtccccacggggcgccttcccaacccttcggttggctcttcccttcgcagggctcttcccggcccaccgcctccttcctgcggcttccccggctccccaggccggaccgaggccagcgtttgactttcctggctcccagtctgctcccctagtgcccaagagcgagaacaccgcttccgctcacatgtaaaggtcgggcgcagcaaatgaagtgggaaaagagaaaaacagacaaaccgctgtggcataaaagattccttttccgtccgttttgctttgcagttcgggcttagcaggagagggttggggagaactggataaacgctttggaatccacaaaggccggtggtgtcgggggccgcaaagggagtgaagaattgaagcagtgagctggataaatccggggcaaagcactaaacaatatggatattttggcaacgcgtgcgcgtgtgggtgggcggacaaaaggactcattactcgtatgattgcctcaattctccacttcctttgtgcacgtgtgtggacgctgttccaggcccgagtccgcctcccgcccaggacgcacagctccgggccgtggcccccgcgcgtccggttgtgcgtcccgggtccctggcccgcgcggcagctacagcttggcggggtctgcgcggaggaggtcggccaggcgcaggctgccgatcttcttcacctcgcccagagcagtgcgcagctcctgcgcggacgggcagagcagccggcgcgccagctcgcgcggcaccgccgtccggtcgctgaagcgcgcggcgagcacgaaggggaaaccgaagcgcgcgcggtactgcgcgttgagctcggccagccgcagccgctcgtccgcgcccaggctcctcaggcctgcgccgctctgttcccgctgcgactcggccgtgagcgtgccccgctgcagctcgctgcccgccaggtccgggtggcagcgcaggatgccctcctggcctgcggagaagcacagacaccggcgggagcgcgtcaaccgcgcccgtcccgcaccgcgcactcgagggggcgcgtaggccgcgcccggcccccctgccccgccccgccccgcccggccccaaagaaggctgcgggagggtgaagtagagtacccaggcggtgatgtcctggcggaacaggggcgcccttggcgcgcccctctaacaagtcctggaccttgcgcttctcggtccccactacattcggtcgggaccaggatccaggggcggggcgggaagtgacacgtttgtcttttgagaccttgggtcaagaagagcggaggagagagagggcggccgctgaggctcggaatttacgactaggtcgggagggagcagagacgcgataaggatcctgagcttttcctatctttcaaagtcctttgctctcagggggggctttgatgtctaaaggggccggacgcaagggcctgaagacttcctgcaaaagctctggaatgggtttcgttctgctccaaaggagaacggacaggggcggggtgcatccatagggataacatccatggggctcggcaaataaatgcc

SEQ ID NO: 108798 - DNA, 30 bp, Homo sapiens; identical to SEQ ID NO: 75887
  chr13:28576403-28576433
  Hypo

SEQ ID NO: 108799 - DNA, 30 bp, Homo sapiens; identical to SEQ ID NO: 75888
  chr13:28599972-28600002
  Hypo

SEQ ID NO: 108800 - DNA, 133 bp, Homo sapiens; identical to SEQ ID NO: 75889
  chr13:28613123-28613256
  Hypo

SEQ ID NO: 108801 - DNA, 1283 bp, Homo sapiens
  chr13:28673900-28675183
  Hyper
tttggggacagtcctcggagtccttgaaaacccctttggggtttatgccaggataagaagagactagaagaaagggacagctagtattttaatatgtaaatctgtttgcataatatttcctaggtaaactattcgttgatccaaccaaaattcggcggggctggggggtatcgttattgaggatgactcgctctaggggagaacgcggacgcattttcccatcagagttccctccataaatcaaaacctcaaaagaagagttaaagacgacacccaggtgtctacagtatccaagggccgggccaggagaggtccttggccacctggcgccgagttcgcggccgcagactcccacggacggcccagcacccgagcgcgcgggccgagctgccccagacccggcgcagcgcctcggcgaggccgtctgcgaagtccgggccgccactcgggaccgcggcccgagccagaggagagacttcggagaagagggaagaggacgcggggtgggaaacgccggggccgcaggcaagtagtgggcgagtccggagggcgcgaaagaggggaggggcgcgggaggcaatggaaggagcgagcgcggggaggagcgaggcggctgggccggaggaggcgcgcgcccgggtccacactgcggggtgggggctgagggaccgcgaggggctgcgagcgagcgagcggggccttaccgagcagcggcagctggccgccgtcgcgcgccaacgccggcatggcctccggagcccggggtccccaggccgcgccggcccagccctgcgatgccgcctggagcggcgcgcctcgcgctgcaggtggctctcttaaggatgcgcgtcaccgaccgcaaattccctcggactggtgcaaagtggaaggggggaggaaccctctccccagaggcagggaccgaggcgggagcggagaggttgggcagagccgagcagccggtgcctggcgcagcgctgcagccgagcccacgtgcccgccgcggtccgcagcctgtgctcggcggcccccggggctccccgactgcggcggggaagattgggcgcggtcccgccggagaagttgcactggctccgcggctctgccgccttgctgcccctgtgagtccccgaactctgtcgtttggatccggggcgtggggactgcagggagccacaaaccaccctcctagtgcgctgggatctttgaggccctgagaaaggcgctgaatccgctcggcacgctggcaactcccgccagcgcacaggcgagcattccattaa

SEQ ID NO: 108802 - DNA, 2078 bp, Homo sapiens
  chr13:29067773-29069851
  Hyper
tgcttaaaagaaaggcgctccgaaatctggctctctgcgcccaggggaacgaggcacaaatctccgccactcagccccactgagcagagactgcgagtccgaaccctcaagttcctcggggctttgacccctcaatggcggcggtctaactgctggtaaaacccccggcccctgactgttccaccgcccgtctcccaaacgcccagcgaaggctgacttaggtggcgggcggacctcatcgattcctcaaaccacatcgtttggtcaaaatcgcccgccctctcttcgctcggattttaaaggctaggcttgtaagtcagtaagttaacggtatttgggccctgggctgcccttgtgggtcagggtcactgatgtccgcgacacggactggaccgcgcaccacgcctgctcccggcagaggccccacccgggtggctgagcgcagcgcactggggccccgcggtccgagagcggcggggaggagcgggcgctcgccgagcgttccccgggacagtccggcttggggactcaagcgggtcatgggatgccggcgctggccctctcctgagatcctcctgctcccccgcaggcacgagtcccctccaaatcggctcccctcctacactctcgtgacgcgaggtcgcggccagtgcccaatatcaccaaagtcccggcctcagcccagccccgggcagcctggcaggctttcaggagcctctgctcccggctccgggggaccctgcgtacctgccccaggtcctctgggaatgggctctgggtgccaggcaggtcccggtgcgtgctgctcctagtgcccagggcctcggcagtgagaccccaacccgacagctggataagggatcagcgatcctgtcgcaaacggacagccccagcgcggacccggtctgagcgctgatgctcgcgggtccaggccagccactcctcgaggcgctccctcggagaaagggcgcagcggccccaagcgtgcccgctgcaactagtgtcccaggttctcgccgtagccagcttctccgggctacagcctcgtctccccgcgtgcaccccgccctggcctcggaggctctgccctccggccgccccatcgcagcccgcctcaggccccggcccccagccgcgcctcacctgtgagaagcagacagctgagcagcgcgcacagcaggaccccggtgtcccagtagctgaccatggtgagcgcgacgcggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgatgaagagcagccgagggcgggggcgatttataacctttccccagcccacttcctaccccggcacctccttctggtgacgtcaaggggtcccccacccctcatccgcctccccacctaccctcttcttcctcccaggctcgcttccctgcggctacggagaggggcgggggccgacgagggcgggtggcccggggccgagcgcgcgtggggaggtgctggcgacgcgggcccgggagcgcggccccggcaggttcagggtctttgctccgcgccctcttgcccttgcccctcctcctgcccatcgcgctcaggaaatccttgcagactccctccacccggcttactcagctctgggggccgcccgaaactggggaagggacaaggctgaagctccgccgcctggccctaggggcggaaagtccgatccaagggaagctggccgcgcctccgcgacggtgttcttggcacggaggactgaggcgcagtccggctgtctccccttgcctgctcttcccgcgctgtcccgccgctcctgaccccttcagactgtcccgagaagtctaggaaggcaccggagaccctcggca

SEQ ID NO: 108803 - DNA, 440 bp, Homo sapiens; identical to SEQ ID NO: 75894
  chr13:29105249-29105689
  Hyper

SEQ ID NO: 108804 - DNA, 1016 bp, Homo sapiens
  chr13:29106308-29107324
  Hyper
gtctccccagaggctcgtttcgaacccgcagctagccaagggcaaatgcatactcgaaagtgccacgcctctcgtccaccctgcgccgcgtccagtccacccccttcatcccgcgccccatgtccacccgcccgctgtccaccctgcgccccatgtccatgcgccccctgtccacccgctcactgtccaacccgcgccccatgtccacccgcctgctgcccaccccgcgcccccagtgcacccgcccagccccgagcgcccgcggagccgagtggagagcagcggccgcagcgcggcgccaggctcgggctgggctggccggcgcgaacccccgggggcgtctgggcggccaggccgggtggcggctgcgcacgtaggagtaccccctgagcccagccgctcggccggcctgacccgcgggtgaccggatacgagtaacgcgtgcgccccgatctgtgccctgcgcggggtcgggcggggaccggccgggggcgccgcgcgcccggtcgggttgactgtcgggggcgatttccgcggggcaaggcgggggcgcgggagcagcgcgcagctgcggggccattccacctgagcgccctgaggtcagggccggggcctgaggacacggcgctgggctccgggggacgcgggttcacgccggcgcccgagcgccacctccccgccctccgccggctcacgtagtcccggggttcggtacgtgaagtgccggcgcgaggctgctcaggccaccgcatgggccgggcgataaacaatcgcacaggatacacaacaccctggactgtcacaagcccctcgcaggaaaagataaataacatctgaggcgctgcggcgcggcttccccgggctgaacaaaaactaggaggtggggggcggtggggcgaagtaaacaacagaaccgaagaattgccgcacggagcctgggccggcggagaaaatcagatgcagtctccttccctttggtgactatccgtgggggtttctcccggtggaaatgagcg

SEQ ID NO: 108805 - DNA, 651 bp, Homo sapiens
  chr13:29292691-29293342
  Hyper
gcctcggatgccctgcgctcgtgcgcgcccgggttcaagggcagcctctggactggggcaacagaggacgcgccggggacagtaacctcggactacgcggccggcgctggggtggggagagtactttcccgtcgaactcgaccaaattacgcttgtcggggagtctcaagcgtattgtaaagcaaacctcggcaagcgcacttccgcgtcccgagtgacacctgcagggttctccggcagccctcggcttccccgcggccctgcggacctcggcctcagcgcggcgcggcggggcgcggagcagctgctccttctgcgcagtggacaatcggccaatcggcgcctccgtcggtcggtcagcggccctgccagcgctaggcgatgactcggccgcagccagctgagcatcgctgtccgccgaggaggcggggtcggctgccgcggcgctgtcactgttctacccggctctcctgcgattgggcccagcggtcggtgccccagcggcgattggtccacccggacgtcactctcccctggagagtggctagtggatcgtgcacccaccctcggaggcccggagtggatcccgcgcgaccgagcagccactcagcaccgctgttgagtggtgggccgcgccgcaggctcaacagc

SEQ ID NO: 108806 - DNA, 70 bp, Homo sapiens; identical to SEQ ID NO: 75901
  chr13:29352560-29352630
  Hypo

SEQ ID NO: 108807 - DNA, 208 bp, Homo sapiens; identical to SEQ ID NO: 34886
  chr13:29393656-29393864
  Hyper

SEQ ID NO: 108808 - DNA, 894 bp, Homo sapiens
  chr13:29394080-29394974
  Hyper
gaggcgcctgggtctcggcgagtgcgtctccgggcggccgggagggggtgcgcgcatcagctgccccgcgccgcctaccgctcgggcccgctcgccgcccggccactgtcaccgcggacggcacctcgcgggcgaggcgcgccggctgcgtggcgcgctgcgaaggttgggctgggcggccgccggccccgcggcttctctttgtccaggcgaggcggctggaggagcagccgcggccgcggcggagccgggagcgcctgggcgtcgtgcgggcggctccggtccccggctgcgccccggccctcgagcgggggcggcggcctgggcggtgcctgcgccgaggtgagtgcgggggcgcggagcggagcgcagccgcggcgcgggcgtgggcgggcagaggtgatagcgagcgccggcggctccaggtgcgggggcgcccctcgcgctccacctgcgccgccgccgccggctctcagggcaagtttatctccccccttctgcggaaacccttgaccgcttagcggagtacagacctgtcggtaaatagaaaactcgagctggagaggaggaggaagcagcgtggcggaacccggcccgagatgagcgtctccgtgagggcagtggtggcctcttggacattacatctttcttggctctttttgacccaggtgagcgaatcctctgctgcgcggtccggtggggtcggctggctctgctgccgccctctggacccgccggagacaggtgagcggagttggggagcgcgcagccgggctcggggcagcgccgggctggttcggcttctcgtctccagagcgctgatgcttcctgcccacatcacctgctctggcttagggactgcagctcttttggcaccttcgcttgctgccaggt

SEQ ID NO: 108809 - DNA, 182 bp, Homo sapiens; identical to SEQ ID NO: 75905
  chr13:29738377-29738559
  Hypo

SEQ ID NO: 108810 - DNA, 208 bp, Homo sapiens; identical to SEQ ID NO: 75906
  chr13:29914008-29914216
  Hypo

SEQ ID NO: 108811 - DNA, 214 bp, Homo sapiens; identical to SEQ ID NO: 75907
  chr13:29933425-29933639
  Hypo

SEQ ID NO: 108812 - DNA, 40 bp, Homo sapiens; identical to SEQ ID NO: 75908
  chr13:29954759-29954799
  Hypo

SEQ ID NO: 108813 - DNA, 19 bp, Homo sapiens
  chr13:30031261-30031280
  Hypo
acagcgagactccattcaa

SEQ ID NO: 108814 - DNA, 30 bp, Homo sapiens; identical to SEQ ID NO: 75910
  chr13:30057559-30057589
  Hypo

SEQ ID NO: 108815 - DNA, 81 bp, Homo sapiens; identical to SEQ ID NO: 75911
  chr13:30098898-30098979
  Hypo

SEQ ID NO: 108816 - DNA, 123 bp, Homo sapiens; identical to SEQ ID NO: 75912
  chr13:30106999-30107122
  Hypo

SEQ ID NO: 108817 - DNA, 144 bp, Homo sapiens; identical to SEQ ID NO: 75913
  chr13:30123237-30123381
  Hypo

SEQ ID NO: 108818 - DNA, 21 bp, Homo sapiens
  chr13:30149067-30149088
  Hypo
accgtgcgtggccagagcagc

SEQ ID NO: 108819 - DNA, 64 bp, Homo sapiens; identical to SEQ ID NO: 43771
  chr13:30574503-30574567
  Hypo

SEQ ID NO: 108820 - DNA, 592 bp, Homo sapiens
  chr13:30707178-30707770
  Hypo
aggtccaggccatagcgacggggacccggaggcaggaccgagagcccagagagttggtggcgctgccgtccctgcactgggtgggccgtgctgggagaaggtcccggggatcactcctcctaggccgccggggcagtctctccagccaccctctttccccagagccagcgggctggggttcttggtttagactctcttctctcctgtcctggaggaccagccatttgacgcccttgtccactgggaggatgttttccatgattccacttcttcccttcctcggccacctaaggcaggccggcttatgcgtgactgtcaaccgaggcaggccacagcgctgtgggcaggcggttttgcacgtatccttagtgaccctgaaggcccagcctctgctggctgcctgagccgagggttttacttcttttcatttaatcactttattggtccttgccgggagggagcccatgggtcctggtaaaagtgcatctccctgtggttctggggctgatcctccttctggagcagaagacagagctcagtgaggaccgcctgtgctgcctgcctgggacgccccagccgcagggccgcgcag

SEQ ID NO: 108821 - DNA, 186 bp, Homo sapiens; identical to SEQ ID NO: 43775
  chr13:30761001-30761187
  Hypo

SEQ ID NO: 108822 - DNA, 30 bp, Homo sapiens; identical to SEQ ID NO: 75919
  chr13:31003108-31003138
  Hypo

SEQ ID NO: 108823 - DNA, 175 bp, Homo sapiens; identical to SEQ ID NO: 75920
  chr13:31385108-31385283
  Hypo

SEQ ID NO: 108824 - DNA, 41 bp, Homo sapiens; identical to SEQ ID NO: 75921
  chr13:31415119-31415160
  Hypo

SEQ ID NO: 108825 - DNA, 230 bp, Homo sapiens; identical to SEQ ID NO: 75922
  chr13:31742917-31743147
  Hypo

SEQ ID NO: 108826 - DNA, 89 bp, Homo sapiens; identical to SEQ ID NO: 43777
  chr13:31821217-31821306
  Hypo

SEQ ID NO: 108827 - DNA, 27 bp, Homo sapiens
  chr13:32159215-32159242
  Hypo
ggcatgagccaccgcgcacggcccatg

SEQ ID NO: 108828 - DNA, 25 bp, Homo sapiens
  chr13:32244681-32244706
  Hypo
acaggctaggctgggcgcggtggct

SEQ ID NO: 108829 - DNA, 30 bp, Homo sapiens; identical to SEQ ID NO: 75926
  chr13:32605107-32605137
  Hyper

SEQ ID NO: 108830 - DNA, 34 bp, Homo sapiens; identical to SEQ ID NO: 75927
  chr13:32605459-32605493
  Hyper

SEQ ID NO: 108831 - DNA, 191 bp, Homo sapiens; identical to SEQ ID NO: 75928
  chr13:32605725-32605916
  Hyper

SEQ ID NO: 108832 - DNA, 91 bp, Homo sapiens; identical to SEQ ID NO: 75929
  chr13:32670558-32670649
  Hypo

SEQ ID NO: 108833 - DNA, 171 bp, Homo sapiens; identical to SEQ ID NO: 75930
  chr13:32752857-32753028
  Hypo

SEQ ID NO: 108834 - DNA, 76 bp, Homo sapiens; identical to SEQ ID NO: 75931
  chr13:32755306-32755382
  Hypo

SEQ ID NO: 108835 - DNA, 30 bp, Homo sapiens; identical to SEQ ID NO: 75932
  chr13:32798473-32798503
  Hypo

SEQ ID NO: 108836 - DNA, 160 bp, Homo sapiens; identical to SEQ ID NO: 34889
  chr13:33001068-33001228
  Hyper

SEQ ID NO: 108837 - DNA, 121 bp, Homo sapiens; identical to SEQ ID NO: 75934
  chr13:33113918-33114039
  Hypo

SEQ ID NO: 108838 - DNA, 17 bp, Homo sapiens
  chr13:33410944-33410961
  Hypo
ctcggcctcccaaagtg

SEQ ID NO: 108839 - DNA, 86 bp, Homo sapiens; identical to SEQ ID NO: 75936
  chr13:33590122-33590208
  Hyper

SEQ ID NO: 108840 - DNA, 974 bp, Homo sapiens
  chr13:33590467-33591441
  Hyper
gagcccgccggggagcgggggtgggcgcgccggcggtgggcgggcgggcgcggcggggcgcgggcataaaggggcgcggcgcggggccccggagcctggctcccgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggatacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggtgagtgcgaggggccaggcggagggccacgcaggggagacaga

SEQ ID NO: 108841 - DNA, 105 bp, Homo sapiens; identical to SEQ ID NO: 75939
  chr13:33924609-33924714
  Hyper

SEQ ID NO: 108842 - DNA, 30 bp, Homo sapiens; identical to SEQ ID NO: 75940
  chr13:34345129-34345159
  Hypo

SEQ ID NO: 108843 - DNA, 42 bp, Homo sapiens; identical to SEQ ID NO: 75941
  chr13:35516493-35516535
  Hyper

SEQ ID NO: 108844 - DNA, 41 bp, Homo sapiens; identical to SEQ ID NO: 34893
  chr13:35517132-35517173
  Hyper

SEQ ID NO: 108845 - DNA, 101 bp, Homo sapiens
  chr13:36045265-36045366
  Hyper
ccacccccttgtaatcgcgacagaagccagcccagccctctgtgttcccgcagcctcgggaacggcccggcattgtgcaggacggtcgcagattgggtgtg

SEQ ID NO: 108846 - DNA, 836 bp, Homo sapiens
  chr13:36704800-36705636
  Hyper
cacacatcactggcccgggcacacggaaaagcacacacacaataagaggccgggcccggccactccttccttggttcccgctccgcagccagttctgacaatgacaagcacctctcccagctcctccgccctggctctccatctccactaacaacgcgaaaagcctgggagggcccgctcgcctgactccaggtttaaagccccatggcaccaaacaaaagaggcaggtgccagcagccccggggccgcccgcacgcaacgcccccgggtcgggccaggctggccagggcagggcggccgcctttcgaggaactgcgggcggggcggcggggccaagctgagcgcccgccctgccctcggcgccccgcggctgcgggcggagcgggctctgcggagtcccccggccgccctccccgcagctcccgtccccagggaaggcaaaccacgcaccggtccgcggagagacgccgccgggggtctttgtggccgcgctgggggccgcctcctggtgctgtcctcgccgggctgggcgcggccggggctgcggggctgcagggctggggggcggcggcggggccgggctgggcggcagcagctgctggagcgcggcgcctcggttgcggccactagtgcagggatgtgcctcggcccgtcctcattgaaatgcggcgcttcgcacagcctcactccagcctctctctccagaggagggcggcggcggcggcggcggcgggcgcgctcccttttcttgtctcactcgctcacacgccctcccgtctccctcctcctcctcctcctccgcgtgcgcgccccgtcgcccccgcccttcttggcag

SEQ ID NO: 108847 - DNA, 244 bp, Homo sapiens
  chr13:36729093-36729337
  Hyper
aagggcagaggtcagcgcggggtctccccggagcaggagtgagcggcgagtgacaggtgcagccgcgccatccccaagcatcccggaacctggcccggaggctgctgtgggatccacagccctgcgcgctggggaggcgctgcaatgaccctgcggcggcgccttcccccggcgtccccaaatagaaacagcactagtgccctctctccgaccccaccagggccgctgccgggctcctccttac

SEQ ID NO: 108848 - DNA, 30 bp, Homo sapiens; identical to SEQ ID NO: 75947
  chr13:36788716-36788746
  Hypo

SEQ ID NO: 108849 - DNA, 30 bp, Homo sapiens; identical to SEQ ID NO: 75948
  chr13:36878705-36878735
  Hypo

SEQ ID NO: 108850 - DNA, 29 bp, Homo sapiens
  chr13:36883103-36883132
  Hypo
aggtgtggtggctcacgcctgtaatccca

SEQ ID NO: 108851 - DNA, 44 bp, Homo sapiens; identical to SEQ ID NO: 75950
  chr13:36885927-36885971
  Hypo

SEQ ID NO: 108852 - DNA, 1332 bp, Homo sapiens
  chr13:36919856-36921188
  Hyper
taaagagtaaaatcacgcgcaatccatcccaatataaccgcagttgttcgtgggccttcttgcagagaaaggctgcccaaccttgacggggccatgggcgctgcgggagggcaaaagaccacagagatctgcgaagccaaagtaaacaacggggttggggcggcgagaatgatcaatagcgatgctccgaaaggactccgcgataggaatcgagcgggaaggattccctccatcctaacagtccatgggttaagaggccgaagcttccctaaataccacactcccgcgagagaagggactgagaacaacttctcaaactattctctctcgaaatcgctcccttcctcgaaaattccatctctgagactcggatgaggtccccaccccctccacccttgtcccgtgaccgtcgcccgctcagcctcccagccgagtccgcggggcctggggcgcccaccccgcccacccaagggaccgcgcaggggtgaactcccccgcgccccacctgcgccttccagacctcgggcgccccggcgttgcctcgagagctccctgcgcggccgccgcggcacggaccagctcccactcccttacactgggcgccgctgcgctcgccgggggccggtcccgaggttcccaaggcctcgcgcgcgcgcttgccgtggcaaccaagacgttccacgacgcgcgctctcgaacgcttcgcgtcacgcggccgcgcggccccgcccgtcggcctcgctcccgccacagagcccgcagcacgccgccgccgcagcctaggtcacgtgagtacccacgcgcgcgtcttgccagcggattcatcaccggcctgctcagactaggttctgcccactctgaccttctaaatggtacgtgggaggacgtccgtccccttcggacccaagagtcaccgtaacactctagaaggggagaaaaggagcgagggcggcaggcgacagagaacctcgcgagtcagcggccccgcgcagacccccccaggcacggtcccctgcggccacgtcggctgctcggcgcctgcgcaatctctttctctccagcgaaaccgaggcctccggagagcctagtagagagtgtgggcagtgagcgcttgtagccgctagagggagcgctgggcacagtgcacgagagacaataaaggctgattatcccctcaatgtctctgcagcctgagctttgtgacttctgtatccagagcacagttaatttccaaaagcccgcctgcaccacgtgttttaagtcttggtgtgtgtgtaaagtctatatcactatcataaaactgttagttcctgattccgggatacaaagagt

SEQ ID NO: 108853 - DNA, 161 bp, Homo sapiens; identical to SEQ ID NO: 75955
  chr13:37004731-37004892
  Hyper

SEQ ID NO: 108854 - DNA, 1398 bp, Homo sapiens
  chr13:37005473-37006871
  Hyper
agtcacctatgcaggcgtctgagcccccgggtttccaggagccccccgtataaggaccccagggactcctctccccacgcggccgggccgcccgcccggcccccagcccggagagctgccaccgaccccctcaacgtcccaagccccagctctgtcgcccgcgttccttcctcttcctgggccacaatcttggctttcccgggccggcttcacgcagttgcgcaggagcccgcgggggaagacctctcgtggggacctcgagcacgacgtgcgaccctaaatccccacatctcctctgccgcctcgcaggccacatgcaccgggagccgggcggggcaggcgcggcccgcaaggacccccgcgatggagacgcaacactgccgcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcaggtgagcaggtcgccatggcgatgcggccccggagagcgcacgcctgccgcggtcggcatggaaacgctcccgctaggtccgggggcgccgctgattggccgattcaacagacgcgggtgggcagctcagccgcatcgctaagcccggccgcctcccaggctggaatccctcgacacttggtccttcccgccccgcccttccgtgccctgcccttccctgcccttccccgccctgccccgcccggcccggcccggccctgcccaaccctgccccgccctgccccgcccagccggccacctcttaaccgcgatcctccagtgcacttgccagttgttccggacacatagaaagataacgacgggaagagcggggcccgctttggggtccaggcaggttttggggcctcctgtctggtgggaggaggccgcagcgcagcaccctgctcgtcacttgggatggagaccggctttcccgcaatcatgtaccctggatcttttattgggggctggggagaagagtatctcagctgggaaggaccggggctcccagatttcgtcttccaggtaac

SEQ ID NO: 108855 - DNA, 265 bp, Homo sapiens
  chr13:37247973-37248238
  Hyper
attttccaatggtggcgcaagctcctccctcgcccgagctgggcgccgtcctagagccaagcgcccgctagagccgagactagggggcggtgaggagtgggacccgctcgcggccattggttgtgcggccaggaggggcggagggacgacgcgcgggctgtgcggggccggcagcccggatccactcccgctgcgcctgctgtccgccgtgcgcccagactgcgcgccgcgccgctgcgcccaacattcccgaggacggcttcgc

SEQ ID NO: 108856 - DNA, 542 bp, Homo sapiens
  chr13:37248512-37249054
  Hyper
gtgtccttactgtcccgagaagcaatcgcagcccggctctccgagtcttggggtgactccacgggctgcaggaggagccgcgaggggccctgagtgcaatgtccttggccccgtgttgacctgcctcggtcccagacactgggaaccgggaaggtctaccctcgctctgcaaggtggattcctccatgcaagtgtagacagttctacactttgcagagtgtgtctaggtgccttctgtttgcttttgcctttgtggtgtgtggagggtcattcttgggtttgttttgctcctgtctgattttctagggtcatttgcgtcccttctcgggaacggggactcgccatgcgcacactgacagctggctttgcacctgctaaggcgctggagagtcttttcgcccgtcttagggtggccctaaatccggggaagttttatgtggcgctgaacacttgcgtttcccaggggcgttttccctagctcccggaaacccagtaggtaactgcgccagcgacccttcccctcttcccgggtctgatgagac

SEQ ID NO: 108857 - DNA, 67 bp, Homo sapiens; identical to SEQ ID NO: 75963
  chr13:37493463-37493530
  Hyper

SEQ ID NO: 108858 - DNA, 118 bp, Homo sapiens
  chr13:37494004-37494122
  Hyper
cccgggaacaacgaccgccaaaagccaagcctcacgccgaggagcctcccaggctgccccgaggacgaacaacttcgccctccactcaatgcgctcacacgcacgcacacaagcagcg

SEQ ID NO: 108859 - DNA, 29 bp, Homo sapiens
  chr13:37633989-37634018
  Hyper
ctggagtccgagtccgcaaagtgggaggg

SEQ ID NO: 108860 - DNA, 461 bp, Homo sapiens; identical to SEQ ID NO: 75965
  chr13:37643689-37644150
  Hypo

SEQ ID NO: 108861 - DNA, 488 bp, Homo sapiens
  chr13:38443222-38443710
  Hyper
gacgcagaatgtaatcgatcggtagaacattgatcactctccttccttcgttaccctactttaagtgccggagagctaaggcctcacttatatgcacccagatgcccccgagatctccattttccccaaatgcataaaaggctaaaaacggccacattccccagcaccacggcgtggctgcagctcctttgtttaccatataagtcacaccgggggttcactcctcgccctctcccctgctttaaagccgagtgcggcggaagactgaggagcacccccaaactcctgctcagcccgagtcaagcaccgaaagcttcacaggtttttttcctgagccttgaagagaaaccacatagccagaaccttttgaactcctaaccccgcagggatgtccgcctcccagaagagagccggcttcccaggcagcttaggaaacttaaccgagatcccagaaagaaggcgaggtgtagctccggtcgaacggagcc

SEQ ID NO: 108862 - DNA, 291 bp, Homo sapiens; identical to SEQ ID NO: 75969
  chr13:39260356-39260647
  Hyper

SEQ ID NO: 108863 - DNA, 389 bp, Homo sapiens; identical to SEQ ID NO: 75970
  chr13:39261007-39261396
  Hyper

SEQ ID NO: 108864 - DNA, 623 bp, Homo sapiens
  chr13:39261689-39262312
  Hyper
aggccatagtgctggcgaaccgcggactccgggtgcctttcggccgtgaagtctggctggatcccctgcatgacctggtgttgcaggtgcagcccggggaccgctgcgcggtttcggtactagacaacgacgcactggcccagcgaccgggccgcctgagtcccaagcgcttcccgtgcgactttggccctggcgaggtgcgctactctcacctgggcgcgcgcagcccgtctcgggaccgcgtccggctgcagctgcgctatgacgcgcccggaggggcagtagtgctaccactggtactggaggtggaggtggtcttcacccagctggaggttgtgactcggaacttgcctctggtcgtggaagagctgctggggaccagcaatgccctggacgcgcggagcctggagttcgccttccagcccgagacagaggagtgccgcgtgggcatcctgtccggcttgggcgcgctgcctcgctatggagaactcctccactacccgcaggtccctggaggagccagagagggaggcgccccggagactctcctgatggactgcaaagctttccaggaactaggcgtgcgctatcgccacacagccgccagtcgctcaccaaacagg

SEQ ID NO: 108865 - DNA, 231 bp, Homo sapiens; identical to SEQ ID NO: 75974
  chr13:40020679-40020910
  Hypo

SEQ ID NO: 108866 - DNA, 30 bp, Homo sapiens; identical to SEQ ID NO: 75975
  chr13:40211522-40211552
  Hypo

SEQ ID NO: 108867 - DNA, 86 bp, Homo sapiens; identical to SEQ ID NO: 75976
  chr13:41103265-41103351
  Hypo

SEQ ID NO: 108868 - DNA, 48 bp, Homo sapiens; identical to SEQ ID NO: 75977
  chr13:41238485-41238533
  Hyper

SEQ ID NO: 108869 - DNA, 35 bp, Homo sapiens; identical to SEQ ID NO: 75978
  chr13:41241688-41241723
  Hyper

SEQ ID NO: 108870 - DNA, 30 bp, Homo sapiens; identical to SEQ ID NO: 75979
  chr13:41496219-41496249
  Hypo

SEQ ID NO: 108871 - DNA, 53 bp, Homo sapiens; identical to SEQ ID NO: 15760
  chr13:41681520-41681573
  Hypo

SEQ ID NO: 108872 - DNA, 30 bp, Homo sapiens; identical to SEQ ID NO: 43786
  chr13:41705935-41705965
  Hypo

SEQ ID NO: 108873 - DNA, 53 bp, Homo sapiens; identical to SEQ ID NO: 75982
  chr13:41859167-41859220
  Hypo

SEQ ID NO: 108874 - DNA, 30 bp, Homo sapiens; identical to SEQ ID NO: 75983
  chr13:42021853-42021883
  Hypo

SEQ ID NO: 108875 - DNA, 30 bp, Homo sapiens; identical to SEQ ID NO: 75984
  chr13:42022516-42022546
  Hypo

SEQ ID NO: 108876 - DNA, 231 bp, Homo sapiens; identical to SEQ ID NO: 75985
  chr13:42031162-42031393
  Hyper

SEQ ID NO: 108877 - DNA, 153 bp, Homo sapiens; identical to SEQ ID NO: 75986
  chr13:42032496-42032649
  Hyper

SEQ ID NO: 108878 - DNA, 29 bp, Homo sapiens
  chr13:42063589-42063618
  Hypo
ggcgtgagccaccgcgcctggccactcct

SEQ ID NO: 108879 - DNA, 181 bp, Homo sapiens; identical to SEQ ID NO: 43787
  chr13:42540722-42540903
  Hypo

SEQ ID NO: 108880 - DNA, 118 bp, Homo sapiens
  chr13:43149215-43149333
  Hyper
gtgggcagaatgacacggcgcgaccagagaggcgcgggctcgggatgggggctctgcggctgtggcgctgtcctgtgggggtgaaggaagagggacagccccacgtgcctgctaggga

SEQ ID NO: 108881 - DNA, 51 bp, Homo sapiens; identical to SEQ ID NO: 75991
  chr13:43543176-43543227
  Hypo

SEQ ID NO: 108882 - DNA, 637 bp, Homo sapiens; identical to SEQ ID NO: 75992
  chr13:43565939-43566576
  Hyper

SEQ ID NO: 108883 - DNA, 30 bp, Homo sapiens; identical to SEQ ID NO: 75993
  chr13:43728041-43728071
  Hypo

SEQ ID NO: 108884 - DNA, 199 bp, Homo sapiens; identical to SEQ ID NO: 75994
  chr13:43985951-43986150
  Hypo

SEQ ID NO: 108885 - DNA, 1406 bp, Homo sapiens
  chr13:44359820-44361226
  Hyper
ggcttgcccacctgtcgaccccactttccccatgtgctcgccgcgggatgacaaccacaacactccagaaccaccccccttccgaaagagggcggggttacgccttcagccaatcaggacccgcgagccccgggtgtccaacctatggggtggctgtggccgtgcagggggaggacgtggggtggtctgggaggggccgcgtccgtgggaggctcgcacgtgtcgggtccggagaggcggggaggcggccggcgtccagcggccgaggcgcgggctctgcaccctggcagcggccgagtccggctgccccagtgcctcctttacctcgcgttgggccaggcagggcgcgctcccgccgacgaagacctgtccaaggtgtccgagctccccgcgagaggggacagtcacgaataacaacagtacccagcgcagactaggcggggaggaaagtttccggcccgcagcagagcggagtccgccaaggctggaggaaaagggatgcagagcgggagggtgaaaacctgaaagaagagggcagcgggaacactgtgtgggcaggaacgggtcccgggggcgacgcccgcagggggagacgggtgcggggtgcgctgtccaaggtgcaggggaggtgactggcgcgcggcgggcgcggagcccggagctgacactggctggcgggcggaggggagagcggggaacagctgtctggggcgctgggcacccccgggcgcgtaaaagtgagggagcttgagacggggcacggcggggaagggcgtgggggctgcaccgaagcccccacgcgtccacgcacccctcctcaccagcctcacctctagctccactcccctcccccctcgcccactcccctctcagtctagatccaggtgccgtggcgggggtgagaccagaggaccccggctcggagcccggacgccccagggaggctgcgggccccggagctgcttacctggggccgccgtatggggagcggaggcaacccgctgcgcggagtggggcgccgggcgcggcgcggctcctcctagcctcggcgtcctcctcctcctttgcttctcccggactctgtcccgggcacggagctgggagacgcggccgggctgcagtcgccgttccctctgctgccgccgccgctgcagcagacagaggacgccccgtggcggctggaagcctgtgtgagtagcggcgcccgggagagcggggatctgctgaggggcgctggagactccgcggctggaggcgcgcgggcgtgcgcacgcgcgcctgcgagtgtgagtgtatgggtgcgcgcgcgcccacggggtgggggagtcgcgaggggagggggagagaggccgagagatgctcgtagggaccgaggcaaaattctacgaccccggaaatccgtaaac

SEQ ID NO: 108886 - DNA, 34 bp, Homo sapiens; identical to SEQ ID NO: 75999
  chr13:44361544-44361578
  Hyper

SEQ ID NO: 108887 - DNA, 834 bp, Homo sapiens
  chr13:44947708-44948542
  Hyper
aaacacaggaggggccgcgtccccgtccccgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtaggtggctgcggggaccggaaggatggcgaggaagtcggaaagggtttcctgagatgagagattacttccgtccgggctgcggcctctctctggagtcggctagccggggctcggggagcggggtgcgcagggctcggggccacgccttgccacctgcagcgcccgggtgggccgcgggggcctcggcgggacgcgctcggccctgtcgcaggagctaacgcagggggaatccttgcaggtgggagcatttcagagcgcacaagccatggtggccaaacagcggatccggatggctaacgagaagcacagcaaaaacatcacccagagggggaacgtagccaaaaccctggtaaggcggggtcggcgccggccaggcagagccctgcagcccggcggggtggggcggaaggtgggggcggggccgggcgggtagcggcgcagggtccggcctcccggctcccggcccgccccttctgcggggtcctgcagagtgggggctgagagctgggttcagggcggcgcggtctgcttggcgtcctcgtgggcggagagggccctggttggtcgtggcccctctgggagtggctacctgggctaccagggaggcgcagaggagccctcctccccgacccgcaccccctgtccc

SEQ ID NO: 108888 - DNA, 56 bp, Homo sapiens; identical to SEQ ID NO: 76001
  chr13:45165560-45165616
  Hypo

SEQ ID NO: 108889 - DNA, 38 bp, Homo sapiens; identical to SEQ ID NO: 76002
  chr13:45491139-45491177
  Hypo

SEQ ID NO: 108890 - DNA, 26 bp, Homo sapiens
  chr13:45562261-45562287
  Hypo
ctgcactacctggcccggcgtggtgg

SEQ ID NO: 108891 - DNA, 26 bp, Homo sapiens
  chr13:45562467-45562493
  Hypo
ttgcttgaactcgggaggcagaggtt

SEQ ID NO: 108892 - DNA, 260 bp, Homo sapiens; identical to SEQ ID NO: 76005
  chr13:45564543-45564803
  Hypo

SEQ ID NO: 108893 - DNA, 281 bp, Homo sapiens; identical to SEQ ID NO: 76006
  chr13:45885713-45885994
  Hyper

SEQ ID NO: 108894 - DNA, 22 bp, Homo sapiens
  chr13:45905242-45905264
  Hypo
cttttgtcgatttgtcttttgt

SEQ ID NO: 108895 - DNA, 34 bp, Homo sapiens; identical to SEQ ID NO: 76008
  chr13:45926312-45926346
  Hypo

SEQ ID NO: 108896 - DNA, 30 bp, Homo sapiens; identical to SEQ ID NO: 43794
  chr13:45939250-45939280
  Hypo

SEQ ID NO: 108897 - DNA, 34 bp, Homo sapiens; identical to SEQ ID NO: 43795
  chr13:45950905-45950939
  Hypo

SEQ ID NO: 108898 - DNA, 30 bp, Homo sapiens; identical to SEQ ID NO: 76011
  chr13:45992804-45992834
  Hyper

SEQ ID NO: 108899 - DNA, 174 bp, Homo sapiens
  chr13:46189788-46189962
  Hyper
ggagcgcattgctaacgtgcgcagcccttacccaagccaggctcccgcgcgtgcatccaccgcgatctcaggccccggcgtttgtggcagctctcggttaccatgggaaccgcactccgcagcctccctgggccccatctaatctgcgtgtgtgcgtggcggagaattctaagc

SEQ ID NO: 108900 - DNA, 30 bp, Homo sapiens; identical to SEQ ID NO: 76013
  chr13:46424993-46425023
  Hyper

SEQ ID NO: 108901 - DNA, 331 bp, Homo sapiens
  chr13:46425360-46425691
  Hyper
ctctcaggttgacagcgtcggggaaagacatcagaccatcaatccagcttttcctgccagctggggaaacaacactcggtcactaacagcacccaatcacctagagagcgagagtgagccgaggcaaacacgccgggttccagacaccgtcccagcccccgagacccgggtttgcaaagggctgcacacgttcgccggagggtcgctgccgcctccgagaaaggacttgaacctgagcccggtgaaggtaaaatgacacagagactcacctttaggttgtgtgtggggttgacgacacagacaagttgcccggcagcggagaaaacccgtt

SEQ ID NO: 108902 - DNA, 90 bp, Homo sapiens; identical to SEQ ID NO: 76016
  chr13:46659250-46659340
  Hypo

SEQ ID NO: 108903 - DNA, 20 bp, Homo sapiens
  chr13:46660849-46660869
  Hypo
tcctacggctatttatggca

SEQ ID NO: 108904 - DNA, 147 bp, Homo sapiens; identical to SEQ ID NO: 76018
  chr13:46661276-46661423
  Hypo

SEQ ID NO: 108905 - DNA, 406 bp, Homo sapiens; identical to SEQ ID NO: 76019
  chr13:46785697-46786103
  Hyper

SEQ ID NO: 108906 - DNA, 30 bp, Homo sapiens; identical to SEQ ID NO: 76020
  chr13:46896454-46896484
  Hypo

SEQ ID NO: 108907 - DNA, 172 bp, Homo sapiens; identical to SEQ ID NO: 15765
  chr13:46920144-46920316
  Hypo

SEQ ID NO: 108908 - DNA, 21 bp, Homo sapiens
  chr13:46926247-46926268
  Hypo
ccaccacgcccactgcacttt

SEQ ID NO: 108909 - DNA, 599 bp, Homo sapiens; identical to SEQ ID NO: 76023
  chr13:46961084-46961683
  Hyper

SEQ ID NO: 108910 - DNA, 158 bp, Homo sapiens; identical to SEQ ID NO: 76024
  chr13:47043913-47044071
  Hypo

SEQ ID NO: 108911 - DNA, 29 bp, Homo sapiens
  chr13:47468139-47468168
  Hyper
tatgggggaagccacgctctgtctgttcg

SEQ ID NO: 108912 - DNA, 16 bp, Homo sapiens
  chr13:47526166-47526182
  Hypo
tcgctatcttttaacc

SEQ ID NO: 108913 - DNA, 142 bp, Homo sapiens; identical to SEQ ID NO: 43800
  chr13:47528522-47528664
  Hypo

SEQ ID NO: 108914 - DNA, 30 bp, Homo sapiens; identical to SEQ ID NO: 76027
  chr13:47685252-47685282
  Hypo

SEQ ID NO: 108915 - DNA, 29 bp, Homo sapiens
  chr13:48318948-48318977
  Hypo
ggagttggccgggcgcggtggctcacgcc

SEQ ID NO: 108916 - DNA, 30 bp, Homo sapiens; identical to SEQ ID NO: 15766
  chr13:48667877-48667907
  Hypo

SEQ ID NO: 108917 - DNA, 30 bp, Homo sapiens; identical to SEQ ID NO: 76030
  chr13:49254587-49254617
  Hypo

SEQ ID NO: 108918 - DNA, 1271 bp, Homo sapiens
  chr13:49794117-49795388
  Hyper
gcagacatcgctcaccggaccgggtagggctcgtgcgctaagggcgccgggtattccagttagtggagagggaagcgccctggaactgcatgggcccgggagagggcgcgggagcggagcagggccgggccggggcgggccgcggccgtgggcggagactgcgcgcagctagctcgggagcgcctcggagcccaccccgcagagccgcttctcgcgccccgcagcgcagcgcagcgctccgccgtctgacctgccgcgcccgcagcgtgcgggctgggaaaggaggcgctcaccgagagggaccacgcgccaggctcccagcccgacccgggacgcggcggccgcgcggagcacccatgggcagcccctggaacggcagcgacggccccgagggggcgcgggagccgccgtggcccgcgctgccgccttgcgacgagcgccgctgctcgccctttcccctgggggcgctggtgccggtgaccgctgtgtgcctgtgcctgttcgtcgtcggggtgagcggcaacgtggtgaccgtgatgctgatcgggcgctaccgggacatgcggaccaccaccaacttgtacctgggcagcatggccgtgtccgacctactcatcctgctcgggctgccgttcgacctgtaccgcctctggcgctcgcggccctgggtgttcgggccgctgctctgccgcctgtccctctacgtgggcgagggctgcacctacgccacgctgctgcacatgaccgcgctcagcgtcgagcgctacctggccatctgccgcccgctccgcgcccgcgtcttggtcacccggcgccgcgtccgcgcgctcatcgctgtgctctgggccgtggcgctgctctctgccggtcccttcttgttcctggtgggcgtcgagcaggaccccggcatctccgtagtcccgggcctcaatggcaccgcgcggatcgcctcctcgcctctcgcctcgtcgccgcctctctggctctcgcgggcgccaccgccgtccccgccgtcggggcccgagaccgcggaggccgcggcgctgttcagccgcgaatgccggccgagccccgcgcagctgggcgcgctgcgtgtcatgctgtgggtcaccaccgcctacttcttcctgccctttctgtgcctcagcatcctctacgggctcatcgggcgggagctgtggagcagccggcggccgctgcgaggcccggccgcctcggggcgggagagaggccaccggcagaccgtccgcgtcctgcgtaagtggagccgc

SEQ ID NO: 108919 - DNA, 30 bp, Homo sapiens; identical to SEQ ID NO: 76032
  chr13:49877160-49877190
  Hypo

SEQ ID NO: 108920 - DNA, 63 bp, Homo sapiens; identical to SEQ ID NO: 43802
  chr13:49922188-49922251
  Hypo

SEQ ID NO: 108921 - DNA, 138 bp, Homo sapiens; identical to SEQ ID NO: 76034
  chr13:49922941-49923079
  Hypo

SEQ ID NO: 108922 - DNA, 297 bp, Homo sapiens
  chr13:50070420-50070717
  Hyper
ggccagaggacagggcgcggcccaggccagttccacaggtggctctgactgcccatggtttcgcgcgagtggtgggcacgcttcggtttacctcccccgcgggtgacagcccagtgcttccaccacaaccgatgtcaactctcctagcgcccctccgctcaccggtaaaccaggacagtggaggggcgccctgatgcggtgaggcagggggcggccctgagggaagagctgggtctcacgttcacggaggacgtgactggaacccgtctccccttctccagtcgttccagtcctccc

SEQ ID NO: 108923 - DNA, 21 bp, Homo sapiens
  chr13:50367842-50367863
  Hypo
ataaagagctgctttcggccg

SEQ ID NO: 108924 - DNA, 311 bp, Homo sapiens; identical to SEQ ID NO: 76038
  chr13:50704489-50704800
  Hyper

SEQ ID NO: 108925 - DNA, 52 bp, Homo sapiens; identical to SEQ ID NO: 76039
  chr13:50705047-50705099
  Hyper

SEQ ID NO: 108926 - DNA, 92 bp, Homo sapiens; identical to SEQ ID NO: 76040
  chr13:51086819-51086911
  Hyper

SEQ ID NO: 108927 - DNA, 104 bp, Homo sapiens; identical to SEQ ID NO: 76041
  chr13:51796701-51796805
  Hyper

SEQ ID NO: 108928 - DNA, 231 bp, Homo sapiens; identical to SEQ ID NO: 76042
  chr13:51797015-51797246
  Hyper

SEQ ID NO: 108929 - DNA, 30 bp, Homo sapiens; identical to SEQ ID NO: 76043
  chr13:52389910-52389940
  Hypo

SEQ ID NO: 108930 - DNA, 30 bp, Homo sapiens; identical to SEQ ID NO: 76044
  chr13:52390252-52390282
  Hypo

SEQ ID NO: 108931 - DNA, 84 bp, Homo sapiens; identical to SEQ ID NO: 76045
  chr13:52532586-52532670
  Hypo

SEQ ID NO: 108932 - DNA, 35 bp, Homo sapiens; identical to SEQ ID NO: 76046
  chr13:52928634-52928669
  Hypo

SEQ ID NO: 108933 - DNA, 706 bp, Homo sapiens; identical to SEQ ID NO: 76047
  chr13:52979745-52980451
  Hyper

SEQ ID NO: 108934 - DNA, 36 bp, Homo sapiens; identical to SEQ ID NO: 43806
  chr13:53025686-53025722
  Hypo

SEQ ID NO: 108935 - DNA, 32 bp, Homo sapiens; identical to SEQ ID NO: 76049
  chr13:53055615-53055647
  Hypo

SEQ ID NO: 108936 - DNA, 658 bp, Homo sapiens
  chr13:53174056-53174714
  Hyper
ctagtccccagagcccgggctttagggcgcccggatgcaaaccagttttgccgccaaggaacccggacaggcgcgcctcctccccggcctcgcaaggaacaggttaaggagacatttcccactttctctgcccggccctgaacgctcgccgcccctgcccagccgcccactgtctggcagcctgcaagtctccattcagaagcggctccgtgctgcccagcgatggcgccctggcggcgcggaagcccgcggccaaatgacacgacttgggggcaaaggaggacaacagttcccaccaggtaggcactgggggaaggaggccgatgaccctgagattctccagcgaccccggcgggccatccctgggcggcgcgcgggtcccgcggcacgtgcgtggcagctctcgccgcttccctggacgcccgggaaggtcacgccgcctgggcgccgaggcccgccccgcgcccctctccctccgcccggggcgctccgcagctgccgaggagcggaagtgggcgccaggccgcggcgcgcccagcccagcccagcccagcccagtcggcgaccccgcgcagcgctgcctgcagaccctggagaaggcggaggcctgcgtctccgggtgctttcctacctctgggctccccgagaccctttctga

SEQ ID NO: 108937 - DNA, 1126 bp, Homo sapiens
  chr13:53312856-53313982
  Hyper
gacgtgccttccccacggtcgcgccactgcttagtgggagatgagccgagaacggcctttctcggaccgtccactacattctcccctactctacgcttcaatcttctcccgtgaaaccttcacttgcttttctacaacgttgacctaaggcggaaagccgcgtgccagagtgggatgggagaggggagctcacgctgggcccgaggggcccgccggcagccgcgcgcccctcgccggcccgcgctcgggctccccctaggggcaccatgggcgacacgggggtccccgcgcgccgccctctggacttacgtgactgtcgctccccttccagaagtagaaggccccgatggccccaaagagcagcagcacagctcccgaaatgaggaccacggctcccaccttgagcagccgcgcggggctggagggcttcaccgtcagcgtagcgtacgcctgcgggccggggcgggagagggaccgtcgcgtttgtgccgccagcacctgcggcccccagcgcacccgggccccacgcggtagcccccagggagtggggagtcgggcgggaaacagctcgcccgggctcctacgggtgcccctttcgccgcgctccctcccgagggtcctttgcagtcgggcgtggaagtgggatgagcaaaccccgcagcacagggccttcgccccaggacctgcaccctctaccggccacgggacgtccctccgcacccgcctgtggatgccgtgacccctgcacactcatacgcgtggggcgacatcccacccacacatttgggacccaaatttatccccccgccaacacacccattcggtggcacgcacccctgagtccgaactgtggaacctgatactcacacaacccaggccctgcgtgtggaatccctggcggtactcaccggggggctgcagaattccacgtcatcaggtcccaccagggcaatgggaactttgtcggagttctctgtcatgtttgcggcgggaggagtgaggcacttggagactccctgggcaccctgggatctgtcccgctgccccgacgtgcagggcatttcaacgccgcgcgcacacacggtgcacggtcccgcctgggccagcccagcggtccccacccctt

SEQ ID NO: 108938 - DNA, 30 bp, Homo sapiens; identical to SEQ ID NO: 76056
  chr13:53353373-53353403
  Hypo

SEQ ID NO: 108939 - DNA, 1063 bp, Homo sapiens
  chr13:53419713-53420776
  Hyper
caccgccacagggggcgccggctcctttccaaaacccggggaggcaccgtagggctgcagcagggaataggggaatgggagtggggggagggttggataagaaacaaacaaaaaacaagtgcgacaggttgtctacctgaatgcacccaccctacccctccagtctcccttcccccagcctgtccgcggagctcggaggggggcgcccagccgaaggaaggcctcacctcggcgtgcgcgccgcggagccgctgctgcccctcgaagtgacaggcgctttccccagtggcgctgccgccctctgagcccggcacttcggccgcggcgaccgcaggcggaggcgcgtccgccgcggggctgccaaagggcgctttgccggtgccagggaaggtgagcacgtcgaacatgttgggcctgggcccggctccccgggcggcctcctccggggagccgggagccgaggctccgccgcccgccgccccgggccgctcttcccggagggccccccctttgcgcacctccttcttgcggcggttgcaggtggtggcgatggcgatgatggcggccagcagcagcgtgcagctcccggccagcacgatgatgacgatcagcggcgtgtcccattgcagcaccgacccggacaccccgagccgagagccaggcgggcgggaacgctccgggcttcctgcactggcaggcgcagccggcccacgcccgccccctgctgttaccacgaagctgacagttgcggtggtggtgagcgggggacggccgccgtcggatatgaccaggagcgccctgaacacgcgaccgggtggctcctgcgagaggtcgccggtgagcagtatctcccccgtgcggcggccgatggcgaaggcttcgcgcggctcctgctgctgcagctcgaacgccagctccccgttggctccctcgtctgcatcccgggcctgcacacgggccacaaccgtgtcctttgcggtgcgcccaggcaccgccacttctagggagccattggctggcgccgggtgcaccaggactggcgcatggtcgttctggtccagca

SEQ ID NO: 108940 - DNA, 55 bp, Homo sapiens
  chr13:53421016-53421071
  Hyper
ccgtggccaggtaggcgcctggcgggttgttctcgcgcaccgacacctcatagac

SEQ ID NO: 108941 - DNA, 480 bp, Homo sapiens
  chr13:53421377-53421857
  Hyper
agtggcaccagcctccggcgtcccggctcccgccggcgagctagcgtccgctcccccgagtgcagcggcggcggcggcagcggcgaagggtgaggttgccggcgcgcctggggcggccagcggggtgatggcgatgtcgggtgcgttgtcattgacgtctcggatgcgcacgatgaccttgcaggtggcagcgcggggcccgggtccgcggtcctgcgcccgcacgtccagctcgtaggtgtcctgacgctcgtagtccacgggcccggccagggtgaggcggcctgatcgcgggtcaagccgaaagaggcggcgcgcctccggcggggtgcgggcgccaaatgcgaacaccacgtcgccgttaggtccctcgtcggggtcggctgcgtccaggtcgagaagcagggagcccacgggcgcgtcttccgccagctccacttcggccacggcgccctgcgggaaggccgggctgtggtcatt

SEQ ID NO: 108942 - DNA, 158 bp, Homo sapiens
  chr13:53422237-53422395
  Hyper
agaagctgaccacatcgaaggccagcacgcactgcggggcctggccacacagccgctcgcggtccaggccggcgtccccgacggtcagctgcccgtcgccttcgcgcacccggagcagagagctgttgaattgcttcatcaggcggaagcttgtgtca

SEQ ID NO: 108943 - DNA, 251 bp, Homo sapiens
  chr13:53422634-53422885
  Hyper
tcagtctcaggctctcggaatcacgctctttgcgagccctgtgcgggagaagtctgcgggtagcagctccgagcctccagcgggctctgaggacgcgcggacccgccctcactctgcgcctctccgtctcttacagaagctgcgccgcctcgcgccgcctttgcctttatagccgccgatatgctaatcacccgagccgggtagccaatggccgcctccccctcgcgtcgcccctccgcctgcctctgaca

SEQ ID NO: 108944 - DNA, 82 bp, Homo sapiens; identical to SEQ ID NO: 76064
  chr13:53423116-53423198
  Hyper

SEQ ID NO: 108945 - DNA, 360 bp, Homo sapiens; identical to SEQ ID NO: 76065
  chr13:53423765-53424125
  Hyper

SEQ ID NO: 108946 - DNA, 1249 bp, Homo sapiens; identical to SEQ ID NO: 76066
  chr13:53424759-53426008
  Hyper

SEQ ID NO: 108947 - DNA, 18 bp, Homo sapiens
  chr13:53427247-53427265
  Hypo
gcccggcctgtctgtatc

SEQ ID NO: 108948 - DNA, 76 bp, Homo sapiens; identical to SEQ ID NO: 76068
  chr13:53580906-53580982
  Hypo

SEQ ID NO: 108949 - DNA, 168 bp, Homo sapiens
  chr13:53775270-53775438
  Hyper
cctcgggggagcggacgctagctagtcggcgggagccaggacgcccgaggctggcgccgccacgctggtgccggagtgggcggcgcgcgagagtctggtggctctggtcagcacttcggacagggactcgggcgccaaccggcagatgcgctgcgccctctactggca

SEQ ID NO: 108950 - DNA, 30 bp, Homo sapiens; identical to SEQ ID NO: 43808
  chr13:56180149-56180179
  Hypo

SEQ ID NO: 108951 - DNA, 39 bp, Homo sapiens; identical to SEQ ID NO: 76071
  chr13:57484515-57484554
  Hypo

SEQ ID NO: 108952 - DNA, 30 bp, Homo sapiens; identical to SEQ ID NO: 76072
  chr13:57861015-57861045
  Hypo

SEQ ID NO: 108953 - DNA, 881 bp, Homo sapiens; identical to SEQ ID NO: 76073
  chr13:58203571-58204452
  Hyper

SEQ ID NO: 108954 - DNA, 78 bp, Homo sapiens
  chr13:58204937-58205015
  Hyper
gggaggaccatgaggcgagagtgaatacgattcgttccgctgcttctgactcatccggcagatcggaacacctgcatt

SEQ ID NO: 108955 - DNA, 1217 bp, Homo sapiens
  chr13:58205795-58207012
  Hyper
ggggagagccttttccgaggaagagagggaggagcctggtggggagaggaaactacaaatcgggacactagttctttacgctgcatttcctcccctccctttggctgctcggaaaggagagagaggaaaaaaaaaatacgcttggctggtagatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctccgggcgggagtagatttgcagcaccctagcgggagcgaggaaaacctactgattctttagctcattatcatctctcccagacgagatttccttcttatcgcctgcctcatcgctcaagtttgagcctcccgaagtccgggcgggagagacgaaacccctggctcacccccagccgcaggaagccaccgccttgctccaagcccctgcagctctgctgcaccgcagcttctcacccagtgcggatgctgtagatcaacaggttcagggaacttgagcagaataaggagagaccaccgggtgccgcagctcgggtgcagagggaaaaaaggacccatagacttgtggctcgcgtcgcgcgcgcacgctgcgccagggccccaggctggcgcgcactccctctctggctcctccagtccgattgctcctgcccccaccttacaggtctgggatgtacctttccatctgttgctgctttcttctatgggcccctgccctcactctcaagaacctcaactactccgtgccggaggagcaaggggccggcacggtgatcgggaacatcggcagggatgctcgactgcagcctgggcttccgcctgcagagcgcggcggcggagggcgcagcaagtcgggtagctaccgggtgctggagaactccgcaccgcacctgctggacgtggacgcagacagcgggctcctctacaccaagcagcgcatcgaccgcgagtccctgtgccgccacaatgccaagtgccagctgtccctcgaggtgttcgccaa

SEQ ID NO: 108956 - DNA, 1731 bp, Homo sapiens
  chr13:58207315-58209046
  Hyper
gctgactgccctggacggtggcgagcctccacgttccgccaccgtacagatcaacgtgaaggtgattgactccaacgacaacagcccggtcttcgaggcgccatcctacttggtggaactgcccgagaacgctccgctgggtacagtggtcatcgatctgaacgccaccgacgccgatgaaggtcccaatggtgaagtgctctactctttcagcagctacgtgcctgaccgcgtgcgggagctcttctccatcgaccccaagaccggcctaatccgtgtgaagggcaatctggactatgaggaaaacgggatgctggagattgacgtgcaggcccgagacctggggcctaaccctatcccagcccactgcaaagtcacggtcaagctcatcgaccgcaacgacaatgcgccgtccatcggtttcgtctccgtgcgccagggggcgctgagcgaggccgcccctcccggcaccgtcatcgccctggtgcgggtcactgaccgggactctggcaagaacggacagctgcagtgtcgggtcctaggcggaggagggacgggcggcggcgggggcctgggcgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgcacgagaacaacatcccgggagagtacctgggctctgtgctcgcccaggatcccgacctgggccagaacggcaccgtatcctactctatcctgccctcgcacatcggcgacgtgtctatctacacctatgtgtctgtgaatcccacgaacggggccatctacgccctgcgctcctttaacttcgagcagaccaaggcttttgagttcaaggtgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggggcaagggcaagaagaagaagatcaacaaaaatgatatcatgctggtgcagagcgaagtggaggagaggaacgccatgaacgtcatgaacgtggtgagcagccc

SEQ ID NO: 108957 - DNA, 30 bp, Homo sapiens; identical to SEQ ID NO: 76081
  chr13:59118670-59118700
  Hypo

SEQ ID NO: 108958 - DNA, 30 bp, Homo sapiens; identical to SEQ ID NO: 43809
  chr13:60614880-60614910
  Hypo

SEQ ID NO: 108959 - DNA, 23 bp, Homo sapiens
  chr13:60710775-60710798
  Hypo
tataaacaattctgccgggcgcg

SEQ ID NO: 108960 - DNA, 21 bp, Homo sapiens
  chr13:60860933-60860954
  Hypo
tatgcaaatgccagccgttgg

SEQ ID NO: 108961 - DNA, 38 bp, Homo sapiens; identical to SEQ ID NO: 76085
  chr13:61791028-61791066
  Hypo

SEQ ID NO: 108962 - DNA, 30 bp, Homo sapiens; identical to SEQ ID NO: 76086
  chr13:61988304-61988334
  Hyper

SEQ ID NO: 108963 - DNA, 127 bp, Homo sapiens
  chr13:61989202-61989329
  Hyper
cgccccatatccaggcgcgggtgccaggtcgccgggcaccagctcactcccagggcctgtgagctgcgcgcattccctcggccgcgcattccctgggaggctgcagtcagagcgctcttgaagggag

SEQ ID NO: 108964 - DNA, 30 bp, Homo sapiens; identical to SEQ ID NO: 76088
  chr13:61989554-61989584
  Hyper

SEQ ID NO: 108965 - DNA, 94 bp, Homo sapiens; identical to SEQ ID NO: 76089
  chr13:64311539-64311633
  Hypo

SEQ ID NO: 108966 - DNA, 30 bp, Homo sapiens; identical to SEQ ID NO: 76090
  chr13:65360861-65360891
  Hypo

SEQ ID NO: 108967 - DNA, 30 bp, Homo sapiens; identical to SEQ ID NO: 76091
  chr13:65499779-65499809
  Hypo

SEQ ID NO: 108968 - DNA, 48 bp, Homo sapiens; identical to SEQ ID NO: 76092
  chr13:65904937-65904985
  Hypo

SEQ ID NO: 108969 - DNA, 20 bp, Homo sapiens
  chr13:65937832-65937852
  Hypo
gttgctttatttgtccggtg

SEQ ID NO: 108970 - DNA, 1210 bp, Homo sapiens
  chr13:67804228-67805438
  Hyper
cataccatttccatccgatgccaatactgcttaagtctctaacttcttgtaggaaacgtcagagttgcggtgatgatgattctctgacagctatccgggtgacagttgcccgaaaaattcctaatcggttatctcttgcgtgcttcagagactctgaggcgctcctttccgtctcgcgtgctctccctctctcccttcccctctgcccctctctccttctccctctcctctctctgaactgaatttcttgatataactctcaataagcccagagggagggcgtgactgcccaggccccgcccccgggctctgattggcctgcatcttgcggcgcgggcggccgcagcccggcgcgagggagggagcgcggaacaaggcgctgactgtctcccagcctcccctcctccgcgccccctcggcagcagcgaaaacccggaaatctgatcctggccccaggagagccgggttccatgaggtgcactgagcatgctctgcagggtccggcgtgggagggacgcgctggcgctccccaggcccgggcggaagcggcgctcgcaggcgctgaaagcgagcgaccctctgagcccgggtggtccggcgggcaagggcggcgcgggagacccgcagggcgcgggcgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatagaggcttttgctggcagggacattggaaagaagggcggagagggagtacagcgaaaggtggggaccgcagaatttggaatctctgcggagaccggaaagaaaattaatcggagcacttcctacatgcagagccacggaaactgccttggaaagagaaagtggcagcgtctgggtcccctcggtcagcccgggccagtcggctgcgcgtgcgaagtctcctctagcggagcgggaccggccgcggcggtggatcgtggcggtccctgcacttctgctccagccgcgcctggaaacctgagcccggactcgcggctgctgcaaaacccgcttccagcccacc

SEQ ID NO: 108971 - DNA, 51 bp, Homo sapiens; identical to SEQ ID NO: 43812
  chr13:68343951-68344002
  Hypo

SEQ ID NO: 108972 - DNA, 73 bp, Homo sapiens; identical to SEQ ID NO: 76100
  chr13:68488541-68488614
  Hypo

SEQ ID NO: 108973 - DNA, 83 bp, Homo sapiens; identical to SEQ ID NO: 76101
  chr13:69619398-69619481
  Hypo

SEQ ID NO: 108974 - DNA, 728 bp, Homo sapiens
  chr13:70681570-70682298
  Hyper
agaggaggaagaggacggggaggacgatgaagaggaagaggaggaaggcttcttccagaaagtgctcacaccgcttctctcttggcttttgagcaggcgactctggctgggtccccagtgctcaaagctgccactgccgtcctgttgcaggcagcctccccccgccgggccgccggtggaaggagacgggtggctgaagagtttccagcggagtcgcagaatgtgcttcacatcgaagtcttttcgcccagagcctgacatgctttacgcacagaaggcaaaaggctggcagctcacgcaggagtaggctggtcagcaggtgggggaggacagcggggcccgggggcggaggaagaggcgggatgcgccctctgcacccctagagccagaagacgctaggtgggctgcgcgctctgccaggcgaaggctggagcgcagacggcaaagccgcgcgtttcagccgtggtcgggtccgcaggacctgggcgtggggacaccaccaggcaggagcagaggcaggactgggacgccaaaagctgagaatcctcgatgcccgcgcgagagccccgtgttatggcgaggtgggacaacccttaggctggagatgcgcgagggagggaggtctgagcgctccgaagctccggaggcggctgcagctggatacacctcactgggatgcgcttgtggcagagccttagtagggaaggtggtggcgttcttgtccttgc

SEQ ID NO: 108975 - DNA, 30 bp, Homo sapiens; identical to SEQ ID NO: 76104
  chr13:71068811-71068841
  Hypo

SEQ ID NO: 108976 - DNA, 30 bp, Homo sapiens; identical to SEQ ID NO: 76105
  chr13:71158391-71158421
  Hypo

SEQ ID NO: 108977 - DNA, 30 bp, Homo sapiens; identical to SEQ ID NO: 76106
  chr13:72408836-72408866
  Hypo

SEQ ID NO: 108978 - DNA, 93 bp, Homo sapiens; identical to SEQ ID NO: 76107
  chr13:72438470-72438563
  Hyper

SEQ ID NO: 108979 - DNA, 259 bp, Homo sapiens; identical to SEQ ID NO: 76108
  chr13:72438769-72439028
  Hyper

SEQ ID NO: 108980 - DNA, 30 bp, Homo sapiens; identical to SEQ ID NO: 76109
  chr13:72439538-72439568
  Hyper

SEQ ID NO: 108981 - DNA, 113 bp, Homo sapiens; identical to SEQ ID NO: 76110
  chr13:72439959-72440072
  Hyper

SEQ ID NO: 108982 - DNA, 37 bp, Homo sapiens; identical to SEQ ID NO: 76111
  chr13:72440704-72440741
  Hyper

SEQ ID NO: 108983 - DNA, 191 bp, Homo sapiens; identical to SEQ ID NO: 76112
  chr13:72441499-72441690
  Hyper

SEQ ID NO: 108984 - DNA, 29 bp, Homo sapiens
  chr13:72469378-72469407
  Hypo
acataatacatttcacgcattttttaaaa

SEQ ID NO: 108985 - DNA, 21 bp, Homo sapiens
  chr13:73253695-73253716
  Hypo
aggcgcagtggctcacgcctg

SEQ ID NO: 108986 - DNA, 30 bp, Homo sapiens; identical to SEQ ID NO: 76115
  chr13:73545132-73545162
  Hypo

SEQ ID NO: 108987 - DNA, 30 bp, Homo sapiens; identical to SEQ ID NO: 76116
  chr13:73619593-73619623
  Hypo

SEQ ID NO: 108988 - DNA, 30 bp, Homo sapiens; identical to SEQ ID NO: 76117
  chr13:73636816-73636846
  Hypo

SEQ ID NO: 108989 - DNA, 30 bp, Homo sapiens; identical to SEQ ID NO: 76118
  chr13:73653014-73653044
  Hypo

SEQ ID NO: 108990 - DNA, 207 bp, Homo sapiens; identical to SEQ ID NO: 76119
  chr13:73664304-73664511
  Hypo

SEQ ID NO: 108991 - DNA, 153 bp, Homo sapiens; identical to SEQ ID NO: 76120
  chr13:74707261-74707414
  Hyper

SEQ ID NO: 108992 - DNA, 43 bp, Homo sapiens; identical to SEQ ID NO: 34971
  chr13:74707625-74707668
  Hyper

SEQ ID NO: 108993 - DNA, 30 bp, Homo sapiens; identical to SEQ ID NO: 43813
  chr13:74987640-74987670
  Hypo

SEQ ID NO: 108994 - DNA, 211 bp, Homo sapiens; identical to SEQ ID NO: 76123
  chr13:75149904-75150115
  Hyper

SEQ ID NO: 108995 - DNA, 261 bp, Homo sapiens; identical to SEQ ID NO: 76124
  chr13:77459367-77459628
  Hyper

SEQ ID NO: 108996 - DNA, 105 bp, Homo sapiens; identical to SEQ ID NO: 76125
  chr13:77553641-77553746
  Hypo

SEQ ID NO: 108997 - DNA, 120 bp, Homo sapiens; identical to SEQ ID NO: 76126
  chr13:77935896-77936016
  Hypo

SEQ ID NO: 108998 - DNA, 23 bp, Homo sapiens
  chr13:78081911-78081934
  Hypo
attacaggcgtaactcatagtaa

SEQ ID NO: 108999 - DNA, 161 bp, Homo sapiens; identical to SEQ ID NO: 76128
  chr13:78271464-78271625
  Hyper

SEQ ID NO: 109000 - DNA, 338 bp, Homo sapiens; identical to SEQ ID NO: 76129
  chr13:78271894-78272232
  Hyper

SEQ ID NO: 109001 - DNA, 44 bp, Homo sapiens; identical to SEQ ID NO: 76130
  chr13:78273206-78273250
  Hyper

SEQ ID NO: 109002 - DNA, 30 bp, Homo sapiens; identical to SEQ ID NO: 76131
  chr13:78335732-78335762
  Hypo

SEQ ID NO: 109003 - DNA, 1223 bp, Homo sapiens; identical to SEQ ID NO: 76132
  chr13:78492801-78494024
  Hyper

SEQ ID NO: 109004 - DNA, 16 bp, Homo sapiens
  chr13:78567988-78568004
  Hypo
gcgcctggcatgtagt

SEQ ID NO: 109005 - DNA, 149 bp, Homo sapiens; identical to SEQ ID NO: 76134
  chr13:79160947-79161096
  Hyper

SEQ ID NO: 109006 - DNA, 1571 bp, Homo sapiens
  chr13:79169673-79171244
  Hyper
ggactgggacacgggcgcttcttctctccagcccttggttcgccggagcaggatgctggtctcaacactagggctatgtcggcttctcaccgaaccgagattttcaatttcagctttgcgattcaggattccacttgaattccccaggacgaaagcctagcggccaggctgcatttcgccccgggtataaatccctgccggataaattcaaatctgtagcagggttttggtaatatgcatcttagcaacaaaacaaaaaccaacctcgtatgccttccagttctttttaaaacgtgtacggcagttgtgaaagttttgtggtgcttgagactgttgacttatgcaactggggagagggtttttttaaccgctttgagatattggtccatcccttttctctcagaacgtcctcaagggcacgtaagagttggaggtgacctccgggagcgcctaattttgagccgcggaacttcggcccacttctccgaggggaccaggcgcgcgccaatacgcatgtgcgggctctgagcgctcagagcgcgcctcttccttcccggctccccgcggtgcgcacccgctggccactctgcgcacgcgcgccgggtgccccggcctaaggccgttgacctcgggttctccccggcacagtcgaatccacgccagggccctcaggccggtagctgtcctgcagtccgagcggagctgcgacctcgggcagctggaagcctgtgggctgctgcttctccaggcaggcggcggagggatgcaggcaggatgagcggcggtcccttcgccgccacccggagaaccgcggctggtgcccttgaaggccctgggatgcctgggttgggtgggtgagtgaacgagaaccctgagtgagtgaggggagggcgggtcccctcctggcttcaaattcaacccaatcagctctgccgatggtttgaaactgcacacgccgacccacccgccccgaagtctgaaagttatgccctggagacctgcgagctgcggagtgcagctggagagggagctgccccacgaggaggcctccagaataactcccggagtcggaacagcgctgggctgctgaagtttgcagcctccggatccgcgccccgccctgcagatccaccggatttcggggagggaatcggggggctgcccgtcctcccgtaaagctgacttgacaacaattacgaaagtttttaattagctccttgttataattcattttatttccagaactctccgaccataaattattcaaagagtaagccaacccgagcggggcggccgcgcgccttccccacgcgcgccgggctggctctggccgctcagctcacccgatgccccgtgagccagccccgcgccagaagccgcggtggcaggaaggtttgatcaaacattaaataacgtaatgtttgcgacaaggcttatctcacaagtggaaaagaggacctcgcgagaattagaattcggctgctattttaaaaaatcaattaagcttgcggtcttttttgaaacagctcgaaaggactgcgtggctatcatcgtggcgctaagactgagat

SEQ ID NO: 109007 - DNA, 220 bp, Homo sapiens; identical to SEQ ID NO: 76139
  chr13:79171448-79171668
  Hyper

SEQ ID NO: 109008 - DNA, 2668 bp, Homo sapiens
  chr13:79175595-79178263
  Hyper
ttgcaaaaccacacccgcaccacgttctttttgaggtccagtttctcggcgatggcggcgatcttctcggacgagggccggggctgcacggcgaagtaggcctcgagggagcgcttctcgggcgcggcgatggaagtccgcttgcgcttcttctcgccgccgttgaagagctcaggcttgttcattttctcgcgctgggcgccctcggcctcctcgagccacgcctgcaggatgggcttgagcgcgatcatgttgttgtgcgagagcgtgagcgactcgaacctgcagatggtgctctggctgagtgagcccacgcccgggatcttgaggttggccagcgccgagcccacgtcggcctgcgtcacgcccagcttgatgcgccgctgcttgaagcgctccgcgaacgcctcgagctcgcgcgggtccgtgtccgagtcgcagatggacgccaggcccgctgcgcccaccacggccgccgccgccgatgccgctgccacctgcccggccgccgccgccgccgctgccgctgccgcgccgtggtgcgccgccgccgccaccagcccggggtgcggcagcccggacggcatgttcatggcggccgccgccgcggggtgcgacaggtggcccaggctgtgcatatgcgggtgagggtgcgcggagccgcccaggagcccgccgcccgggccgccgccgccgccccccgggccgccaccgccgcctcccccggggccgccgcccgggccgccgccgccgcccgggccgccaccgccccccgggccgtcgtgggcgccgccgccgccggccgccgcgcccgcgccgcccgcgccggccatgagcgcgagcgacggcgaggagatgtggtccagcagatcgccgggttcgagcgcctggtggtggtggtggtggtggtggtggtgcgccagaggcaccgtggaagtggacgtgcacggcacgctgttcatcgtgtggtacgtggcgtccggcttgaaaggatggctcttgccctgggacacggcgatgtccacggccgccagcgcctcggcccgcgccagcagcgtctcgtccaggctggcgaagaggttgctctgcagctgcaggcgacacaaaccaaaccaaaaaaaccacaaaaccaaaagagcaaaacaaaacaacagaagaaacacacacacaggccggaaagcacagcatgcgaagggcaaacacaaagcaaccaaaataacaacgggtttgggggcagtggagagcgggaaagacggagagggggcacattgacgaccagggagggggcagacgagaagggatgggagcgtggagagggggacagaagtagggagaaagggggacacaagaacacattccggaaacgggcgtgggagacgaaaaagagggaaaagaagaaatggaaatgtaactcgcagctggggacccgtgtcacacacccgagcacgcacagagactgcctttctgaggcgtgaaattaacagagaaagtagagggaagtcgagagtcctggccccagcgctccctactccgatcgcaggcgcctgacgcggaggcagaggcagacaggaacacgacattaagggccgccggacaaaacgtgcctcgctgcgggactgctctacaccccctgcccgcagttccccgcaccgggacctgcacacaccagcccccgacatgcagcgtttcggagacggggaggggcgggcgcgcgggccggggccgcgggcgtggggcgcttaccggcggcgtgggcaggcaggcccgccggatggcctcggagctggagtgcagcgacgggtacttgtgctcagggagggtgggatgcatggcaaagtgaggctgcttgctgttcatggacatcatcgtggcggcttggcatgtatatccacaaacactccgaaagtccgcgggaaagtgcgtacgccggctcacccggcctcccttcggaggctgcagccgcggcggtcgcggcggctggcggcggccccgccgcgggctgctgctgctgctcctgctgctgccaggcgctccctctgaccgcgcagagcgccgcgcgccggcctcgcggtcccgcttctccgacagctctagccccgcgcgccgacgggatgcactcctctaacacctgagccccacttctcgcggccgtcccggggagctctcgcgagagctcgcggccccaccgcgctgacaggcatcagctgtctccgtctgtctgacgcgcgctctccttctcggcggccccgtgcgtctgcgcgcgcgcgcgctcgtccggccgcgaccagcgcgtgggagccgctcttatagtgaccaccagcaaggacagcgcaggtgatgcacctgtagctacccgggcatgcgcactgcccgcctcacctttcccaccgtggtctggaaagatcagaaggtccagctattgtctaagggtgggcaccttttagaataaaaaagacgagatgcgcgcacgcccctctatgtgtgtgtgtgtgtgtgtgtgtgcgtgcgtgtgtgtgtatgtgtgtatgtttcttctccctgatagcaagccttgaatatatgagcattacttaggcattcctcctcttcgggatgcctaacaagctgttgtataatgtatacagctggacatttctacgttaaattatgcccgcgcattcctctgtat

SEQ ID NO: 109009 - DNA, 216 bp, Homo sapiens; identical to SEQ ID NO: 76146
  chr13:79179534-79179750
  Hyper

SEQ ID NO: 109010 - DNA, 974 bp, Homo sapiens
  chr13:79182684-79183658
  Hyper
caggaggagcagagacgtccccgccccgcctgggccctgccgcattcaaagctggaagaaggcgctgatcagagaaggggcttccaggtcctgggttagaacaacaacaaacaaacgaaactccacaacagacacgcctgcccatgaccccacgcaaggacataggaagttctgtcgccttcctgctccgcggatagccgcctgccgtctgctgccaccagaacgcacggacgctcggggtggaggtagtcaatgggcagcaggggacccccagcccccacaagcgcggctccgaggacctggaagcgggtgcctgtcgctctccgcaggctccgctctgcctccaggagcaagatccccaaaagggtctggaagctgtggagaaaaccgcaaggacgcgagtccaaacccgagagtgcggagctgggtcctgtcacccggctccaacgctcgccggcgccgccgccagccgcccctccttcccgccgcccgcacaaatcaaagccccttgcgagggactgggaaatagttgccttgtcatgtaacacattgccctgatttattataaaattttaacgaaatcatgcatattttaacagcctttaatcactgcatgaaaatttaattcatgaactgtagcgcgtttaaataaatgaagtgttaattcattaggattaattaatttgttaaaggattgtgtgcaaggttaaggtggaaagaaaactctttgttggtttcgcgtcttaatcgccaggtttcacgagtaataataaaatgaaaggaaaccgcagggcgggccgttcgggtggagcttgggcgggaccagcccggagcgcccccgagaaagtgggaaaatcgggctggaagggctagggcgcgtctgtcttcccgagactggggagtgggggtccggtgggggctagaggggaagggaagagcgggcaccggcggcgggaatccgagaaggccgagtt

SEQ ID NO: 109011 - DNA, 150 bp, Homo sapiens; identical to SEQ ID NO: 76148
  chr13:80015563-80015713
  Hypo

SEQ ID NO: 109012 - DNA, 65 bp, Homo sapiens; identical to SEQ ID NO: 76149
  chr13:80914079-80914144
  Hyper

SEQ ID NO: 109013 - DNA, 32 bp, Homo sapiens; identical to SEQ ID NO: 76150
  chr13:80914581-80914613
  Hyper

SEQ ID NO: 109014 - DNA, 41 bp, Homo sapiens; identical to SEQ ID NO: 76151
  chr13:80915541-80915582
  Hyper

SEQ ID NO: 109015 - DNA, 30 bp, Homo sapiens; identical to SEQ ID NO: 76152
  chr13:81279635-81279665
  Hypo

SEQ ID NO: 109016 - DNA, 19 bp, Homo sapiens
  chr13:82399492-82399511
  Hypo
actccgtctaaaaaaaaag

SEQ ID NO: 109017 - DNA, 30 bp, Homo sapiens; identical to SEQ ID NO: 76154
  chr13:82646591-82646621
  Hypo

SEQ ID NO: 109018 - DNA, 30 bp, Homo sapiens; identical to SEQ ID NO: 76155
  chr13:82797186-82797216
  Hypo

SEQ ID NO: 109019 - DNA, 17 bp, Homo sapiens
  chr13:84382511-84382528
  Hypo
gggtgcggtggcttacg

SEQ ID NO: 109020 - DNA, 196 bp, Homo sapiens; identical to SEQ ID NO: 34986
  chr13:84455560-84455756
  Hyper

SEQ ID NO: 109021 - DNA, 369 bp, Homo sapiens; identical to SEQ ID NO: 76158
  chr13:84456111-84456480
  Hyper

SEQ ID NO: 109022 - DNA, 77 bp, Homo sapiens; identical to SEQ ID NO: 76159
  chr13:84456706-84456783
  Hyper

SEQ ID NO: 109023 - DNA, 30 bp, Homo sapiens; identical to SEQ ID NO: 76160
  chr13:85406594-85406624
  Hypo

SEQ ID NO: 109024 - DNA, 24 bp, Homo sapiens
  chr13:87738892-87738916
  Hypo
tttatttttttgagacggagtctc

SEQ ID NO: 109025 - DNA, 1631 bp, Homo sapiens
  chr13:88323342-88324973
  Hyper
ttaacagtaagtacacgagacagcagcattctgaatggcaggaggaaggcaggcgatcagcacagggctggaatcatctgttcctgaccaccagcaagcctggcactgccggggttatttccactcctccctttcccaatccgagaattgcacagtcccacgctcgaattacacacatggtccaagacttctctctcttcctacgaatgtgacatccaagggggccccggttgcgccgccctagcccagggacgccttcgccctcggctgccatctatcggccaccgagcgcccgcttcgccccgggcccatcatgtctgctgcagcttggctcgcaccagaggcgcgacaataaacaagtgcactggactgggccctgcacccgctccggagcagctgtctcagagacccggtgttgcttaccgcgttgccacctcctcggcgcccgggaggaagacgcaactttctcggagttttttttagagccaccgggctgccaggacaagccacaggcatagaacgacgcggttgctgcccgccccccccttcccccagaaaccccaaaggatgtcggtgatagagagttccaactaatgacgattgtgcgccgcatctggggaagggatacagaaaaaaaccctgcaaacaccgtgaggatgaaactgccaaagggatgcaagagcctctcaaatactaattaggggccgcggcggcggcgggctcggcgcggagacagcgtcggcgggatcccagcgcggtggtcgccgctgcgctggggggcggaggacagcgcaggagctgcagccgccgccttcgctggagcagccgaggggccggtgccacctttgctcgccccctcactaccatgtacagtgtgcgctgcaagaagaaggcgggagatgcatgcacacccccgcgacccgctccctctggctcgtcccccggcgtgcgccactgaccaggggggaatgtggtgaagacggcgaggaggagagccgaggggggaggggagggccggccggcgcgaacccaggccggagggtgcgaggagccagaggaggctggagggggcggcggccacagctgggtcggagaaagttgccccctatgcagatggcaactgtgagtacccctgtgggggggagggtgcagcgaaggctgccagggaccccgcgatcgcgccttaacacgtattggagcgagtgtgcgagtgatcatgagtgtgagcgggtgcgagcgctcggcggggctgaccgtcacgttggcggggccggcggggccaggcagtcttctccgcgtccccctcctcccgctccgtgcctcccctcccagcagctccccctccccgccccgcccggctccggctcccggcccctaccgcgaggcgcctctccagccggacctccgccgccccctcccgccgcctccctatcccgccgctgcagaacgccccccgctctccaccccccaaccctgctgcccgctccgactaccgcggagagcaccggggagagccttttggggagccccggaacccgcggtcgccaccgcggcggcggccccaggctggaggcgtccgggcgcctctttcctccagcctctgggactgcgctgctcgcagtctcctcgcc

SEQ ID NO: 109026 - DNA, 863 bp, Homo sapiens; identical to SEQ ID NO: 76166
  chr13:88325198-88326061
  Hyper

SEQ ID NO: 109027 - DNA, 812 bp, Homo sapiens
  chr13:88326312-88327124
  Hyper
tccttcctttaagagtgctgctgttgatcagaagtaggaagtggaaggaagccttcaaggggacaaaaagagagcaagaaaaaaaagggggagggggtcatattgattcctgtgggagatgaaattcggatattaaacaactgacctaagtcgcttacagttcttcctcccacctttctattttgcctcttaatcagcccaggcgtcctttccctgagattaaaaaaaagagagaggggagcgttaacaattaaatgtaataagcaactccaaagatggggatgctgtcgaggtggtagttccgtgcaaaccttgctattaccgttgcaaatagacgcggagcccaaggtaagggaggctttcgtgctgatccttggtgtactgattcccggtaagcggtaggaacgtcctttttaaactctaggcatcgggaggtattcggagattgcggataccttcgctgagttctttgtaatccatcgtgcagaactatttcagtggcttaaagatgcggtttggtagcgtcgctgacatgatcaatgagaagtggtcgcagggcgctctccgggaagcgctgctaagtggtaccgtgcatgcaattaggacgctgatgtgctttaatagcgtggtagtgaagtccaccatcaaagcaaatgcgctctccttttttctccttactcaaagctccgggagacaattggtgatttaagagcttcttggggctcctttgatgcattatattacagcctttttgcctctgaaaagtatcctttaggttcccaccgtggcatttctagcgatggtttaaaata

SEQ ID NO: 109028 - DNA, 29 bp, Homo sapiens
  chr13:88997906-88997935
  Hypo
cccagcgcatcctccgctgctgctggcct

SEQ ID NO: 109029 - DNA, 32 bp, Homo sapiens; identical to SEQ ID NO: 76169
  chr13:89253759-89253791
  Hypo

SEQ ID NO: 109030 - DNA, 27 bp, Homo sapiens
  chr13:90047527-90047554
  Hypo
ccacaacaggccaggcgcggtggctca

SEQ ID NO: 109031 - DNA, 101 bp, Homo sapiens; identical to SEQ ID NO: 76171
  chr13:90685501-90685602
  Hypo

SEQ ID NO: 109032 - DNA, 30 bp, Homo sapiens; identical to SEQ ID NO: 43817
  chr13:91948489-91948519
  Hypo

SEQ ID NO: 109033 - DNA, 87 bp, Homo sapiens; identical to SEQ ID NO: 76173
  chr13:92050679-92050766
  Hyper

SEQ ID NO: 109034 - DNA, 679 bp, Homo sapiens
  chr13:92050975-92051654
  Hyper
cagtggtggccagagcggatgcttgcgggctccctgcggctccactagttttcttcgccccgcccagccgcccactcttctcggctagggaagaagaccagagggtgctcagctggaaaactctggtgtctcagcttagggcctcctccgggaagagctaactgctcccaggtgaagccggtgcccgcgggcggtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcgagggcgtgcagacctgcgaagaagttcggaaacttttccagtggcggctgctgggagctgtcagggggctgccggattcgccgcgggcaggtaaggggcaatgagggggtctctggactggcggcgtccgagcccggccttcgctcccccaggctcccttggtggcactcgtgggaagatgacctttcgggccctgcagccgcgcagggtgaatcccggggaggcttccggggatgcttggtgcgggtagcctgagtgcagcgcagcgcagctctggggac

SEQ ID NO: 109035 - DNA, 30 bp, Homo sapiens; identical to SEQ ID NO: 76176
  chr13:92345893-92345923
  Hypo

SEQ ID NO: 109036 - DNA, 30 bp, Homo sapiens; identical to SEQ ID NO: 76177
  chr13:92857981-92858011
  Hypo

SEQ ID NO: 109037 - DNA, 1916 bp, Homo sapiens
  chr13:93879208-93881124
  Hyper
catccccaagaacctcgagctcacaccaacagacacacgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggtaagcgcgggcgcgctgcaggggcaggctgcagccctcggctgccgcacgtcccactggccgcccggcgtccccttccttccccctgttgctgagttggtgctcactttctgccaccgctatgggactccgcgtctccgtgttgggcggcggatgctcctgcggcttcttcggcgggggaaggtgtgcgtctccgccgcctcattgtgtgcacacgcgggagcaccctggctcccgcctcccgctgctctcgcgcccttctaccccttagttgatggctcaggcccggctggccagggagcccgggtcactccggggcggctgcaaggcgcagacggagagccgagccgggcgctcactccgcgttctggttcgggcaaacttggaagaactgcgaccgcagtttgcccagcgccacagtctgagtggcgccttctccactcccgcccttgcgccggcaggggcggtggagagacgcggagggctcccccagcccctctctcccctatccgtccttcgggcgacagagcgcccggcgctcgggccgggggcgggcaaggctgggagggaccctcgccggggacctggcctctggacgccggcgtttcaaggctggtttggggacttcacgggctgcctgtttcagatgtggggcgggctttcccgttagggttcctcagtgcttccccagttgctgttggccactcagggcccggggacaccctgccacccggtctggagccggcctcgtctgccagcgaacagccaactttagcgggtggctcagctggggattcgggtccgggttcgggggccccgtgtcccccgcatgcccggccactggcattgctccaccaagagcttgagagcgcccaccctttctctcggcgccagtgtgtgtagcacttggtctccgacaacttgcgcggcagtctgggtgcttgttttccggctcttagctccaaccgaatccgagcttctctggggctctgtgaatgaaacgtgtcggggagagataatcctttggctgctaaagaacagaactgagagaggccgagggaggccaggagatgctgcgagggcgcgggctgctcaaaccgggcagctgaagtccttagtgacctcagatcgtcaagtcaaaacgctgaatttccaccagcctctgtctgctttttgccaaataactggtggatggatgaaaagcattttgcagatatcttagaacatcacagtttcgatacgttgaggaattact

SEQ ID NO: 109038 - DNA, 79 bp, Homo sapiens; identical to SEQ ID NO: 76184
  chr13:95201260-95201339
  Hyper

SEQ ID NO: 109039 - DNA, 36 bp, Homo sapiens; identical to SEQ ID NO: 76185
  chr13:95201626-95201662
  Hyper

SEQ ID NO: 109040 - DNA, 21 bp, Homo sapiens
  chr13:95201891-95201912
  Hyper
tttaaaagtagctgccgaaac

SEQ ID NO: 109041 - DNA, 20 bp, Homo sapiens
  chr13:95201972-95201992
  Hyper
cggcacgttctgggttgtct

SEQ ID NO: 109042 - DNA, 30 bp, Homo sapiens; identical to SEQ ID NO: 76187
  chr13:95202314-95202344
  Hyper

SEQ ID NO: 109043 - DNA, 81 bp, Homo sapiens; identical to SEQ ID NO: 76188
  chr13:95354293-95354374
  Hyper

SEQ ID NO: 109044 - DNA, 56 bp, Homo sapiens; identical to SEQ ID NO: 76189
  chr13:95355963-95356019
  Hyper

SEQ ID NO: 109045 - DNA, 1528 bp, Homo sapiens; identical to SEQ ID NO: 76190
  chr13:95357026-95358554
  Hyper

SEQ ID NO: 109046 - DNA, 787 bp, Homo sapiens; identical to SEQ ID NO: 76191
  chr13:95359626-95360413
  Hyper

SEQ ID NO: 109047 - DNA, 30 bp, Homo sapiens; identical to SEQ ID NO: 76192
  chr13:95360897-95360927
  Hyper

SEQ ID NO: 109048 - DNA, 2968 bp, Homo sapiens
  chr13:95362808-95365776
  Hyper
acaaaaggccagattcgagccggtcactggtcaagaatggatctggttgggagttctgcttgagagaacagagatctgcaaagttcaaatagtacaaacagggaggcgaggctgctcagagccatcccactcccagaaacgaatgacacaagcagcttttcccgtgtgccagccatttcagacctcacatttgaacagcgtgcatgcaacacggaccgggagggggttgggggttggggggctgaggggcgaggaagaagaatgagaaacaaaaacaaaaccgaccatgaaacttccaacaaaactggaaaggccaacatgtcaaaaagttactcctccacctccgtgggtcaaaacgcaacaggttccgaagtgcaaagcaaacgccaactgctgccgcacacaaccgcctgctttcgagttggctgccgaagtgcgggtctgaaatgatcctgcgaattcacaggcctgctcgcccgcgcccttgcgcgcttggccactcctgccccgcctggcctctctgcctctacctggcacctatacattctatgtacatacaaaccgggcccccggtcgcgggagggcgcacggggaggccgcagcgctcgtacctatacatatgtacacgtgtgcacaccggtcctcgcgaggcggccccgcggggtcatagcgcggcagcgtaggccgcggggtaggggtccagctggggcttgcccatgcccggcagcaggatgtaggcgagcggcggctgcagcccggggctgggccacgcgctgcagttgcacgggatcatgtagcccgggttgcccgggctggggtgcgagtgcgtgtgccccccggcggcggcggccgccgctgcagccgccgccgccgcgccgtggaaggcgcccgcgcccgcggtcgggtagcccagcgacgacgcgtacgggaggccggacgaggacgacgagatctctgccattttggagcccaggtcgagcagcgagtaggggctgcccgcggcggcggcggcggcggcagcggcggcggcagcggccgactgcgggaagaagacgcgtgcggcggcagcggcggcggccgcggccgccttctcgggattggcgagcagcgactcaggcaccaggccgccgcccgcccccgcgtgcagcccggcgcccgccttgagcgcagggtgctcggcgtccgccacgccgcccaggccgtagggcaccgggaaggcgaacttgtccttcttgagcagcgtcttgggcttgcgccgcggccggtacttgtagtcggggtgctccttcatgtgcatggcgcgtagacgcttggcctcgtcgatgaacggccgcttctccgactctgtgagcagtttccactcggcgcccaagcgcttgctgatctccgagttgtgcatcttggggttctcctgggccatcttgcgccgctgagcccgcgaccacaccatgaaggcgttcatgggccgcttgacgtggtccaccggcttggacatgctctcgccctgccgcggctgcagcccgccgcctcccgggccctcgccctcggcccggaggaaatcaatgttggctgcccgcggagacccgctcggccggccggggctcgtcgcgccccggcgtcgctcccgccccggaggagggggctgggggaccagcccagggccacgccgcgccccgggccgccttagtgtctccggccgagcgctcgagcaggttgtctctgggacactctaacttctcggcggtgccccctccccgcggcggcagtttgccctttacgttctttgggtccttcgtctgcagtggcgtttgctggtgagctccccgcaggtagcggcggccgggcagagcgctcctcctcctcggtcgttctctcttaaatgcaaagcgtccccaaaagttgcgtcgcggagactcctcgaagttgagccgaggagcccgccgccgcgtgctgccaagtgccaaagggggctctcagcggctggagtgtttgggttctcctcggtgactttctcatttgacagaagcagatgggggtggggaaggcggggaggtggccctggaggaggaagaggagggggaggcggaggagtgtccaggcgtgccacgagaacgcagagcgcagcaatggatataaatacaaatacagcagcaccagcctgtcttcttggctccgggcagggtgcgccgatgggaaacccccaatcggctgggtgattttttttttttggaggggggagctgtcccccgcagcacctgcctctcgagtcttcctctcccgctgctggactgacgggtggggcgaggaaggagggtggatgaggcttgagcaagcgttggtcgcccggcctcagaggaagttctcccggctcgccgaggagccgcgtccggccgtcccctgggccatgccggctctgttcgctccgagccccttcaggcgcgcctgccgacttagggctcccggagctcgccggccgcggagggcagcgcagcctccacgcggcgccgcaggcctggcaccggccgcgtccccgcctcgctcttctcggcagccgcctggcacttgcaactaacttcgcccaagtttcctgcgccgcggcgcccctctcggcgcgctcctgggagcgtgcgcccgcgagtccgccgcgcccggggcccctctgtcctcgctgctgtggccagagccgagccggcgcaggggcggaggtgctgcaggagagttaaggaaaacgggccatcacctcagttcgcaggtccgcgctgtggcacctcccgctctccccactcccgcggcgcagggggccccttcccagcccaggccgccctctgcaccggctcaggtgagtgtggctacctgcatgtgtgcgcgcccggagccggcactgggtgtgcatgtccagccgcggctgtgtgtgtatatctgggggcctgcggaggaggtggagcccaggactcggggagggaggagg

SEQ ID NO: 109049 - DNA, 30 bp, Homo sapiens; identical to SEQ ID NO: 76199
  chr13:95451825-95451855
  Hypo

SEQ ID NO: 109050 - DNA, 23 bp, Homo sapiens
  chr13:95476305-95476328
  Hypo
ttaaaaattcttggccgggcacg

SEQ ID NO: 109051 - DNA, 1313 bp, Homo sapiens
  chr13:95619761-95621074
  Hyper
cttactgcagtgcagcgtttatgacacttgaaaacagattggagagtgggttttgctcgggcgacttgattgtctttcaagttggcgttaagagttttcaacaggtctccttccctgccagccgggaccccgggggtccctcggagcagggcgggtgggaccgctcggcctccttctctcgcccgcacgggcgccgccgcagacccggagcaggcacccggcggccgccgcgtgggctgcagcttagcctcctctgcgggcgcccggcagggctgcgcggccgagactcggggcgccggcgccggggcggccgggagctctgtcatttggcaactccctgcagactgatgacacggcgctttccatggtcgagccccacaaagtgtagggctgcggggcgcacctggctgggctcctaattacccggcctgggacgcacggggcagccgcggagggtggcgcctggggtcgggccggggtccccttcgccgcagtcccgcccacccgcagcctccgaggggtcccggccagggcgttctccacacgctcggctacctgcaggggttcgccactgcaagccgggccagtagaagtttgggggcgaaggcagagagcatttccttctcggcttttggcgcctccacgctgcacagaggcaggggcgactctgcaggccccgtttcccccatcctcccctccaccccagttccccgcaggacgtaggcgccgtccctagctcccccttctgtcctcgccctaacaccgcagggcctctcctggggatgtggggtcctgcgtgcttttgggggctacaaaaagtgggggccgtcgcagagcagagggaagctaggagcgggcaacgaattgaatcctggagacccgggaggagcgaggctgctgccgtccccggggaaagggcgacttcggcggggataccccgtgccaggccctgcaactcccgggccctcgggaatgggatgggggaggcgcggggtgcgcgcagctcccggtgatgttaaggcgtccgatggagacttgggttatttgcttcgcgtatcctcccctgttcctctgcaccgagctcctggctgccgctgcggccgctgtgtgcccgaggggcggctctgtaacccggctccaggcatttcttaggtttcccatccccgccctccaagctcccgggagcgcctgctccgctgcccgcagacaggcgtcgttcaaacctcagctctgctcggtctgcattcatggaccccagatcttcaccctaggatttccatctcagcatttcacgttcccggggaaaaagggag

SEQ ID NO: 109052 - DNA, 355 bp, Homo sapiens; identical to SEQ ID NO: 76204
  chr13:95655055-95655410
  Hyper

SEQ ID NO: 109053 - DNA, 135 bp, Homo sapiens; identical to SEQ ID NO: 76205
  chr13:95711256-95711391
  Hypo

SEQ ID NO: 109054 - DNA, 70 bp, Homo sapiens; identical to SEQ ID NO: 76206
  chr13:95718405-95718475
  Hypo

SEQ ID NO: 109055 - DNA, 30 bp, Homo sapiens; identical to SEQ ID NO: 76207
  chr13:95725531-95725561
  Hypo

SEQ ID NO: 109056 - DNA, 85 bp, Homo sapiens; identical to SEQ ID NO: 76208
  chr13:95775589-95775674
  Hypo

SEQ ID NO: 109057 - DNA, 30 bp, Homo sapiens; identical to SEQ ID NO: 76209
  chr13:95780731-95780761
  Hypo

SEQ ID NO: 109058 - DNA, 50 bp, Homo sapiens; identical to SEQ ID NO: 76210
  chr13:95843472-95843522
  Hypo

SEQ ID NO: 109059 - DNA, 73 bp, Homo sapiens; identical to SEQ ID NO: 76211
  chr13:95858839-95858912
  Hypo

SEQ ID NO: 109060 - DNA, 30 bp, Homo sapiens; identical to SEQ ID NO: 76212
  chr13:95870024-95870054
  Hypo

SEQ ID NO: 109061 - DNA, 105 bp, Homo sapiens; identical to SEQ ID NO: 76213
  chr13:95888741-95888846
  Hypo

SEQ ID NO: 109062 - DNA, 91 bp, Homo sapiens; identical to SEQ ID NO: 76214
  chr13:96031634-96031725
  Hypo

SEQ ID NO: 109063 - DNA, 30 bp, Homo sapiens; identical to SEQ ID NO: 35019
  chr13:96056313-96056343
  Hyper

SEQ ID NO: 109064 - DNA, 30 bp, Homo sapiens; identical to SEQ ID NO: 76216
  chr13:96135326-96135356
  Hypo

SEQ ID NO: 109065 - DNA, 525 bp, Homo sapiens
  chr13:96204838-96205363
  Hyper
atgggtgtgaggggtcgcgtgcgccccctggcgccgggtccgctgggcggggtggtgggcggggacggtgggcggaggcggaggcgggaggcggagccccggggttgggagtgcgggggtcgcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggtctgcatccccgcggcccccgccctcagccctccttccttgatggccagcccgctaggcgccctctcgcccccaatacccccagcgggacccctagactggactcctctgaggcccgacccgtctctcccaacag

SEQ ID NO: 109066 - DNA, 865 bp, Homo sapiens
  chr13:96296373-96297238
  Hyper
gcctcaagtcccaggcgcatggcaccgccgggcagccgaaccagcagacaaaagccgagagacgcgggttccaggggaacctcggcgcccttccttggaaggcaaacaggcagtgggggcagcggcggctactccagctggatctgcagaggctcggctcgcagcctggagaggcaggagggccggcttcgcgggtatcgggatgccccgtcagccacctcctgtgggcgcctggcgcatccccggtctcggctcaccccagctgcgcgctcctgggcgggtgccgggcgctgcaggcgggcgggggcgacacaggggacccagaccccagggtcgctgctgacgcgggccgggcccgcggaggccgaggagcagcaaagcggagagaggcaggccggctccttcttgcagggcgcaggatgaaacgtgtctggtctgggcaagttgtggcgaggcgggtcgactggcgccgctctagggccttccagactccggaccacggacgactcaggataccccacccccctcccgccccctcccctccgcgatctccctccggcctcttccctcggtgtcccggctcctctggcaactgggcgggaccgcgagcgtctagaccgcagcgctaaaatgcgctcagccaatccggcagctggcgcagacacgtggttcgggggcgcgctccgttgctggccctggatgctaaccctaggaaggcttttcaaagagaaaccagattcgctcctacccggttgttggtctggccctcagcaagctaatttcccagaggagcttcaggtgaattatcttccaaaaagagatgcgttttaatcgcagaagtctgcagatgcgaaggaccttgaaa

SEQ ID NO: 109067 - DNA, 66 bp, Homo sapiens; identical to SEQ ID NO: 43823
  chr13:96409578-96409644
  Hypo

SEQ ID NO: 109068 - DNA, 919 bp, Homo sapiens; identical to SEQ ID NO: 76222
  chr13:96742194-96743113
  Hyper

SEQ ID NO: 109069 - DNA, 769 bp, Homo sapiens
  chr13:96743347-96744116
  Hyper
ccccccgagggacctcggggggccgcggcgccggaggaggaggacgaggagcccggagacccccgggagggggaggaagaggaggaggaagacgagccggaccccgaggccccggaaaacggctccctgccccgattcgtgccgcgcttcaacttcagcctgaaggacctgacccgcttcgtggatttcaacatcaaagggcgcgacgtgatcgtgttcctccacatccagaagacggggggcaccactttcggccggcacctggtgaagaacatccggctggagcagccttgtagctgcaaagcgggtcagaagaagtgcacctgccaccggcctggcaagaaggagacgtggctcttctcccgcttctccaccggctggagctgcgggctgcacgccgactggacggagctcaccaactgcgtgccggccatcatggagaagaaggactgtccccgcaaccacagccacaccaggtactgtcgcccgctgggtctctgttcttcccccccaccccccatccctcttcctcagtcctgacccagagcgaccccgcgctccctgcccctgccgatggtttcctggcgtcttcagcggttggcgccgtggctttggggagggatgagaaacctccggatagtgcctaggtcctgaactcgttcttcccccagcccccaccgcttcccgccacccctctgccttcaccctctaagatgtgcggagccaccgtgtggatcctgcctgttgcctagcacggcctggcctccct

SEQ ID NO: 109070 - DNA, 30 bp, Homo sapiens; identical to SEQ ID NO: 76225
  chr13:96958800-96958830
  Hypo

SEQ ID NO: 109071 - DNA, 18 bp, Homo sapiens
  chr13:97599727-97599745
  Hypo
tctcgcctcactgcaacc

SEQ ID NO: 109072 - DNA, 16 bp, Homo sapiens
  chr13:98426774-98426790
  Hypo
tgcctgatctcagctc

SEQ ID NO: 109073 - DNA, 30 bp, Homo sapiens; identical to SEQ ID NO: 76228
  chr13:98702848-98702878
  Hypo

SEQ ID NO: 109074 - DNA, 30 bp, Homo sapiens; identical to SEQ ID NO: 76229
  chr13:98795810-98795840
  Hyper

SEQ ID NO: 109075 - DNA, 39 bp, Homo sapiens; identical to SEQ ID NO: 76230
  chr13:98866341-98866380
  Hypo

SEQ ID NO: 109076 - DNA, 48 bp, Homo sapiens; identical to SEQ ID NO: 76231
  chr13:98870050-98870098
  Hypo

SEQ ID NO: 109077 - DNA, 325 bp, Homo sapiens; identical to SEQ ID NO: 76232
  chr13:99083172-99083497
  Hypo

SEQ ID NO: 109078 - DNA, 30 bp, Homo sapiens; identical to SEQ ID NO: 76233
  chr13:99136257-99136287
  Hypo

SEQ ID NO: 109079 - DNA, 30 bp, Homo sapiens; identical to SEQ ID NO: 76234
  chr13:99176587-99176617
  Hypo

SEQ ID NO: 109080 - DNA, 187 bp, Homo sapiens; identical to SEQ ID NO: 76235
  chr13:99189615-99189802
  Hypo

SEQ ID NO: 109081 - DNA, 46 bp, Homo sapiens; identical to SEQ ID NO: 76236
  chr13:99328589-99328635
  Hypo

SEQ ID NO: 109082 - DNA, 407 bp, Homo sapiens
  chr13:99404616-99405023
  Hyper
cctcggcggagtcggcgcctctgggcacctctggcttccgcgccccggccgcacggtgaccacccgggaggggatcccgggcgccccgcaacctcccggcccccgtgggccttcgggtcgccccgcttcccgccgccgcgtacccttcgcgcctcccggccctcggtgccggcccccgccccgcgtagctccgagtctttagcccggccggccccccacccgccgagcgtacccatggcggcggctcccagggctcctgcgacctgccggcgggacgtgctcctggcaggtgctactcctccgacctgacgtccaggcccggccccgttgccccaggtacagccccagctctgcgaggcggggccgccggctccacccggggggcggtgctgcggggagcagaggtc

SEQ ID NO: 109083 - DNA, 213 bp, Homo sapiens; identical to SEQ ID NO: 76238
  chr13:99428504-99428717
  Hypo

SEQ ID NO: 109084 - DNA, 24 bp, Homo sapiens
  chr13:99851628-99851652
  Hypo
tggggagagcgagactccgtctca

SEQ ID NO: 109085 - DNA, 30 bp, Homo sapiens; identical to SEQ ID NO: 43831
  chr13:100095884-100095914
  Hypo

SEQ ID NO: 109086 - DNA, 37 bp, Homo sapiens; identical to SEQ ID NO: 43832
  chr13:100146505-100146542
  Hypo

SEQ ID NO: 109087 - DNA, 81 bp, Homo sapiens; identical to SEQ ID NO: 15770
  chr13:100356871-100356952
  Hypo

SEQ ID NO: 109088 - DNA, 30 bp, Homo sapiens; identical to SEQ ID NO: 75350
  chr13:100452188-100452218
  Hypo

SEQ ID NO: 109089 - DNA, 30 bp, Homo sapiens; identical to SEQ ID NO: 75351
  chr13:100523137-100523167
  Hypo

SEQ ID NO: 109090 - DNA, 41 bp, Homo sapiens
  chr13:100547868-100547909
  Hyper
cccgcgcttgggacccggcagctctgcgcgggctggttttg

SEQ ID NO: 109091 - DNA, 276 bp, Homo sapiens; identical to SEQ ID NO: 43834
  chr13:100575337-100575613
  Hypo

SEQ ID NO: 109092 - DNA, 30 bp, Homo sapiens; identical to SEQ ID NO: 43835
  chr13:100583792-100583822
  Hypo

SEQ ID NO: 109093 - DNA, 1162 bp, Homo sapiens
  chr13:100608107-100609269
  Hyper
acttccagcttggagcggaaatcggggccggggcaaggacgcaggggcgtgtcgcccacgtttctggcccggctagccgcaactccttggatgtaaacgagatttggccggcgctgcggcgtgtggggaaagatgattacactcgaaaggaatcacgactccttgcggagccattactcgtgccgctccgcacgcgcaggttctggcccggctttcagcaactccccgctcctcgctaaccactcgctcgtaatttgtgggccgcagtggagctgcgcccggggctgcagccccccaattaaagcacttttgcagctcggacacccagagagctgcctccgcgcacgccaggccggcacctcctgctcccactcccctctccgcccagccgtgggcagctgaaatggatgtgatttcacgcacttcctgcgcgcgcacacacacatgcacacatggacatacacttgcacacacgcacaacgcgcattccccctccaatgccgcccgcacacgtgcgcgagcctggacgttccccttttgtgctcgttttgcaggcccagagctcctgctgctggttttctcctttctctccttcatcgcctcttccttcgccactttccttctggaccctccgggctggctcctgcccctctgccccggtggcgctctcgcctattcctcccgggaggagccggggccgcagaggtgcgccctgcacgcccagcgagggccgagttctgggacggctgggaccaaagggctggcctccggcctgcgccctgtttgttttcctttcgccccctgaatactagattgagacgtaaagattacccgggccgaataatgccgggagtcaacactcgagcaaacaaaagtgcttgcacaactagtcaaccccgctgggacccgggccgcgggctgggggagagaacgcgctcctcgctgctaattacaaataaatgatgatgtgctcactaagtaattgatttaatgaagttcctatgaaactattaaacccgggtggaggtcaggctggaggcgccccagagcgcccattgtgggctgtttaactccaccaggctcctcggaaagacatcggggctaataggtgaagtcacagctgctcgcgctgacttctcggagcgcccggctggccgcgggc

SEQ ID NO: 109094 - DNA, 109 bp, Homo sapiens; identical to SEQ ID NO: 75357
  chr13:100609476-100609585
  Hyper

SEQ ID NO: 109095 - DNA, 350 bp, Homo sapiens; identical to SEQ ID NO: 75358
  chr13:100611882-100612232
  Hyper

SEQ ID NO: 109096 - DNA, 30 bp, Homo sapiens; identical to SEQ ID NO: 75359
  chr13:100620344-100620374
  Hyper

SEQ ID NO: 109097 - DNA, 276 bp, Homo sapiens; identical to SEQ ID NO: 75360
  chr13:100620640-100620916
  Hyper

SEQ ID NO: 109098 - DNA, 231 bp, Homo sapiens; identical to SEQ ID NO: 75361
  chr13:100621135-100621366
  Hyper

SEQ ID NO: 109099 - DNA, 299 bp, Homo sapiens; identical to SEQ ID NO: 75362
  chr13:100621716-100622015
  Hyper

SEQ ID NO: 109100 - DNA, 959 bp, Homo sapiens; identical to SEQ ID NO: 75363
  chr13:100622222-100623181
  Hyper

SEQ ID NO: 109101 - DNA, 773 bp, Homo sapiens
  chr13:100623899-100624672
  Hyper
tttattccctctgcccgccttcaaaaacatgtatgtattgggcgctctttaacttcttttgtcctggcctcttaactctgcttattcctgttcccactctatcctccagcgattggcagagtgaacaccacatttgagctgcacagtgggaccgagattttggaaatggcacgggtgggattggagggagccgcgtgattggcagtagcctcggctgctcgattggctcccgttcaggccctcgacccagcggggattcgcccccgtgcttgcggccgcctgcgctttcgcttcgcgccccctcctccgctggagccacacgtccccgcctccccggggatgcccaagttgcacttgcagaaagtttgagcctggcctgcgcgcgcagcgccccgctcttccttgacgcacctcgcggagcgcgcgccggcacgcgggcagagggcgcggggtggtgaggggctgaggacccccgaggggcagtcccagtttcaaaaaccttggcctcacttctctgtgtgccttctggcacccaagtactttctgcctctacctccacctctcttgtggggtggaagagccctgggctgctgtttgggagagaagggtgaatagcccgtcctacctgtagtggtgatgctagaaacttcttgtttggacacccaacctgcctagcgctcacctagggcgcatagacagtagacggagtgaagaagataaagtctattggttgcaagacaacttgagtgatttggctccgcgaaacaccaggt

SEQ ID NO: 109102 - DNA, 66 bp, Homo sapiens
  chr13:100624887-100624953
  Hyper
gcggggcaggccaaacggcatctctgcagagagaagccgctaaataagcaccgtcctttaagtaga

SEQ ID NO: 109103 - DNA, 154 bp, Homo sapiens; identical to SEQ ID NO: 75367
  chr13:100626366-100626520
  Hyper

SEQ ID NO: 109104 - DNA, 30 bp, Homo sapiens
  chr13:100626979-100627009
  Hyper
gggggctgtggaaggcgttatgccaattct

SEQ ID NO: 109105 - DNA, 106 bp, Homo sapiens
  chr13:100627295-100627401
  Hyper
gttggctgagttaaccgcgctcagctgcctggaggccacgggacccgatctctggggatgctcgagctggcgcttgcggcttcccgctgcgcgtagtgggggactg

SEQ ID NO: 109106 - DNA, 511 bp, Homo sapiens; identical to SEQ ID NO: 75368
  chr13:100630630-100631141
  Hyper

SEQ ID NO: 109107 - DNA, 32 bp, Homo sapiens; identical to SEQ ID NO: 75369
  chr13:100631610-100631642
  Hyper

SEQ ID NO: 109108 - DNA, 54 bp, Homo sapiens; identical to SEQ ID NO: 35044
  chr13:100631883-100631937
  Hyper

SEQ ID NO: 109109 - DNA, 85 bp, Homo sapiens; identical to SEQ ID NO: 75371
  chr13:100632429-100632514
  Hyper

SEQ ID NO: 109110 - DNA, 42 bp, Homo sapiens; identical to SEQ ID NO: 75372
  chr13:100633842-100633884
  Hyper

SEQ ID NO: 109111 - DNA, 30 bp, Homo sapiens; identical to SEQ ID NO: 75373
  chr13:100634277-100634307
  Hyper

SEQ ID NO: 109112 - DNA, 595 bp, Homo sapiens
  chr13:100634944-100635539
  Hyper
actccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggtaaccgcgggctgggacagggaccaggcgcggaggggagacacgcacaggctgagactcaggctgtgggtgccgacgctgggcgcagaccgccagccggggacctgggatgggaggtgtttttgcgtgtacgaaagagccagcag

SEQ ID NO: 109113 - DNA, 506 bp, Homo sapiens
  chr13:100635935-100636441
  Hyper
cgtctcggggtgggtcgcgggggctttactgtggtttcgcagcagtttgtgaaattctctaatgggcaccacagagtttgcgattcccaacttggacccaggtcagctagagccccaggtcagctagagccccaggcagcgcggccccgcggggggatcgcgtgagaagagagagccgcaaaagaacgcgcctcccgcctcatagattattcatctatgaccaggtctcagccaaaatcgtgccagacgatttcctaaaagaaagccaaatgttttagcaacttcccccgtcaatatttactccgaagtggggatgcgccagcggcctattgttctcttccgggaagggagggagccgaggtgcgagacaagcttttaacaaggtttaaaatttgagaaatttatttgcatgaaatgctcgctttcgagtcctgtgtctgagcggatgtctttaagaaacaatttaggtgctaatggaatttaacgttaaacggtcccctttccaa

SEQ ID NO: 109114 - DNA, 1159 bp, Homo sapiens; identical to SEQ ID NO: 75378
  chr13:100636859-100638018
  Hyper

SEQ ID NO: 109115 - DNA, 194 bp, Homo sapiens; identical to SEQ ID NO: 75379
  chr13:100640276-100640470
  Hyper

SEQ ID NO: 109116 - DNA, 1296 bp, Homo sapiens
  chr13:100640905-100642201
  Hyper
ggagcgggcgggagccgcttttcctcgaaagggctcccagtccctggtccctcgcttcccaaggctttgtccaaacaagtcacggacccgacaaggtggtccattctctctctttggcctttcttttctgcccttcgaatccgaaggactggatggaggggaggggatatggcaatagtgtagaagtgtcaagatgtgaaaattgctcaactgagaacgcacgcgggggctcgcggcccaacagcctgcaccacactcaggagcctgggcctgggcctgggggtggggtgggggggacaggcgtcccccccaccccaaccccacccctatccctgcccggctgtctaaacggacctaaatgctaacctgctgttgccttgactccagagacacgaaactgaagctagccctcgcccctctctgggatcccgcgctgcgctgcgggtagctgcccgcagggaggcccaacctgccgcggctggagcacggtttctgctagccgccgccgtcaacttgaacttcagtgagcctaggccggcttccttcgcgctcacctccatccaccacctaagaagtcccctcagcgcgagcgtcgctttatccggaggcagctggagccccctcgggaggcccgtcattattattattaattatcgtgatccttactgcattattaatgcccaggatgataaccggcatcggtatcagctttccctggttcagtgatatcccacgaagttcggggcggggaggaagtcactccaggatcagaggccgcgtcggttctgcttggggcatgggcagagggaggctgctggggccaagccccggctggacgcgagggaagaaactcgtcccaggacccgcacgcccatacctggctgtcccagagctcttccctaggccggcaccttcgctcttcctcttccccaccccctagcccttttgtctctttttcagacggatgttttcagtctcaagtggttttattttccgcacaaaaccctgagatcaagggcagatcacagactgtaccggaggctcgggtttccctggactctgtgctgttctgcgtcccagggttggctaggaaggaaggcctgggccggcgaggtgacgggtctcccgcccaggtcggcaggacggggggaggtgtgtcccggtaggtccctggtgagctcacccgtggcatcggggacccgcgggaacccaccgggcgcccactagagactcgggtcctaccctcccccacactactccaccgaaatgatcggaagggcgcgctaggcctgcttc

SEQ ID NO: 109117 - DNA, 204 bp, Homo sapiens
  chr13:100642886-100643090
  Hyper
gtgctggggccacctcgtcgccctcccacgtttctcttttgttcccaggagccgacgagcttttgaagaggtgacacctcgcttcgccttctcctgctctaggccctgccctcgtccagcatccctcctgccccacgaagcgagaggatgctcagcgcagctgccaggcagagagtgtgtggggaggtcccttgcctttgcgcg

SEQ ID NO: 109118 - DNA, 383 bp, Homo sapiens
  chr13:100643150-100643533
  Hyper
tatgctcacacaccctcacctccttcagcttccgcacctcccagccacaggctcgcgtgagtgggaaggacctgaggccgcagaaatgtgggttagcgtgggcagcaggagatgctccccgcacccctcctcccattcctacctcccccagccctttctagcgcctcttggaggggaccgggcctgccctgcgctctcaacctaattcggcctcggagggtcctcccccacccagggcggcactccccaggccggcactcgcgccactggcgtgggactaaggctccctgcagttgggtctcccaagcccacttccaggggctgagagaggccaggctgccttgcctgcccgcgcgccctccagccctcgggtgtagggaggg

SEQ ID NO: 109119 - DNA, 516 bp, Homo sapiens
  chr13:100643736-100644252
  Hyper
gtcagagataatcatcgcagttaacgctcagcgactgggctgctccgcggaggccggcggaggcctacagaggctcctgactggcagaactggaggtgtgggtgtggttcccttttcaccccggctcttatgttgccagtctcccccctaccaccaggcaaagcccccctaaacttagggtctggaacaaggccgagccagcgagggcctgccaggagctgcgctggagcctctcgctgcatccagagctggttcttgttcttttctctctcttggcccactgggcccacagtggttaggtggccgagtgtggtttcccgaaactctttggagtcgcctgggtctgcgtgcccctggccccgtcctcacccccgggctcgtcccccagcctccgccggcccgcctgtgaatggtggatttaatgagcgtttgtgtggcgttggccggcggttctgaagatgcgctgacctggagggagggcgcgaaaggtcaggcgcatgccgggcccaacttggg

SEQ ID NO: 109120 - DNA, 405 bp, Homo sapiens; identical to SEQ ID NO: 75384
  chr13:100647898-100648303
  Hyper

SEQ ID NO: 109121 - DNA, 686 bp, Homo sapiens
  chr13:100649333-100650019
  Hyper
ccctgggcgcagggctgtgtgtgcgaggacaattattttcatcagctgcttgctagcccgcgcccgactgctcctctttgcagaaccgacgggctttcaactctggaagtgaagcaggacgaattcctccatggagactccctccttgggaacgtcgaactctctctgccttggggagtggggctcgataaagggtacctaggtcgcaccctggcaggggagcactagagggccgcgaggtcccgggtttcgccatcctgagacccccgcgcggatggcccaggaggggcgcggcggccctgagtcaaggtgggcgggggcaggtgcttccctccaccgcgttgtcctatgccggcgcggtccccaccgcccgacctagcccggcgccggccgagcacggcggccgcgcttcgcactccttcctcccaccgggtccgcaggcccggcttcacgattcccgggccctcgggcatgtgagggacttgagtgaatgcagctccctcaactcactcccgcaaaaccacagccaagagggccttaagtcagagaacccggcctaggagcctcccctagagcctcggcgcgggccccttccccttccccacatcggtcggccgagggagcctagagccggtgggagacgggcagcggcctctcctgatcctttcctgcggtcatacaagttc

SEQ ID NO: 109122 - DNA, 30 bp, Homo sapiens; identical to SEQ ID NO: 75388
  chr13:101298018-101298048
  Hypo

SEQ ID NO: 109123 - DNA, 31 bp, Homo sapiens; identical to SEQ ID NO: 75389
  chr13:101532259-101532290
  Hypo

SEQ ID NO: 109124 - DNA, 30 bp, Homo sapiens; identical to SEQ ID NO: 75390
  chr13:101714425-101714455
  Hypo

SEQ ID NO: 109125 - DNA, 30 bp, Homo sapiens; identical to SEQ ID NO: 75391
  chr13:101787561-101787591
  Hypo

SEQ ID NO: 109126 - DNA, 1017 bp, Homo sapiens
  chr13:102068158-102069175
  Hyper
ccccacctccccacccgcgcgttggcccagaggtttacccaggcagcggccctggtgccgagggggcaggtgcagcgctgtagtgatgcccagtggcctcgtcctcagccacctgccccccaacacctgctagatgcccaggcggggcaggcccgaggtgtcgccggccctgggcttcccaagccagcccaggggcatcccgcggcaggcgcccccgacacccacgcgcaggaatagggagggcgcatcgcggctcccgcgccccggccaggccggcaaggaccccaccgccccgctctcgggtggaggcgcccctccccacccctcccccgcgcggggcccccgcccgcagcccctctagcagcccctctcgcagccccagcgcccctgagccgtcctggcccggaccggccaaggaactaacgagcgcgcatcgcgggcctcgggcgcagggcacggagccggccgcgccgcagcctcccgggcaccggcggcggtgaccaacctgtaaccccagcgctcagagctgtcatggtgcccgcgggcggcggcggcggcgacagtgggcgaccggcaggatcagtgccaggcgcggcgcccagggcgggcggggacgcgggcccctcacctacggcggctcagctcaggcagcgcgctcggcccggctggggccgcggctcacgctcgccgtgtcactcactgagcgccgccgccgccgggcaggctgggggaggggtgggagccggagttttcgggcctttaaaaaattattattttatttaaatttttaaagttagctttgctacagggactgcagtgatgccgaagggcgggcaccgcagaggaggctgcgccgcagttggtggggagcgccagggtcggtactggcagttccttcttgccggctgccacccgcagtcagtctcacagcaacagctaggctctcatctgcgagctcctctcgggggtctttcgtactcaacagcacggcggcggtgtgcacgggagtccgccggg

SEQ ID NO: 109127 - DNA, 30 bp, Homo sapiens; identical to SEQ ID NO: 43836
  chr13:102206088-102206118
  Hypo

SEQ ID NO: 109128 - DNA, 30 bp, Homo sapiens; identical to SEQ ID NO: 43837
  chr13:102385630-102385660
  Hypo

SEQ ID NO: 109129 - DNA, 1585 bp, Homo sapiens
  chr13:102568410-102569995
  Hyper
gctcagatcagactgcgagcggtggctcgaccccgggtgtggcaggaaggggtgccccgcgttccagagccagtgccagtccctatcctcccgggaagccgagactcagggggaacaggtttcccagagcccagcctgcagggacgcggagggcaggagccgccggcgaggagcagccaacttgccatctctggcggctgcacttctcggcggctacaggttgcccgacagcggactccagggtccccgcgacggcacccagagtgctcagaagggaggccggggccggggtgggccgggaaaaccgagggagggaaggagcctggagaagctccgtttaggcggggagggggcgacccggggcgcatctcccgaccatgacccccacagaccttggcgccgcaacctgcgcttcttgaggccgaagatgcgcactttggagaagatatccaccaggttgccgttgcagagcccgcggttcttgctggggctgctccgcctcctgctggcagacggccggtcccagtgctgctcccgcgcctgccgcttctggcggatcaagccgctagcgatggccgcggccatggtggccccgggaacgggtccggggagggagggcgcgggaggacggcgagccgggggcaccggaggggaaggcggcggcgcagaccgtggctcgccctcggggcagaggagggggtgccaggcgggactggggagaggggaaggggggctcagtcctgaccgggacccatcgccctctccgcggggcgcggggccaggcgcgcagatgcgcccagggcgcagccggacgatcccgggaagccggacgtcgtggccgccgccgcttggccacgtccgagtggagagcgggaccgcggctgcgggcgctgctggtcaccgctcgtcgcaggaaccccggcgggggtcgccaccgccactcgcgctgccttctcgccctgcccggctcccgggcgggaggtagagccggccggcggctccccgggcgccggctggagggcgggtcccggcagggtctctgcgcgtccgtcggtccgggtcgcgctgggcaggactcagcgccgggctccagctgcccgcgggccggtgccgccgccggcgccgcccgctctcggcttctgccggtgattgtcaagtgctttggaaatcagcatctggagagaccaatcttctcccctgagatctctaatcaaacgctccgttcccaccccactacaccccctccacctatgtggtccccctcctgatgtacctcttcagaaagaaacaaaacgtataggtaataatgatttaaaaataataagaaagaaagctaagatggattgcagggatggggtgctaagaggccgagccaaagcaggtggaattgaaggaacatcggggcgctttttcttagatgcaactcgctggttcccgagccttccgcggcttggttggggcttctcggtcttaacgtggttaccggtgcactgaaactctcagcagcggttggagggcgaggtggtttccgccctccctgctaatccctccagcaccaacgcccccccgtcgccacccccaaccc

SEQ ID NO: 109130 - DNA, 46 bp, Homo sapiens; identical to SEQ ID NO: 75401
  chr13:102571921-102571967
  Hyper

SEQ ID NO: 109131 - DNA, 46 bp, Homo sapiens; identical to SEQ ID NO: 75402
  chr13:102572229-102572275
  Hyper

SEQ ID NO: 109132 - DNA, 663 bp, Homo sapiens
  chr13:103046665-103047328
  Hyper
cacatggggtgcccccgcgtcaacgccggaggagtgaccttgcaaacccgcgccccgcgggcggcagagccggccgctcactgcccggtccccggccaccacggaagagcgaagatctctgccagggcaggagccctagccccgacccgcgccccaagtctctcccgcgcggcggcttccggccgccatggtttccatagcaacaacagcacaagctgccgggtcccagagacgccctagggtcagaggtcatctccgtggcaacggaaacttcccgcgctacggcggctccaacgggccgcttccgccgcattgcgtagcgaagcccccggcgagccgaggctgggagcgcggtgatggccggtccccgtgagcagagggcagcggcggcgggaccggggactctgggccaatgggtaaagccaggaggaagcccgtgcctggcccgttgggctccctcctcctcagagccgaagcagtccacactcggaacccagcttcacccggattaccgaggggttccacgcctggaggcagagctgcagcgtgggcccgctcgcggctttgcagaaaacaaataatgacacacttctctggaagcccggggcctgggcccagagccgtggcttctgccaaactttctggtcccggacaccaactccc

SEQ ID NO: 109133 - DNA, 1329 bp, Homo sapiens
  chr13:103052094-103053423
  Hyper
aggagggtaaaaggacggaggaggaggaaacagatggggtgaatagaaacggtgtaagaactagaacacagggaggaggactcagggcagagcccagagcccactgcagcaccgagtccacggagcagccagaggctactaccagagcctcaattgccaccccaaagtaccagctgggggcaatcttctccgccccagcataggagcctctgcccttttagactgtctaacaactcgcagtttctcctttgctgcaggaatggtggccgcaaacggtctcagcctccgcacccaccgcctccgtccccgcccacccgcacctcctcctcctctgcctcgcgctgcacccgcaggcggcagacccctcggagcgcgccaccccagctacgttgcattggcaaggttcggaggctggagggcagcagccacttgctgccccagtcgctggggctctgggtgccagtgcggcccccggcagagcccagggcgtcagggaggccgtggagagccatgatctactgcaccgcagtgccagcgtcaggagcttccagagcccgggctgccactgcgggacggccgatctgcccgctccctccttcagacacaaccccagacaaaaacagccggccccgggtccctctccaccctgaacggagctaggggacgccacacactcccggctgccagcgtgagcggttccgggaaaggctgcgcccagcctcctcgccagcgccgccgccaccaccatgcagccctccagcctgcctcccctgggttgctcgcccacagctccgcggccgcccccaatcgcctcggactgagacgcggggacgggaacccctgggatccgactccccaaatcagatgcatttgcatttcttatgtaatgtactgcaagttcccttgttggagccctttggaatcggggcgcatgatcaccagtaggcttaaaagcaggaactcacggcctggctcatccccacccctggccctgtgggaccccgacgcagggctttgacaccgctttctaaagggggggacttcaattacaaatattagaggggctgggcttgtcctctcagtctggggttccctcccggcgcaagccttgctcaagtattcccggtggcaggatgtgtcagaggcagacagggggaatgagttaatgctcgggcacccggagctggacgggggagggacgcgggggctgacggaggagcggggccgcgagggagggggcctcttttactttggtaaaggtgatcgtggtggcgaatattgtgcaagctaatcagaaagtctagagcaggttctcggaacccagctacg

SEQ ID NO: 109134 - DNA, 189 bp, Homo sapiens; identical to SEQ ID NO: 75408
  chr13:103054542-103054731
  Hyper

SEQ ID NO: 109135 - DNA, 133 bp, Homo sapiens; identical to SEQ ID NO: 75409
  chr13:103157771-103157904
  Hypo

SEQ ID NO: 109136 - DNA, 30 bp, Homo sapiens; identical to SEQ ID NO: 75410
  chr13:103451013-103451043
  Hyper

SEQ ID NO: 109137 - DNA, 27 bp, Homo sapiens
  chr13:103569166-103569193
  Hypo
ccggccgtcccccgttaatcttactcc

SEQ ID NO: 109138 - DNA, 30 bp, Homo sapiens; identical to SEQ ID NO: 75412
  chr13:103598335-103598365
  Hypo

SEQ ID NO: 109139 - DNA, 163 bp, Homo sapiens; identical to SEQ ID NO: 75413
  chr13:103724063-103724226
  Hypo

SEQ ID NO: 109140 - DNA, 23 bp, Homo sapiens
  chr13:103931640-103931663
  Hypo
tatagaaaacctggccgggcgcg

SEQ ID NO: 109141 - DNA, 21 bp, Homo sapiens
  chr13:104514710-104514731
  Hypo
cccggccgagaattttatgta

SEQ ID NO: 109142 - DNA, 30 bp, Homo sapiens; identical to SEQ ID NO: 75416
  chr13:104659524-104659554
  Hypo

SEQ ID NO: 109143 - DNA, 19 bp, Homo sapiens
  chr13:105886013-105886032
  Hypo
ttttttcttttgagacgga

SEQ ID NO: 109144 - DNA, 18 bp, Homo sapiens
  chr13:106549803-106549821
  Hypo
actcggcccattatcaat

SEQ ID NO: 109145 - DNA, 39 bp, Homo sapiens; identical to SEQ ID NO: 75419
  chr13:107001648-107001687
  Hyper

SEQ ID NO: 109146 - DNA, 496 bp, Homo sapiens; identical to SEQ ID NO: 75420
  chr13:107186664-107187160
  Hyper

SEQ ID NO: 109147 - DNA, 70 bp, Homo sapiens; identical to SEQ ID NO: 75421
  chr13:107188738-107188808
  Hyper

SEQ ID NO: 109148 - DNA, 30 bp, Homo sapiens; identical to SEQ ID NO: 75422
  chr13:107189087-107189117
  Hyper

SEQ ID NO: 109149 - DNA, 30 bp, Homo sapiens; identical to SEQ ID NO: 75423
  chr13:107323934-107323964
  Hypo

SEQ ID NO: 109150 - DNA, 37 bp, Homo sapiens; identical to SEQ ID NO: 75424
  chr13:107552994-107553031
  Hypo

SEQ ID NO: 109151 - DNA, 245 bp, Homo sapiens; identical to SEQ ID NO: 75425
  chr13:107570101-107570346
  Hyper

SEQ ID NO: 109152 - DNA, 22 bp, Homo sapiens
  chr13:108122378-108122400
  Hypo
ccacgcccgaccaactatgtat

SEQ ID NO: 109153 - DNA, 143 bp, Homo sapiens; identical to SEQ ID NO: 43839
  chr13:108218849-108218992
  Hypo

SEQ ID NO: 109154 - DNA, 30 bp, Homo sapiens; identical to SEQ ID NO: 75428
  chr13:108518091-108518121
  Hyper

SEQ ID NO: 109155 - DNA, 277 bp, Homo sapiens
  chr13:108518380-108518657
  Hyper
gtccgcattctccaccgtgaagcactggcccgaggacgcgccctgggggtaacaagtctccaggcgccacacgggcttggcagagtttcctagaaaaagagccttgccccggtcgtctttgcctcggttgcccttgccgccgccgccgccgccgtctcccggggaggggggcagggtgggggacgaggaggcggagaggagtctgtgtgcctgggcggcgggcgaggactcccccatgctcgccaggagcgcgggccaggagggctcctgctgccgc

SEQ ID NO: 109156 - DNA, 216 bp, Homo sapiens; identical to SEQ ID NO: 75430
  chr13:108518717-108518933
  Hyper

SEQ ID NO: 109157 - DNA, 156 bp, Homo sapiens; identical to SEQ ID NO: 35076
  chr13:108519254-108519410
  Hyper

SEQ ID NO: 109158 - DNA, 310 bp, Homo sapiens
  chr13:108519622-108519932
  Hyper
ccccaccccccaccccgcgctctaagtgctgccgccgccgccgccgccgccgccgctgccgcagggccgcccgcgggcgccgccgccggggctccgactgctgacgccgcctcccgcggagctccgggccgaatcgcctgggctgggcctcccgagagccacagtcatcttcagtccgcgggctaagttgccgccatcttcgtcctggagaaacacttttttggggggagcgctggcttttgcgtcatctcctcccgcgccgagctcgctccatcctggcgcagtggcgccggctcggcccgggaggagg

SEQ ID NO: 109159 - DNA, 408 bp, Homo sapiens
  chr13:108520465-108520873
  Hyper
ctattctaaagtaaacgattagaagtggcctcatagagtcttaggaagaaacagtaagccctgtgccacccggggtcactgcctagccctgccctccgcgcgcaccgtccgcgtctccgagggctcctcctcggacctggaccctctggagcggcttcgaccctccctctgcccccgctgcctgcgtccagaccccctcccgggtgggctcctccgaggacctccgcagccgcgggcgagctgggtgcctgcgagtcgccgccgcagtctgagcctctggtgccccttagcgttggctctcggagttctgagaagggaaaggagacagacactctgggaaaatctggggtcacctcgattccggctcctacgctggatgccgtgggcaagcatcggtctcctttgatc

SEQ ID NO: 109160 - DNA, 1455 bp, Homo sapiens
  chr13:109147577-109149032
  Hyper
cactgccacagtccccgcgatggcctttgttctgttaggactccccagggggacctcggctccaggtcacagctctgggcactcccttctcctcctgctcccaggatcttgctaaagtggagacggaaggaaaagtttcaggagtgagctgcgttcttagaattgtagcagagagagaggagggagagagcagaggatcggagggcaggagtggagagaggcgcggtctcctggaacgcgcgggggaacgtggaaaggagggcgcgggagacccggagggctgccccggcggggattagaagcgaggcgggttcagcgtcctgggcgccgcaggaaagtgacccgcagagcgaggcgcggcgccccgggagctggagctcagccccacgacccgcgctgcggcgggcaccacgcggggggcgcgcggggaggggagaggcggggccggcggggactgtgtcgccgccgacgccgcggctgcgggtcgcagaggcgggcagagagagccgccgccgagcgggtggcggagcagtccccagcctccagccggcctggctgcgcgcaaccgcgccggccccgggcacaggggcaactgccgacccctctcacccgccgcgcggggctggtttccgagccgagtcccggccatcgccgcgtcgcctggcgcccggctccggcggacccttctccggcaggtaggggcgtcggcggggcgctgcgcgcggtccaagcgcggggaacgcggcggggcagcctctccgagtctggaggtacgcggggcgcagaggctgttctgcaccgccgggctggggacgccgggagggtgccccgggtcggacttgcggcgctgggtccccacccagagttcccgcacggtgagggttggacgcgtctggggggcgtggagaggaggcttgtcggtcccttcctgggaaaggaatcgcggggacttcccaaccgctaggacgcgtaagccgaggctgggagtagaagccttctgaactctggacctaccccagaaggagggggcgaaactggccatttcgagggacgcggaagccccgttgctaggggagatgggggaagcggcgtggtcacctacacaaccgctcccaggcgcgatgggggctctgcttcctcctcctctgtttctttggggatggaaaagagagcagaacaaagatgtagagtgaaggagggctccccagctgttgcctcttgcgcggattctgctgacccctctgcgcgaccccagctgggcagtgtcagctccattgtctcagaggccggcggccaagtgagggaccagtctcacccggggggcgtcgagcctcagcgcatcgccccgtcttccctggctgcagaaaaccactaggccggtggaagtgctccgtttaattggtccctagtacgcccccgaaaggaaatggagacgatttccgtcaagttctctta

SEQ ID NO: 109161 - DNA, 30 bp, Homo sapiens; identical to SEQ ID NO: 75439
  chr13:109149238-109149268
  Hyper

SEQ ID NO: 109162 - DNA, 30 bp, Homo sapiens; identical to SEQ ID NO: 75440
  chr13:109779816-109779846
  Hypo

SEQ ID NO: 109163 - DNA, 200 bp, Homo sapiens
  chr13:109793278-109793478
  Hyper
caggcccgcgtcccccggcctggcgctgttcaacgggtccggccgagcctccccgccgtccacgccgcccccgcccccgcccccgcccgggccgccccccgcgccctacaggccctgcgcgcacttggccttcccgccggagcccgccccggtgaacgcggggaaagcggggccgagcgcagaggcgcccaaggttcacc

SEQ ID NO: 109164 - DNA, 30 bp, Homo sapiens; identical to SEQ ID NO: 75441
  chr13:109917328-109917358
  Hypo

SEQ ID NO: 109165 - DNA, 30 bp, Homo sapiens; identical to SEQ ID NO: 75442
  chr13:109944512-109944542
  Hypo

SEQ ID NO: 109166 - DNA, 23 bp, Homo sapiens
  chr13:110053866-110053889
  Hypo
tacctgagattcaatcgctgagg

SEQ ID NO: 109167 - DNA, 23 bp, Homo sapiens
  chr13:110053949-110053972
  Hypo
ttttggcccgataaattccattt

SEQ ID NO: 109168 - DNA, 30 bp, Homo sapiens; identical to SEQ ID NO: 75445
  chr13:110174352-110174382
  Hypo

SEQ ID NO: 109169 - DNA, 30 bp, Homo sapiens; identical to SEQ ID NO: 75446
  chr13:110344624-110344654
  Hypo

SEQ ID NO: 109170 - DNA, 160 bp, Homo sapiens; identical to SEQ ID NO: 75447
  chr13:110424427-110424587
  Hypo

SEQ ID NO: 109171 - DNA, 2130 bp, Homo sapiens; identical to SEQ ID NO: 75448
  chr13:110434379-110436509
  Hypo

SEQ ID NO: 109172 - DNA, 35 bp, Homo sapiens; identical to SEQ ID NO: 75449
  chr13:110438921-110438956
  Hyper

SEQ ID NO: 109173 - DNA, 45 bp, Homo sapiens; identical to SEQ ID NO: 75450
  chr13:110439819-110439864
  Hyper

SEQ ID NO: 109174 - DNA, 30 bp, Homo sapiens; identical to SEQ ID NO: 75451
  chr13:110525952-110525982
  Hypo

SEQ ID NO: 109175 - DNA, 30 bp, Homo sapiens; identical to SEQ ID NO: 43842
  chr13:110659714-110659744
  Hypo

SEQ ID NO: 109176 - DNA, 30 bp, Homo sapiens; identical to SEQ ID NO: 75453
  chr13:110767621-110767651
  Hypo

SEQ ID NO: 109177 - DNA, 30 bp, Homo sapiens; identical to SEQ ID NO: 75454
  chr13:110958402-110958432
  Hyper

SEQ ID NO: 109178 - DNA, 1894 bp, Homo sapiens
  chr13:110958709-110960603
  Hyper
acttctgccttggagcgcgccttaggcagcagtcgtgggaaagctcagatacagctgtttccaggcaaagggcccagagcttttcagcctcagccaccagggtctccagacaaggagaaatacgcccaaagctgctcccaggggctaggagctcggagctcccagtgtgggtctctgagcagcgcggggtgggcgctcccggccctccagcccccaactccctcgcgcacccgggacgggtgaaggcgcccagctgccgagcatacccgcgacgcgggttcaaatcccgccggctcccaggcaccctcaccccgccacagcgcgggctgtttctcctcccttccccggaggaattccttaactctccagtacccataccataacaaaggaggctcggtccaccaatgcgcgatcgtagcctacagggacccccaacgaaccccggcccagagaatgcacctggccgtgccacgcgcgacccccgaggggcaggcggacgggtccaggcgcggacaaaggggcctctcggggcgcccaagctcggggcgggacgccgggagcggagctggccgggaactcaccttcgcagcggcccggctgtgctcctcgtggagcagaagggcggcgggcagcagcagcagccagacgctgagccggggccccatggtggcgcgcccgaggcggcgagggacggctgcccggcgtgcgggggccgcggcggacagctagctctcggaaggccggacttccagcgctacgcaccgtcccgggtgcggcggctccaagcggagacctgagcgcggcgggccgagctccccaatttgttggcgctgccccctcccccccggcggtgcgcgggcggcgcctcaaaggggaggaccctgcggcgcgggtaagaggcggcgggagcgcgcggcccgggagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagcccctgaagccgagcccgaggtgagagcgacccccgagcggcgcccagaccctggcccgagagcaccgacttggagcgccttgtgcaggctagggctgcacgctctcctgcttgggagtagaaagggggagggtgggagagcgaagaccgagctcctcggccaaggagcacccacaggggcctaacgggaggctctccttctttccgggtcgtgggggggacggccctccggtcacccctgcatgcgggccgcgcaccgcgctgtccccgcgtctcgcggaccgagaccggcggtgaggatgggctgcctccctcatcctgcgctaaactcgctttgtctgtcgcctctaggctaagtgggactgaccggggcccagagtggacgaaccgccagcatggggagagaccagcgcgcggtggccggccctgccctacggcggtaagcgactttctgcctggtccccgtgggtcacgcgcgcatggacccttcggtgtaactctcggggactgacaagccgggcccgcacgttcacgtctctcttcctccctttcccatgcaggtggctgctgctggggacagtgaccgtggggttcctcgcccagagcgtcttggcggtaagtcctggctcccgcgcttggacttgcgcgcccgagagtggttgggacgtttgagtggccttggagaaggcagctcgtccgtgcgctcccgagtgtgtgtgtgcgtgtggatgttcgccaggctgcccac

SEQ ID NO: 109179 - DNA, 221 bp, Homo sapiens; identical to SEQ ID NO: 35090
  chr13:110960909-110961130
  Hyper

SEQ ID NO: 109180 - DNA, 97 bp, Homo sapiens; identical to SEQ ID NO: 75461
  chr13:110998830-110998927
  Hypo

SEQ ID NO: 109181 - DNA, 126 bp, Homo sapiens; identical to SEQ ID NO: 75462
  chr13:110999273-110999399
  Hypo

SEQ ID NO: 109182 - DNA, 149 bp, Homo sapiens; identical to SEQ ID NO: 43844
  chr13:111144888-111145037
  Hypo

SEQ ID NO: 109183 - DNA, 30 bp, Homo sapiens; identical to SEQ ID NO: 75464
  chr13:111207973-111208003
  Hypo

SEQ ID NO: 109184 - DNA, 66 bp, Homo sapiens; identical to SEQ ID NO: 75465
  chr13:111267526-111267592
  Hypo

SEQ ID NO: 109185 - DNA, 580 bp, Homo sapiens; identical to SEQ ID NO: 75466
  chr13:111277084-111277664
  Hypo

SEQ ID NO: 109186 - DNA, 105 bp, Homo sapiens; identical to SEQ ID NO: 75467
  chr13:111278321-111278426
  Hypo

SEQ ID NO: 109187 - DNA, 178 bp, Homo sapiens; identical to SEQ ID NO: 75468
  chr13:111289167-111289345
  Hypo

SEQ ID NO: 109188 - DNA, 30 bp, Homo sapiens; identical to SEQ ID NO: 75469
  chr13:111337750-111337780
  Hypo

SEQ ID NO: 109189 - DNA, 88 bp, Homo sapiens; identical to SEQ ID NO: 75470
  chr13:111363884-111363972
  Hypo

SEQ ID NO: 109190 - DNA, 214 bp, Homo sapiens; identical to SEQ ID NO: 75471
  chr13:111477321-111477535
  Hypo

SEQ ID NO: 109191 - DNA, 37 bp, Homo sapiens; identical to SEQ ID NO: 75472
  chr13:111682046-111682083
  Hypo

SEQ ID NO: 109192 - DNA, 39 bp, Homo sapiens; identical to SEQ ID NO: 75473
  chr13:111704359-111704398
  Hypo

SEQ ID NO: 109193 - DNA, 30 bp, Homo sapiens; identical to SEQ ID NO: 75474
  chr13:111745610-111745640
  Hypo

SEQ ID NO: 109194 - DNA, 30 bp, Homo sapiens; identical to SEQ ID NO: 43850
  chr13:111764740-111764770
  Hypo

SEQ ID NO: 109195 - DNA, 146 bp, Homo sapiens; identical to SEQ ID NO: 75476
  chr13:111766799-111766945
  Hyper

SEQ ID NO: 109196 - DNA, 1295 bp, Homo sapiens
  chr13:111767213-111768508
  Hyper
tgcaaggtagcaaagcgaaacaaacgtctcgttttcagcctgtccccgccaccttgaaataaaaccggcaaaaataaaaagagcattctgggaagtacttcatcatttcaacgctcacgaattcaaaacataaacaaaggcttccgagtgccccggccaggggcgcggggcgcacggcgggcccggggcaggtaagcgcaggtgcgcgcccgcccccacccccggctccctccccatccgctccccgctccccttcccctttcccttccccgcccgctcccagccgccgccgccgccccgcgcacggcctggagcggaggctgcgcagggcgcggggcggcgcgggccgggcgcgggccgggcggacggccgcgtctttcttctcctggcggtgatgtcattgggcgacggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtaagtcccggcccgcgcccccgcccgcgccccccggtccggcccgctgcggcccgggatgcgcgcggagcacctgaggccggccgcgctcgggaaacccgtgcgccctcctttgtgcgcggagcggcggcgcggccggcgccaggaccgtggcgggagctcggggggcgccattgtgtgcggggcagggggagggggccggggagcggggtcggggggaggggcggcgcgggcggcgggggtccccgggaaggagagtgcaccgcagcgaggagacggggcttctgcgccgcccgaacgctaagttgcccctccgcgtggggggccggccccgctccctggcagcagccgcatcggaaaccgcgttccgacgcggtgcggctcactccgctggctttgtgtggacagttcttgccggtggcgttgcgtgagtttcgcctcccaggttaattgaccggttgctctgtatt

SEQ ID NO: 109197 - DNA, 30 bp, Homo sapiens; identical to SEQ ID NO: 75479
  chr13:111768797-111768827
  Hyper

SEQ ID NO: 109198 - DNA, 30 bp, Homo sapiens; identical to SEQ ID NO: 75480
  chr13:111773890-111773920
  Hypo

SEQ ID NO: 109199 - DNA, 30 bp, Homo sapiens; identical to SEQ ID NO: 75481
  chr13:111797673-111797703
  Hypo

SEQ ID NO: 109200 - DNA, 30 bp, Homo sapiens; identical to SEQ ID NO: 75482
  chr13:111932841-111932871
  Hypo

SEQ ID NO: 109201 - DNA, 30 bp, Homo sapiens; identical to SEQ ID NO: 75483
  chr13:111972934-111972964
  Hypo

SEQ ID NO: 109202 - DNA, 408 bp, Homo sapiens; identical to SEQ ID NO: 75484
  chr13:111978537-111978945
  Hypo

SEQ ID NO: 109203 - DNA, 137 bp, Homo sapiens; identical to SEQ ID NO: 75485
  chr13:111997459-111997596
  Hypo

SEQ ID NO: 109204 - DNA, 30 bp, Homo sapiens; identical to SEQ ID NO: 75486
  chr13:112052769-112052799
  Hypo

SEQ ID NO: 109205 - DNA, 149 bp, Homo sapiens; identical to SEQ ID NO: 75487
  chr13:112060039-112060188
  Hypo

SEQ ID NO: 109206 - DNA, 30 bp, Homo sapiens; identical to SEQ ID NO: 43852
  chr13:112062748-112062778
  Hypo

SEQ ID NO: 109207 - DNA, 187 bp, Homo sapiens; identical to SEQ ID NO: 75489
  chr13:112078320-112078507
  Hypo

SEQ ID NO: 109208 - DNA, 60 bp, Homo sapiens; identical to SEQ ID NO: 75490
  chr13:112090514-112090574
  Hypo

SEQ ID NO: 109209 - DNA, 30 bp, Homo sapiens; identical to SEQ ID NO: 75491
  chr13:112165349-112165379
  Hypo

SEQ ID NO: 109210 - DNA, 30 bp, Homo sapiens; identical to SEQ ID NO: 75492
  chr13:112172192-112172222
  Hypo

SEQ ID NO: 109211 - DNA, 111 bp, Homo sapiens; identical to SEQ ID NO: 75493
  chr13:112192088-112192199
  Hypo

SEQ ID NO: 109212 - DNA, 30 bp, Homo sapiens; identical to SEQ ID NO: 75494
  chr13:112196610-112196640
  Hypo

SEQ ID NO: 109213 - DNA, 272 bp, Homo sapiens; identical to SEQ ID NO: 75495
  chr13:112200634-112200906
  Hypo

SEQ ID NO: 109214 - DNA, 30 bp, Homo sapiens
  chr13:112225369-112225399
  Hypo
cagtgccggcagaagcgcgttcggctccat

SEQ ID NO: 109215 - DNA, 66 bp, Homo sapiens; identical to SEQ ID NO: 75496
  chr13:112236766-112236832
  Hypo

SEQ ID NO: 109216 - DNA, 30 bp, Homo sapiens; identical to SEQ ID NO: 43855
  chr13:112243149-112243179
  Hypo

SEQ ID NO: 109217 - DNA, 79 bp, Homo sapiens; identical to SEQ ID NO: 75498
  chr13:112272942-112273021
  Hypo

SEQ ID NO: 109218 - DNA, 30 bp, Homo sapiens; identical to SEQ ID NO: 75499
  chr13:112274381-112274411
  Hypo

SEQ ID NO: 109219 - DNA, 68 bp, Homo sapiens; identical to SEQ ID NO: 43857
  chr13:112274715-112274783
  Hypo

SEQ ID NO: 109220 - DNA, 36 bp, Homo sapiens; identical to SEQ ID NO: 75501
  chr13:112276380-112276416
  Hypo

SEQ ID NO: 109221 - DNA, 30 bp, Homo sapiens; identical to SEQ ID NO: 75502
  chr13:112309025-112309055
  Hypo

SEQ ID NO: 109222 - DNA, 179 bp, Homo sapiens; identical to SEQ ID NO: 75503
  chr13:112320583-112320762
  Hypo

SEQ ID NO: 109223 - DNA, 32 bp, Homo sapiens; identical to SEQ ID NO: 75504
  chr13:112321043-112321075
  Hypo

SEQ ID NO: 109224 - DNA, 30 bp, Homo sapiens; identical to SEQ ID NO: 75505
  chr13:112323073-112323103
  Hypo

SEQ ID NO: 109225 - DNA, 167 bp, Homo sapiens; identical to SEQ ID NO: 75506
  chr13:112341901-112342068
  Hypo

SEQ ID NO: 109226 - DNA, 30 bp, Homo sapiens; identical to SEQ ID NO: 75507
  chr13:112347214-112347244
  Hypo

SEQ ID NO: 109227 - DNA, 36 bp, Homo sapiens; identical to SEQ ID NO: 75508
  chr13:112512707-112512743
  Hypo

SEQ ID NO: 109228 - DNA, 116 bp, Homo sapiens; identical to SEQ ID NO: 75509
  chr13:112513008-112513124
  Hypo

SEQ ID NO: 109229 - DNA, 325 bp, Homo sapiens; identical to SEQ ID NO: 75510
  chr13:112553503-112553828
  Hypo

SEQ ID NO: 109230 - DNA, 64 bp, Homo sapiens; identical to SEQ ID NO: 75511
  chr13:112558994-112559058
  Hypo

SEQ ID NO: 109231 - DNA, 62 bp, Homo sapiens; identical to SEQ ID NO: 75512
  chr13:112559680-112559742
  Hypo

SEQ ID NO: 109232 - DNA, 60 bp, Homo sapiens; identical to SEQ ID NO: 75513
  chr13:112573418-112573478
  Hypo

SEQ ID NO: 109233 - DNA, 35 bp, Homo sapiens; identical to SEQ ID NO: 43861
  chr13:112573696-112573731
  Hypo

SEQ ID NO: 109234 - DNA, 81 bp, Homo sapiens; identical to SEQ ID NO: 75515
  chr13:112618899-112618980
  Hypo

SEQ ID NO: 109235 - DNA, 30 bp, Homo sapiens; identical to SEQ ID NO: 75516
  chr13:112679985-112680015
  Hypo

SEQ ID NO: 109236 - DNA, 58 bp, Homo sapiens; identical to SEQ ID NO: 75517
  chr13:112682842-112682900
  Hypo

SEQ ID NO: 109237 - DNA, 270 bp, Homo sapiens; identical to SEQ ID NO: 75518
  chr13:112690736-112691006
  Hypo

SEQ ID NO: 109238 - DNA, 1070 bp, Homo sapiens
  chr13:112707631-112708701
  Hyper
tcctgttcccatgtgcggttggtgtcggagttagacatcatcaagaggtgaaaatttgggaagacatttcaaggatgacggaagctctgagtgagtgaacagatattcttcgtgcagaataatcccccgtggcactggtttgccggcagagcagaatgtttgagacctcaccccgcagccacgcgcgggcgtaaatcgttctcagcacgagaaacacaaaggccgcaggatcccgcgagccgcagggggttggggtcatttttttgatgccgccgcccttaagagttccagtccttcaggcgaaaggggcagatcaggccttcggggaggacccttgcctgggagagggagggcagtgccccaggggccgcctccggtgcctaaacaaagaagacggtcttctgagcgtccgccctccccgcctcgccgcgcaaggaccccgcgctcctgggccacttcctcttgcaaaccacgaggaaaagccagtttccacccagacggccggctgtgggcaaagggaataaagcgccggtgccgccacgctctgcacttggctctgggcctggcgggggtctggcgcggccgcagacacctgggtgacctgggccgtggttgccggctctgctcggacagagagtctttttatttgtcgcctccgccttctcaccactgaggccgcaggacagcctcgctgcccggggccgagttcggtggacaagggggcagcgcccacagcaagccggaaagagggaggcgcggggccgcgcttggggcctgccgctgcacgccagcctgggcaaagagctgccaccttctgcgggcgaagcgggtcgggacgcaggacggcagcggggctggaggcagctacgtgggtccacacccccatgccctgcaaggctccttggccctgcttctcctctgtctcggcgggagaggagcagcctcggttttacagaatttcagggtcgcgtctccagcgccccgggcgaggccactacgtttaggagcgctcgccttcgctgcgctgtgtaccgtgtacacactggctccgtgcgcgagaccccgatgtg

SEQ ID NO: 109239 - DNA, 30 bp, Homo sapiens; identical to SEQ ID NO: 35097
  chr13:112709027-112709057
  Hyper

SEQ ID NO: 109240 - DNA, 75 bp, Homo sapiens; identical to SEQ ID NO: 75522
  chr13:112709489-112709564
  Hyper

SEQ ID NO: 109241 - DNA, 3214 bp, Homo sapiens
  chr13:112709815-112713029
  Hyper
cagagacccagaccccgagaaacaagtgtggctccagcccaggagcctcacagaacacatttcctcctccgccttcggctctgcgtgggctagccccgcgctagggagggcaggcaactaggtcctccgaggtgaggctggggctccgcctgcagagggagtgacagcgcgccgcgagggtccgcgacccaggcaggggtggccgcaccaccccggagcgccgcacagccccgcaggcctcccctcccgcagtgcgtgcctggaacgcggggccgcctggccgagggacgtttacctggagagctttgtgtccacaacactaatccttagacactgcttcgttcagcagctgccgtcagtcgtgagggcactagtgtggggatgggggcgaattcaggagcccgtcgcagagcaatatttaaaaaggggggggggagccggagctgctcccaggggaggcctcgcgcggcggcgcccacggccacggtgtccccgctgcgagccaacaaagctgaggcgctgtccgcgggaggagagagcccagcgcggggaccggcgcgggtgggagtgggggcgcggcgcggaaaaccccagggaaggaccgggtggacacgggacgggaggggggtgacatcctcccacccgggggttagaaaaggtccgggtggtagttccaggcgaaaataggcagccctctgtgatgacagaattgacaactattttttgggggggcgggggttggacttccgagtccctcgggacggaggcgcaggggagcaggaggggtgccccgtccctgcagttgcctcggcccgaatcccgcaggccaggccggaacgcgggggcgggggcgcgggagggggacccgcggcgggaggcgagagcgagcgaatggggagaggagcggggagcaggaggggacgcaggggagaggggactggggagcggcgagaggaggacgggagacgcggctccacctcccagctcaaaacggcgtcccagctgctcgcaaaccaactgctcgattctattcactgtcgagtaggaacaaaaaagtggctatttattagaatacttgtttggtattgttccgcgccacacaaaaggcgtttcattatgtggagggatctcctttttccagagagaaacaataacttgaaattgtctttaaagtcttttctatcaataataaatttcattttcttgtctctctcgcctgcagtgtgtgtgcgcgcgcgcgaggcgaggagagaggcgcgtgtgcgagtgagtgtgctagcgggggtgcgcgtgtgagtgtgcgcgtgtgtgtgcgtgcgcgtggcaccggcgcccgcggctacggggctggcgctgccggagccgggccggaccggggtccgagatctgcgtcgcgctgggcacgctggccacccggtccggaatgagtcggggctccgggaggtgcccgtgggcagagcgttaggggcgcggccgtgccggacccgccctggggacccgctggagctggaggaggaactaactgtaagtgtgtctcgaacttgcgcgggggcttcagcccgcccggggctgcggagctggccggtaaaggctctcgggagaggggcgcggtgtctccacggtgactttccgtgaaggaggatggggtgtctccgcagctttggggccccaggaaagaacaggtgggtagatgtggtggccacggctagcggactcgccgcggggcacatttgtcattttcttatctgtgcgttcactcctcccccatcctcggcttttgggattggccgccgcccaacggacccagactgtttctctctgggtcgccatttttggggaggggggagggaggtcgagtctgtggatttgggggagaggttcttgtccgccacagctccgcgccccctccccgcccctcgcggctcccccaccctcgcgttcggcagcgccaggctgcgctctccccggtgcacacccggccgcgccgagaactaaatccgcgggctgaaattacgttttaaaaattaacatgttgaagcgtgtgccatttagtgagaggtgttttgggcaaagaatcaatttaactgtgactgaccgacgggcttgactgtattaattctgctaccgaaaaaaaaaaaaaaaaaaaagcaatgagccgcaagccttggactcgcagagctgccggtgcccgtccgagagccccaccagcgcggctcacgcctcagtctcgccgccccaaggtgggatccgacgcccaaaggagggcgccccaaggtgggatccgagcgggccgccctaggaggagtgaaccccgcccgggcgcacagctccgtgcgcctgtcctccctcctccagcgaaatcacacccgctttgcctcctcttgcagcaccgcgcgtgcctaggttctcggtctgcgcagctgggagtctcccccaccagcgccgcggagccgcccgcttccgctccctctttccgcgggtttgagcctcccgtggagaggaaaggtcacgaagtttcaaaggtgaaatggattttcggcggtggctggtgcgggagtcaatgggcagggcggggcaagcctggcagtcatcgacccgagcagggacccggctggccgcctccccttgcaggaaacaggtgtttgaacgcgatagcggccgccagtcaactaaggcattaaaagctcgctttataacatcgatttcctggagtgcggtggggcctgcgttctggaagctcgtttgtgaaaggcggggttgggggaattgccctgatggtaccccagttggcgcagaagatccccaaaagtccctgtcaccgcagcggcggacagcggggctgcccaggcggctgggagggcagcttttccctcccgctggggtggaaagaggagtcctgctccgttccccacccaggacaatggtcttgttaccccggcctcctcccctgcacctagggcctggcatgcagagagcgcccgcagcagagggggaagtctccaacaactggcaggtgtcccccgaggagctccgcttgatttggaagggtggttaaaccgggatccaggaggaaagcaattccgttgccacccacatcccctgggccctaccaggcttcttcccctgctagcacatctcccggatgcgacgcaggccaggtggcagggctgaagcaggcaggcacacaggagatggcatgcgtacctgtaaggat

SEQ ID NO: 109242 - DNA, 1190 bp, Homo sapiens
  chr13:112715163-112716353
  Hyper
aagacttagcttaggcgacttctctaaagaactcaaccaaatctgaaaggcacaggcattttctcctcaaaatccgaggctcgagaaccatctcctctggcagggtccagtctcagctccgcctcttgcctcctcacccacttgggcataacttttgcgggtcctagaaatctgggcagcagaagagggaggggaacgctcccagccggcagccgctctgggcgtgcacccgccacgcgaagccagaggttggacgacgcagccggccaggcgcggctcccgggggaccccgaaaccgcctgtggctcaggccctacttggcaagaagagactggggagtgagaggaggggtcactcttgctctctcgcacaatagacttcccgcaggcgagtgcgaacggccttttgcttcctccttcttttccaggacccttagcgacaggagaggaagagaagcggcccggcggtttaattgccaatttcctgatgcagccacagggcccagcagcggctcagcctaggccaccgggtccaggcctctaggcaataggcccggcgccccctccaagcaccgtttcccgccgaccccgcagtcatcactgtgagctcgagagtatgggcagcctgtggtgccctgaggcgccgggcgctcggcgcatccgccgtgcccacagcgctgaggaccaactagggctgccctcggccaggggcactgtgcccgtttgagtggcactcggacctggcgaggggtggaagcccaggtagagctcgcgtctttaagagccacccgacagaactgcgcgctacatctgcgccagctgggctgggtgggaacagcgcagaaatactcccgtgccggggcgtacagggcaggtaggcccagcagagagtcttctcggaaagtttcccacaaaagaagggccgggcaggccgagcggcaggaaaagccggtgctcagcggcgaggcccgagaggtctggcatccggcggcctcccagctttgctcgggtctcccgccgcctctctccagagccgcccgtagctccgtggggcggagggcgcaatgccccgctctggttccagcctttttcctccccttgtctcctctttcattcataaacctggtggctacagacgcagcttgaatattgacgtctctcccccaactgctctgccgttaacccaattac

SEQ ID NO: 109243 - DNA, 27 bp, Homo sapiens
  chr13:112716607-112716634
  Hyper
ttcacccagagagctcggaggcacaca

SEQ ID NO: 109244 - DNA, 27 bp, Homo sapiens
  chr13:112716694-112716721
  Hyper
attgtgaatgtgcggctctccacacga

SEQ ID NO: 109245 - DNA, 989 bp, Homo sapiens
  chr13:112717056-112718045
  Hyper
atgatggactcagagcgcccagggaccctagagagaggagcactcctcaagagccccctggccatcacccgagcgccctggagcgccatcacccgaacgcgcgctccaggccctcgaacaaggcctctggctgccagagcgagtgaggggcgcagaggcggcagagagcggagagccccggtgtctccgcgagggcggcggcggccagcagacggcgatcgaggcgcgcgccacggcacggccagcgcagacacgccgcggggtctcgggccggagccgtgcagccgggcccgctgcctctttgcccctcatggctccgcgcgggaggaaaccgggccttctccgcccgccctcctctcgctgcggtgtccccagcacccccgccccgcccccgcgcggtccccaccgtcgcgctcccctccctcctcgccctcgctccgcgcctcctgttggcagagatggcctcgaaggcctcttccaatttgaatggctctttcttcttctctctcccgcgctttcttttccgccttctcctcctctccttctgactactcttgtctctttcaaaagctccgcctggaaactagcggcttcctcttcatctgcctcctttaactgtggcctcggccctctggggcgacaccagagcgcggaagcctgagcccctcggagatccggggaggcacctacacatggcctcaatcctccaaccggccccagaagccgtaggagctgaacccaggagggcaaccggttgtggtgcggccacatgtccctggagagtgtcagcaagacgggtcgacttcaccaggaccacgaaagacagggcagagtttctgtcttctttcactgtcccgtagaactcctagcttgtccatcgtgctccttgcttgggactcgggactgacactgggccagaaaatccacctctagatgcctcaaagctcgctttcatgctggggggcgggcgggagcggggaagggggaca

SEQ ID NO: 109246 - DNA, 2555 bp, Homo sapiens
  chr13:112720033-112722588
  Hyper
tgctacttgagactgcgtttgaaaatctctttcacgttcccaaatcaaagccactttgaggtttaagaatgataaccacaggtgaatgccttactctttccacgagccaggcctttcctttgcatgacgcagaccggcggctgagacccgtcctgaggccccgcctttcattcggtttatgtggccccgcgcagttcacgcagttttctccgttcttaggcaaccagctcgtgggaaattcactccagaaaagcgtgcgccatatcattattttgcgattcaacaaactttttcaactgttgttcaggaactagattccagatagatcttgttgtgttcggccttcctagaaattccttttccagaggaagaagatccgggttgggaagagtgcgtgactatggccccgggctcattgaaagactcctccccacaaaagtttagggctgatactaaacgaagctatggagccatgcccacacaaatactccccctttacccgaattgtggggcctggactgtgaaggccttcgctgcaagagcgggcactggcgaacttcagtgcacgccgcggccgagaacggatgcagggcgggggatggctgagccgcctgatccttgcagagaacctgcaggggccctcggagggtatcccctgcgtccaagggagcgcccctccttttcagcactcgggggaactgagggcgacgtgccagccccgcactcaactttccccttccctgcaggcacagagttggccggcgggggcagaggaggagctgggtctccactgcgcccgtttaaacctggccaggggctgcgtttcctccccccaccccacgacgatcctttcttagtcttcgcttttcaacccaatcgttaatcattcggaacgcgcgggcggggagcggcgaggagggcgagctcggggttcgccgccgccgccgccgccgcgcgcgcgcgctcaggaagcggtgtggctgtcaccccctcccgggcctcctcccccctccttcctgctttgctccccctccttcctcccctcctccccgctccgccgcccgcgcccagtgtatctactccctccccacgtcactcgccagcgcgccatgcaaatcaccgccgccgccggctcccattggccgcggcgcgctcatttaatggcagcccgggcccggcgtatggctgctgggccccgcgcgccgccggccccgcgtgcgcctccgctccgagcgcacggccccgggcaggcagcgggcagcccatcccgggctcggcggccccggctctccggccctctccgcgagcccgcgctcctcccgctgtccccgggcccctccctggctgcaccgtaatcgccccctgcaggcccccctgcgcctccccccccccgccactggcgcctggcttcccccgggcacctgggaccagcacatgcccagcgcacgcggcgcgccgccctgctagaagttgcagcctccgagttggaggccgctgaggaccgagcgcaggaggaaggagacagcgcgcagcggcggccggcgaggagacagcacaccccgggccgggcccagcgcaccgctcccggccccaaaagcggagctgcaacttggccacgactgcacctgtttgcaccgctccgccgagggcgcctgggctgcggtggcggcgaagacggcgaccccgaccgtcggcctctttggcaagtggtttgtgcatcaggagaaactttccacctgcgagccgaaccggcgccgagtgcgtgtgtttctgcctttttttgttgtcgttgcctccacccctccccattcttctctccgctaggacccccccgcccccgtctcactccgtctgaattcctctccgtctccctcccaccccggccgtctatgctccaggccctctcctcgcggtgccggtgaacccgccagccgccccgatgtacagcatgatgatggagaccgacctgcactcgcccggcggcgcccaggcccccacgaacctctcgggccccgccggggcgggcggcggcgggggcggaggcgggggcggcggcggcggcgggggcgccaaggccaaccaggaccgggtcaaacggcccatgaacgccttcatggtgtggtcccgcgggcagcggcgcaagatggcccaggagaaccccaagatgcacaactcggagatcagcaagcgcctgggggccgagtggaaggtcatgtccgaggccgagaagcggccgttcatcgacgaggccaagcggctgcgcgcgctgcacatgaaggagcacccggattacaagtaccggccgcgccgcaagaccaagacgctgctcaagaaggacaagtactcgctggccggcgggctcctggcggccggcgcgggtggcggcggcgcggctgtggccatgggcgtgggcgtgggcgtgggcgcggcggccgtgggccagcgcctggagagcccaggcggcgcggcgggcggcggctacgcgcacgtcaacggctgggccaacggcgcctaccccggctcggtggcggcggcggcggcggccgcggccatga

SEQ ID NO: 109247 - DNA, 880 bp, Homo sapiens
  chr13:112722844-112723724
  Hyper
gcaccagaactcggccgtggcggcggcggcggcggcggcggccgcgtcgtcgggcgccctgggcgcgctgggctctctggtgaagtcggagcccagcggcagcccgcccgccccagcgcactcgcgggcgccgtgccccggggacctgcgcgagatgatcagcatgtacttgcccgccggcgaggggggcgacccggcggcggcagcagcggccgcggcgcagagccggctgcactcgctgccgcagcactaccagggcgcgggcgcgggcgtgaacggcacggtgcccctgacgcacatctagcgccttcgggacgccggggactctgcggcggcgacccacgagctcgcggcccgcgcccggctcccgccccgccccggcgcggcgtggcttttgtacagacgttcccacattcttgtcaaaaggaaaatactggagacgaacgccgggtgacgcgtgtcccccactcaccttccccggagaccctggcgaccgccgggcgctgacaccagacttgggttttagactgaacttcggtgttttcttgagactttttgtacagtatttatcacctacggaggaagcggaaagcgttttctttgctcgaggggacaaaaaagtcaaaacgaggcgagaggcgaagcccacttttgtataccggccggcgcgctcactttcctccgcgttgcttccggacggcgccgaccgccggagcccaagtgacgcggagctcgtcgcatttgttataaatgtagtaaggcaggtccaagcacttacaagttttttgtagttgttaccgctcttttgggttggtttgttaatttatacaaagagattaccaccaccaccccctccttcagacggcggagttatattctg

SEQ ID NO: 109248 - DNA, 423 bp, Homo sapiens; identical to SEQ ID NO: 75539
  chr13:112724172-112724595
  Hyper

SEQ ID NO: 109249 - DNA, 190 bp, Homo sapiens; identical to SEQ ID NO: 75540
  chr13:112725278-112725468
  Hyper

SEQ ID NO: 109250 - DNA, 45 bp, Homo sapiens; identical to SEQ ID NO: 35116
  chr13:112725825-112725870
  Hyper

SEQ ID NO: 109251 - DNA, 2058 bp, Homo sapiens
  chr13:112726292-112728350
  Hyper
ccggagaaacccacccgtaacgtactagatggattagttttaaagaagactcgggcacagcgtgatctccagatgcgcgtcgggagcgtgactgataggtctattaaaatcacgcgtgtgggagaacggcactcatgctcccgcgtttcattcccccggcaaagactgggcgccgcagatttctgtctccggaaaattccagttaattcaagaaacccatccccggacgtgtgcccgcccccccccgaaggctcgcttcaggccagcccggactccagcgccccctcgaccccgtcgggctccggccgactcccgccccctccccacccacgctcggcctgggcccgggggcagcggctccagaggcgtcggcggcagaatttaacccccggtctgagtccttggaaacttcaagtgaaaagcagacttggccttggcgcggctctctttccagcgtgactatctggcgagactgaaaggccaggccagatggggaaaagtgagcggggtgcgggcccccagtatccggcggggtggggcggcgtcaggacggagcgagggccggcgggggggctcgcgtggaggcccaggccgggaggtggggacgcagggacccctcacccagtcctctgctcccgcccgagccaggcctcgggatcacctccccttgcctgagggcgagctctcctcctccctcttcctccccgcctcccccgttcttccctccctctctccctcctccctccccggcccttcctctccagctgcgcgcccgccgggaccacgctcctcccgcccccgggagccgagcggcgtctgcggctggtccggacgtgtcccctccgggcgggggtggccgggcctcctcggggcctcgggcctcccgggcgcacccccctgcctgcgcctctccaagtcgccctttctccggctctgcccgcggctgagccccgcacaccgcgccgctgtccttggggtcccggcacacggcgttccctccccgcccccgccatccactcccaccgcctctccagtccctgtgccgtctccaccgccctctgactcccgcaccgagctgcgtctccgccgccggcctctctcagcgcggcccggcctcctctttgtctttgaagctcccccgccgaggcccgcgcgcggctcccctctccgtccctctccggcccttgggcgcccagtcggaggtcggggcgggatggggcacgagtctcggggcggcccgcgctccccctactagtcccctcattgcctcggccccgtccccgcagcctcggggcgggagggcgcaggggtccccgggcgccctgggagcccatctccctcaggtccgcgccggtgtcagccgccggcggggggcgggtggagattaagatgagtgctgcgagggacggggccgagggttttgtgtagaaggagagcaggattagtggagagaaagtgctgacccggggtcagccgcaagtcaaacccttttacactcagccggcggaacgagcacggctcgggccggacggcaacaagtgggcgcgaagggagggggaggggaggccgggtaccggccgggtccggcgtgagagaggggagggggaggggacgcggccacagcgccccagggcctcagcgtcatcggggacgggcgccgaggggagcgcgcaccagcgacccgggcgcggactggggcctgcagggcgtgactggctgccccccaggactccatctccttcataaacacctgccttttccattccccggggccgcttcggctgctcctctggagggaagactggggagaaggttgcctgcgctctctgccccagaggctctgttttagaaactgtttcttaatttccataagaaacaaaaaaatcacaggaaggcctggttcctctcccggacgactgcgtccccaggctctccaggaatcttcgccttatccgagcttcttcgcagccctggatctatttctggggggcgtgtgtgacgcagaatcggggtataaaatatcaatgctgtttgtcacgacaccgctttctccacccg

SEQ ID NO: 109252 - DNA, 2441 bp, Homo sapiens
  chr13:112758003-112760444
  Hyper
ctcagcacctgcaggcggggggaccgcgcgcttggctcgaagaccccgccctgggcaggggacagaaaatatgaaatcagatggggagttatgaataactgtcctcccctcccctctgccgtgtttcctgaatccgtacgctatgcaggaggggggcgggggcgggggcgcggggaggaggagggggccgtttgccattaatctgggaacaagcggctaacctcggtgactggtattttcgcttttcttttctcacttttctcagtgtggggaaagcagtcaagcccgcgcggagcgattgtgaggggctctgctggaatttggcagcgcggaggcttggagagaagccccatgctggctcccattcagccggcccgttttcctcgagctttggaagtttcactcagccgtgcactcaatggcttcacaaagctgattacaagcttcagcgcattcctgaaggagccaaaagcgacgcaggtgcaaacgagccgagggagccccttatcccggtgacagaatgggacaagctgggaaaggcttagaccacacaagtccaaggctcaccaggccgcagaaagcctgccttgggaaccgggggtcattatccgccctattcagcggggcccggggaccctgggggccgagcgaggccagcccgggcgggagcaccgccgccagcgcgcgccggcgacaggggggaaccccgctgggcgctgcggccaggccggggctcagggcgctgggctgtgcgtttgcacaaatctgtgttccggcgggccggtgtcaaccctagtggggacacgggagaaagagcacgccagtaggccacgcggcgcgtgggcagtgcgcaacttctgtcggcgtccaggctgtacggccacgtttcagccggtgcccccaggccatggacacccagctccagggtcgctctgcgccctttctccccagcccacctttcccattggtcccctctcctgtccgagtggcagcgcggccccgcagggagcgaccccgggagggacagtgaccgcacgcgtggagtggggacggcggggcacaggacggtagtctaagagtgttcgcatggccgaggacgctttcgctgcgagtttggggtcgaggggcagttccctcccggagtcattaacttcgtctcctcgtgctcagggaccagcaacttggtgctgcgggcgccagaaagaaaagggtagcgcctcgcggagcgcgcgggggaagagggactgcggcagcgggacgcgagggcgggaggggcgcagcagcggggagccggagcgcagcggaggggagcgctggggggcggggagcgctcgggcagccaccctgtccccgtctggagccccgcgctgcgtctaggagggcgcaacacgcagtccccgcgggggccagagctcggagccccctagtgcatgccccctctcctcgcgccctgccgaggcctcggccctgcctgccgtgccctgggcctggttgtgcccgggggtccccgcgggcagggcgcggggcaggcagggcgcgcgcgccgacgctcttttgtctgataactaatttgagttaatgcgatctttatgtaaagctaacagcggataattgtctattttctcgccaacagtctccatcacaatcacttatctggaaacctgcggttggattaatcgttatattcccgagatgagcgtcgctgcaatccgcagcgaacgcgggtagggacctggagacgcctcccgggcgctggcggggccggtgtgggccagctccgctaccgcctgagacgcggtgtgcccaggtgttggtgcccgcgggagagggctgtggggcgccttccccaggatttgcttgacttgcttttcgctcgagtgggtggtgcgcgggtgcgggaggcggagggaggaggaggggtgaggggaggagggcctgtggggctgcggacccggagcagcctgggtggagcgcggcctcgggaggccctgggtgcatcgcggcggggcctgggggggcccaggcgccggaggagccgtcggtgccggaatgcagcgtgtttcacttgggagaaacgttgccctcggtcccttgcctccctcctgttgtctcggtttttctggcttcgtccttcgtcccacccacccgttcccacctcaggtccctcccccaggatcccctccttaaggatccaggtctctgaaaattattggcaacagttacacgccccacgattgaaatccacaagagaagagtcccagttctgcaggccgctccagggctaggggtagagatggtggcaggtggtgcgtcaactctctagggaagaggaacttgcattacaaagacttgtctttctgagctgaagtcaaaacgggggcgtcaagcgcgctccgtttggcggcggtggaggggccgcgcgcccgcgctgtcccagccgg

SEQ ID NO: 109253 - DNA, 527 bp, Homo sapiens; identical to SEQ ID NO: 75552
  chr13:112760850-112761377
  Hyper

SEQ ID NO: 109254 - DNA, 30 bp, Homo sapiens; identical to SEQ ID NO: 43865
  chr13:112800543-112800573
  Hypo

SEQ ID NO: 109255 - DNA, 30 bp, Homo sapiens; identical to SEQ ID NO: 75554
  chr13:112805073-112805103
  Hypo

SEQ ID NO: 109256 - DNA, 41 bp, Homo sapiens; identical to SEQ ID NO: 43866
  chr13:112830483-112830524
  Hypo

SEQ ID NO: 109257 - DNA, 30 bp, Homo sapiens; identical to SEQ ID NO: 75556
  chr13:112846818-112846848
  Hypo

SEQ ID NO: 109258 - DNA, 212 bp, Homo sapiens; identical to SEQ ID NO: 75557
  chr13:112882188-112882400
  Hypo

SEQ ID NO: 109259 - DNA, 20 bp, Homo sapiens
  chr13:112882956-112882976
  Hypo
ttttttcttttgagacgcag

SEQ ID NO: 109260 - DNA, 222 bp, Homo sapiens; identical to SEQ ID NO: 75559
  chr13:112895421-112895643
  Hypo

SEQ ID NO: 109261 - DNA, 36 bp, Homo sapiens; identical to SEQ ID NO: 75560
  chr13:112899548-112899584
  Hypo

SEQ ID NO: 109262 - DNA, 34 bp, Homo sapiens; identical to SEQ ID NO: 75561
  chr13:112906409-112906443
  Hypo

SEQ ID NO: 109263 - DNA, 30 bp, Homo sapiens; identical to SEQ ID NO: 75562
  chr13:112910078-112910108
  Hypo

SEQ ID NO: 109264 - DNA, 77 bp, Homo sapiens; identical to SEQ ID NO: 75563
  chr13:112998058-112998135
  Hypo

SEQ ID NO: 109265 - DNA, 30 bp, Homo sapiens; identical to SEQ ID NO: 75564
  chr13:113013574-113013604
  Hypo

SEQ ID NO: 109266 - DNA, 30 bp, Homo sapiens; identical to SEQ ID NO: 75565
  chr13:113050319-113050349
  Hypo

SEQ ID NO: 109267 - DNA, 42 bp, Homo sapiens; identical to SEQ ID NO: 43869
  chr13:113099281-113099323
  Hypo

SEQ ID NO: 109268 - DNA, 95 bp, Homo sapiens; identical to SEQ ID NO: 75567
  chr13:113107030-113107125
  Hypo

SEQ ID NO: 109269 - DNA, 294 bp, Homo sapiens; identical to SEQ ID NO: 75568
  chr13:113107711-113108005
  Hypo

SEQ ID NO: 109270 - DNA, 30 bp, Homo sapiens; identical to SEQ ID NO: 75569
  chr13:113108949-113108979
  Hypo

SEQ ID NO: 109271 - DNA, 34 bp, Homo sapiens; identical to SEQ ID NO: 75570
  chr13:113119848-113119882
  Hypo

SEQ ID NO: 109272 - DNA, 30 bp, Homo sapiens; identical to SEQ ID NO: 75571
  chr13:113132528-113132558
  Hypo

SEQ ID NO: 109273 - DNA, 59 bp, Homo sapiens; identical to SEQ ID NO: 75572
  chr13:113160568-113160627
  Hypo

SEQ ID NO: 109274 - DNA, 218 bp, Homo sapiens; identical to SEQ ID NO: 75573
  chr13:113269889-113270107
  Hypo

SEQ ID NO: 109275 - DNA, 49 bp, Homo sapiens; identical to SEQ ID NO: 75574
  chr13:113285488-113285537
  Hypo

SEQ ID NO: 109276 - DNA, 30 bp, Homo sapiens; identical to SEQ ID NO: 43871
  chr13:113319347-113319377
  Hypo

SEQ ID NO: 109277 - DNA, 245 bp, Homo sapiens; identical to SEQ ID NO: 75576
  chr13:113350398-113350643
  Hypo

SEQ ID NO: 109278 - DNA, 36 bp, Homo sapiens; identical to SEQ ID NO: 75577
  chr13:113368582-113368618
  Hypo

SEQ ID NO: 109279 - DNA, 30 bp, Homo sapiens; identical to SEQ ID NO: 75578
  chr13:113396823-113396853
  Hypo

SEQ ID NO: 109280 - DNA, 333 bp, Homo sapiens; identical to SEQ ID NO: 75579
  chr13:113400400-113400733
  Hypo

SEQ ID NO: 109281 - DNA, 39 bp, Homo sapiens; identical to SEQ ID NO: 43873
  chr13:113401430-113401469
  Hypo

SEQ ID NO: 109282 - DNA, 30 bp, Homo sapiens; identical to SEQ ID NO: 75581
  chr13:113424191-113424221
  Hypo

SEQ ID NO: 109283 - DNA, 52 bp, Homo sapiens; identical to SEQ ID NO: 75582
  chr13:113424883-113424935
  Hypo

SEQ ID NO: 109284 - DNA, 30 bp, Homo sapiens; identical to SEQ ID NO: 75583
  chr13:113505580-113505610
  Hypo

SEQ ID NO: 109285 - DNA, 30 bp, Homo sapiens; identical to SEQ ID NO: 75584
  chr13:113542925-113542955
  Hypo

SEQ ID NO: 109286 - DNA, 30 bp, Homo sapiens; identical to SEQ ID NO: 75585
  chr13:113545760-113545790
  Hypo

SEQ ID NO: 109287 - DNA, 156 bp, Homo sapiens; identical to SEQ ID NO: 75586
  chr13:113546374-113546530
  Hypo

SEQ ID NO: 109288 - DNA, 167 bp, Homo sapiens; identical to SEQ ID NO: 75587
  chr13:113547082-113547249
  Hyper

SEQ ID NO: 109289 - DNA, 30 bp, Homo sapiens; identical to SEQ ID NO: 75588
  chr13:113552672-113552702
  Hypo

SEQ ID NO: 109290 - DNA, 30 bp, Homo sapiens; identical to SEQ ID NO: 75589
  chr13:113552957-113552987
  Hypo

SEQ ID NO: 109291 - DNA, 190 bp, Homo sapiens; identical to SEQ ID NO: 75590
  chr13:113566241-113566431
  Hypo

SEQ ID NO: 109292 - DNA, 30 bp, Homo sapiens; identical to SEQ ID NO: 75591
  chr13:113568768-113568798
  Hypo

SEQ ID NO: 109293 - DNA, 309 bp, Homo sapiens; identical to SEQ ID NO: 75592
  chr13:113598542-113598851
  Hypo

SEQ ID NO: 109294 - DNA, 51 bp, Homo sapiens; identical to SEQ ID NO: 75593
  chr13:113608271-113608322
  Hypo

SEQ ID NO: 109295 - DNA, 64 bp, Homo sapiens; identical to SEQ ID NO: 75594
  chr13:113623284-113623348
  Hyper

SEQ ID NO: 109296 - DNA, 700 bp, Homo sapiens
  chr13:113648342-113649042
  Hypo
ccgaccctccgccttcgtctttttcctgattaaaaaaaagcaccttcatgcggggtgcggcgcttgggaccccccaagctgacgtcactgtctgtgccggtgtctcgggcaggggcaggtgtggatgccaagctgacgtcactgtgccagtgtctcgggcaggggcgtggctgccaacggggcacggtgcgtgggatgccaagctgacatcactatgcaggtgtctcgggcaggggctggcgtggctgtcggcgtgacggggcgcggcgcgtgggacgccaagctgacgtcactgtctgtgccggtgtctcgggcgggggccagtgtggctgccaatggggcaaggtgcgtgggacgtcaagctgacgtcactgtctgtgccagtgtctcgggcaggggctggcagggctgcccaggaggctgtcggtggggcagttcctcatgaatctctgagctgagtttgtaaaagtgtgtgagagtggggaaaatatgggtgaaaatattttcagacatttggattcccctttggtgagctgtctcgtttcttcccgctggtcagggatgtggctgcttgaacagctgggcgcggtgaccaatgtgtggagagccgggaagcctgcggtgaggccgcgcgatgtccttcatcccgggcagtaaatccagccccgagggtggggcatcctcccgggcacaggctctc

SEQ ID NO: 109297 - DNA, 38 bp, Homo sapiens; identical to SEQ ID NO: 75596
  chr13:113678958-113678996
  Hypo

SEQ ID NO: 109298 - DNA, 148 bp, Homo sapiens; identical to SEQ ID NO: 75597
  chr13:113718501-113718649
  Hypo

SEQ ID NO: 109299 - DNA, 104 bp, Homo sapiens; identical to SEQ ID NO: 75598
  chr13:113719085-113719189
  Hypo

SEQ ID NO: 109300 - DNA, 19 bp, Homo sapiens
  chr13:113763577-113763596
  Hypo
ggagcgtgggtgtcgggga

SEQ ID NO: 109301 - DNA, 127 bp, Homo sapiens; identical to SEQ ID NO: 75600
  chr13:113775919-113776046
  Hypo

SEQ ID NO: 109302 - DNA, 30 bp, Homo sapiens; identical to SEQ ID NO: 75601
  chr13:113797930-113797960
  Hypo

SEQ ID NO: 109303 - DNA, 30 bp, Homo sapiens; identical to SEQ ID NO: 75602
  chr13:113825962-113825992
  Hypo

SEQ ID NO: 109304 - DNA, 30 bp, Homo sapiens; identical to SEQ ID NO: 75603
  chr13:113848551-113848581
  Hypo

SEQ ID NO: 109305 - DNA, 50 bp, Homo sapiens; identical to SEQ ID NO: 75604
  chr13:113984359-113984409
  Hypo

SEQ ID NO: 109306 - DNA, 503 bp, Homo sapiens; identical to SEQ ID NO: 75605
  chr13:113985469-113985972
  Hypo

SEQ ID NO: 109307 - DNA, 137 bp, Homo sapiens
  chr13:114017816-114017953
  Hyper
gcatggatcgagttttgatccatcccgatatggctccctgctgggagggacgggtctccttcgcgtccgacccgccggcccatctcaaagcgggaaaaccggtccctgcggctgccctagctcggagcccgcagctt

SEQ ID NO: 109308 - DNA, 111 bp, Homo sapiens; identical to SEQ ID NO: 75607
  chr13:114018219-114018330
  Hyper

SEQ ID NO: 109309 - DNA, 33 bp, Homo sapiens; identical to SEQ ID NO: 75608
  chr13:114019204-114019237
  Hypo

SEQ ID NO: 109310 - DNA, 38 bp, Homo sapiens; identical to SEQ ID NO: 75609
  chr13:114028380-114028418
  Hypo

SEQ ID NO: 109311 - DNA, 211 bp, Homo sapiens; identical to SEQ ID NO: 75610
  chr13:114055940-114056151
  Hypo

SEQ ID NO: 109312 - DNA, 36 bp, Homo sapiens; identical to SEQ ID NO: 75611
  chr13:114056508-114056544
  Hypo

SEQ ID NO: 109313 - DNA, 30 bp, Homo sapiens; identical to SEQ ID NO: 43882
  chr13:114059583-114059613
  Hypo

SEQ ID NO: 109314 - DNA, 479 bp, Homo sapiens; identical to SEQ ID NO: 43883
  chr13:114059986-114060465
  Hypo

SEQ ID NO: 109315 - DNA, 146 bp, Homo sapiens; identical to SEQ ID NO: 75614
  chr13:114060775-114060921
  Hypo

SEQ ID NO: 109316 - DNA, 113 bp, Homo sapiens; identical to SEQ ID NO: 75615
  chr13:114064741-114064854
  Hypo

SEQ ID NO: 109317 - DNA, 727 bp, Homo sapiens; identical to SEQ ID NO: 75616
  chr13:114074574-114075301
  Hypo

SEQ ID NO: 109318 - DNA, 30 bp, Homo sapiens; identical to SEQ ID NO: 75617
  chr13:114080589-114080619
  Hypo

SEQ ID NO: 109319 - DNA, 75 bp, Homo sapiens; identical to SEQ ID NO: 75618
  chr13:114103353-114103428
  Hypo

SEQ ID NO: 109320 - DNA, 36 bp, Homo sapiens
  chr13:114107694-114107730
  Hypo
tgtagccaagagcatcgccgacgctccccagcaaca

SEQ ID NO: 109321 - DNA, 59 bp, Homo sapiens; identical to SEQ ID NO: 75619
  chr13:114108109-114108168
  Hypo

SEQ ID NO: 109322 - DNA, 30 bp, Homo sapiens; identical to SEQ ID NO: 75620
  chr13:114115112-114115142
  Hypo

SEQ ID NO: 109323 - DNA, 374 bp, Homo sapiens; identical to SEQ ID NO: 75621
  chr13:114122901-114123275
  Hypo

SEQ ID NO: 109324 - DNA, 22 bp, Homo sapiens
  chr13:114123716-114123738
  Hypo
tgaaaccatggctcacgcctgt

SEQ ID NO: 109325 - DNA, 86 bp, Homo sapiens; identical to SEQ ID NO: 15788
  chr13:114188403-114188489
  Hypo

SEQ ID NO: 109326 - DNA, 221 bp, Homo sapiens; identical to SEQ ID NO: 75624
  chr13:114189411-114189632
  Hypo

SEQ ID NO: 109327 - DNA, 30 bp, Homo sapiens; identical to SEQ ID NO: 75625
  chr13:114190112-114190142
  Hypo

SEQ ID NO: 109328 - DNA, 30 bp, Homo sapiens; identical to SEQ ID NO: 75626
  chr13:114191082-114191112
  Hypo

SEQ ID NO: 109329 - DNA, 30 bp, Homo sapiens; identical to SEQ ID NO: 75627
  chr13:114202484-114202514
  Hypo

SEQ ID NO: 109330 - DNA, 39 bp, Homo sapiens; identical to SEQ ID NO: 75628
  chr13:114202814-114202853
  Hypo

SEQ ID NO: 109331 - DNA, 177 bp, Homo sapiens; identical to SEQ ID NO: 75629
  chr13:114203823-114204000
  Hypo

SEQ ID NO: 109332 - DNA, 30 bp, Homo sapiens; identical to SEQ ID NO: 75630
  chr13:114212474-114212504
  Hypo

SEQ ID NO: 109333 - DNA, 79 bp, Homo sapiens; identical to SEQ ID NO: 75631
  chr13:114220555-114220634
  Hypo

SEQ ID NO: 109334 - DNA, 33 bp, Homo sapiens; identical to SEQ ID NO: 75632
  chr13:114221622-114221655
  Hypo

SEQ ID NO: 109335 - DNA, 78 bp, Homo sapiens; identical to SEQ ID NO: 75633
  chr13:114271924-114272002
  Hypo

SEQ ID NO: 109336 - DNA, 30 bp, Homo sapiens; identical to SEQ ID NO: 75634
  chr13:114283331-114283361
  Hypo

SEQ ID NO: 109337 - DNA, 30 bp, Homo sapiens; identical to SEQ ID NO: 43894
  chr13:114285192-114285222
  Hypo

SEQ ID NO: 109338 - DNA, 30 bp, Homo sapiens; identical to SEQ ID NO: 43895
  chr13:114285597-114285627
  Hypo

SEQ ID NO: 109339 - DNA, 76 bp, Homo sapiens; identical to SEQ ID NO: 75637
  chr13:114302276-114302352
  Hypo

SEQ ID NO: 109340 - DNA, 374 bp, Homo sapiens; identical to SEQ ID NO: 75638
  chr13:114304719-114305093
  Hypo

SEQ ID NO: 109341 - DNA, 30 bp, Homo sapiens; identical to SEQ ID NO: 75639
  chr13:114305730-114305760
  Hypo

SEQ ID NO: 109342 - DNA, 91 bp, Homo sapiens; identical to SEQ ID NO: 75640
  chr13:114312311-114312402
  Hypo

SEQ ID NO: 109343 - DNA, 40 bp, Homo sapiens; identical to SEQ ID NO: 75641
  chr13:114318203-114318243
  Hypo

SEQ ID NO: 109344 - DNA, 30 bp, Homo sapiens; identical to SEQ ID NO: 75642
  chr13:114323035-114323065
  Hypo

SEQ ID NO: 109345 - DNA, 30 bp, Homo sapiens; identical to SEQ ID NO: 43899
  chr13:114426896-114426926
  Hypo

SEQ ID NO: 109346 - DNA, 30 bp, Homo sapiens; identical to SEQ ID NO: 75644
  chr13:114438068-114438098
  Hypo

SEQ ID NO: 109347 - DNA, 30 bp, Homo sapiens; identical to SEQ ID NO: 75645
  chr13:114438450-114438480
  Hypo

SEQ ID NO: 109348 - DNA, 136 bp, Homo sapiens; identical to SEQ ID NO: 75646
  chr13:114450586-114450722
  Hypo

SEQ ID NO: 109349 - DNA, 38 bp, Homo sapiens; identical to SEQ ID NO: 75647
  chr13:114454880-114454918
  Hypo

SEQ ID NO: 109350 - DNA, 288 bp, Homo sapiens
  chr13:114462710-114462998
  Hyper
cttcgtttggaagagcgaggtagccttttcctgtttgaacgtgcagaggcgctcacagaactggacagtgttgcttggtttcggctcgcccctctctcgtgtttctccccggtgtgttcacggaatctccaattcttccacttcccagaccaagcccgctgcagcctcggagccaggcaaaggctgggaaaacaggaaacctgttgcgtgttcaccagttcgcaagccgggctcgggggctctgccgggaagtggccaggactggaaggatgccgggtgtcttcctga

SEQ ID NO: 109351 - DNA, 153 bp, Homo sapiens; identical to SEQ ID NO: 75650
  chr13:114466991-114467144
  Hypo

SEQ ID NO: 109352 - DNA, 70 bp, Homo sapiens; identical to SEQ ID NO: 75651
  chr13:114478858-114478928
  Hypo

SEQ ID NO: 109353 - DNA, 68 bp, Homo sapiens; identical to SEQ ID NO: 75652
  chr13:114479383-114479451
  Hypo

SEQ ID NO: 109354 - DNA, 132 bp, Homo sapiens; identical to SEQ ID NO: 75653
  chr13:114492908-114493040
  Hypo

SEQ ID NO: 109355 - DNA, 30 bp, Homo sapiens; identical to SEQ ID NO: 75654
  chr13:114494463-114494493
  Hypo

SEQ ID NO: 109356 - DNA, 30 bp, Homo sapiens; identical to SEQ ID NO: 75655
  chr13:114495640-114495670
  Hypo

SEQ ID NO: 109357 - DNA, 30 bp, Homo sapiens; identical to SEQ ID NO: 43903
  chr13:114497409-114497439
  Hypo

SEQ ID NO: 109358 - DNA, 516 bp, Homo sapiens; identical to SEQ ID NO: 75657
  chr13:114497813-114498329
  Hypo

SEQ ID NO: 109359 - DNA, 38 bp, Homo sapiens; identical to SEQ ID NO: 75658
  chr13:114499931-114499969
  Hypo

SEQ ID NO: 109360 - DNA, 30 bp, Homo sapiens; identical to SEQ ID NO: 75659
  chr13:114502300-114502330
  Hypo

SEQ ID NO: 109361 - DNA, 175 bp, Homo sapiens; identical to SEQ ID NO: 43905
  chr13:114502787-114502962
  Hypo

SEQ ID NO: 109362 - DNA, 185 bp, Homo sapiens; identical to SEQ ID NO: 75661
  chr13:114506372-114506557
  Hypo

SEQ ID NO: 109363 - DNA, 30 bp, Homo sapiens; identical to SEQ ID NO: 75662
  chr13:114507314-114507344
  Hypo

SEQ ID NO: 109364 - DNA, 30 bp, Homo sapiens; identical to SEQ ID NO: 75663
  chr13:114508713-114508743
  Hypo

SEQ ID NO: 109365 - DNA, 48 bp, Homo sapiens; identical to SEQ ID NO: 75664
  chr13:114515287-114515335
  Hypo

SEQ ID NO: 109366 - DNA, 252 bp, Homo sapiens; identical to SEQ ID NO: 75665
  chr13:114515648-114515900
  Hypo

SEQ ID NO: 109367 - DNA, 30 bp, Homo sapiens; identical to SEQ ID NO: 75666
  chr13:114517682-114517712
  Hypo

SEQ ID NO: 109368 - DNA, 30 bp, Homo sapiens; identical to SEQ ID NO: 75667
  chr13:114524666-114524696
  Hypo

SEQ ID NO: 109369 - DNA, 142 bp, Homo sapiens; identical to SEQ ID NO: 75668
  chr13:114526487-114526629
  Hypo

SEQ ID NO: 109370 - DNA, 36 bp, Homo sapiens; identical to SEQ ID NO: 75669
  chr13:114531771-114531807
  Hypo

SEQ ID NO: 109371 - DNA, 30 bp, Homo sapiens; identical to SEQ ID NO: 75670
  chr13:114601611-114601641
  Hypo

SEQ ID NO: 109372 - DNA, 154 bp, Homo sapiens; identical to SEQ ID NO: 43908
  chr13:114742788-114742942
  Hypo

SEQ ID NO: 109373 - DNA, 69 bp, Homo sapiens; identical to SEQ ID NO: 75672
  chr13:114744097-114744166
  Hypo

SEQ ID NO: 109374 - DNA, 50 bp, Homo sapiens; identical to SEQ ID NO: 75673
  chr13:114744515-114744565
  Hypo

SEQ ID NO: 109375 - DNA, 77 bp, Homo sapiens; identical to SEQ ID NO: 43909
  chr13:114746775-114746852
  Hypo

SEQ ID NO: 109376 - DNA, 812 bp, Homo sapiens; identical to SEQ ID NO: 75675
  chr13:114748324-114749136
  Hypo

SEQ ID NO: 109377 - DNA, 32 bp, Homo sapiens; identical to SEQ ID NO: 43911
  chr13:114749950-114749982
  Hypo

SEQ ID NO: 109378 - DNA, 30 bp, Homo sapiens; identical to SEQ ID NO: 75677
  chr13:114750396-114750426
  Hypo

SEQ ID NO: 109379 - DNA, 78 bp, Homo sapiens; identical to SEQ ID NO: 75678
  chr13:114750975-114751053
  Hypo

SEQ ID NO: 109380 - DNA, 30 bp, Homo sapiens; identical to SEQ ID NO: 43912
  chr13:114751360-114751390
  Hypo

SEQ ID NO: 109381 - DNA, 39 bp, Homo sapiens; identical to SEQ ID NO: 75680
  chr13:114755827-114755866
  Hypo

SEQ ID NO: 109382 - DNA, 30 bp, Homo sapiens; identical to SEQ ID NO: 75681
  chr13:114758007-114758037
  Hypo

SEQ ID NO: 109383 - DNA, 111 bp, Homo sapiens; identical to SEQ ID NO: 75682
  chr13:114760934-114761045
  Hypo

SEQ ID NO: 109384 - DNA, 197 bp, Homo sapiens; identical to SEQ ID NO: 75683
  chr13:114762623-114762820
  Hypo

SEQ ID NO: 109385 - DNA, 193 bp, Homo sapiens; identical to SEQ ID NO: 75684
  chr13:114765044-114765237
  Hypo

SEQ ID NO: 109386 - DNA, 754 bp, Homo sapiens; identical to SEQ ID NO: 75685
  chr13:114767261-114768015
  Hypo

SEQ ID NO: 109387 - DNA, 206 bp, Homo sapiens; identical to SEQ ID NO: 43917
  chr13:114769986-114770192
  Hypo

SEQ ID NO: 109388 - DNA, 143 bp, Homo sapiens; identical to SEQ ID NO: 75687
  chr13:114770922-114771065
  Hypo

SEQ ID NO: 109389 - DNA, 200 bp, Homo sapiens; identical to SEQ ID NO: 75688
  chr13:114774947-114775147
  Hypo

SEQ ID NO: 109390 - DNA, 146 bp, Homo sapiens; identical to SEQ ID NO: 75689
  chr13:114776302-114776448
  Hypo

SEQ ID NO: 109391 - DNA, 40 bp, Homo sapiens; identical to SEQ ID NO: 43921
  chr13:114777010-114777050
  Hypo

SEQ ID NO: 109392 - DNA, 30 bp, Homo sapiens; identical to SEQ ID NO: 75691
  chr13:114777780-114777810
  Hypo

SEQ ID NO: 109393 - DNA, 34 bp, Homo sapiens; identical to SEQ ID NO: 43922
  chr13:114778697-114778731
  Hypo

SEQ ID NO: 109394 - DNA, 113 bp, Homo sapiens; identical to SEQ ID NO: 75693
  chr13:114779925-114780038
  Hypo

SEQ ID NO: 109395 - DNA, 543 bp, Homo sapiens; identical to SEQ ID NO: 75694
  chr13:114780540-114781083
  Hypo

SEQ ID NO: 109396 - DNA, 35 bp, Homo sapiens; identical to SEQ ID NO: 75695
  chr13:114781299-114781334
  Hypo

SEQ ID NO: 109397 - DNA, 93 bp, Homo sapiens; identical to SEQ ID NO: 75696
  chr13:114782866-114782959
  Hypo

SEQ ID NO: 109398 - DNA, 56 bp, Homo sapiens; identical to SEQ ID NO: 75697
  chr13:114784530-114784586
  Hypo

SEQ ID NO: 109399 - DNA, 66 bp, Homo sapiens; identical to SEQ ID NO: 43926
  chr13:114785766-114785832
  Hypo

SEQ ID NO: 109400 - DNA, 165 bp, Homo sapiens; identical to SEQ ID NO: 75699
  chr13:114786866-114787031
  Hypo

SEQ ID NO: 109401 - DNA, 116 bp, Homo sapiens; identical to SEQ ID NO: 75700
  chr13:114789389-114789505
  Hypo

SEQ ID NO: 109402 - DNA, 20 bp, Homo sapiens
  chr13:114802298-114802318
  Hypo
caccgcgcccagcctggagt

SEQ ID NO: 109403 - DNA, 115 bp, Homo sapiens; identical to SEQ ID NO: 75702
  chr13:114802580-114802695
  Hypo

SEQ ID NO: 109404 - DNA, 42 bp, Homo sapiens; identical to SEQ ID NO: 75703
  chr13:114803361-114803403
  Hypo

SEQ ID NO: 109405 - DNA, 30 bp, Homo sapiens; identical to SEQ ID NO: 75704
  chr13:114803808-114803838
  Hypo

SEQ ID NO: 109406 - DNA, 346 bp, Homo sapiens; identical to SEQ ID NO: 75705
  chr13:114807501-114807847
  Hypo

SEQ ID NO: 109407 - DNA, 46 bp, Homo sapiens; identical to SEQ ID NO: 75706
  chr13:114808091-114808137
  Hypo

SEQ ID NO: 109408 - DNA, 18 bp, Homo sapiens
  chr13:114812180-114812198
  Hypo
gtccgagccctgccttca

SEQ ID NO: 109409 - DNA, 30 bp, Homo sapiens; identical to SEQ ID NO: 75708
  chr13:114816511-114816541
  Hypo

SEQ ID NO: 109410 - DNA, 72 bp, Homo sapiens; identical to SEQ ID NO: 75709
  chr13:114820299-114820371
  Hypo

SEQ ID NO: 109411 - DNA, 30 bp, Homo sapiens; identical to SEQ ID NO: 75710
  chr13:114838479-114838509
  Hypo

SEQ ID NO: 109412 - DNA, 30 bp, Homo sapiens; identical to SEQ ID NO: 75711
  chr13:114840646-114840676
  Hypo

SEQ ID NO: 109413 - DNA, 316 bp, Homo sapiens; identical to SEQ ID NO: 75712
  chr13:114842818-114843134
  Hypo

SEQ ID NO: 109414 - DNA, 30 bp, Homo sapiens; identical to SEQ ID NO: 75713
  chr13:114844847-114844877
  Hypo

SEQ ID NO: 109415 - DNA, 37 bp, Homo sapiens; identical to SEQ ID NO: 75714
  chr13:114845313-114845350
  Hypo

SEQ ID NO: 109416 - DNA, 460 bp, Homo sapiens; identical to SEQ ID NO: 75715
  chr13:114847212-114847672
  Hypo

SEQ ID NO: 109417 - DNA, 227 bp, Homo sapiens; identical to SEQ ID NO: 75716
  chr13:114855474-114855701
  Hypo

SEQ ID NO: 109418 - DNA, 30 bp, Homo sapiens; identical to SEQ ID NO: 75717
  chr13:114862455-114862485
  Hypo

SEQ ID NO: 109419 - DNA, 37 bp, Homo sapiens; identical to SEQ ID NO: 75718
  chr13:114886881-114886918
  Hypo

SEQ ID NO: 109420 - DNA, 53 bp, Homo sapiens; identical to SEQ ID NO: 75719
  chr13:114889099-114889152
  Hypo

SEQ ID NO: 109421 - DNA, 30 bp, Homo sapiens; identical to SEQ ID NO: 75720
  chr13:114889446-114889476
  Hypo

SEQ ID NO: 109422 - DNA, 38 bp, Homo sapiens; identical to SEQ ID NO: 75721
  chr13:114892617-114892655
  Hypo

SEQ ID NO: 109423 - DNA, 30 bp, Homo sapiens; identical to SEQ ID NO: 75722
  chr13:114911257-114911287
  Hypo

SEQ ID NO: 109424 - DNA, 69 bp, Homo sapiens; identical to SEQ ID NO: 75723
  chr13:114917035-114917104
  Hypo

SEQ ID NO: 109425 - DNA, 30 bp, Homo sapiens; identical to SEQ ID NO: 75724
  chr13:114917570-114917600
  Hypo

SEQ ID NO: 109426 - DNA, 37 bp, Homo sapiens; identical to SEQ ID NO: 75725
  chr13:114922755-114922792
  Hypo

SEQ ID NO: 109427 - DNA, 351 bp, Homo sapiens; identical to SEQ ID NO: 75726
  chr13:114961720-114962071
  Hypo

SEQ ID NO: 109428 - DNA, 107 bp, Homo sapiens; identical to SEQ ID NO: 75727
  chr13:114989891-114989998
  Hypo

SEQ ID NO: 109429 - DNA, 207 bp, Homo sapiens; identical to SEQ ID NO: 75728
  chr13:115024113-115024320
  Hypo

SEQ ID NO: 109430 - DNA, 38 bp, Homo sapiens; identical to SEQ ID NO: 76526
  chr14:20707559-20707597
  Hypo

SEQ ID NO: 109431 - DNA, 125 bp, Homo sapiens; identical to SEQ ID NO: 76527
  chr14:20928177-20928302
  Hypo

SEQ ID NO: 109432 - DNA, 30 bp, Homo sapiens; identical to SEQ ID NO: 76528
  chr14:20936882-20936912
  Hypo

SEQ ID NO: 109433 - DNA, 77 bp, Homo sapiens; identical to SEQ ID NO: 76529
  chr14:21093454-21093531
  Hyper

SEQ ID NO: 109434 - DNA, 196 bp, Homo sapiens; identical to SEQ ID NO: 76530
  chr14:21093591-21093787
  Hyper

SEQ ID NO: 109435 - DNA, 283 bp, Homo sapiens; identical to SEQ ID NO: 76531
  chr14:21098864-21099147
  Hyper

SEQ ID NO: 109436 - DNA, 430 bp, Homo sapiens
  chr14:21100626-21101056
  Hyper
acagcaacttttccccgacggcacctcctgggcgcccttgaaagacgccttaaatctaaacctataatacataggtaatcaactaaagctgaaagggaatggccaaagcacccacgtggagtgctgggtgctgtaggcgagaggtctgaggtagtggcttttagagctcaacatcttggtaatgttggttcgaccttttcccctgccagtcccgcggtgacctttatctttcggtgagtgaaatcggtcgttcgtgtttttcgtgggtcttccaaccacaggccgcctgagatggttctagtccctttgagtatacagacccttcctgtgcattgaccgacacagctcggcccggatcccgaaatgaacgtttctaccttcggaacgctgcgtctcggatccttctgaacccgcacgttgactttcctgg

SEQ ID NO: 109437 - DNA, 60 bp, Homo sapiens; identical to SEQ ID NO: 76535
  chr14:21121400-21121460
  Hyper

SEQ ID NO: 109438 - DNA, 47 bp, Homo sapiens
  chr14:21121902-21121949
  Hyper
ctcatcccccacccccgttcttcctcccgatgcgctttctgccttct

SEQ ID NO: 109439 - DNA, 17 bp, Homo sapiens
  chr14:21141354-21141371
  Hypo
ggcgtgagccaccgcac

SEQ ID NO: 109440 - DNA, 68 bp, Homo sapiens; identical to SEQ ID NO: 76538
  chr14:21172544-21172612
  Hypo

SEQ ID NO: 109441 - DNA, 117 bp, Homo sapiens; identical to SEQ ID NO: 76539
  chr14:21190395-21190512
  Hypo

SEQ ID NO: 109442 - DNA, 24 bp, Homo sapiens
  chr14:21265229-21265253
  Hypo
gcacctggccgtagcttctaattc

SEQ ID NO: 109443 - DNA, 23 bp, Homo sapiens
  chr14:21282035-21282058
  Hypo
atgtttctggctgggcgcagtgg

SEQ ID NO: 109444 - DNA, 37 bp, Homo sapiens; identical to SEQ ID NO: 76542
  chr14:21287757-21287794
  Hypo

SEQ ID NO: 109445 - DNA, 18 bp, Homo sapiens
  chr14:21289138-21289156
  Hypo
agcactttgagaggccga

SEQ ID NO: 109446 - DNA, 20 bp, Homo sapiens
  chr14:21297174-21297194
  Hypo
aagagcgagaaaaaaattaa

SEQ ID NO: 109447 - DNA, 209 bp, Homo sapiens; identical to SEQ ID NO: 76545
  chr14:21341988-21342197
  Hyper

SEQ ID NO: 109448 - DNA, 132 bp, Homo sapiens; identical to SEQ ID NO: 76546
  chr14:21439185-21439317
  Hyper

SEQ ID NO: 109449 - DNA, 130 bp, Homo sapiens; identical to SEQ ID NO: 76547
  chr14:21492900-21493030
  Hyper

SEQ ID NO: 109450 - DNA, 251 bp, Homo sapiens; identical to SEQ ID NO: 76548
  chr14:21493570-21493821
  Hyper

SEQ ID NO: 109451 - DNA, 28 bp, Homo sapiens
  chr14:21609905-21609933
  Hypo
tggaaagctaacaaccgtcaggccggga

SEQ ID NO: 109452 - DNA, 32 bp, Homo sapiens; identical to SEQ ID NO: 43943
  chr14:21657875-21657907
  Hypo

SEQ ID NO: 109453 - DNA, 30 bp, Homo sapiens; identical to SEQ ID NO: 43944
  chr14:21721854-21721884
  Hypo

SEQ ID NO: 109454 - DNA, 30 bp, Homo sapiens; identical to SEQ ID NO: 76552
  chr14:21766806-21766836
  Hypo

SEQ ID NO: 109455 - DNA, 349 bp, Homo sapiens; identical to SEQ ID NO: 76553
  chr14:21769030-21769379
  Hyper

SEQ ID NO: 109456 - DNA, 30 bp, Homo sapiens; identical to SEQ ID NO: 76554
  chr14:21943010-21943040
  Hypo

SEQ ID NO: 109457 - DNA, 174 bp, Homo sapiens; identical to SEQ ID NO: 76555
  chr14:21980230-21980404
  Hypo

SEQ ID NO: 109458 - DNA, 248 bp, Homo sapiens
  chr14:21994140-21994388
  Hyper
ctgcgcatccccctccgcccccacccctgcccagcccgaccgaccctaccgcacctccgagctctgccggctccccgcagggcaccccgagacgagagctcctctcggattcgtgcgccatggttgtgggggaagtggagggccaggtggggtgggagacaatggatattgggattgagggaggcgatggccgctgggtctgcggcagcctctgcacccagcggcccagactgcggagatggagatcg

SEQ ID NO: 109459 - DNA, 30 bp, Homo sapiens; identical to SEQ ID NO: 76557
  chr14:21994769-21994799
  Hyper

SEQ ID NO: 109460 - DNA, 183 bp, Homo sapiens; identical to SEQ ID NO: 76558
  chr14:22004998-22005181
  Hyper

SEQ ID NO: 109461 - DNA, 38 bp, Homo sapiens; identical to SEQ ID NO: 43946
  chr14:22551269-22551307
  Hypo

SEQ ID NO: 109462 - DNA, 95 bp, Homo sapiens; identical to SEQ ID NO: 76560
  chr14:22763687-22763782
  Hypo

SEQ ID NO: 109463 - DNA, 32 bp, Homo sapiens; identical to SEQ ID NO: 76561
  chr14:22812323-22812355
  Hypo

SEQ ID NO: 109464 - DNA, 31 bp, Homo sapiens; identical to SEQ ID NO: 76562
  chr14:23028684-23028715
  Hypo

SEQ ID NO: 109465 - DNA, 176 bp, Homo sapiens; identical to SEQ ID NO: 76563
  chr14:23183874-23184050
  Hypo

SEQ ID NO: 109466 - DNA, 30 bp, Homo sapiens
  chr14:23290879-23290909
  Hypo
tttttgacagtaatgcgttaaaggcaaaga

SEQ ID NO: 109467 - DNA, 232 bp, Homo sapiens; identical to SEQ ID NO: 76564
  chr14:23291733-23291965
  Hyper

SEQ ID NO: 109468 - DNA, 23 bp, Homo sapiens
  chr14:23293758-23293781
  Hypo
actgcgcccggtttttgttgttg

SEQ ID NO: 109469 - DNA, 120 bp, Homo sapiens; identical to SEQ ID NO: 76566
  chr14:23339352-23339472
  Hypo

SEQ ID NO: 109470 - DNA, 94 bp, Homo sapiens; identical to SEQ ID NO: 76567
  chr14:23355390-23355484
  Hypo

SEQ ID NO: 109471 - DNA, 43 bp, Homo sapiens; identical to SEQ ID NO: 76568
  chr14:23355778-23355821
  Hyper

SEQ ID NO: 109472 - DNA, 29 bp, Homo sapiens
  chr14:23356236-23356265
  Hyper
ctcccaggatgccccggtgtgaccgccgg

SEQ ID NO: 109473 - DNA, 56 bp, Homo sapiens; identical to SEQ ID NO: 76569
  chr14:23399557-23399613
  Hyper

SEQ ID NO: 109474 - DNA, 206 bp, Homo sapiens; identical to SEQ ID NO: 76570
  chr14:23426887-23427093
  Hypo

SEQ ID NO: 109475 - DNA, 318 bp, Homo sapiens; identical to SEQ ID NO: 76571
  chr14:23450428-23450746
  Hyper

SEQ ID NO: 109476 - DNA, 30 bp, Homo sapiens; identical to SEQ ID NO: 76572
  chr14:23537948-23537978
  Hypo

SEQ ID NO: 109477 - DNA, 30 bp, Homo sapiens; identical to SEQ ID NO: 76573
  chr14:23545233-23545263
  Hypo

SEQ ID NO: 109478 - DNA, 34 bp, Homo sapiens; identical to SEQ ID NO: 76574
  chr14:23577687-23577721
  Hypo

SEQ ID NO: 109479 - DNA, 188 bp, Homo sapiens; identical to SEQ ID NO: 76575
  chr14:23652713-23652901
  Hyper

SEQ ID NO: 109480 - DNA, 100 bp, Homo sapiens; identical to SEQ ID NO: 76576
  chr14:23706665-23706765
  Hypo

SEQ ID NO: 109481 - DNA, 156 bp, Homo sapiens; identical to SEQ ID NO: 76577
  chr14:23707497-23707653
  Hypo

SEQ ID NO: 109482 - DNA, 285 bp, Homo sapiens; identical to SEQ ID NO: 43952
  chr14:23776954-23777239
  Hypo

SEQ ID NO: 109483 - DNA, 809 bp, Homo sapiens
  chr14:23821384-23822193
  Hyper
cagcgggggcgccagcgtgaagatggggtccgaggccatgcccagagccacgaagagcaccggcaggcagcagaggccgagctgcagctgctggccgccgcccagcgcccccacctgggcgagcagcgcctcaaagctgagggggcctgggggcacggccagcgacaggctgctgcccagtccgtcgccgcccgcgtctccctccccctcccgctcgcgctcccgctcaccctgcagctgctccgtgggcaccgcatctccgagggtcccgacctgctgttggggggcagggggtggcaggagaagggtgaagcggaggaaaccgcagagcaagggcagggggcaggtgggagggagggctaggaaggcagtcaggggcgagggatgcgcaggaggaaaatgccagacgctccgcgggggcgggggtgctgggagaggatggcgtcgccacctggggctcgggcacttactccgttggaggtgggggtgatctctacagtgttgtcgattttgccgccgcccccgccattgggctcgggggtcccggtggccacccggggagccagcttgccgaccgcaggggccctgccggcccgcgccgaaaggatgcgctgtcctctggctcagttgcgcgccggctgcccggacacagacagctcgaagagatcccgctctgcagctctgcagccgcgggcgcctccttggtctctgcgatctctgcgctgctttcccctccccttcctctagactctcctccccttcccacgtcagcagaaccttcggtccagactcttcgtcagagagaggaa

SEQ ID NO: 109484 - DNA, 965 bp, Homo sapiens
  chr14:23834172-23835137
  Hyper
gtggaggtctctccccggcagcctccactccctggtggactcaccgacgtggcaatggccatggctttggcctcccgcgcagcctgcctcaggccaggctcggttttgctgacttcagcggtggctgccccgcaccatggtccgcggcctctagcccccagctgtggcgcctgagtcgtggcctccgccaaggttggaggaggagaaagaaaacccacaaaacttcccaaatgagaggcaggctagccaggcaggaggaggagcggggcgggccggggcgtcgctgcgggacggcatccaagggcgcgcgctgcgtgctgtccccgcggcctcccgggcgccaccggctcggccaggccccgggagctgcccgccctaggccgcgggggcgccccgggctcgcaggatccgaaaattcccttcccgggccggggcgggtgagcaggcgggcgctgggctgcgctcgacgcctctccaggccgctcaggagagcctcgagggctgggagaagccgccggggcggttgggctggacgagcgagtttaggggccaaccgtctccacccgccggccgcgctgcagagcggtgctcccagggctggggtctgcggcgaccccgctgggaggaagggagagcgagaactgagacgcttgccccaagttgcctggagccaaaggcccccgagagcgtggccgtggggctgggtcgctggagtggccgcttcggcccagacactcgcacccccggcggtgcggcggttttcacgcgcgcactcactcagcgcgcccgggggtctgaggtcgccgctacggcgcctcgccccgggcagcagcaaccagcacgcaggcacccctggaacaggcgggactgccttcccgacgcgcggcctgcgcccaggcggcggaggggcccagcccccttccagtcctcggctccagggcgcagggccacgagctcccgctccc

SEQ ID NO: 109485 - DNA, 94 bp, Homo sapiens; identical to SEQ ID NO: 43953
  chr14:23884288-23884382
  Hypo

SEQ ID NO: 109486 - DNA, 49 bp, Homo sapiens; identical to SEQ ID NO: 76582
  chr14:23939668-23939717
  Hypo

SEQ ID NO: 109487 - DNA, 115 bp, Homo sapiens
  chr14:23982352-23982467
  Hypo
gcttggcactgatctcggggagagagagggagggaggctgggcaaagagcatctgttccctccattctcccagctccatcggctgccaacctagggccatcgtctgcctccatca

SEQ ID NO: 109488 - DNA, 93 bp, Homo sapiens; identical to SEQ ID NO: 43954
  chr14:24021398-24021491
  Hypo

SEQ ID NO: 109489 - DNA, 277 bp, Homo sapiens
  chr14:24045413-24045690
  Hyper
gctttcgggacgacgcgccgtcggcgtccccgggcccggccagcacgaagccgccccgggagcccgaggcggggctgcctccctcgtcgcccggcaagggcaggggcgggggtggcgtcggggggtcgctgtggccggaatccagggaggtgcggcggggcgagcgcagcagcgccgcctgatggtagggcacactctggcgtaccccgtagccgtggcgcttcccggcctgccactggccctggtaggtgcctgcgggcggcggaggggtgggaga

SEQ ID NO: 109490 - DNA, 30 bp, Homo sapiens; identical to SEQ ID NO: 76585
  chr14:24608282-24608312
  Hypo

SEQ ID NO: 109491 - DNA, 91 bp, Homo sapiens; identical to SEQ ID NO: 76586
  chr14:24682617-24682708
  Hyper

SEQ ID NO: 109492 - DNA, 1031 bp, Homo sapiens
  chr14:24803463-24804494
  Hyper
aagtctgtcagaacccggacagaaacgagaagcatccaggactcagctttctccctgagcagacccagaagggtagagtgacttgcccagggtcactgcagttcctagccaggctcaatggtcctttctttctctgctcccagcaacgaaaacacatcgaaaagaagaccccacaaaccccaaccccgaaaatgctccccaggtagagaccctcccgcagcagaggctcggctcaccctgccgctggcccaggccactgcgagcagcgccgcgagcgcacagagcacgatccccagcagcagcagcagcagcgggtactgctggctcaggctgtagtaggtctcgtagaagaggtcttcgctggggggcggccgggggctgaagaggcgggccatgatctccccagccccgagccccggggctggctagggccgggcgccgggttacctccttcggcccggcgggccccacctgagcttttctcacccgctcaaagccgctaccaccccgcgcccccaacctcgtggcaatcccgtctcctttttcaggccctccctgcggcctcccagcccgctcccagctggcgatgaggggatccctcagtcctttcctcctcctccctcaaacccggattgtagaggtgccctagaaaagcctcatcgccaggagggcaggatttggggttggtgcgagggagccccgggttcccctgatccccgaactcactgcccgcggcgctggcgcagcggagtgggctaggtccggggagggagccggggacctgatggcggagtcacgctcgccgctgcgctctggctcagagtcccgggcgacaggcgcttccctcccggcgccgcggccccctcccacttccccgacgggacagcccggccccttcctgtgccaaagccggactcccctggtctcctcccgcacttggttttgtctctcctaacaccatcgcctccccgcttcagccccttcagggaagggcaatgtggaccctgggagagatgcgaaggggtgggctg

SEQ ID NO: 109493 - DNA, 152 bp, Homo sapiens; identical to SEQ ID NO: 76590
  chr14:24808711-24808863
  Hyper

SEQ ID NO: 109494 - DNA, 80 bp, Homo sapiens; identical to SEQ ID NO: 76591
  chr14:24837744-24837824
  Hyper

SEQ ID NO: 109495 - DNA, 30 bp, Homo sapiens; identical to SEQ ID NO: 76592
  chr14:24860993-24861023
  Hypo

SEQ ID NO: 109496 - DNA, 153 bp, Homo sapiens; identical to SEQ ID NO: 15809
  chr14:24862082-24862235
  Hypo

SEQ ID NO: 109497 - DNA, 45 bp, Homo sapiens; identical to SEQ ID NO: 76594
  chr14:24868518-24868563
  Hyper

SEQ ID NO: 109498 - DNA, 66 bp, Homo sapiens; identical to SEQ ID NO: 76595
  chr14:24901940-24902006
  Hypo

SEQ ID NO: 109499 - DNA, 30 bp, Homo sapiens; identical to SEQ ID NO: 76596
  chr14:25156087-25156117
  Hypo

SEQ ID NO: 109500 - DNA, 250 bp, Homo sapiens; identical to SEQ ID NO: 76597
  chr14:25518419-25518669
  Hyper

SEQ ID NO: 109501 - DNA, 634 bp, Homo sapiens; identical to SEQ ID NO: 76598
  chr14:25518982-25519616
  Hyper

SEQ ID NO: 109502 - DNA, 309 bp, Homo sapiens; identical to SEQ ID NO: 76599
  chr14:26674308-26674617
  Hyper

SEQ ID NO: 109503 - DNA, 30 bp, Homo sapiens; identical to SEQ ID NO: 76600
  chr14:26960497-26960527
  Hypo

SEQ ID NO: 109504 - DNA, 124 bp, Homo sapiens; identical to SEQ ID NO: 76601
  chr14:27066218-27066342
  Hyper

SEQ ID NO: 109505 - DNA, 85 bp, Homo sapiens; identical to SEQ ID NO: 76602
  chr14:27066596-27066681
  Hyper

SEQ ID NO: 109506 - DNA, 239 bp, Homo sapiens
  chr14:27067097-27067336
  Hyper
gaaggaggtggatgccgagagaggagcgagcggcagaggagggcaggagccgggaaggagcgcggcggtccccgcgccgcgctagcgttgcgctcgctcccgctgctggtgctgccgccgccgccgctgccggagcggttctgccgttgcctgggctgctcggcgctgctgctgctgccgcccggtctcgctcattatttctcccgcttgttggggggggctggcggggagggaggggg

SEQ ID NO: 109507 - DNA, 95 bp, Homo sapiens; identical to SEQ ID NO: 76604
  chr14:27067604-27067699
  Hyper

SEQ ID NO: 109508 - DNA, 205 bp, Homo sapiens; identical to SEQ ID NO: 76605
  chr14:27068077-27068282
  Hyper

SEQ ID NO: 109509 - DNA, 96 bp, Homo sapiens; identical to SEQ ID NO: 76606
  chr14:29224711-29224807
  Hyper

SEQ ID NO: 109510 - DNA, 237 bp, Homo sapiens; identical to SEQ ID NO: 35156
  chr14:29225531-29225768
  Hyper

SEQ ID NO: 109511 - DNA, 534 bp, Homo sapiens; identical to SEQ ID NO: 76608
  chr14:29226033-29226567
  Hyper

SEQ ID NO: 109512 - DNA, 2202 bp, Homo sapiens
  chr14:29227651-29229853
  Hyper
cagcaagcagacagacgatatgatatgatcttaagggaccatctccaaaactgaaggagcagagaatgtgtaattcttttcccagtaaatccttccagttcctaggacaagactcaaacgtcccgctaggagctgcagctgcgaggtggagccaaaggctctgacaagtggcttgtgtatgacccaatatttatcaataacaacaacaaaatcaagtgaaaccaaggctgcggattttgaaatgcttctgcagccctggcgtggatatgcacgtgagcgaagtaaaagtcgctggagatgagttggctccacttgtccgccctggggagcaatcctggggcaaaatccagtgctaattgatcccaaccagccacattatcagctgtaaatgttcaaggggacaaagaatgagcattgtgtactaaagatactccaagcattttttcaagtaaatagggacgtgtaatcagtagcgtgtgtatgcatataaataggaaaagagaattatttttaattaattaggaaaataatgtttcatgtgtaattccagaattctctagcgtctcccactgtccgactgttttgtgattgggacttcctctaggaaaacctgcgggccctgttttgtgtttcgagcgggagagcagacactcagctcaaatagaggcctttctctcgtctttcggggtgtttattctatggccaaaaggtaagatggccaaggcagcgatctgagcgtgatgtctggccccgcggggggcccaggaggcccaagttgggacagctccggagctaccccggtgcccctcagctgggggagggcgcgcggcagccgcctgccagccccacaggctgctctccaaaggagctgggctttttcagcgtttctgtttccttgtagcctcatctatcttatctaacaagttcacgctccgggagaaaagaagagggtgagaaaaaaaaaaaagaaagaaaaaagaaaacctcttcaccgcggtgattcatagttcataggctccggagccaaacttgccgacccagcttttttctcgaacattactttctctcctacgtgccttaggacaaacccagaaggaagacactaaaattgccgaacaagaatctaggattgttttaaaaataaaagtgaccccccacagacacctttgatgttgttgattctgacacagaggagtcgagttgttttgtttacacatgctaacggtaacttgctcctgatgccgctctacgcgcagcttagtctgtcttctcctctcctccccgcaggcgactccttccaaagagcgagagagaaatacgggtattactgttatcccccactgggttcaataccccttacatgtaattgaatattcgaattaacgtcacctgcatgcaccccagtcttttaactctgaaatgtgctttatagcaatacagacttgaaacctttaactgttttctatatccccgcgtttaccgtggcagatgacctcttagcccaaaattgatttggtgtgtatccggtcttatgtgccaaaaaaagagatacctaggctgaaaaggcaactttaaggggggacatctagagagatgacgcctagaatcaaggcctctggctcgattgcgttcggcaagcgtctgcaacaaaggagcgtcgggcaagctcgcgggtatgcgcagggagcagcggcgcgcagacctgggagccccagctccgcgaagctcctcgaagggaaccctcgcagttacagcctcaagaggcaaggcaggggagggagaaaagctggacctcttgagaaacgctcctccaacagattttccatggcctcgtgttggagaaggggcgcgggggaggagcgagggttggggtaggaagacctactggaaccgactccggagagtgagggccaggtgggtgtaagatgagcacaaagtaaaaacttgcccattggtttgtccacgcaggtttcttgaaagaagcagatagatctgattagtagatactactttccccacgcaaagggagactttggggtgaagggttctctgcgtgcttcctggcttgcttaccccactcatgaagttttctctcctctcattccttcagacctttagtgggtgcaagcatttcctataagatacttattaatctcatatacggaccttgaactgttcaatgttttccgtgtacatttaaat

SEQ ID NO: 109513 - DNA, 378 bp, Homo sapiens
  chr14:29230851-29231229
  Hyper
ttttgctgaagatcacgggacttttcttttggctgcgtacgtacttggcttcagagagcctggaacacctggcagcgtcacagagacttgcctggagagtcccaggggtctctgtcaaggccttctcctcatccttgtcctcttcctcctcctgctcctcttcttcgccttggactttctcccttttaaagtggctccctagcttacacaagctaaacatttccactctcatagacgaggctctcccatagatttttttactcgaggttctcaagcaaaattgccggtgccacaatgttatgatggaaggatgctgaaatgacaggcctagtagacgcttgtcttaatcatcggcttcttaatttagttttagtgctg

SEQ ID NO: 109514 - DNA, 437 bp, Homo sapiens; identical to SEQ ID NO: 76612
  chr14:29231289-29231726
  Hyper

SEQ ID NO: 109515 - DNA, 1639 bp, Homo sapiens
  chr14:29234555-29236194
  Hyper
tccttttaaagcccccgattcgcaatttccccattcacttcaacctccaaccgaaccttcccagttccaaagcccaagaagctgggactgtgagatccacgttcccaaggctccccggtgctttccagcagcactcagggttggcaagagctggcttcagtatactgttatttcaggaatgaggcccgcacaaaataaaagcatttgagaaacggaaaggaaaaaaaaggagtgaaaataggaaggcttaaaaaaaaaaccggaaagaaatagacgcccacccttattttccctccaatgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaaggaaaaggaagagacacacgtatatagcatgtgttacctgatttatttcgagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgagtaagtaacccctgtttggccccgcgctcctctgcccacttcctcctcctcatctcatcgctcccaaagctctcccacaccctcctcccccgaagtaaaggacacccccgcacacacgccagcggtgggccttatctccccccttatccaaagctgcgctagactattacctacaaagggcacaattttcctgctggctcagaaatgccagacactggcctgcaaggccgactcggaaaagtagtgcctcgcctctacctcctccatttcctgccctctcgcatcctctccctgcactcccactcttcccactaccaccaccacccccgctttcaaaaataaaattggatacaaactttaatcactaaggacaaatattgacgcttaaacgaaaatgacccagtacaatgaggaggaagccggaaatgtgagctattggccctaggaggggaatttcggtggagcggagccggcggggtggagggggtggcgggggcgcagggaagggctgcggcaccgcgtgctcccgccggcgtatccctacgcggctccgcgcggcctcggggtccgaggcccgcggagagggggaggcgagcgcccgagggggcggcagccggcgggcggggcgggggtgggtgggcccggcccctccgattggtcgacggcgagagagacgctcccgcacgccgccagctctgattggcccagcggtaggaaaggttaaaccaaaaatttttttacagccctagtgtgcgcctgtagctcggaaaattaattgtggctatagccgcctcgatcgctgtctccccagcctcgccgcggccgctccgggacgcgcccgcccgccgcccggctctccccccctttgggctgctgctgctgctgctgtgactgctgctgcgagaggaggaggaggaggaggaagcagcgggggggggagcggggggtggggggggagaccaagaagtacagttg

SEQ ID NO: 109516 - DNA, 360 bp, Homo sapiens
  chr14:29236254-29236614
  Hyper
cttttcctttttttttttttttctaattcctgaggggtggttgctgcttttgctacatgacttgccagcgcccgagcctgcggtccaactgcgctgctgccggagcgctcagtgccgccgctgccgcccgcgccccccgcgccccgttcggcacccaccggtcgccgccgcccgccgcgccgctgtcccgctcccgcgccgccgccgccgtttccccccgacgactgggtgatgctggacatgggagataggaaagaggtgaaaatgatccccaagtcctcgttcagcatcaacagcctggtgcccgaggcggtccagaacgacaaccaccacgcgagccacggccaccacaacagccac

SEQ ID NO: 109517 - DNA, 1219 bp, Homo sapiens
  chr14:29236674-29237893
  Hyper
caaccgccgccgccgccgcagcagcagcagccgccgccgccgccgcccccggcaccgcagcccccccagacgcggggcgccccggccgccgacgacgacaagggcccccagcagctgctgctcccgccgccgccaccgccaccaccggccgccgccctggacggggctaaagcggacgggctgggcggcaagggcgagccgggcggcgggccgggggagctggcgcccgtcgggccggacgagaaggagaagggcgccggcgccgggggggaggagaagaagggggcgggcgagggcggcaaggacggggaggggggcaaggagggcgagaagaagaacggcaagtacgagaagccgccgttcagctacaacgcgctcatcatgatggccatccggcagagccccgagaagcggctcacgctcaacggcatctacgagttcatcatgaagaacttcccttactaccgcgagaacaagcagggctggcagaactccatccgccacaatctgtccctcaacaagtgcttcgtgaaggtgccgcgccactacgacgacccgggcaagggcaactactggatgctggacccgtcgagcgacgacgtgttcatcggcggcaccacgggcaagctgcggcgccgctccaccacctcgcgggccaagctggccttcaagcgcggtgcgcgcctcacctccaccggcctcaccttcatggaccgcgccggctccctctactggcccatgtcgcccttcctgtccctgcaccacccccgcgccagcagcactttgagttacaacggcaccacgtcggcctaccccagccaccccatgccctacagctccgtgttgactcagaactcgctgggcaacaaccactccttctccaccgccaacggcctgagcgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctgggg

SEQ ID NO: 109518 - DNA, 102 bp, Homo sapiens; identical to SEQ ID NO: 76623
  chr14:29242506-29242608
  Hyper

SEQ ID NO: 109519 - DNA, 114 bp, Homo sapiens; identical to SEQ ID NO: 76624
  chr14:29243157-29243271
  Hyper

SEQ ID NO: 109520 - DNA, 779 bp, Homo sapiens
  chr14:29243513-29244292
  Hyper
ttaattagcttttcccggcgcctcagggactccggggtgaagatggagaggtggcataatggcgggacttgaagtcgttgtggcagggacctggcagcgttgttttctcgggttttgaaccggtgtggagaagtaacttcagctgctgagttggggccgccctggctgcgcggtggcggaggaggagaggagaagcgctctcgggacattgcggcggcgatccccgcagagggtgaagccgggcgctgcgcagggagcagcaacatgagggcgctcttgcccaggacaagcagagctgtacgtttgggtagctcatattggctgatgccaagaaaagtgacttcagaaccttggctggcgcgcttccctaccttttccctttcttcttaatcttctgtgtgccaccacctccccccaaccttttttcccctcccaaagttgtttccttttgtttacccggtgcggtttcagatctcagcacttctcagctagtagataaaattatttgctctgtaatggacatctcttctcctctccacttgttaccccactcgcccttcgctttctaccccattttgcttctctctgcccaagcctgtggtccaaggtgcagggatctcacaggaaaacaggtagcctcggggtgggaattcccagagcactgaaggcgccggttgttggccagagggaggccgggactccggtgggcagagtaccccgcgagtgcggagattttcaggctgtaatcttcagtctgggaaaggcgatgggaaggaagg

SEQ ID NO: 109521 - DNA, 645 bp, Homo sapiens; identical to SEQ ID NO: 76627
  chr14:29247097-29247742
  Hyper

SEQ ID NO: 109522 - DNA, 1046 bp, Homo sapiens
  chr14:29254087-29255133
  Hyper
agtggctcatatggtcgttctgtgttttgtagaatacgtaggggactcctgaaatgtgtgggatgtaggtaggggcgggagcgactctgtggggagagaagggagaaaaagattgagagaaggaaagagaagtgtatttgcaaggcaggctgacaatttctcaattaatttggggcagagacagaaagactccgagtttctagcttcttttctatacctcagataaaaaactgaagacagccttattctaacaactcaatttaaaaagagcccccctgcgtacgtccccgcacccctttcgccccagcggccgctcacaaagcgccacccgcgcctcgggcgcccgcagaagccggagccagttctcagccctgatcgccgccagccgcccaggcttcggggaaggagggaggggagaataatgcgcccctctttcaataaacgccactgccaaccactccaacagacacactttcggtcccccgccagagctccggtgcccccgagtgaccgctttctgcgatcgcgtccgccgggaccccgtccctctttccccttcagtcttcagggagggggaggcgctccgcattagcggggcagttcagcaaccccgaccccacccgcgtggctccaggcccaggggtccgttcacttccccgtccggtttgggggacgccaattcgcctaagaaaaccctggcagaagagcgcggacccttcactacaaacctcacgtcagggttacagccacatttaggaacctcttcggaaaagctgagaaatcactgttttgcaaaaagccttctgtactgtgatggggctttgtggtgagaggaacctctgagaagcctcgtgcggcttgagtttagagtcacgccctgcccagcgacattctcccgcgcacgggagaacctgcacttccggtctccaaccctcgcgggccgtgactcttcccctcccccgcgccgggccctgcatttccggcccccttgctctcctgcacttccgcccagtcacatggatgatggatagcgttgggagctgttt

SEQ ID NO: 109523 - DNA, 30 bp, Homo sapiens; identical to SEQ ID NO: 76630
  chr14:30066780-30066810
  Hypo

SEQ ID NO: 109524 - DNA, 23 bp, Homo sapiens
  chr14:30126794-30126817
  Hypo
gggcgcagtggctcacggctgta

SEQ ID NO: 109525 - DNA, 30 bp, Homo sapiens; identical to SEQ ID NO: 35181
  chr14:30396081-30396111
  Hyper

SEQ ID NO: 109526 - DNA, 128 bp, Homo sapiens; identical to SEQ ID NO: 76633
  chr14:30396380-30396508
  Hyper

SEQ ID NO: 109527 - DNA, 478 bp, Homo sapiens; identical to SEQ ID NO: 76634
  chr14:30396920-30397398
  Hyper

SEQ ID NO: 109528 - DNA, 57 bp, Homo sapiens; identical to SEQ ID NO: 76635
  chr14:30739946-30740003
  Hyper

SEQ ID NO: 109529 - DNA, 142 bp, Homo sapiens; identical to SEQ ID NO: 76636
  chr14:31027434-31027576
  Hypo

SEQ ID NO: 109530 - DNA, 34 bp, Homo sapiens; identical to SEQ ID NO: 76637
  chr14:31309552-31309586
  Hypo

SEQ ID NO: 109531 - DNA, 1298 bp, Homo sapiens; identical to SEQ ID NO: 76638
  chr14:31343340-31344638
  Hyper

SEQ ID NO: 109532 - DNA, 157 bp, Homo sapiens; identical to SEQ ID NO: 76639
  chr14:31534496-31534653
  Hypo

SEQ ID NO: 109533 - DNA, 40 bp, Homo sapiens; identical to SEQ ID NO: 76640
  chr14:31713750-31713790
  Hypo

SEQ ID NO: 109534 - DNA, 100 bp, Homo sapiens; identical to SEQ ID NO: 43959
  chr14:31925624-31925724
  Hypo

SEQ ID NO: 109535 - DNA, 172 bp, Homo sapiens; identical to SEQ ID NO: 76642
  chr14:32597712-32597884
  Hypo

SEQ ID NO: 109536 - DNA, 82 bp, Homo sapiens; identical to SEQ ID NO: 76643
  chr14:32671453-32671535
  Hyper

SEQ ID NO: 109537 - DNA, 16 bp, Homo sapiens
  chr14:33163277-33163293
  Hypo
gtccatggggccaggc

SEQ ID NO: 109538 - DNA, 936 bp, Homo sapiens
  chr14:33401981-33402917
  Hyper
cacagatgctcattacgattctttttacgtgcaacacgtgggggacgaagcagtttcatatctcctggtattatctgccgtccaaagcattttctttgaaaggaaaatggaaacgcagctgcgccgtgggcccggccagcgagagctggggctccctccctctgtttcccagcggctgccgggtgcaggaggcgcctccggaaactgacttgggttaggggagttcagaggttgccccagcaggcgcgggacgccgccagggcgaaggctcgtctttgtgcgggttggctgtttcccgagagccatcagggtgggaggggacgcccgggtctgcggcaagggcaggcgtctggcccctacaccgtgtgcggggacgctaggctgggcggcctgtgtcactcttggccttggcaacttctggccaatccgccctgcccctctgggtcccggcgggccggctgcgccctaggctcaaagggttaagcaggtgcctctccgggcgaggcgctattggccgagggctggggcggcgcggccgcggtcaccacgcttcgccgatcccaacttgggttcctgcggaaggcaaggcggccactcgtcccctggctgcggctgcggggcccaggccttggcgcgcagggagtgggaaggagaaaaggacgagaaggggcaagcaccagccgcaccagcaaagggggcgagggtggcgcgcgcaagatgaggggagctgaagccctgcatcccgaaggaggctgcgcccaccgcccgcaactccactccaggctcgccagccggaagaaagaggaggaagtgggacaacgggggtcctgggcaggggtaggggaaacgatcaactcccactgcccccacccactagtcgagttggaatgcaagtcgtcacttaaaaaggctcacccaaaccgcaggcatacctcc

SEQ ID NO: 109539 - DNA, 1208 bp, Homo sapiens; identical to SEQ ID NO: 76648
  chr14:33403210-33404418
  Hyper

SEQ ID NO: 109540 - DNA, 88 bp, Homo sapiens; identical to SEQ ID NO: 76649
  chr14:33407604-33407692
  Hyper

SEQ ID NO: 109541 - DNA, 27 bp, Homo sapiens
  chr14:33407752-33407779
  Hyper
cgtacgagagagcgctctggagcaaag

SEQ ID NO: 109542 - DNA, 98 bp, Homo sapiens; identical to SEQ ID NO: 76651
  chr14:33408303-33408401
  Hyper

SEQ ID NO: 109543 - DNA, 204 bp, Homo sapiens; identical to SEQ ID NO: 76652
  chr14:33408623-33408827
  Hyper

SEQ ID NO: 109544 - DNA, 84 bp, Homo sapiens; identical to SEQ ID NO: 76653
  chr14:33408887-33408971
  Hyper

SEQ ID NO: 109545 - DNA, 30 bp, Homo sapiens; identical to SEQ ID NO: 76654
  chr14:33801361-33801391
  Hypo

SEQ ID NO: 109546 - DNA, 20 bp, Homo sapiens
  chr14:34408709-34408729
  Hypo
ccggccgaaacaatcttaaa

SEQ ID NO: 109547 - DNA, 242 bp, Homo sapiens
  chr14:34419561-34419803
  Hyper
ccgcgggagcagctgcggcagggcgccgagcgcgtcctaccttagacctctccttgacgtagtatttgcccagccggctcccgcagtagaggaccagcctgtcgatgagggacaggaggaagctgatggcctcgcagccctcctcgttgcccccgatccacgtgatctggtcgccccgcaggtgtcgcttggagacgccggcgcgcggccccgccagctggccgtcccgcagggccccggtg

SEQ ID NO: 109548 - DNA, 367 bp, Homo sapiens; identical to SEQ ID NO: 76657
  chr14:34420004-34420371
  Hyper

SEQ ID NO: 109549 - DNA, 53 bp, Homo sapiens; identical to SEQ ID NO: 76658
  chr14:34499201-34499254
  Hypo

SEQ ID NO: 109550 - DNA, 213 bp, Homo sapiens; identical to SEQ ID NO: 76659
  chr14:34529691-34529904
  Hyper

SEQ ID NO: 109551 - DNA, 19 bp, Homo sapiens
  chr14:34554235-34554254
  Hypo
gaactcagccaggtgcggt

SEQ ID NO: 109552 - DNA, 23 bp, Homo sapiens
  chr14:34920639-34920662
  Hypo
caattctaggctgggcgcggtag

SEQ ID NO: 109553 - DNA, 16 bp, Homo sapiens
  chr14:34921211-34921227
  Hypo
tagcgtggtggctcac

SEQ ID NO: 109554 - DNA, 80 bp, Homo sapiens; identical to SEQ ID NO: 76663
  chr14:35009476-35009556
  Hypo

SEQ ID NO: 109555 - DNA, 180 bp, Homo sapiens; identical to SEQ ID NO: 76664
  chr14:35017114-35017294
  Hypo

SEQ ID NO: 109556 - DNA, 461 bp, Homo sapiens; identical to SEQ ID NO: 76665
  chr14:35023150-35023611
  Hypo

SEQ ID NO: 109557 - DNA, 92 bp, Homo sapiens; identical to SEQ ID NO: 76666
  chr14:35024362-35024454
  Hypo

SEQ ID NO: 109558 - DNA, 30 bp, Homo sapiens; identical to SEQ ID NO: 76667
  chr14:35032127-35032157
  Hypo

SEQ ID NO: 109559 - DNA, 43 bp, Homo sapiens; identical to SEQ ID NO: 76668
  chr14:35133216-35133259
  Hypo

SEQ ID NO: 109560 - DNA, 35 bp, Homo sapiens; identical to SEQ ID NO: 76669
  chr14:35507693-35507728
  Hypo

SEQ ID NO: 109561 - DNA, 30 bp, Homo sapiens; identical to SEQ ID NO: 76670
  chr14:35838869-35838899
  Hypo

SEQ ID NO: 109562 - DNA, 107 bp, Homo sapiens; identical to SEQ ID NO: 76671
  chr14:35866805-35866912
  Hypo

SEQ ID NO: 109563 - DNA, 404 bp, Homo sapiens; identical to SEQ ID NO: 76672
  chr14:36002600-36003004
  Hyper

SEQ ID NO: 109564 - DNA, 1468 bp, Homo sapiens
  chr14:36003546-36005014
  Hyper
ggccccagggggcgccgcccttcttggaggaggctcccagcgcctccttgcccggcgcggagcgggcgacaccccccacccgagaggaaccaggaaaggggttgacggcggaggcggcccgggaacagtcggggtcgccatgtcgggcggctggggtgagcccggggacgggcgggcgggaaggcgcggagtggcgggcgggtggcagggaaggtcccgggcccagccccagccccagccccagtccagcgaagccggcaggcgcagagctgcgtcgggcgttcctggagcgctgcctcagctcgcccgtctccgccgagtctttccccgggggcgccgccgccgtggccgctttctcctgctccgtggcgccagcagccgcaccgaccccgggggagcagtttctgctgccgcttcgggcgccgttcccagagcccgcgcttcagccggaccctgcgcccctctcggccgcccttcagagtctgaagcgggcggccggcggcgagcgccgcggcaaggcacccacggactgcgcgtctggacccgcggccgcgggaatcaagaagccaaaggccatgaggaagttgagctttgccgatgaggtgaccacatcccctgtcctgggcctgaagatcaaggaggaggagcccggagcgccgtcccggggcttggggggcagccgcacgccactgggggagttcatctgccagctgtgcaaggagcagtacgcagaccccttcgcgctggcccagcaccgctgctcccgcatcgtgcgcgtagagtaccgctgccctgagtgcgacaaggtgttcagctgtcctgcgaacctggcctcccatcgccgctggcataagccgcgtcctgcggctgcaaacgccgccacagtctcctccgccgacgggaagccgccttcttcgtcgtcttcgtcctcccgggactccggggccattgcatcttttctggcggagggaaaggagaacagccgaatagagcggactgcggatcagcacccgcaggccagggacagctccggggcggatcagcacccggacagcgccccgaggcagggcctccaggtgctgacgcatccagagccaccgctgcctcagggcccctacacggagggggtgttggggcgccgggtacctgtgccgggcagtaccagtggtggcaggggatccgagattttcgtgtgcccatattgccacaaaaagtttcgtcgccaagcctatctgcgcaagcacctgagcactcacgaggcgggctcggcccgtgcgctagcgccgggctttggctccgaacgcggtgccccacttgccttcgcttgcccattgtgcggagcgcacttccctacagcagatatcagggagaagcaccggctgtggcatgctgtccgcgaggagctgctcctgcccgctctggcgggggctcctcccgaaacgtcgggccctagcgggccatctgacgg

SEQ ID NO: 109565 - DNA, 93 bp, Homo sapiens; identical to SEQ ID NO: 76677
  chr14:36458302-36458395
  Hypo

SEQ ID NO: 109566 - DNA, 30 bp, Homo sapiens; identical to SEQ ID NO: 76678
  chr14:36790254-36790284
  Hypo

SEQ ID NO: 109567 - DNA, 1160 bp, Homo sapiens
  chr14:36972706-36973866
  Hyper
ctgactttattcttacggaattaaacacaataatttttttaaaatatcttctttgaggcaagtgaccacgagagcacctgttatttaaaagtttattgggtagtttaaaaagcggtgtctccctcttcccccttcaaaaataaatggcattgaagtcctccgtttctcttgtttagatcctgcggttggctcgctcatgaatattaactgagaaaggtgaagcagtaatttagggaatcgaatcaaactcactaggagcaaagaagtggtcctgaatcaaaatggaataaacgataacccagagtcattgtcaagtctcccaaatgaagagatgttctgggtaaataaaagtgacaaagtcgtaccacataaacaaatgtagaagatagatgccccagatcaagaaatactactaaagtgacctgacttgacagtaattgcaggcagcttttgagaactgcatcggggttaaacggcagagatcctgacgacctgggcgaccgtccctgcgcagcccggcgggaggctgcgcccagaatcctgggctttgggcctctggggcccggcgaggagatgaagaagtcaagcctcgagctctccggaggttcgatggccgccgggccagtgcgggctcagaggaagaccctgcaaaaaagagcgctcgcccccacccctggagccgaccctgcgcagtagggccgcagccggtccccgcgggcagctcagcgggcgcgggcgggaggctcccggaacgcaggctgaggtcaggctgaccacgccgcctcctcagtcgccgtatcgcggggctggcggccagcgccttagaagagcctgctccgccgcaggaagaaagacgcccgacaggcgcccactgcccgaacccacgcgggggccagtcagccagcgggccgtgttgggaaagctccgcgcggcggcgggacataggatccccatcggggacctgggcgacggcctgagcttgggcgcccctccagctgggcgtcatctccacacagttcttcccttgcgccgcgaattcagcccctgtgaagacgctttgggcattggcgagcaacaggggaaaaaacgagtcacttaaatgggagaaggaaggggatggtcatgaggacttggaggaaaccacacggaaaagaaatcct

SEQ ID NO: 109568 - DNA, 1025 bp, Homo sapiens
  chr14:36974507-36975532
  Hyper
gagatgaaacaaattcgcccaaaagatagaaatctttgcctcggaaattatcggagaatattaacggagagggaggggagcgcgcgggtcgccgaggaaggacgcgggtacggccccttgctttggggtggcagagccgggctcaggagccagccaagctgacttcgcgaggtggcgcctgggcctttcgggggaaagccccgacggcggagccgcggctgggcggggactcaaatgctggcggcctctgggctggggccgagcagggggtgccgaccgcgggaagtctgggcggccgccctcccacccagacgagccgatgctgggccgcggtccctctcagctacctcgcttgcccgcctcggggcccctggagaggggtctgtgcctcccaggcagggaagcgtcttgatgtgcaccccggcgttcaccaaccaaataagggcctcgctcacacagtcgatgtcatgctgggtattaaaagggttgtgctgcagctaaaatatctcacagtgtgtgtgaacctcataaaagggaggacccggattccaagcccctcgaagtccccaagcagcctggagggtgggggactcccctctccttctctccacactgagcccccgggcaagcccaggcctcctcctgcgccggggtccccgggctccgaaactgcgagagccctgcggagcccggccagaggggcagagggtgggggctgggggcggggacctggggggtgcagcccagccagaacccgcggcctagcctgatcgcggggagccgggatccgccttccatcctgggaaacgactcgggttagggaagcgggatgggctccgctcggagttcccaggcagctggggcgccctccaagtgacgcctttgtccaggctgcgctcgcggagaataaagggggcgctgtccaacctcaggttcggggaaaaccaaggaaccaagggactctttttctaaaatgccctctccaaactacagggaggaggaatgggacacgtgtgcagaaaaag

SEQ ID NO: 109569 - DNA, 30 bp, Homo sapiens; identical to SEQ ID NO: 76685
  chr14:36976704-36976734
  Hyper

SEQ ID NO: 109570 - DNA, 1345 bp, Homo sapiens
  chr14:36977343-36978688
  Hyper
caaagaaagattgtgcgttaagatcttttttaaaaatccctgcaagttagagtttgcatcatcgtcgtgacctagtgaactaatatttgtatattctgggatcgaaattccgaggaagtttctgctcttccgcacaccagacttgccggtgtggtctccaggaggggttgggggccgcgtcctcagggggcgcgcggccgaggctgttcccagcgcgggaacgggagggagaacctgggcaggggcggggcggggcggggcgcggggacctgggtacgcggagacgcggggcgggcgggggccgagagcgaggctgccggctgggtgttgggagagaggccgcgggtggacggggtaaggactgggactggggagactgagagctggggggtgcggggaggatgaggctgcggacaggaaacgaagggcctgggacagctgcttctcttggtcctagaaaccaaactttcgtagcgagagaccctaagacagctcgagatttcaagtgtccacacttctagtttagacatttggcaaccaattcggaacagccgggccgcgaggggcccccaggtctttggcggcgtcgttgggaggccgcggagttgtccctgggcttccctgaaggccccgcagactccccgccagtcccggccacacccagccagggctttgcagctccagcctgagaatgttagccccggcaaccccttctggcggttgttcctttaaaaaccaattcattttttccatcaagtcttctacccaatgggtagactcttcgttaaatgactgttaaccagtactgaggagaagcacaatcaacatagtttctctgtcacctttcttgccggttttttcctcccaaccatggagtctccattttctaagcaattaaattatatattcaacaggaacattccatttaaaatggttcgggacagaagactgatgcacaaggtctgaagctggaagaaaatatttagtgcttgcctacagattctgtcacccatcatctgctcggaatgcgctccgtatctttcagcgtgtccggctcttatgattgcaaatggccctgttttcaaatggaaataagacttgcaaactgattatgtgtattgaatcagaatcactcgctagatcctcttgtttaaaatgtattgaaaaaaggatgatgggtgcagacctctgtaaccagctctgtctcttctctgggaggtcgatctattttgcaactttttgccatttgagcgtgtttcagccagataattacgttgccattgtgttaccggcccaaagctcagacagggtacacacaccaccacccagccgtctcccaggccct

SEQ ID NO: 109571 - DNA, 67 bp, Homo sapiens; identical to SEQ ID NO: 35211
  chr14:36979742-36979809
  Hyper

SEQ ID NO: 109572 - DNA, 2774 bp, Homo sapiens
  chr14:36981839-36984613
  Hyper
gaacatggtgtccagcgtctcctaaccaggatctagccgagcagagaaaacattcagcctcctccctcccaatacccgtgtctgtcactttctttccattcaaaaagaaagtcctagttgaactaaacaagccagtaacccatgcctaagaatcatatcatctcagattctcatctcccaatgggctttctagttctccacaaataaaatcgtctactctgcttcctcgcgctaataattggggggtggggagcagggaagggagagcgatgtctggagacatatgatcagaattcaaggcagcttctcacaactctcttgtttatagaaaatgaatgtctgcctggcttgcttttagttcagaaaaggggtcagtctttatcagcacggttcacacagatcctggattttttttcccttatcttaaattgacccgcttttaagataaagacataatagagaaagcattgaccttacctggtccctaatgagttggaagtcagaaaacccggctctcatttcctcttatctggatcgcctgagaagagactcgcgctaccttttgtgcactcgcgcctcgagatagcccctcactgacgcctggacgcggtgagcgcgctgaaggctgtgcggcctctaaagtctcagaattcctccctgcggcctcaaaattggagagttggattccagaccaagacactgtcactagagctccctagccctggcccaggaagatttaaaatcccttaaaatcccttagacttgctcccgagcaagtctttccctatgaaaggccaaactctaagcttcgtgaagaagcctcctacaaggacactggtctggagcgcccgggcctccgcgtctccaggagtgcgcgcccagagcgtttctagcggagactgcccaggcctggctcggatttcagtcgcggggccccaggctacttcccaccgggccagcagcagggccgagccgctgccctgttggctgaggcattccctgcccccacccccctcctggccttgaggaccgcagtgtgtacccttgttggtagcggcagcagcccgggatccctgtctcccctgctcagagcatctctgtctcgctcttctccccgcttctgagcttggcccagtccctgaccccctcgctagctgagagagctgctttccttcctctcctgcccacagctcccagttcccaggctggggccagggtggggagcagctttgggatgctaaacatcaaaaaagcccagcctggggtttcagggcccgaagccactagagcggctctccaaggctctcgagaaagtcctagtgtttacatggcgaagtgggggtggggagaggaggaaggggggtgcagtgtgcaaaatctcccccactcctctcagccgttggggcctagggatgggtagggtactttggcggaggcaaagcttcgcggtgatctcggggtgaaccgtacttgctcccaaacctcggaagcttccaagcacctcagcgccaggggcatcctcagaatgctgatttctccgagaggggaggccagaaattgggcacgagttgatgcaggagattcccagaaaggaggactgtcggctttccagaagccgacggtgctgtaggggcggagggtgtccccaggttgcggaaccctcttgcactgctcccagcgcgcacctatttccctaatgaaacgcttcagattgcgttctaggtctcttcccgcagctgcgacaattcccccagccgggagcgggagcggatggagccagcgtaattgatggcaagaaagaggctgaggtcctgtttgtctcggtccgcaaacccgattgagttcacctttccccgggacaagtaaacagacttcaaactatgccgactgtagacggcgaggagaagaatgtatttgatggaaactccatccaatgcaaagatgataaggccgagggtgccacagcctactaaaattgtgactcccaaaggcttcctcccagctagaatggggtgcggggcagccgccagaaccacagccgggcaccgccagccaggtccccgcccgggcttgggctaggctggggcaggttaagcgaagctccaattccgtgggatccggacctagagccaaacagcagctgcagtatccatgtcccctgcccggccggcctgagctgggtgccttagccacctacactcccggtcccggaaccacagctgaccattccaacgcaagtggtcaaatttgtttgttttccaaaacgtgagacctgttaaaatctcccttccccgccttccaacaagcactctcactagacccaaccatcctcttgggaatcttcgagtccctctggctgttggaaactgtgtctcagcagtgaggcccaggtttctgagggagaaagcccggcctagcccacagtcttaaggcaccacgccagaggaggctccaggaagttaacaaagaggactgctgggcccggagcgaggactccggccagtctgctttcctcacaagctcttggtgggggagcgggagagagggattgggaagagatgcagacgaataacgaaatgagagaggggaagagaggaagaaaaagaaagttgaaaacctgggcgagaagtgagtacatgccaaataagaatcaattgcccataatccaatacttccaggcctagaggaaagtgctgggaggggcgtctgcccgcagctggctcagctgcctttcgaccggagatttggcaagggtgacccggaagggctacagc

SEQ ID NO: 109573 - DNA, 98 bp, Homo sapiens; identical to SEQ ID NO: 76693
  chr14:36985841-36985939
  Hyper

SEQ ID NO: 109574 - DNA, 2013 bp, Homo sapiens
  chr14:36986140-36988153
  Hyper
tgtgccccgccctagcgtggaaaacccatttgaatcaccaaaaaaagacaccccaaagctgttttatgcccttctctgcttaaagattccttgagattggatgcgcttggttgtttttcattttctttttttaaaaaaaaaaacccacaaattttagggggggaaaaaaagaaagacgtccagcagtttggcctttgtggtttttttgttccttggtctaaacgcggccaggttgttaagaaaagtcgaagcgcgtggagcagcggtggatggtggtctgtgtggcgggcaggagggaagcggtgaggcagagcgctgggctagggccggcccggcgtcctctcaccaggtccgaccgtatagcaaggtggagcaggacatggtgccgtagtccgagcccgaggagttcaggtgggacaggctggatacctggccctgcagcgccgcggggctggcggcgtggtgcgccaggtccggagactggcctgcgctgcctggctggtggcccgggtgtgcgccaaggccggcgccaccgctgcccacggagatggccgctgccgccgcctgcgcggcctgcgcctggtgctgcgcctgctgctgcgcgtggccttgtaggctggcggcgcccggcgcgggggcacccgcctggcacggtttgccgtctttcaccaggaccggcaccgccacgcgtcgcggcgactgctgctgagcctgttgctgctgcgggcacccggtgcccccgccgcccccgccgccgccgctgtcctgctgcagttgctgctgcgccgccttgtccttggcctggcgcttcattttgtagcggtggttctggaaccagatcttgacctgcgtgggcgtcaggtggatcatgctggccaggtgctcgcgctccggcgccgacaggtacttctgttgcttgaagcgtcgctccagctcgtacacctgcgcctgcgagaagagcacccggcgcttcctgcgcggcgcgcttggcagcggggccatgttcttgctcacgtcccccagcgagcccaggccgcccatgccgctcatgttcatgccgctcgccgggcccatgaagcgggagactgtaagcgacaaacgcacagcgtcggccggggccaggccgagccaggccacccctgttttccgcgccattggcccgcccggcccgccccaaccgacggcgccctcctgacccaggcagcctagcgctggggcccaagaggcccatccgcggggaactgccagcgcctgccccaggccgtaccgtcgagggggctgtactggagcgctcacagccccaaccctggctgccctccctcagtctcagttccctctttcgaaccaaaagacgcagtgggggaaaggccgcttctgctcctttcgtgcccagcccgggtcagagcattaggattagctggccacaggcggcgaactgggctcaggccgggagctggggtcctacggtagaccccagtttggagaggttaggagagggggtgttgacttccaaaagctggagcccccagacgctttgcctcttggcttctctcctgtcaggccccagtgagggcacctgctcggacccttagagtcccctctggaactgcgagtcctcccacctgcccagactccgctggagagagggccgggccgggcgctcgagtgcctcccaacagggcagcctccctcctggcccggtctagcctctccgcgctctgctcgcccctgctccttgagctcggggtcgcttcccttggctccccgaggtcttctgcgccgagcagagctgccagtccaccgcgcctaggagacgccgagtacccgcatctgaccgcaggaccccagcgctaccaagtgcctgttcttggacccccagccgagcagggggaagcatccccagctcccgcacccaagtccctggcgccgctgccgggccgccctccctgatgcccagcgcgcagcctgccggcgccgcgccttctggacggctctcgccgcacctcctgagct

SEQ ID NO: 109575 - DNA, 93 bp, Homo sapiens; identical to SEQ ID NO: 76696
  chr14:36988551-36988644
  Hyper

SEQ ID NO: 109576 - DNA, 2151 bp, Homo sapiens
  chr14:36989186-36991337
  Hyper
tcggtcggggttccccgggcacggacaggtctttaggaggagggggctgagggacagggtgggggtttcacctgagcctgccggggctgctcctccctcccgccgcggcctcccagccccgcgccttcccactgcctccggaccacatcgggcttcgctgcgctgagccccagtcgccaacaaatgagcgagcgagtctggggacgaaccctggggccgcactgttggtctacgtgtctgtcagtctgtctgcctctcttctgccgccgtcagagggacacctctgctccccgccccctttccccctaccggagagaatccgagcgggcggagggggcgctgagtaggggatcgactgcctcccggaggctgtcccggatccccgagccacaacccgcccccgcagctcaggggtttttcagtgggccacccccgctaacacgcctcccccaaggtcttccccccccccccccacccccggccgagcaaacacagcactggcccccagagctgggaggatgggaaggggtctcacgggagggtccgtcactgaagttgccccacctcgaacaaacctggtgtccctgaccctcgcccatctcccagacacgcggggatctggggctggagctgactttccgaggacatcacagccccagcacccgagcccagagccacgctgttttcccctctgatgcttcagggagcgcgcgagcagggagcggcgtgagtgcccgtctgtctgttgccgggcggaactgagcctgaaccccggcggctggagcgctggccaggagggggcgaatgccgaggtgcgggcagctcagcgggcgggaggctgggccgaggctcgcctccgcccgcagctcagccatgcaaaagtgctcttgcttcccgggaataaccaaatatctttgtttaaagtggtggcgtaaatggccagtcgctttgtggccacgctggatattagtagatgaggatcattctgcttcaattgggcgcctctcatccgacgagcaagaaactgcttaggaggaagagggtttcctgtctgcgcgttcccaggcttcaagtgtgggccccgcgccttgagggtccttgggcgcctggcgagggggagctgtgggctgcgctccccagcggaatcgggggtgtcccccgcgttgctccggccaggccggggcctgcagccgagtcgactaccgagtggagcactgaacggcgcggattttgagaccgactccggtttttgtccttggattttaaacgtttttatcattgtttttgttttgctttctccttagctgttttagtctcctctgcgcgccaggggctgggagggcggagcgctccccggccggccccggcaggtgcctccaagacacccgcgctggtcaaggagcttcttgaatttagtttttgttttcacattttctttcccctccttgtagagaaggagctcctgatcatgacgaacaggcagttttgagctacttaattcatccgggctccctttttttattaatagcaattacagtagagaaagttttatttatttttaaagatttcagccctctccttgaagagagctcttactccctcaatacaaagccaacttctataataacattcgcttttctcaccgcctaccttctttaccagggtaaagaaagctcaggacaccctccgccctcccacctgcgcccgcgtttttgtgcggtccccacggcagagctggggaggccaccctacgtttgcgcagggagacgcgctcgccgctggtgttgcgaaagaccagagcgaagcccggctccttgcccttccttcccaggggcttctctggggggcgctctcaggccccgacgaactgagcattgatcactgtggtggctaagcaaggaggggaggcgacgccgggcttaagcgaaccacagaggagaactggcaacgctgaatacagaccttgtctgcaggcgcgacctggccgggcctgagtcccgaatggggtctaattgcgaaggcggggtgggtttcccagtcacccagcttctttctctcactcgccattatttcatagttgtttgtaagtttaaggaacaccaagtgtagaatgttgtacatctcttccagtctcaacgccatttagaaatg

SEQ ID NO: 109577 - DNA, 922 bp, Homo sapiens
  chr14:36991579-36992501
  Hyper
tcagcaggccacaggcgcacgtggctggcagctccccggcctccggctctgacagtccgggggcaaccaggcctgcagttctcgaggaaacccccagccccccacgtctcgttctggaccaggaaccccctccccaacaaccgcgcagcaagtggcgactctgggagctgaactggagtggagctcgaagtggctggggcgggcaaagactcccgcttcactctgggacacaactgggacggcgcttcaacctctgcctgcaggcgtgcttctcgcgcgcaccagcaagctctctatccacctcgcctgggcctttgcagcgccctgccgcccaggctccagcgcctctactaccctagccccttctcaacacgcggctctgccttcttccccagtaccactgcactgccgaaaataagcccggagactaacgcaccttgtagggaagagaaggacatctgtatctccaagcttatccaagcaaaggcctccagagtccctcccatggcccgaaacacctccctctgaccgaagagcgtcctttctttccgccgcctcctggactcatcctaaatagggcagacccgggctaaaccagtgatttttttttccatgaatacgaagaaccccgattgcactttgcgaagtctgcgcgtattcctttatcccgcaactagcttgctcccgggtggagtgggcacagtggggagcggtcagggcagggcagggcccaacgctggcccctcgcggagctttccctggcgcgacctcacacggtcgctgcctctattccgaccacgctctgcttcgctggctgcggctccgccaggaatccgagggggcgcaggcccaggctcggccctagatgcgcggaatcgccatcagcctttgcttacaccagcgtggccgcagggaaactcct

SEQ ID NO: 109578 - DNA, 37 bp, Homo sapiens; identical to SEQ ID NO: 76704
  chr14:36993177-36993214
  Hyper

SEQ ID NO: 109579 - DNA, 1635 bp, Homo sapiens
  chr14:36993438-36995073
  Hyper
cccctcagttgctcccgcagtctcccacagctaggcacaggcttctaagccgggctgagctgggctcgcgagtgccatcgaggcaaccaggcgcagggagcggaaggcaggagtgtaactgggcgctggggggcgctgctccgcaaccccaagatccgaggaatgcctccgggggatgatttctctggaggggtctcgcagggccccctctgcgctgctttctcaggcaccagaaccgaaatcctcgggagggaccgcgggagcccggggcgtgcagacaggcggctttcacagacgcagcgggaggaaggatccctctactgctccctttcccgatttgaccgtctagggcctttgagaggactttccttttgggaaagcttttctcaattcgtggcctgtgggcaggctggggggtggggcgccaagtcatccgagcgcggcttctgcttctccctttccctcacaggcatgctctacggagggtatgggaggcgagggcgcgtctatgagggccagagtccgcgaagagagtccggcccttaggcctttggtgttgaagaatctgctcctctgtcgggtcaagccccactagaagttaacacctgtggtctccaaacttgcctattttcctgtcacgcagttcaagccaagattcaactcgtcttgaatttttgtatttagagcccctaccttctccaccgactccaggggcgccctctggcgggaaggggcctggggtaggagggaacctgagggagcgggttacaaagcagagaacagcgggagctcagcagctccctttgaattgcgaggaaaccaagacggagacgggaggtaggagcacgggcctgaagcggtcagccgaccctgtgaggcccgcgctgccgtgctacgccgcgaatccgccagacgcccccgtcggaaggggcagggacaccctcgggggcgctctagggttcgtgctgcgctaaggtaagtttcgcagctgctcctgataattaaaggacagattcccgaagcatccttgtggcggcgcggctgttttcgccccaggacctgtgcagcctcattcagctttaggtagtcgaaacctatagctctttctgccctctgttccccaacaaatctcagtcccaacagtgggagcccgtgggccttgggtgttcgagtttcccgcgggcttgccagcagcgctggggttccctcctccgctcctttcctcctctccaacctcccaccacagcccgtctcccccacatccccaacacttgtcccaggcagtttccggtggccgcagtatcgaccccaggccattggggtgggtgtgagggaagggtggagggggaatctccgaggcccaatgttttctgggacttgagggaggctgaattctccctcgctgcctaggacttggggtctgaaggttgcagaccgaggcgatccgcagcgccctcttccggcggccgtctggagaactgcagctttagagcggtctcggggaagctttgctactagtttccggctagggaaaactggtggtggtcggagactggtagtacatcatccacgcattcgctcattctaactgtccgcccgaccatacgtcaggctgtctatcggtccacccaaagc

SEQ ID NO: 109580 - DNA, 33 bp, Homo sapiens; identical to SEQ ID NO: 76708
  chr14:37050213-37050246
  Hyper

SEQ ID NO: 109581 - DNA, 39 bp, Homo sapiens; identical to SEQ ID NO: 76709
  chr14:37050500-37050539
  Hyper

SEQ ID NO: 109582 - DNA, 152 bp, Homo sapiens; identical to SEQ ID NO: 76710
  chr14:37051044-37051196
  Hyper

SEQ ID NO: 109583 - DNA, 364 bp, Homo sapiens; identical to SEQ ID NO: 76711
  chr14:37051599-37051963
  Hyper

SEQ ID NO: 109584 - DNA, 379 bp, Homo sapiens
  chr14:37116105-37116484
  Hyper
ctggagacttggggacgtgaagggggggttctgtgatcccggaaaaaaagtaacttctcttggtaggtgatactaggcagttgcgtcccggggagtccccgcctttctgcgcttcccctgacgggggcacaggggccggcgtgcgtgtgtgggtacgtagctcatcccggggagctgggatcctcttttccgcacttggggaagacgaatgccgaccattggctcagacaccataccacacaggcatttctggaggcatttcgcggcgttattatgggaagttgcgcggaccggggccttcgcgctacagccgaggagtctcagcgcctgccaggcgggagccgcacttccggcgaggtgtcttcgggagggggcgcca

SEQ ID NO: 109585 - DNA, 932 bp, Homo sapiens
  chr14:37116709-37117641
  Hyper
acacctgcgcgccctcgactggggcccgctccagcagtgaagacccaggcccttccctgggccgtggctgctcttggtgcctcatgggagcgcccggggtagggactcggctagtgacctgtaggacatgaggggcgagctgggagccgattcgcccacggcgtctccttcgccatggaggccccccacccattccactccggggttgcggccacgcaccataagagcaccttcaggtctgagctctttaggggtgggagtaggcagttcgtgagtccgggaaggcctgcggggtttcccgcctgctgcggacttagcgtggggccgaccggggctggcgagggctggcgaggactggcggggacccgcggggctgagccagctctcgcgaagccctcaagtgaggaacggcgcttgtggctgcgcgctctccgcagccaagttgcagggtccagcaggggctcaggtcctgttccctccgcagatcccggatctagggctctagtggtctcggccggagggaaggtgacgcgcagtgggcgcagacgcagagtgcggggcgccgaacgtgggaaggagcgggttcagcgcgctggtgagagtttcaggaaatccgggagagggcggtatttaccagtcccttccccgagagcaaccaggcaaatcggggaaggttagaggtgggggacctgcctgagccgggacaaaaaactttggagctagggccttctaaccctggagacttgccgactccggggcgggctctcgcactcaagtcccgagatgggatgattttccaactttcgtccagcctctccttccgctcccgccgctctgctagcactcccgcactctctccctgggtcacaaccctcgcctgcggaatacctgtctgaagggcgcgtcagtagaagcttcgtttcatactacct

SEQ ID NO: 109586 - DNA, 1424 bp, Homo sapiens
  chr14:37123336-37124760
  Hyper
ctagaaagccacagccgctgtggaggaggtaagaggtcagctctttcgttggtcctggtgagggtaaaatttttaggcaggaggagcactgactggcaaagggaagaggaaagggttcgccctggaccccacaaatccgcctcttggagcaaacagcctgcaggtagaggggcctattagagcctgcccagttcccgggagggccaaccccagccagtaagaagacctgaggcgtaggatccctgcgcaggaggttgcaggaatgcccccgctagccgcaaggttcctgctggcctgtagagctttcgtgatccccgccaagatgcgaacagtaaggtcctcgtatggatcgcagtttttgtccgaaacctgaaaacactaacttgggatttcgcagttctggccctcgggcccgcctcggaggcgcacccccaatccccacggaacgaattccgcggctaaaatgcattttcccaaggcagtaaaagtgacccctgcacctaacaacctttgggctttctcttctcctgactaccacctctcgcagggtgcgctgaaatctctttatcgttatcgttttttataaatgaaatgatttatttattcgctgtttgcagggaatgaaaggagttgatcctgactccaagatgcattccaaagaaagaaaacgcaactgtagcccggactccgcggaggaaggccaactgactccactacgtgcacttccgagccacttgggcccagctagctgtgttaattatgggttctaattttattgcaactcggcacctcctggtttgttcccactatagtggtcttaaaaagaaacacacacaggcataccccagaatgaatccccgggaaggcaaaggtagattttttcggtgcttgagttgatgctctgagagcgcgctgagagtctcgggcatgtcttggcactcttggaaacaaattgcagccaagagcacggttcttccggtcctctccttgctcctctgtgcgccgctcggccgcgggactcctggaacatgttgtgcaccgcccgagtggctgcggacctcacctcgacgccctggatagccggggccaggaggagacgagcaggcagtctcccgccctcacctagtcagctgcgacctccgcggcgtggactcttggccagcagtgaggaggacaaggttgcagatcctctttgctgcgggttctgggtccggccttgggcggcattctgtcttctaaagtgtggaggtgggtagaagagtgtccactttcagtgtagacacctgaggtatgggggcttctttgggggctccagcgtgagctgctcctgcagattagggaaatggagagaacaacaatggggacatggtggaattcagatttccccctgttaattaacaatatgatttcgcttagtccaagtg

SEQ ID NO: 109587 - DNA, 3790 bp, Homo sapiens
  chr14:37124976-37128766
  Hyper
gtagcccctgggggccgcaagagaatccgcccggtagggcatagaagatgggttttcggtgaatcgtgaaaagacatgatcgggtttcccttggagcatggtggagaatgatgcggagccttggggtcaatggagagttgagggtgcagagggatctgaaagggggaaccaaaaatatcgggctttgaaattctgtggattttcaaaggcggttcccaaccttgtcaaaaactacagtgggtgcgcgatctaatctggctcctataggtggcgctgtgacaaggtgcggtggccgggagaggcggctgggggactcgaagactgcgggaaattttctgcgactccgacgctaacccgctgctcccagcctccgcttcctgttttcgagggattagctaggactgtgcaacaccagtctccgctctcggagtcggcacgggggctggtgggtggcgggatgaactcggggaaggcgacaggctggaaacgcagctcctcgactttgcagcgcaccaaccccctatcgccccgtccgctgctcaggtgcgaggattcgccagacgccacaggactgggggcgactcgcaagggcatcatgccacctagaggaaacgcgcagtgagtgagccctgggtcactgaaaatgggagaacgttcgagtcggtcaagatgactccggcctgcgagttgattcagactcctcggaagccagaaattgggtctagagtgggttggtccctccgtcagcagttcgggcccagccgaagcttggggcctagagggcagacgtccggctctgatcagagtacagcgggctgggcctggcagcctgcaggcaacctggaccttgcaataaagctgcattcaacataactcagaccacagtgggagcccccgaagggcttcatgtgagtcccgaaaccagagtttagaggcgcggcctggttctcgtttatcttttccagacagcatttaggccaataaggtctttgaaaggaggcagccccaaagccctcaggccgacacctgagggcagggtctcaaacagctgtgcttgaagaaccggcaatcttgcttttcccacacgcagctgcacctctcctgagcgctgcagctgatggctgtatagtgaccacggactgcgtcctcctcacgaagctgcgcaacttctgctaatgctgcaaccctggcaagacgaaatccccctccctctggctagatcagcccagcctcccctcagggaccttcctgcccctccctacccctccctacccctaggccgctccccccttcctctgttgggatccgatccttgttcgctcttgcaatcccgcagcccggagttttgccccgtgcattaaaacatgttctctttcatttgcagatttaataaacaaacgtaaccatatcacatggagctccacactgtccttctgaaagcaattccgctgttgaaaactgaaaaatgggtgtaatttgctttcagaaagtaatgttagggtcacggcaatttctcgggccgttatttatttttactttaaagtctttaggaaagatttgcttatatgctcggaaaacttccaaatgcgcgaataccagcaatcccgctcgccttcaacgcgtggggtaagggggggtggggaacaattactgagtgacgctaatatggggaaactgaaaagaaatgtcgattgtttttattgtaatagaaggagtgagcaaacagaaaaaccaaccccgggtgatcggaaacaggcaggcggagaattaaaagcgggtttcagacagcaacaggcccctcccctgctctcgcaaggagaaagcgggcgacgagcgctcgcagcccgtggggctgatcccacctcccgcagggctccggtcgtgtcgctgtcggaccgcagaacgccgggacgcatttccgagctcgggcccgacccaacccgctgccattctagctacctagtggagccgcggagagactcttgaaccgtgaggctccttgatgagaaggtggagaggctgccgggctattctccgagcatcttccggccgagctctgctcctctccgtgcgcttgcggcttctccttgggctagcgcgtccgcagtccctccaagtccaggccgcaggtcagtgtgcgggcgcctcctgtcctcctctcccaccagaggacccctgagggctgtctccatccccaatccccgcgactgctccttttagccgccatcccctcccgcagcgcagatcctgcaggggccagcggtccagggcggaccctccctcgccctgggcgcggggcgagcttctggctgtcacttgccgctgcagtttcagggaaactcagctggccgcttaccctgcaagacggggacatagcagagggccgagttctggagaagctgggcttgtttttctctctgcaccgcgcgcaatgccccaactgaccctgaagggtcttgcctttactgcatttgcccccagacggctagaagtcaatgcactatgaaaatcccagtcccggacctcggactctggctgtcttacaatccctgcaactcctccgagtggacaagaggcgggcaccgtcgcctgggcctcgcttggggggggggggtcctgtccccagcagggggcaagttggaggaatcagctccttaatattttctgctagctctgcttgtcataactgcaactcggaatagaacaacctctctcccgtgcatacgcacccccaactctcgccctatcctcccatccacagtcatcactgacctgtagacccggaggagcaggcttccgggggtcggtccaggttggggatacagggaggggtcctcgcgttccgcacaacctgtagtgcttgggtctgacttcggcagccctcgggtacagtctgccgggctagattcccgttgcttctccgcgtctctccgcgggccgctctagcgccgggaagggggcgccgcaggtgactgcccgcggcactgggacggctgacagatttatggagacttcacagcatctggctggggtccgcgagggcagggcggagtccggtcgatccgatgctggggtctaaagcttccccagccacacgcctgggccgagtcgcccccagagtccccggcccctgctccccttgggcgggtgtacacaaggatccggccagcgccgagtgtactggttcctcccacccagtgtagccccctccttcacactctcggcccggcttccagtctcccactgagtaaatatttatccagagagcgagtcgcccctcggaggaggcctcgacgcggctagggaaaggctttttggcttctccctggcctgagccagctgcaggccttactggtgttttggttttggtcttaaatttctccttttagtcgaaattcttccgatctctttgagatcttctgagtccagagtgagcagtgtaaccaggcggcagactccagctgacccttgttcttgttctaggtcctgcatccttacattcatcgggactgaccagaccttagtgttctctcttttccttccttcatcctctttctctgcctcagatccgtcgtctctcggtcggtctcagcgggtcgctgactacctcgccctagcactcggtccgcgccccgggaaggcttcagcatcaccctcttctgctgggatcccgctgaccctgtctgcagcttcggcttctcttgctcccagagcggggtcttcggcttgccgcggatacttagtggcccaaaacacctaaaattgactcttcctgcgctcttgagaatgc

SEQ ID NO: 109588 - DNA, 167 bp, Homo sapiens; identical to SEQ ID NO: 76720
  chr14:37129080-37129247
  Hyper

SEQ ID NO: 109589 - DNA, 799 bp, Homo sapiens; identical to SEQ ID NO: 76721
  chr14:37130018-37130817
  Hyper

SEQ ID NO: 109590 - DNA, 200 bp, Homo sapiens; identical to SEQ ID NO: 76722
  chr14:37131143-37131343
  Hyper

SEQ ID NO: 109591 - DNA, 54 bp, Homo sapiens; identical to SEQ ID NO: 76723
  chr14:37131834-37131888
  Hyper

SEQ ID NO: 109592 - DNA, 1189 bp, Homo sapiens
  chr14:37132193-37133382
  Hyper
gcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaaggtaggggctcagaggctgggcgtgtggatgtgcagcgtctgcccccgcactctcgcggaggtcccagtatctgcagcctcagggacactgtctttcccaccacctgaggctttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttccaccctcccccgcctctcgcgccgaggcagcctcagcccggcttgctcacttggagagtgcggccggggctggacttggggcgcagcccgggaggcccgagcctgcttggggctgccggctgcagactccgctgtgggcagagcagcttgcttggggatcactacggccgggagaagtctggccgggaggagtccagcacgccttggaaattgaagtattctccgattctggtaatcaggccaaatttgctcaggcaggaagttcaaatgtcacctaattggtttcgttcttatgcttcacttcattttcctcggaaatggaggtcccgaagttactactagtaacttgcatgtaactcattcccagacgaagtcatattcac

SEQ ID NO: 109593 - DNA, 86 bp, Homo sapiens; identical to SEQ ID NO: 35247
  chr14:37133668-37133754
  Hyper

SEQ ID NO: 109594 - DNA, 54 bp, Homo sapiens
  chr14:37135721-37135775
  Hyper
ccgcaacaacttccccgccgccgccccgcacgcggtgaacgggttggagaaggg

SEQ ID NO: 109595 - DNA, 615 bp, Homo sapiens
  chr14:37136003-37136618
  Hyper
acccccgccaggggccgggagcgctcgtcagggcgctgggggtctggggcggcagctccccggggcgaggctctgggaagcgcctccaggcctgtcggcctccgggagcttggggaggcggctcccgaagccctttcggcggctctcgttgggggtagagttaaccaaagaaggcgcttctgaagggccgagcggagcagccctggggcctcagagccgcgccttcacgcccgcgaaacgcgcgccccgggtctcggccccacggtgcgactgcggctgcggggtcctcacgttcggactttctctccggtggctctcggacaaacacgcttggccaatcctgcggagaggggcacccagataaacgtaacaaagctaccattttctcgactaaaggtcacattgtaatctcccaaggaagttagtgagaaaacctcaaattatacggactggctgtggaccgtttaatttttctttccctccgtccctccctcatgtctccaaaggaaaatttaaaacactcgtgtttttattttccccccgagaaaagctaaacaaccaccacaacaaaagccccagatttaagtctaaattcatcaccgtcctggagtcaag

SEQ ID NO: 109596 - DNA, 52 bp, Homo sapiens; identical to SEQ ID NO: 76730
  chr14:37641710-37641762
  Hyper

SEQ ID NO: 109597 - DNA, 30 bp, Homo sapiens; identical to SEQ ID NO: 76731
  chr14:37641962-37641992
  Hyper

SEQ ID NO: 109598 - DNA, 201 bp, Homo sapiens; identical to SEQ ID NO: 76732
  chr14:37666791-37666992
  Hyper

SEQ ID NO: 109599 - DNA, 438 bp, Homo sapiens; identical to SEQ ID NO: 76733
  chr14:38052765-38053203
  Hyper

SEQ ID NO: 109600 - DNA, 249 bp, Homo sapiens; identical to SEQ ID NO: 76734
  chr14:38057123-38057372
  Hyper

SEQ ID NO: 109601 - DNA, 30 bp, Homo sapiens; identical to SEQ ID NO: 76735
  chr14:38057802-38057832
  Hyper

SEQ ID NO: 109602 - DNA, 339 bp, Homo sapiens
  chr14:38060644-38060983
  Hyper
gctcctggtggtcaccgaggcgctgcctagaggcaggctggcgggcaacgtagagccgtaaggcgagtattgcagtgcctgttcgtatgccttgaagtccagcttatgctgctgctccgaggaggacatgaggttgttgatggagaacgggtggttgaaggagtagtgggggtcccctttcaggtgcagctgggactcgtggggtgccaagccgtgtgccgggtgagaggcgggcacagaggccagcgccccgggcccggagcttatggggggcgcagttgaggaggctggagtcttcaactccgaggcgccccctgtcgccgtcgccccactgtggtc

SEQ ID NO: 109603 - DNA, 160 bp, Homo sapiens; identical to SEQ ID NO: 76737
  chr14:38061931-38062091
  Hyper

SEQ ID NO: 109604 - DNA, 30 bp, Homo sapiens; identical to SEQ ID NO: 76738
  chr14:38063973-38064003
  Hyper

SEQ ID NO: 109605 - DNA, 30 bp, Homo sapiens; identical to SEQ ID NO: 76739
  chr14:38064995-38065025
  Hyper

SEQ ID NO: 109606 - DNA, 30 bp, Homo sapiens; identical to SEQ ID NO: 76740
  chr14:38065668-38065698
  Hyper

SEQ ID NO: 109607 - DNA, 128 bp, Homo sapiens; identical to SEQ ID NO: 35255
  chr14:38072551-38072679
  Hyper

SEQ ID NO: 109608 - DNA, 175 bp, Homo sapiens; identical to SEQ ID NO: 76742
  chr14:38677313-38677488
  Hyper

SEQ ID NO: 109609 - DNA, 30 bp, Homo sapiens; identical to SEQ ID NO: 35257
  chr14:38678172-38678202
  Hyper

SEQ ID NO: 109610 - DNA, 819 bp, Homo sapiens; identical to SEQ ID NO: 76744
  chr14:38678518-38679337
  Hyper

SEQ ID NO: 109611 - DNA, 182 bp, Homo sapiens; identical to SEQ ID NO: 76745
  chr14:38679732-38679914
  Hyper

SEQ ID NO: 109612 - DNA, 30 bp, Homo sapiens; identical to SEQ ID NO: 76746
  chr14:38680274-38680304
  Hyper

SEQ ID NO: 109613 - DNA, 1319 bp, Homo sapiens
  chr14:38724150-38725469
  Hyper
ttgaagggtagacatcgtgctctgtgatccccatcgaggaatctcaggaatagatgttactgaattgtcttgttcagggacaagtggtgtctctcccagcttctcgtcgaccctgattggccatgttctctgcggcacggggctggttgcagtggccggcgggcgcctggtgggcaccccggtccccccaagggtcggctgtccttccccactggtcacacaagagcggccgtccttccccagctcgaagcccgtagcacattcgcaggcaaagcctcccaagtcgtctaggcagttagggagctctgcgcatttgccagcacggaggtacctcccggggcagggacacaacacatcgcccgagagtttgtcccagcgagcgccgatttcgtccgcgatgcaagtaactgagatcgggagctgtccccggcagagcgcactcacctcggtcccaggtggactgaagtccagagcggcgctgtgcagctggaagggcgcgcgatagctcaagttagaggcggccccggggcgcggcgcaggacacaagacctcaaactggtacttgcacaggtagccgttggcgcgcaggtggcatcgcatctccttccagcctgcgggctcgaccccaccggtggcctggagtaccgcgcatctccgcgcggtgcaggagcgttggggctcctccacccactgcagcgtgtcgctttcgagaccgccggggtcggaggacagccaggagaaaccccgcaaaggctcgttctccagggtgcagtgggaacgcctgcgctccagtgcgacccagaacagcaggtctttggagccccctccgggccctgggcctgcccgcaggagcgcgagcacagcgcgcagctcggcgcccgcacgcacggtgctgagcgccccacctcgcaggatgcaggcctcctcggccgcctgccgcttcatggtagcgtggtgcaggctgtagcaggcccccgaggccgagcagccagcacggtcggcagtggggtgttcgccgccgcccggcccgggccagagcgcctgccagaggaggcacagggcgaacgccggcctcattctctgaggccccgcacgcagagctgctcccaacttggatctgtcccgctcgaggacgcagagctgtgtctggagcgcggtcaccgccctctacagctggcttccccaacccggttccccctcccttcccctccgccctcgctcccgacggaccccccaactgccaagaatccccccgcgggcccagcggccaacagtttcccttaggccgcgacaggaaatgtgtgcggagcgctgccagg

SEQ ID NO: 109614 - DNA, 23 bp, Homo sapiens
  chr14:40221669-40221692
  Hypo
cgagagtccgtctcaaaaaaaaa

SEQ ID NO: 109615 - DNA, 638 bp, Homo sapiens
  chr14:42074205-42074843
  Hyper
ttggtgcaactccaccgccctccagtgaagtcccagaagcgatcaagtttaaagtgaaagggggatggaagcattttttctccctatgccttcggagtctgtggcttcagtttgctgcaggttctctccgtggacttctcagaaacctcaactttccacttcgagggacagaaagctacaaggaaaacgctgatggttttggtggagattctcctggacttcagtggtgtcctctggtacatctgtccgcggtgtccctttggtttatttctgtggtcttcctgcgcagtccctcagcggctcggagtttggccttccagctctccaactcagatcctgagcctcctaagctcccgcggagaccctgaagtcccggatctggcgccgctcgccgacctggagggaggctgcaccgctgaagtgcagtctcggagctgcgctcctctggaacaaagcagccagacgtggcttgagtggattcctaagccaaggattggatccggagtaccaggggcagagagggggagcagaggaaagaaaggagatgtgaggagtttccacctaaagcacttcactcctcgtgttcttccccgacagagatagctgtgtggttcttccttacgcgtgggtgcaggtgt

SEQ ID NO: 109616 - DNA, 1289 bp, Homo sapiens
  chr14:42075097-42076386
  Hyper
ggtgctctcagtgtccgaagaccacgtgctggtgaacccacaatgagaagcgaaagggtttcaggactctagcagaaaggaagagcaagatttcactcagggtttcttagaagaaagagttaactttgctcactggcttttccaggatggagggagtggggatagggtcggggagagaagcattgggagtcttgtcggagtctcaagcaaaaccaggcgagggctccgggcagatccattcccgcagggccctgtctaacctcctttccagtcgcacctctttcctgctttagaccctgcgtctgtgccggtgaccttagagactaggtctggcttatgaagactgttgggctccctttctgcccttcacatagtaaaatgtgaccaactgcagtattcgtaatgtctgatgctgagctgagttgattcccaaatataaatgttcttttcagaatccgctcccatctgattagtaagcaaatcaccacccacaactaaggggacagcggaagccagcctcagatgactgaaacccccaagtcagtagctctcctcaaaatttccggcgggttattatagataatgacttttcccaccgccctaagcagccgaagcttgactcagtgatgattctctctatcccgtaactgcgaggaagtgggcgatcagcaaattgcccttttgcaggaggctggggacgcccctggaagttcgctttcattctccaggttttctgccttttcccttcccccttcctgcaacgcccccgcgcctcctcagcctggggatttcctggcgcttcgccggccctctccgcaaccccctgataaatcggttcagaaccagtctggctgggaggcccgagggctgacagcagcggagcggccccggccggggtctcacggactctcggggtctggccgacacggccgctcccgtcactgcagcgcgggctgagctcacggccgcgcgcccgccgccgccgccgccgccgccttcatgctgcagcgcagggctcagttccacgcggccaggaggccgccgttgcccacacgcgacgctttgggaagcccagctcccgggtccgccccggccgcggccgcagccccggacctcggctgcttgcctcgcgcctgaactgcggactcgccccagcgcggtggccagcgggcggggcgctgtgttccgcggcgcgcagggaggcggtgagcgtgtgcagagctgcccgaacggaggactatgtatgtgtgtgcgcgtgtttgcgtgtgtttgagcgtgtttttccttct

SEQ ID NO: 109617 - DNA, 1091 bp, Homo sapiens
  chr14:42076628-42077719
  Hyper
ggcccttctgtgttccggaaagatcctggatgttggctaccttttcaagtcatcttggcatgtctctagtgttttgtaagccgctttccagctagctgcgtgtgtgtgtgcgcgcgcgtgtgtacgcgcgcgcctatctgatgcatttgactgtcttttatccaactgcccagaagcaaatgtgttaactcggcgatgccccttcatgcccgggttcttgcagagctctgaggacgcccagacccattttcctggctggatttggagcggctgctgggctgtggacccaggtgtgtggatcgctttacccagaagcttggaaagcgccaatattaacctgcttccaggtacatcacaaggtcaagagagtgtcttgcagccctcttgtttccgtgtatctacaccttcttctcttggccagaaggatatttacgttttggttcacagcatttgaagccaaaagttcagcccttcgaactggtttgctatacaaaacaaaacaaaacaaataaggtaatgaggattgcttattaaactgcttaacaaaatccccgactcttcctcagccctttctcggctccctcctccccaccaaaatgtcaccagctcttgaattacgtggattcgggttggaggagaacttgaaggaaacgtgattaaagggctatgcgagaacgctctctttgctgcccgcggtccggtgggcttcgaagccaatcgtgagaaggaccggttccctccgtgctgcttcctccccgtgcagtgctgggtgtgcgtgtgcgagtgtgagtgcaagtgcgcgcgcgcccgggtgcgagtgtgtgtgagtgtgagcgtgtgtctgtgtgtgcgtgcgcggccgccctgcctctgcccgctccccgggcgcggagccgcgggtttcatggggcgattgcagcgattcccccacccagagcgacctgcgggcagcggcggcagtggcaggagccgcctttccgattccctacgatgcgggtgctgagctatggcaaagggcagcgaagtgacgagcgagacccgcgtacgactgtgaaagccacctggagccaccttgccgggattgtacctgc

SEQ ID NO: 109618 - DNA, 705 bp, Homo sapiens
  chr14:42078784-42079489
  Hyper
atttcactcctttctcgaagacattagaattaacaagataaagcacttccaaagtagtctcatcaatgttttattccatagtgaagacggtctgaataatttaactaaggagtgttcgtttgtctcccgcctttgggagctgcttgctggctacattcagcggaggatttggcccagccaagctcagggtgccctgcttcaggaggcagtgactggggctgctggggggcggggggttctctttgctaacgccgtttaggaagtgtaggggcgctgcctgattttcccccactcgctgcatttctatagatatccatatgatggcatttgcagacttctagctggccgatagctgctctgcttgtccctgcgcactgacgtccccaactcctcttcgagtctgggctcggctgctgctgcagccctcgcaggctggtggtgctacaaggccatgtatgcagcgggctttgggggctgggctctgccactgcagctggcaggacggctttgacactttctccgggcagggcggaagagctcagcggaccccctggcagacagcaagcgcatcgtggccgaggcggccgcctggatgcgagaggagggagatgcccagagccacagaggagcgtggagggcggtggtgtcctgtctttgcctgcaaaacctttctctctctctccctccccgcgacaatgaatattg

SEQ ID NO: 109619 - DNA, 93 bp, Homo sapiens; identical to SEQ ID NO: 76760
  chr14:44004339-44004432
  Hypo

SEQ ID NO: 109620 - DNA, 25 bp, Homo sapiens
  chr14:45382862-45382887
  Hypo
ggtctcgaaacgctagcctccagtt

SEQ ID NO: 109621 - DNA, 30 bp, Homo sapiens; identical to SEQ ID NO: 76762
  chr14:45434972-45435002
  Hypo

SEQ ID NO: 109622 - DNA, 25 bp, Homo sapiens
  chr14:45997179-45997204
  Hypo
agtgaaactccgtctcaaaaaaaaa

SEQ ID NO: 109623 - DNA, 81 bp, Homo sapiens; identical to SEQ ID NO: 76764
  chr14:46293369-46293450
  Hypo

SEQ ID NO: 109624 - DNA, 182 bp, Homo sapiens; identical to SEQ ID NO: 76765
  chr14:46443145-46443327
  Hypo

SEQ ID NO: 109625 - DNA, 35 bp, Homo sapiens; identical to SEQ ID NO: 76766
  chr14:48095553-48095588
  Hypo

SEQ ID NO: 109626 - DNA, 28 bp, Homo sapiens
  chr14:48135049-48135077
  Hypo
caccatggactcctgcgttgcctcagcc

SEQ ID NO: 109627 - DNA, 2636 bp, Homo sapiens
  chr14:48143051-48145687
  Hyper
gccctggaacccagacgcgcggacttagcagtccgttcattcatgcacttgctcatccattcacacaaacatgtcccttaattgtgtctggcaccgagaatcttgcctgctattttcccctcccgaagtcagtgctcatggcaaccgctggtgcagaacgcaactcaactgtcaccccacttcctgagccggaaaatcaaggcatgtaggcattcacagaaaaaggaaaaggtggagaggaggaggcggcgggggcggagaggggtggggagactcacggggtcacactggaagcttccctggggggtggggggaaaccgtgacaccgacaccgtggcatgcaaggagccaaaccattattaaatcaaagactgctggagctcggattccccgcggggataaatcaagtgcaaagccgctcgttcgcacgagtgcgttgctgccggctaaacccaactccgagccagagcccaggcgccggggaagcggctcgcagcccaatccgcagcgcgctcgctgcctctttatcgctcccaataacgtgatgaagtgtaaatcaaatgccacgccgggaggggccccggaacggcgcgagtcgtgcattttcgctcaccagcctatcttgcctaagaatcacaaggtcacgatagcgtcgcgattccactcaccgtacactccttggccagagatcccctccaggaggactgtcagcagccacacgagaccgtacagtaaatccatcttcacgtgaacatgaacatatccagcccagggggtacgcaacgggaccttcaggaggccggcggccagccaggcgcgctccactcgcgcccgggccaagccgaggtgcccgggaaccgctcgccgaaggaggaagcgccgtccgtctgtccttccccggcggcggcggcgagcggagcgcaggagccccgcactccacacactcatgcacacacacactcacacacactcacacactctcccacaacacaataccctgacacacactcacacgcacgccgcactcacaccgggtgcctgggaaaatcgcagacgccggggaggagcagggggcggtgatgggaaggggagctgcgaggcgaagtgttcttcagggaagcgggctcgagtctccgcagctgcggcggcggcggcggcgcgctgggccggcggcgggcgcgggcagggggccgggggtgccgcgcggtaggagcctggcttggacagccgaggagcaggaagtggcctctgacccaggacaccgagcagggctctcttgcctggattcgcctttacaaagtaactcgcgaaggtccccggaggggcgtcaagcggcgacagcggcccgcccgcccgcagtccgaagcccccagccctgctgtcttgccttcccccattccatcagttgccattgcaacgccaatcctgttacacgatacagactcgcatcgccgaacggggagaggaggaagaggaggaggaggaagaggaggaggaggaagaggaggagtggggctaggggaacgggggtggggaagagggaagggaggagggggaagaaggaggaggaaagggtccaacagggagcggagtgtgcgtctggagctcgcttgggcacaccagcccagccgccaccgccaccgctctccaaaatagcctttagcgcccggccagcgtagaggtgctctggccggccgcaccaattcccggagccgaaagcagagtccaggcaccgccacttgcaagagagggagaatgccaggcaaatacccgatccgcacacacgtctacgcgtgcccaccggcactgcgcgcgtcctcttcgcttccgcgccgcccccgccaggtggagggggtggggacggtcgggacaggcgggagtttagaggagggagccgcagaaggggttccccgcttgagctaacgtagtggtggcatccagaggtgaacgcgggagcggccgcctgcggagggcacccggctgcgtggcgtccgctcgggccgctgctgcggcagaggtgccctggttgggcggctgggcgcctggggttcgacgccggccgggatccctgggtgtgcgcggagatgcgcgccgcggaggcgaatggagggaggaggagaaggagaaagaggagaaagaggagaaggaggaggaggaggaggagggcgaagcggcaagcgcggggcgcaggcggaccggcggccgggctgctgggctgctgggctgccggggaggaaggctgtgtgtggtcacgttgtgcgctacgtgctgagagcgcgagctgctagccgcagccgggcgacgtcaaagccgggtgcgcggctctgccgcctgcctccgcgcctcctctgcccctcctttgctctgccttcctgtgtcagccgagctcatcagtatggacaacgccgaaaggctccgcgaggccggcggcatctggcctccaacctcccccgccaaagcgctccctcgcctctcggggagctccgcggtggcgaatgcccgttatgtatttctgatgccgccgtctgcgtttgcacgctgaagggccagctaccaccttagacccagggtaattacatgacacgctatctcctctccgccgcccaaggtcttccaggatccgttatgcttggcta

SEQ ID NO: 109628 - DNA, 30 bp, Homo sapiens; identical to SEQ ID NO: 76774
  chr14:48852289-48852319
  Hypo

SEQ ID NO: 109629 - DNA, 45 bp, Homo sapiens; identical to SEQ ID NO: 76775
  chr14:50098049-50098094
  Hypo

SEQ ID NO: 109630 - DNA, 171 bp, Homo sapiens; identical to SEQ ID NO: 35279
  chr14:50155136-50155307
  Hyper

SEQ ID NO: 109631 - DNA, 180 bp, Homo sapiens; identical to SEQ ID NO: 43975
  chr14:50233117-50233297
  Hypo

SEQ ID NO: 109632 - DNA, 144 bp, Homo sapiens; identical to SEQ ID NO: 43976
  chr14:50233597-50233741
  Hypo

SEQ ID NO: 109633 - DNA, 52 bp, Homo sapiens; identical to SEQ ID NO: 76779
  chr14:50287126-50287178
  Hypo

SEQ ID NO: 109634 - DNA, 30 bp, Homo sapiens; identical to SEQ ID NO: 76780
  chr14:50316746-50316776
  Hypo

SEQ ID NO: 109635 - DNA, 20 bp, Homo sapiens
  chr14:50333655-50333675
  Hypo
caacctcgaatcagccgttt

SEQ ID NO: 109636 - DNA, 120 bp, Homo sapiens; identical to SEQ ID NO: 76782
  chr14:50333975-50334095
  Hypo

SEQ ID NO: 109637 - DNA, 20 bp, Homo sapiens
  chr14:50334335-50334355
  Hypo
gactccgtctcaaaaaaaaa

SEQ ID NO: 109638 - DNA, 39 bp, Homo sapiens; identical to SEQ ID NO: 76784
  chr14:50337688-50337727
  Hypo

SEQ ID NO: 109639 - DNA, 29 bp, Homo sapiens
  chr14:50434015-50434044
  Hypo
catttatgcataaacgatcacatgacatg

SEQ ID NO: 109640 - DNA, 53 bp, Homo sapiens; identical to SEQ ID NO: 76786
  chr14:50474165-50474218
  Hypo

SEQ ID NO: 109641 - DNA, 28 bp, Homo sapiens
  chr14:50681829-50681857
  Hypo
aggcgtgagccaccgcgcccggcaaggt

SEQ ID NO: 109642 - DNA, 77 bp, Homo sapiens; identical to SEQ ID NO: 76788
  chr14:50777921-50777998
  Hypo

SEQ ID NO: 109643 - DNA, 20 bp, Homo sapiens
  chr14:50828512-50828532
  Hypo
agccctggcagtcctcgctc

SEQ ID NO: 109644 - DNA, 18 bp, Homo sapiens
  chr14:50888271-50888289
  Hypo
gcccggcaacaaaataaa

SEQ ID NO: 109645 - DNA, 469 bp, Homo sapiens; identical to SEQ ID NO: 76791
  chr14:51026665-51027134
  Hyper

SEQ ID NO: 109646 - DNA, 36 bp, Homo sapiens; identical to SEQ ID NO: 76792
  chr14:51027845-51027881
  Hyper

SEQ ID NO: 109647 - DNA, 281 bp, Homo sapiens
  chr14:51338697-51338978
  Hyper
gtgtgtgtgtgtggccgcgaacagcctgacccgggcggagcgcaccctcgggccgcgtctcccccgccgtaccagcctgcctgaccgcgcggaggaggagggcgggcgcggtgccgccggggcgggaaggtcgcgggcggctgctccggactgcagctcccgcggcggtggcggcgtatcgggacacggcgcgggatggacgcgcaggactgccaggcggccgcatcgcccgagccgcccgggcccccagcccgtagctgcgtggccgcctggtgggacat

SEQ ID NO: 109648 - DNA, 49 bp, Homo sapiens; identical to SEQ ID NO: 35282
  chr14:51410296-51410345
  Hyper

SEQ ID NO: 109649 - DNA, 171 bp, Homo sapiens; identical to SEQ ID NO: 76795
  chr14:51410569-51410740
  Hyper

SEQ ID NO: 109650 - DNA, 126 bp, Homo sapiens; identical to SEQ ID NO: 76796
  chr14:51411033-51411159
  Hyper

SEQ ID NO: 109651 - DNA, 1725 bp, Homo sapiens
  chr14:51560287-51562012
  Hyper
ggtctggcccagagccgggctcatcagtattccgcctgcggcgtctccccgaccctccgccgtgcctcaccaggtccgcctatccagcagcgacagactcccgccgtccgcgcgaccccaccgcccccatcccagtccctccccgagggttcgcagcccgccctgccctcgagcgtgcctagcggccctgggcactggcgcggctctacccagctatgcagtgctttcccacacactggccgcggccactggctgcagacccgccgcggaaagggggcgccctgagtcccgctcgcaggcagcgcgccccgagagacccgctctaaggcatccccgcaacaactctgtgggggcattcaactcccccgtgcgccggttaagattcccccatgcctcctgcaatgcaccagaccagggaggtaaacatcgaaggcacctgcattgcgcccccactgggatgcgctgtgcgcaagagacggggaccgtctgctgcaaaaccggatgatcggagacgcagggagttaggagtgggttttcttaggactcaccttatgtagtttccacatggcccccagagccttgacttcgtggctggagtgtttgccctcctccaagcactggtagcacacgggcatcttgcattgcacgcagtacatgctgtggttctccagctcgtggtctgtgcaggtggagaccttgcgtgggctcagcctccggctcacacgaccctgggccgggggcaccaggcggtgcttggctaggggcccccggggcgggtggcagcgcaggcggcacggatcgcagtagaagacatcgcactgttcgcacatgacggtggcttccttgggcgccttctcgcagagctggcacttgagggccgcggctttgctctgctggtagcggtcaattaccccttccagtacgcgattcttggggaagccgcggagcccccggtcatccaggatgaggctgcggtgacactgggggcaggtgatacaggagttgcggggcaccggggccagggccggtgacaagtgggtggccggtggcggcatagccgggggaaacacgcggacgccgttgggggacttctggcacggggtagtgggggcgctggcgaaccccccgtaggagccatagccgctgtccgcctcgctgtataggctcatcttgtccaggtccagatagtcatagtcggagaccccggagcccgcggcccgatggctctggggggattcagactctggggtctgcaccaggatgttgcgggcgcacgcctgacacaaattgtgagagcagggcaggatgatgggctcccgatagaaggagccgcacacggggcatttcaactcctcttccatctcctccatggggaccggtctgggaggagacagcgacggctgcagcgggtgcctgagctggcgaggtggccgacgggcccgtcttgtccagcaccctggccagcggcggcggctgtggtggtggtgccttcccgcgcagcactggcacggacacccagagaggcgctagctctgtgagccgcagccgcgtagccgccgcgccgcgcgccagcccggaccgcccctacctgccctcctagtcccgccccggcccatgagcagcggcccattgggcggggggcaagagatcgaagctctcattggccaccagacccgtccgtctcctcgtctccgcaggccacagggggttcggtagagtctgagg

SEQ ID NO: 109652 - DNA, 425 bp, Homo sapiens; identical to SEQ ID NO: 35288
  chr14:51562235-51562660
  Hyper

SEQ ID NO: 109653 - DNA, 165 bp, Homo sapiens; identical to SEQ ID NO: 76801
  chr14:51849769-51849934
  Hypo

SEQ ID NO: 109654 - DNA, 39 bp, Homo sapiens; identical to SEQ ID NO: 76802
  chr14:52119506-52119545
  Hyper

SEQ ID NO: 109655 - DNA, 70 bp, Homo sapiens; identical to SEQ ID NO: 76803
  chr14:52226939-52227009
  Hypo

SEQ ID NO: 109656 - DNA, 30 bp, Homo sapiens; identical to SEQ ID NO: 76804
  chr14:52241137-52241167
  Hypo

SEQ ID NO: 109657 - DNA, 17 bp, Homo sapiens
  chr14:52321531-52321548
  Hypo
gccgtggctctttctta

SEQ ID NO: 109658 - DNA, 23 bp, Homo sapiens
  chr14:52395020-52395043
  Hypo
tacaggcgcggtggctcacgcct

SEQ ID NO: 109659 - DNA, 30 bp, Homo sapiens; identical to SEQ ID NO: 76807
  chr14:52484814-52484844
  Hypo

SEQ ID NO: 109660 - DNA, 1924 bp, Homo sapiens
  chr14:52534580-52536504
  Hyper
ccgagggcagcgccccgcgcttgacctcctcgtaagcgcctacctgctcccaggtggccaggaaggcgtgggtgggggtaaagcgcgcagagcgcgggaagccagcgcgcacatagcgggcggccaggcccagcactgcgggggaggtgtcctctcggtacaggactcggcctctgccgtggctcgtgtcgatgtccgccagaaaaggggcgatggccgggaagtcggtggggaaatcatagtccacatactgcgtttccctggggaagtcctgagtggagatgatgccgttggtgcccacctgggagaggagagggacaaaaaggtgacagtcgctcaagcccaaggacgctaccctttcgcgcagggagggaagggaactgacttaggcaaaaagcctctctctccttccccactggccagggagtctggattcagggaaacaagcgcaacttttgcgactgtcccagctccgcgctgcagtaggtccaggggccctaaaactcgttcacctatcttctcactcccctcacaaccccggagccccatgtcctcggagaggaagcctccaggtctgaagagggaacaccccagctccgcagacgggcacagccttctcgcggtcctaactgcaaagcccgctggccgccctagcaacgccaccttttctgcctgggacgcgtacgtggctgcgaacaattcttgctctcccctccaggtcattcttgctcccctacagcagcggggcaggcagcggcatcgctctctggccgggtaccaccgcaagggtgctggggggctccaggagtggggtctgtttcctcccctctggaggcagggtttccgtgagaccgaccccagggaagaagctgcgggaaaagtgccaggagggggctgaacttacgtagaggttgctgaatcgggcttcgtagaagtgcaggggattcgccagcttcaccacggctgagctttcgtcgtcgccttcctgcaggagctggtccccccacgactccccgtgtgggaagagctcgtctgggtgcagcgccgcggcccgcaacattagcaacggcagcagcagtagcactggtaacgacgacagcaccggccgcccggccacccggtccccctccatgctcgctcggccgtgcgcttacccgctgcacaacgcgtcccgccccggcctccagcccactctccgcgccgcgccagcctcgaacctggatctccgcgggcgcctgggcggggcgggactccaggcccacccagcaagctaattggctgaggccctcggctggggaccaatcaccggctctgagaaagttcggcagtggccaccacatctggttctcgttaacttttctaaggcagcggccgctggagcagcggggctggcggggtaaaagctcctggccagggctgcctggagctgccccttccactccgcccccagggagctcccgggtcatcctctcatccgggctgccccgcggcccccaaggagccccacccccgggaccaaatggcccgcaaggtttggggcagcggcgttgcaggagatgagctcagcgcaaagggaaccccgcagcggcgagtgcggctgctggcctgcgcgctgtggccccaacaggctggcagggcgcgggcgggtggcggggttgcggtatgagctttgctccctgccctggggtcccgggcgctcctggctctggaggcctggccatcggtccgaaaagcaaagggacattgtcgtggtcccctcggccgcttcgctccacccagagacgccctgaggagaagcgagcctttgtacgaaggcagagggctgactcctaagttctgtccccctcccgaaggccggccgctagggaagacttggccaccctctggaagtaccttcccccgggaaaaccgcagcaggaaagac

SEQ ID NO: 109661 - DNA, 1101 bp, Homo sapiens
  chr14:52734481-52735582
  Hyper
gggccctcgcccttccgcagccttcactccagccctctgctcccgcacgccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgagcgccttctccctggctttctgcgcgctacctttcatgggcttcgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaattgtgagtccccgggccccgaggcagcagggcactgagactgtccggccgcggatgcggggcgggaagggtggagcggatcgggatggacgcggcgccaggcgagctgcgccctgggccaggaaggtttgctgctgagttccccaaattggattccttccacagccccgagatataactcagtttgcggagcgaaatgagggaaag

SEQ ID NO: 109662 - DNA, 46 bp, Homo sapiens; identical to SEQ ID NO: 76821
  chr14:52780697-52780743
  Hyper

SEQ ID NO: 109663 - DNA, 30 bp, Homo sapiens; identical to SEQ ID NO: 76822
  chr14:52780977-52781007
  Hyper

SEQ ID NO: 109664 - DNA, 554 bp, Homo sapiens; identical to SEQ ID NO: 76823
  chr14:52781428-52781982
  Hyper

SEQ ID NO: 109665 - DNA, 89 bp, Homo sapiens; identical to SEQ ID NO: 76824
  chr14:52940008-52940097
  Hypo

SEQ ID NO: 109666 - DNA, 30 bp, Homo sapiens; identical to SEQ ID NO: 76825
  chr14:53259141-53259171
  Hypo

SEQ ID NO: 109667 - DNA, 1018 bp, Homo sapiens; identical to SEQ ID NO: 76826
  chr14:53416802-53417820
  Hyper

SEQ ID NO: 109668 - DNA, 30 bp, Homo sapiens; identical to SEQ ID NO: 76827
  chr14:53819535-53819565
  Hypo

SEQ ID NO: 109669 - DNA, 222 bp, Homo sapiens; identical to SEQ ID NO: 76828
  chr14:54421079-54421301
  Hyper

SEQ ID NO: 109670 - DNA, 630 bp, Homo sapiens
  chr14:54422341-54422971
  Hyper
cttcaactcacaaaccgcgatccttggaaaccatcctccaaagcagtgcttggaggcctctaaggcccccggaccaactcccgctggaagaagcctgcagggactcgggaatcacgggaacctttcccgtcggttccgggcctggagggccaggaagagccgcgcgtccgcctttcgtcccgccaggaactccccataggacacgacaccgcaggaacaagcgtcctgggagcccctgggatcttggctgtcgtctctagggaccctacaccgtgaaatgatagaggcgaggttccttgggttccgcaagtcgacgaaaatagctcgtggagaaggcgcgtcctgcaactgcagttcgcaagctctcagggcgccccgccagctgggggccagattgggtgacactcccctcgacgcagcctccggagcggcgcgcactctccagaggccagcaggactgcgctctctaccgcagaacctgctccagctaggtgttctctccccatctcgccgtcgctctgccccctcactctctctggacctcagagccggttctctccttcctcctcccgcgctttccgtccggggatcgcaacctccagcccgtgggcaacgcgttcagcccaagac

SEQ ID NO: 109671 - DNA, 106 bp, Homo sapiens; identical to SEQ ID NO: 76831
  chr14:54423369-54423475
  Hyper

SEQ ID NO: 109672 - DNA, 461 bp, Homo sapiens; identical to SEQ ID NO: 76832
  chr14:54430146-54430607
  Hyper

SEQ ID NO: 109673 - DNA, 30 bp, Homo sapiens; identical to SEQ ID NO: 76833
  chr14:54687020-54687050
  Hyper

SEQ ID NO: 109674 - DNA, 42 bp, Homo sapiens; identical to SEQ ID NO: 76834
  chr14:54687254-54687296
  Hyper

SEQ ID NO: 109675 - DNA, 17 bp, Homo sapiens
  chr14:55370202-55370219
  Hypo
cttaaaatccatttccg

SEQ ID NO: 109676 - DNA, 39 bp, Homo sapiens; identical to SEQ ID NO: 43985
  chr14:55517158-55517197
  Hypo

SEQ ID NO: 109677 - DNA, 233 bp, Homo sapiens; identical to SEQ ID NO: 76837
  chr14:55519752-55519985
  Hypo

SEQ ID NO: 109678 - DNA, 52 bp, Homo sapiens; identical to SEQ ID NO: 76838
  chr14:55596101-55596153
  Hyper

SEQ ID NO: 109679 - DNA, 30 bp, Homo sapiens; identical to SEQ ID NO: 15822
  chr14:55664068-55664098
  Hypo

SEQ ID NO: 109680 - DNA, 321 bp, Homo sapiens; identical to SEQ ID NO: 76840
  chr14:55765285-55765606
  Hypo

SEQ ID NO: 109681 - DNA, 74 bp, Homo sapiens; identical to SEQ ID NO: 76841
  chr14:55766010-55766084
  Hypo

SEQ ID NO: 109682 - DNA, 30 bp, Homo sapiens; identical to SEQ ID NO: 43988
  chr14:56077686-56077716
  Hypo

SEQ ID NO: 109683 - DNA, 267 bp, Homo sapiens; identical to SEQ ID NO: 43989
  chr14:57045520-57045787
  Hypo

SEQ ID NO: 109684 - DNA, 1364 bp, Homo sapiens
  chr14:57260863-57262227
  Hyper
cattttaggccaattcgttaaaccagccgtctaaacgggccctggcactgggtatccgaccgctccacgcgccagctggtgaggcctggagttggaaccggaagccgtctccagccggcctcctaggccctaggtgcccgggtgggcacacttccgcgagggcccggggacagcgccggccaagtcttgcgggcaactgcacactcggttccgggaggcaggtactccaggtcgggagccctgaggccaagcctgtctcagttcccacgtcaagaggaagcctgggcttcggagcccaccctgcctggggccgcggtcccggagcgcggcgggaagaacgcccacgtcacctcccggtgttgttacacccacaatcaccacactctgacccccgcaaagaccacagaggagtaggaagagggctgccctcgtactccccaagccacccccgcctctgagcgcggaggcacgatgttctggggctcgagccttcgcatccaccgggccagcgctaaccaccggccgccgccctggaggggacccggcggccccgccacgtgcggctgcgagtttcagacccgcttccggggggcggcggccgtcggaggcctgggttggggggtcgtgagccggatgttccccgcagctggccagaaagctgcctctgagcctcttgagcaactccctgcctcctccggtagtctctctggactctccaagtgacttgctgggggcaccgggcgcggggagggcaggcccccggggtgacgcaggtgtgtactttacagccagagaaggcctagctttcagggacattggcttagtttgttgggtgagacgtgggggtggagaatgggagcactgtctctttgccaaattttccagagaaaccccgggactagctctgtccctggtgccccggctactgccagcgggtccttagcgctgtcgattgcgcgcaccggagcccgaagtcttccccaccgctggcaggagagccccgcgagctctcccggacgtgtcgggtcctaaaggggagagctgagcagccacttcagggattgcactccgaggtggccgaggcagggaggagcgctggccccgcgaaggaggcctcaaccttaggacaacccgggcgtcccgggcgaaggtctcgatctgccggagccactgcctttcaggcatcgctccattaaagccagggaggagagggtcattggccagcgacccgccctccttacgtccggaggtcaccccacgcctacaggcaggtttttctgtctcctttgcagaacactatgcgtttgttacaacgattaaatgaagaacacagaagtctctggctctgccgggcagaacgcctc

SEQ ID NO: 109685 - DNA, 1881 bp, Homo sapiens
  chr14:57263796-57265677
  Hyper
agggcggaaacggggcgactaggggaatcaggttttatcagagcaccctgcgctgacaggctcgggcggtttagaagagaaaatcagaggtgctcagggcacctggtcacaaacctgggcatgcagatgcctgatgggggcttggaccctttcgtggcacgaaaaggagagagactgctgttcatcttaaaagtctcgaaggaggcaaaaacccaggcggaagtcatggctgactctgatcctgcatcttctcattctggttgttttccaccgcgtctgctcccatttgcgtgggatgcgctggtctcctgcccgactcttttgtgttcctcttttgcatgattaaaaacacgtttctatatgcactaaaccatcacctagcactggcacgcctggttttgggttacagctttgtccgtataataacagcgaagttctccctgggtgtgagatgcgggttcgaacatgtggtgtgcgcgccagggctggccgcttccggttaagtggacgcggggacttgactgcgtcccctgccttgcaggtaactggaatgggttgcctggcaagttggccctgcccgggacgccgaagggaccgcttccccattccagagcctgcctctggccttcagggccgctgacaggtccgaaaagaaagagaaggcactcagttttaaaaaaaagagatctagaggactggggaaaaggggatgagccaaggcaaactgggaattgctcgggcttcccccgaaagcctcagctcagtgccgggggagaccccaacggagggccagactcccccaaatccagtggccgaagacctggatttcctgggaggatccccgggggcccgaggcaggcccagctgggccccgtctgctcgggacgcgggaggcctcagccgtggcgggagcccccgctgtggcggcctcgcccttcgaggccaggagaagcggccccctcctaagccgtcagcggctcatcctaccgggagacctggaaaaccagcagccgcgggccctgctgggcttgctttcgccgccccggccccttctccccggccagtggaccccgctcgccgtcccgtctgtcagtctcggttttagctccttcgggcgcagggcgctcgcctcccggccgggccaccccaccctccaatccccgaggccgacccgacccctgcactccgccaggccgcgaggtttcccagcgaccggcgccccggcccgcggccgacctggaggcctgactgcagggctcgggcggggccctctctcggctctggctggcggcccactcccgcgggcgtacaggcctcgccaccgggcctcggccttgccgcggcccacagcgccctgggaccggcgcccccgaggcctgagaactacgcccggggggcgcgggctgaggctcaagagaggtcctaggtgcgggccagggatggagccagcccagagagaaaggggaaaacccggcaaggcaagagcctcagtctcgcccctgcctggcccgccaggctgtgagtggggcccattgggcagcgccaacctggggagtccggcgtctgccccagctgggggccctcggggcagagatgtgagtgctgttcccaggtaactccgactgggcactggggagttagaaaagccagctctttagccagagcgcctagggcgcggcggagagcgggccgcccggcaccacgttccttctggcagttccgccccagcctcccagcgtcttgcgcctgtggcggcggcagtacgggcctggggggtcacccacaggaaaggtgagattagcagcaccatgtgggagaggggttgaggaaacccaccattatctaaaacttggaggtttccaaagccggaacttaattgag

SEQ ID NO: 109686 - DNA, 313 bp, Homo sapiens
  chr14:57270936-57271249
  Hyper
agtgccacctcctctcgcatgaagatgtctgggtaccgggtcttggcaaacagtgcttccagcacatctagctgcgcccgagtgaacgtcgtcctctcccggcgctgtttccggggggtggctgcgggacaagaagcccagggccctttagggtgggggagcagtttctcagtcataggcgtttccgcgggttctccgacgcccctgccctccaccccgcagcagtcccccgttcctcacagcccttcagccgggagcctaccaatgctctccccaccgtctccccagccttgctccccggggacccaggaca

SEQ ID NO: 109687 - DNA, 37 bp, Homo sapiens; identical to SEQ ID NO: 76854
  chr14:57271647-57271684
  Hyper

SEQ ID NO: 109688 - DNA, 401 bp, Homo sapiens
  chr14:57272009-57272410
  Hyper
agggtgttgcatccccggagggtgggcatggggaagaggggtgcgggagtgcagcagggctcacttacccgggtagcccacggaggggtgcagcaagtccatacccgaagtggtcagactcagcccattgactgcgtaaggcggttgcttaagataagacatcatgctaaggttgtttggaggtgcaaagtcggcccaaatcgggggtacccagctggaagatcttgatgcgcccggggtggacaggttcagagtccttggtgggtgggtttggagcagtggaactaagggcaaagcaaacaaacaaacagaggggctggtttactgcttcggaggcagcagctcttccacgttccagcactaacttaaaaagagcacggactaggcgaggcagaggcttt

SEQ ID NO: 109689 - DNA, 30 bp, Homo sapiens; identical to SEQ ID NO: 11888
  chr14:57273051-57273081
  Hyper

SEQ ID NO: 109690 - DNA, 2824 bp, Homo sapiens
  chr14:57274417-57277241
  Hyper
gattctctccacaaccggcctaggtatgcactctgcatagaaggcatgggcccttcaatctaactttcaaagctcttttcctctcgaagcagggtccagaacggggaaaagaaataacttttgaaaaatccacgcctcactatgactgctcacgaggtggcctctggagaactcatacctagaagctgaccgcggtcgcgcggcgagttccggcagccggtcggcgaccgcacctccgggcgcgagtgcctgggtcccgcgttcctgcccggcagccccgcagccccgcagccccgcagccccgcagccccgcaggcctggcgcccgaggtcccgctccactgcccgcgccccccgcgcagccttatatctaacggtcaattcgtgcaatctgtcgcttctccctcccccacgccttgttttttttttcttccaagaagcccatctaccagttgctgtgtcctcgctcaacaataattacctcgtccgagaattaattataataaatgttttcttgataaactaacgagataatccgaggggcacacgtcccttaattacaggccgccatgctcctctctgcttctcgtccgggctgattaattttctgcatgatggaaaggaaacaaaactacgcggactggcgactggcctgcggctgggaagacgacgaagaggaggaaagaaagaaaaaggagacgtgtgggcaccgcggaaaacggccggcgctggcctctctccggcgaactcgagtgaaagtttctggcctcggggaatcaaataactctgccacccgcgagggagggaggaagaaacgtgccaaaagggttggccttgactattaattatcgttgggagaaagccccggtgttagcgctgaggtctgggtgtctaccttactctggggggaggagttccctctcctactcccctctgttgctaataacttttggtgcctgtaaaaagtcccgagctgagcaggagaaatcctgaccccgaagctctaggatggaggggagaatttctaggagcgacttccccgtcccctccccaagcaatccaccaccgcagggtcggcgccgctcggccttcgctccccgcgcaccagttctatctgtgaaggaagcaaaagccaactcggtggaatcctgacaggggacttgggtttccaaaaatatgtcccgaaatcgggcatcgatttcaagagtcacttgaacgcaacaacgcgaagacttcttgggagtttgcagagcgacccgtcgcccgcgcccggcgctggcagggaccttcggatggttcttactgggccgatccatggcacaggctgggcctcggcgaacccctcggcccccgcccggccccgagccacgacacctcattgtcctggagcctgggaagggggtgcgcgagcgcgcgggcgagccctgcctctccccgccagagaacagctgaggggccgcggtcccagcgggaggattccggtccctggcccggccgcggccttgggcggagcaggggccactagctgccacttctgcccgccccaggtgcgcgcggagggctacgtggggcgggccgcgacccggcaaagtcatgttgaaaaaacactcttcacgttcgctcggcctggtgaccagggtcggggaccacgacaaccgggggttgggaggctgcgtaattacaacccagggtggtttggattttggggggtggtggatatttaaaaacaaaaaggagatctggaagcttttgggagaaacagacaaccgagctgtgctaggctgagggagaggaggccaaagagagcgagcagtgagcgccggggcggacgagaagccagcgctcccagcctcctcggttatccgctccggtttccgctcacgttcaacaggggccgacaggggctcgagcggcggcccccggcccaggccgacccgcaagcgaaccgagcttccggcgcgcgggcccaaggaggcgcctggctttttattattgttgtttcaatccatccatctagttacatctgcatctttttgtctcggactctaaaaaggtccctgggatccatccaaacgaccccaaccaaatctgggggccaaaacgcaaagatcgcgggagaagcccagaacggcgttgacataaaaacaaaaccacaaacaaaaccttccaaaacaccccagattacattcgcagcgtttcgacgacgttttgcagaagcgacgacccccaggagcacgctctctgcctctctcccactaccgctctcatctctagatcacatttttctttttgcaacgatcgttattacacctcaaaatttgtaagagaaaaaatacatccgcctacagaactccacgttcgcagaggggcatcggtcggtctattggaggtactggggtgatggccgacagacacggggacacgtagatatggatatagacaagacagacggacacttaccttacagcctcatgggaggttagaaaaagtcaaatatcctttaaattccaaatagccagctatcctaaaagaaatcaagagtattgagttagaaaccttgcagtcttcacccttccatgaaaagtcaaacacaaccaaaaaaaattttttttaaagaacgaaaatgaggaaggcggctagagttctaaacacgcgtgggcccctctgcaatacatacaaagtagatgtggcgagtgagggctgctctagcaatttttatttttaatcacagtggaggctgtgttggagctgaggccggtcccgctctcagggagatttgctgagaaagcgcctctctggcaactttttgacgcaaactctccaac

SEQ ID NO: 109691 - DNA, 1746 bp, Homo sapiens
  chr14:57277879-57279625
  Hyper
cttctctattccctacgcccttataaatatccttacacatataaataaatgatccccgagtgagagaccccggcttctggtaggttcctggggttttttggaattgagaagcccacgacagactgcagggaacacgaaccccggaatctaatctcagggcccatttaggagaagtagctgggaccacatcgggcctcgaggatgcgagtgtgaggtcgacaagatatcgtggaagagagcgaacgagggaggcccccgttggaaacagtttctgtgttagaacaaacgccaccaaacgaccgacactgcgaggcctggagctacctgggctggcgccgcccgagccccgggctgcgagcccagaggctgggaagtgatgggacctgggggcccgagccggagagtgcgacccccagcccaacttttttgcctggcatagaaagcagggaccggacaggtttcaaacggatccgagtccctagaaaagcaaaaacagactgggcggagtgtggggtggggggtggctagtggaactggtgagtgtgtgtgaataagctgggtgggggtgggagcagaagacagctcttgcttcacaacacccagtgcaggaaaagaaaaataaaatctcttcctaaataccccaccccccgccacccacccaccaccaactaccatcaccaccacggccagtgggcccaaagaaacagctcgctgcctttaatttggggacctatgttaatgaagttggtaattaattcgtcgctttgttgtcggttcttatactgtatgtgtactcaaatgtggccgtccttgggatttacagcaattaacgaattacgggagtgcgcacgaggcagcaagctctcggcagccgggctccggctcgggctcggcctggggctggggactccgcggcagcggcccctgtcacaggtgtccctagagctttgggccctggcggcccctcgagcccccgaggggcccggagcccgcccagctccttcccggccctctgcagcagctccagtccggagacccgctggctgtcgcgttcccaggagtcaagagtttctaggggcccgggcgggggggagggtgagtaccgaccttttttctcaccccacccccactgtactgaaacacctggcggccgcccccgaagcctttaatggggatggtggtgaggagggggtaacaaatgccccgggcgttatgaccctcgtggcgctggctgtcggaggcactggttgggtgcgcttggtcagagtcatgatgctttcgatgaaggaaaggcaaatccacctcgatcacctgaagcagagtctccttcctacccctagaaaagacaacgtttcccccagtttgatcacaatgatgtttaaagcataaaagagccgaaaaagaaaaatggacgttgtgaatctggcagaggggaaggccggaggaaggccttggggacagtgggcatggggtgggatggagaatgatcagaacatgcgcttgtgagctaaaccaagtaaaccattttggactgggagatccatctgccgtagggtccagtgtccagggtaacctttcaagcccgatgtagaggtttgcgatgtcctcccagatggcgggggcagctgaatctccctaaaaatccccctgttctattcgacaggggcagatttatgcatggtggggcgtgagagggttttgcccttccagcggccggcagcagacagctcccgcttctcctttgcc

SEQ ID NO: 109692 - DNA, 30 bp, Homo sapiens; identical to SEQ ID NO: 76864
  chr14:57280814-57280844
  Hyper

SEQ ID NO: 109693 - DNA, 126 bp, Homo sapiens; identical to SEQ ID NO: 35328
  chr14:57281138-57281264
  Hyper

SEQ ID NO: 109694 - DNA, 1395 bp, Homo sapiens
  chr14:57283299-57284694
  Hyper
catacctgagatacacggtgcaaacgcccccggctccctcctttcccaattcacccacttcttaatttgagtttcttaatgtgcaagcgccagggccggctgtggtcaggcgggctattttctggcaagtgtggcgcggggctggacgcccctgccggcgggtcgccgggtctcgagctgcgccgccccgctggaggcgccggggctgcctggctctccgcgcaaacctcgcgcccttccgtttgcgcgcatggagccgggtgagggcggccgcggccaccgcgcgatggaggatttggaagctcagagccagctggtacattttgagaaatttagcaaaccagactgggctgcctcggaaactgggttctgttctgactcatttgcagaaaagttatggggaaaaacatcttgtaaaattaaggttatgtttggcgggtacagtcttgagcgcacatggtcatccggcgaatcagccaagttttccaaagcgccccctctccagctctcaggccaggggagcaaagcgtaggtgtgtgcgtgtgcgtgtgcgcgcgcgcgtgtctctgtgtctgcgtgtgtgctcgcaagcgcgtgtgggtttggggtggggggacatcctgacctttctacaccctagtgcgtcccaactccagactgggaggagacgtctgcggcctctggtcttttcccttcttggacgaggtgcggccagctgagacctcacaccggccacctcggacccagtgcgccgagctaggggagacggcgcgggactgggggacccctgggatcccgccctcgtagcggaaggagtggcagcccttggtgccgggcctggtccttgaggctgccggccctccggggcgccaggactcgaggacgcggtttgcccccgcagtcctaagatccccggggccgtgacagcttggggaaggggcaaactctgtttggtctccacgaagtgcttcgatgttcgcaaaagggtaggcccctcttgcttggggtcctacacccctcggaactggctctgcccctgcctcttccccagcacagtctcccagctaaggctcagacagccggggaaaggggcgcccccatcactattccccacaacccgccccagtgtgagccagggcgcggctgcaggctgacaggcgcaccgtgaccacgccgtcacttcccttcaccaaaggttagatgggaggcgtgcaccctctggggagttcgcaaagcttctcgctttgatcagccgcgcgcagtgccagggagagatattgctggggtctgagtccgtcggaagtgtctagaaaagaagagagaggagcaggtaatcagactttggcggctgccctggagacactttcacacatccagcctcgtggaggaggaagg

SEQ ID NO: 109695 - DNA, 242 bp, Homo sapiens; identical to SEQ ID NO: 76869
  chr14:58332163-58332405
  Hyper

SEQ ID NO: 109696 - DNA, 233 bp, Homo sapiens
  chr14:58332640-58332873
  Hyper
tgcagctcctgctcccgcgcccgggctctgactccaccgcccggcgcagcaccggctccgcatcacagcggcggcggcggcggcggcggcggagcggcccccactcgggccggcctctccgtcagcctggcagctctcccgcgcgccacccggagcactgctgcccgaatagcgccccctcacctccgacgcccaccgtggccgggggcgggtgtgggcgccccacctggtcg

SEQ ID NO: 109697 - DNA, 22 bp, Homo sapiens
  chr14:58404059-58404081
  Hypo
acaggcgcgagccaccgcacct

SEQ ID NO: 109698 - DNA, 41 bp, Homo sapiens; identical to SEQ ID NO: 76872
  chr14:58410326-58410367
  Hypo

SEQ ID NO: 109699 - DNA, 39 bp, Homo sapiens; identical to SEQ ID NO: 76873
  chr14:58599573-58599612
  Hypo

SEQ ID NO: 109700 - DNA, 100 bp, Homo sapiens; identical to SEQ ID NO: 35334
  chr14:58618341-58618441
  Hyper

SEQ ID NO: 109701 - DNA, 60 bp, Homo sapiens; identical to SEQ ID NO: 76875
  chr14:58797784-58797844
  Hyper

SEQ ID NO: 109702 - DNA, 40 bp, Homo sapiens; identical to SEQ ID NO: 43992
  chr14:58893188-58893228
  Hypo

SEQ ID NO: 109703 - DNA, 36 bp, Homo sapiens; identical to SEQ ID NO: 76877
  chr14:58922879-58922915
  Hypo

SEQ ID NO: 109704 - DNA, 30 bp, Homo sapiens; identical to SEQ ID NO: 76878
  chr14:59014447-59014477
  Hypo

SEQ ID NO: 109705 - DNA, 30 bp, Homo sapiens; identical to SEQ ID NO: 76879
  chr14:59649485-59649515
  Hypo

SEQ ID NO: 109706 - DNA, 987 bp, Homo sapiens
  chr14:59931116-59932103
  Hyper
ggccgcgcccagctgcgcggggtccggggaggtccggtagaggcagccgtggaagctctgcgccgccgcgagttcccggggcgccccgagcagctcccagggcaaggagaagcccagggccgtcagccaggcgcccgccagcagctgcagcgcgcggcggcggccgatcttctcccgcggcggccgcacgatagcgcagtaacggtccaacgagatgagcgccacgctgagcgtggacacgatgccgaagcacgagctgaagaagcggctggcggcgcagaagccgcgccagggccccgcggcggcggcaggcgccgaacccccgggcggagtgaagaggtccaggaaggcggcgggcaggcagagcagcgccgtgagcagatccgatagggacagcgacaggatgaaggcgttggtgacggtgcggagctgccggtgcttcacaatcacccccatcaccgcgcagttgccaaggctagacagcaggaagatgagcaggaggacgagcgcctgggccgccactgcagctccgtgcgacagcagcggcgccgcctccgggcctagcggccgcctcaccgccgcccccgcctcccgcgctgccccggacccgccaaggccgccgccaccgggagcggcagctgtgccgcctccgcttgcgtcgctcaggttccccagcgccgcggtcgccacggtgctgaaggagagcacggccgccgtggccgcggaggaagtcccgccaggtgggccggccgcggagggggcgccggagtgctggctgcccagtaaggccatgctcgctggtgggcggggcggctgcggctcctccatggggcccagtggcggccgcggatctcctcatcccgcaccgggggcggcggccgctaggtcggagtggtggctcggggccgggggctagcggccgccgcggggagctgggctcggccggaggggtggcggtcgctggggacctggcggagcctttgacgt

SEQ ID NO: 109707 - DNA, 352 bp, Homo sapiens; identical to SEQ ID NO: 76883
  chr14:60043255-60043607
  Hyper

SEQ ID NO: 109708 - DNA, 479 bp, Homo sapiens
  chr14:60097193-60097672
  Hyper
ccatcttggtggaatcggcagtggcctgcatcgtgcgggctttgggggctcgccgtggctctcctcgggggcgccgagcgtgcactcaagcgttggtgcccggctgctgcggctgggctcgcagtggccgcgcggctgcggagagactgaggctgcaccaggcggcgcgcggtgaggggcgggagcgtcgctggcgccgcagtctgcgcggccggcagcgaatcagcgcggcgcggccccggagccgcctgcgcgcatggggatgcgggcgccgctccacgcgacagcgttggctgggctgcccaagggtgctaccctggagacgggtaaagcggttctggccgcgaaggcgctgacgcggacagtgggtgggaggtttgggaggaggggaaaaagggctgacggtgggggtgagaggaggaggacttgggctgttcctgggagttcttgactcccagaatatgcgaggtgcatattct

SEQ ID NO: 109709 - DNA, 260 bp, Homo sapiens; identical to SEQ ID NO: 76886
  chr14:60336793-60337053
  Hyper

SEQ ID NO: 109710 - DNA, 758 bp, Homo sapiens
  chr14:60385979-60386737
  Hyper
cgatcatgggccctgcgagtctgtgggtagcggctcaccctgctggactgcgcagatccagagaacgacacgagacctgcggttgctttggtttgccttttactaagttcatttctcagcctctctgcccactctgaaaagtctcccctttccccccttttaattctactctattttgtaaattactgttgtctcctgaaaattttggaatgcttaaaaggcactcaaaagcctgtccgagatcgactagaagaccctcggaaggtccctctcttctctggacctcactgggcgttcgtttgcccgcgccgtccttccattcggcttgccgggcgcgcagcggcttgcggctgtggtcagccaccttcccgggaggcggtggtcgctggccgcgggaaggatgccgcgctgggggtcggggttcgtcccggctgtcacgccaccttgtgacatcacagggccatgccctcggggctcaaggccagagaggctccgcgcttccaggacccgagagctaaagataatgaatgggagagagcgagactggaggaggtaacgaataagtccccaccaccttgcccataacgcgttgctttcagtcacgttccgcgaactggcgaaggtaagtgaaaagataagcgcaggtacagaaaaacctgccagcgagaagctcccgccgtttcccaggagccccaggtggggtcttccggttggacccctgcttccgctgattggttggaggtcgccaccacgtgatg

SEQ ID NO: 109711 - DNA, 407 bp, Homo sapiens; identical to SEQ ID NO: 76889
  chr14:60794473-60794880
  Hyper

SEQ ID NO: 109712 - DNA, 30 bp, Homo sapiens; identical to SEQ ID NO: 76890
  chr14:60798457-60798487
  Hyper

SEQ ID NO: 109713 - DNA, 1101 bp, Homo sapiens
  chr14:60951858-60952959
  Hyper
ggatatatttcgtaacgaccttttcaatatagcattcttcacaggaacatgtgggcagagccagaactggaagacgagaggcccccttgagcccatggcgacattcccagccccttcccgggccaagcccaacgagcgcttcagaaatcgttgttgagtcggggcacgacttgaagttttggggatggggtgggaagcacccgcataaccgcttatgcgtgggattgcaacaagcatccggatcttccagggttcacggacacccagatttctccacaggatatgccctttaaagtaaacgctctgaatatgtcccttggtggcgtgtgtacaaccacgtgtagcaaaattctaacgaaagcccttccccaacacccgggtaaacctagagaaacagtgcgatttcgcatttacgaatttaccacgaagaataaaaaaattggaggttttcacagaacagccaattcgcattacggcatacgcctgaggcggggttcctgtctaccgtgcccctcagagcccaggaaccacagcccgtgcgcctcccgcagtgggagttcgccggccgactcccaccctcacagcctcctgtcctggcttcccctcgcccgaggctgcaacaccgcatcccccccatcccccgccgcgccctcagcctcgggccgcaccaacccaggggataaggcgactccggtcgctctgaggggcagggccagccagccccctcccacccacgcacacgctccccctcagagccgccggcccagagaaaaaccgccacatgcagctcccttccacacgcacctaaacagctcctctggacccgaacgcccacaccctccctccctggggtcccaaactccactcaggacgccacagcggatcctaactacaaacggtccccggagccctgggctggactcgctcagccccgcccccacgcccctggtaccagccctgagagaccccgcggagcacgccgcgggagccgcagatcgcgctgaagagcagcgagatcgcgctctggacgagacctgcgcggctgcaaccgctccttcttcgcgggtggaagcgcggaataagccccgtaaaaccacagaa

SEQ ID NO: 109714 - DNA, 853 bp, Homo sapiens
  chr14:60973239-60974092
  Hyper
atacttcttcctgttcgtcccttccccttgtgaagctggtgaacaaataagtgattccaaggtgccctggcgcagtctatttcctttgggttaataaaattaaatcaagtcccttgcgatggcgaagatggatctcctgatagtagtccccaacctccaggcacttctcagtcccttcctgccaagccaccagacagtgctcctactctgccacacgcagcccgcacccttctggcggctcccgcgaggccaactcagactctcagttccagttgcccgcgagcctcagacacgcagaagctaaagcgccctcatctaattatttgcagaactattatccaagaaatgggccatgggataaatattcccatttcctggatggggcccctagactgtccacttgctcacaaagattaagggtaagaaaccagctctccccgaatgtgccgcttccaaactgtccagtaaaagggcgagagggagacgtgtggtctcctggggcatggacaacctctcccacctcagcagctaggcgctgggatcggggtcggctctcggctcggctcgcgggctgtaaggtctccgcggaccccaccgcctcttctgcgcgctaagggtgagcgccaagcaatttcgcgagcaatagccggcaaagtaaccaccccgagagggaaaataaacctctgcaaactggagcaagggggtgctttcctcccctggccagaagctccgggatcgcagccctcccgggtccggcttcatccctgcccggccaccgaggccctctttttctgcaccgcggattctcctccgcctgcgtgttcggggcccttgtatccgatgtttctttcta

SEQ ID NO: 109715 - DNA, 47 bp, Homo sapiens; identical to SEQ ID NO: 35348
  chr14:60974368-60974415
  Hyper

SEQ ID NO: 109716 - DNA, 1476 bp, Homo sapiens
  chr14:60975384-60976860
  Hyper
gaaaaatgagaagatcgcttccccccaccggcttcctgctcccaccgcaaggtttgctgtttcgttacaactaaacttgcgaattctcggagcatttcagtttggcccagtcctctttgtcctctggagacctctcgaccgagacaacgcatcgccccaaagtgaattcctgaattcctgtggcatcactgcctatttggtgggaaaaagggagggaggggtagagcggggtgggggagggaggagtagtgaacgctgccgcactcgcctctctttttctcccagacactcgcatgtcttttcaacctccaggttctgcaaaatactgaagaaaagtccaggagctaacggcgggcgctgtcgagcacggggaggtgctgaaatagtcctggcgtgctgattcaagctttgattggcagagccacccggtgactgacagggggtctccatggcgcccgcgccgccaatccgcccaccccaatagcggagccagctcgcctgccggcgtgcctgagccgagccgagcccgaaccccaagccgcggagccagcacctcctccagtcggggtcgtccgctcccggccgttgagccaccgccgccacccggtagtgtgtcccgctgccccaatccgcctcatcaacaagcgcctggcacactcagccaggcccgcgggcatctgctgcgtgtcccgctccgggctcagtgccctcgccgccgccggcactgcctcgatgttccagctgcccatcttgaatttcagcccccagcaagtggccggggtatgtgagaccctggaagagagcggcgatgtggagcgcctgggtcgcttcctctggtcgctgcccgtggcccctgcggcctgcgaggccctcaacaagaatgagtcggtgctacgcgcacgagccatcgtggcctttcacggtggcaactaccgcgagctctatcatatcctggaaaaccacaagttcaccaaggagtcgcacgccaagctgcaggcgctgtggcttgaagcacactaccaggaggctgagaagctgcgtggaagacccctgggacctgtggacaagtaccgagtaaggaagaagttcccgctgccgcgcaccatttgggacggcgaacagaagacacactgcttcaaggagcgcacgcggcacctgctacgcgagtggtacctgcaggatccataccctaaccccagcaaaaaacgtgagctcgcccaggcaaccggactgacccctacgcaggtgggcaactggttcaaaaaccgccgacaaagggaccgagcggctgcagccaagaacaggtcggtacctagaggcctccgcgctttgagcgcaccggggaggaggcgggtggaggcacctctggcgcccttacccagtccctggcgactccaattcagcaggagttgggagcgcggtctgtcttgggttaagagccctgcgttctgggctcctggccgggagttcccttgc

SEQ ID NO: 109717 - DNA, 1005 bp, Homo sapiens
  chr14:60977284-60978289
  Hyper
ttttgcggaagagcccggcctcatcccccaggcccaaatgctccttacaatcctttttgcctttaggtcgggccgacccgatccaacgcgatcgcgggagcacttgctcaggcgtaagccccaggcagacgcaccgttagaaatggtatcccatgtccctgggaccgatctgtccttgtcacccacacttcgtttatttcctgacagtcctgtaaatctcccaaaagtgcacaacaaacagggaggacactgcaagcccagtatataaaagacctgggagctgcggcgctgagaaagggcgcgaatcatggtggggcacaacagtagggacccgcggaggggcggccgcggactcctgcccgacctctgtcgccttgccgagtaatcctcgccttaactgctggggtcttcggaagaacctctagccgccgggctggagggacgcaggaggtggtgggggcgggcgacgggcggctgtgttacgagctgtgacccgtgttccctttcttccccgtagactccagcagcaggtcctgtcacagggttccgggcgggcactacgggcggagggcgacggcacgccagaggtgctgggcgtcgccaccagcccggccgccagtctatccagcaaggcggccacttcagccatctccatcacgtccagcgacagcgagtgcgacatctgagttgcccatccaggatgctcagaagcagattccagtgtaaaaacgagaaaaacaaaatgaaagaggggaagaagatgagagacctgcaaatccagcgccacagaagccaggtgaccagggacccgcgggctcgggttgccgtttcccgccccaccccgcggccggcctggcttcactggcgccctttggccgcgaccacgggaaccagcggtgaggcctgacccagcaccacgttcttcttgctttgctttttcctaaggattttgctgcaaagtctccttcggaacccgaactgcaagctgagcgcctgcccagattc

SEQ ID NO: 109718 - DNA, 30 bp, Homo sapiens; identical to SEQ ID NO: 76903
  chr14:60978879-60978909
  Hyper

SEQ ID NO: 109719 - DNA, 1842 bp, Homo sapiens
  chr14:60981157-60982999
  Hyper
ggtcaggctcttttccggcttataaacatttcaaccacactccagtttcaccaaaaaaaacgacggcccctgctccccaaatgccgcagttcctctcgcctccactttaatgacccactccacttccacccgtcactccctcctttcccttcgccagtttgtttataaaaaatctgggagggaggggagaagacgatgggggtggggagggcttgctctttgtttacattaaacaaatgacaggcaaagagctcaagcaaagtcttccttgacctcgttccctctccctaattttaacaaaaaggaaaaaaatattgtatccaaagagaatgtgaatggggcgggaggagaggagaagcagcttttcgctctattcaacggggacgcgagagcgcggacgatttccgctccttttgtgaggcggagcccgggggcggccgtgaatggggggtctgtggagcggccggcggggctgtcaggcggctctgcgtaatcagggctaatgacggcggccgggcgctcggcgggacaatgcgcggggccgcggggttttgtcggcctgaatggctaataggtttgcctgtgagctgcgagggggcggtgtcggggaggaggcggcggcgaggggagaaggggtcattgtccgcgcgctggcccgggcgccgaggcgtgtccctgcctgcgccgcgcggctacccccgtgcccggcgccgccgacgggaaggcagcggcggggaggccccctggaggcctgctgggaaatggcggctggagcggcgggcgcgtgggtcccctcggggaggcgccccaagccacggtccgctcccaaagagaagcccagactgggcccacagtacccgggaaggtgagtccttactcgggggcccagatctccccacggaggccacagatctgggtccccgaggaaggagagccccccttttcgcgcacccaccttttccatccagcgccccgcgaactcgcggacgtgtaggcctcgagccactcctactgttgggctgcgtgactcagcggctcgaggagagaaacctctcaaaaccgggggaccgagacggggttcaatttaaacctaggtgggagaatgagcccacaagcgcgcgcccctgcagctgcggaggcgcgcgcccgcccaccctcgggcgcctgaagtcgcagcggttgcagagcctcgagcccgtggatgcggcgcgcgccgcggtctgggcctgcgcgagaggctgccgcccgcgtcgggcctgggcctacgcgtgtctggcctgggcctgccggtgcaacagcagttgtcgccaccggtcctaggccgcgccgagcgagtcgccgagaggggcgggaagaggggagaggtccgagaccagggagcgggacctaaagggggctttccgcgcccgacaggtccgccggggttagccttcgaggcggggagagggagcggggtccttcaaggaccgcatgttcgcgatagcacatttgagccctggcaggccacctgggccgccttctttcggaaaccttgcggggtttccaagcaaggtttacaatgggaaactttatttcccattgtaagctcttacaaatctcctctggctagatccttccttgcagctctctttgctaggatttatattcccaaacttcttcagacgtgccctaccgcgagggaacgaactggttttcttcccgttttcacctccttgtctggagacaaaggggtgtgagggcgatcccagagctgaacaagcagtttcacgcctccctgcccgctcatgctgtttccgcttgccctgtggtttgctctgcctggaacgccgccccctacctcaa

SEQ ID NO: 109720 - DNA, 724 bp, Homo sapiens
  chr14:61104140-61104864
  Hyper
cctaccccccagtgccggcgaggccccctggcagatggaagctgctgactgatgggggctgccgagcgcgagggagctgagtgaggcccttgcgccctaggcggttgcaccccggacccctgcagctgtggacgccggagctgtgcgcagtcatcctgagccagcccgcggggcccgatcggaagggacgcctctcctaagagctggcctggagtcctggagcctccaagcgggcaagtaggggccgcaaaggctgggctgggcctccgctgaggccctcgggggcctctgggccctcatggcctggaggccgcgcggcccaagcccctagagcagaggccgcgctagcctgcaggggtcgacgcagggccggaggcagcggcttttccttcccactccgggttgaccctaaagacacgatttaacgtggcggcggcagctgcccacgctgtctggaggagcagggcgcctgggatgcggcggcgaaactggcccggaggggggcccaggcctcacgcgcccggctctctcccagctctcctcctcctccttctcgggctcagaaagccttccagccgcggccccagccctccccccagcctgtgctgggctccgctttccctccatcaactccaagccgaattcaatccgagaaggctcctttgagcttttgtgtttgctgggggagatgtgggcgcaggagggatcgcgttacaactttcat

SEQ ID NO: 109721 - DNA, 254 bp, Homo sapiens; identical to SEQ ID NO: 76910
  chr14:61108567-61108821
  Hyper

SEQ ID NO: 109722 - DNA, 1157 bp, Homo sapiens; identical to SEQ ID NO: 76911
  chr14:61109111-61110268
  Hyper

SEQ ID NO: 109723 - DNA, 299 bp, Homo sapiens
  chr14:61110508-61110807
  Hyper
catctggaatatgcgcgctctggatttagtgccaggggttttacaaagagtttatgactgtgacagaaaattgtccttttaacaagtttacaagcagtaatcacgggggcttttacaggaccagcgctcttgctcctcgccggatctgcagacatttccaagattcaccaactaagggagcaggaagtgggccggggcgccctgcgagacacaacttccacgagcctaaaattatcccaggcggagctgggagagtggagggtagtcaccggagtaggaagagacggcatgtaagaaat

SEQ ID NO: 109724 - DNA, 608 bp, Homo sapiens; identical to SEQ ID NO: 76914
  chr14:61114114-61114722
  Hyper

SEQ ID NO: 109725 - DNA, 1613 bp, Homo sapiens; identical to SEQ ID NO: 76915
  chr14:61114997-61116610
  Hyper

SEQ ID NO: 109726 - DNA, 160 bp, Homo sapiens; identical to SEQ ID NO: 76916
  chr14:61116868-61117028
  Hyper

SEQ ID NO: 109727 - DNA, 358 bp, Homo sapiens; identical to SEQ ID NO: 35364
  chr14:61118778-61119136
  Hyper

SEQ ID NO: 109728 - DNA, 34 bp, Homo sapiens; identical to SEQ ID NO: 76918
  chr14:61120426-61120460
  Hyper

SEQ ID NO: 109729 - DNA, 141 bp, Homo sapiens; identical to SEQ ID NO: 76919
  chr14:61123540-61123681
  Hyper

SEQ ID NO: 109730 - DNA, 393 bp, Homo sapiens; identical to SEQ ID NO: 76920
  chr14:61124304-61124697
  Hyper

SEQ ID NO: 109731 - DNA, 507 bp, Homo sapiens
  chr14:61188120-61188627
  Hyper
atccccgcagtgccccgcggtcggttcgctttcatgccgaggggaggggattacccgggctttgggctgcggggccaggagcgcagaaagcgctttgatttacaagctgaggctgagccgccgtcgccgtctgcgagggtgactcaccgggggtgcgggtgggaggtagatccggagaggggcctaaaccaggcaactgggccggcggcggggtgggtgtggagtttatggggtggggcgggggggacgaagaagccagcagtggagcgtgggggagtcccagggagcgtgcccggctcgcgagcggaggcggcggagcagctggcctgctcgcggtgcccccttgccaccctctgccccggccctgcggattccgttggtttccgagcgcgggatccgcggcctctagtgggcgcagggcaggtggctcggcgtaaccaaagcgccttctctggacctctccgcatatctgcggaaggcgcacgcacatcccggtgcaccttttgt

SEQ ID NO: 109732 - DNA, 190 bp, Homo sapiens; identical to SEQ ID NO: 76923
  chr14:61655782-61655972
  Hyper

SEQ ID NO: 109733 - DNA, 384 bp, Homo sapiens
  chr14:61747354-61747738
  Hyper
tgaagaggctgttggcgatggcgccgcagggcgcgatgggcaggccggccgcgctgcgctggtagggggcgcactcgttgacagggtggcgcagcgcgctggggagtccgctcagctgcgcgtcgtcgcgggacacgccgtagcgccggttgttctggtagaagttggtcagctcgtagtagaggtacactgggccctggaagagctcgggcagcgagaagtaccaggcgcacgagcaggggggcggcagcgcccggccctggccagccgcggcgcacaccgagcagttaccggtgcccgggtcgcctgtatagtcgtactccagctccttgatgccgttggaggagtagtagaggcccaggcccaggccgatgaaggccaggc

SEQ ID NO: 109734 - DNA, 107 bp, Homo sapiens; identical to SEQ ID NO: 76926
  chr14:61748097-61748204
  Hyper

SEQ ID NO: 109735 - DNA, 237 bp, Homo sapiens; identical to SEQ ID NO: 76927
  chr14:61788181-61788418
  Hyper

SEQ ID NO: 109736 - DNA, 483 bp, Homo sapiens; identical to SEQ ID NO: 35370
  chr14:61788722-61789205
  Hyper

SEQ ID NO: 109737 - DNA, 30 bp, Homo sapiens; identical to SEQ ID NO: 76929
  chr14:61943693-61943723
  Hyper

SEQ ID NO: 109738 - DNA, 140 bp, Homo sapiens; identical to SEQ ID NO: 76930
  chr14:62148179-62148319
  Hypo

SEQ ID NO: 109739 - DNA, 708 bp, Homo sapiens
  chr14:62279298-62280006
  Hyper
gctgggctctcaggacgccggcggcggccgcagggctggcggctgctgggcgcggggcggcgcggggcggcgcggcgcggcgggggcgcgcggcaggaggggctgtgcgcggcgcggcccccgagcgcaccgggcctgccgaggagcgcgcgcccggccgggctcggcgccggtttcccgaacctgggcggccgtcgggcagccccctcgtccgaccatggcgactgacagtgagtgcgctccggccgcggaggccaggggtggggggaggccgcggtgcccagggtgggaagttcgatttcagacgctgcctttgtgctggctcgcggcagcagcggccgggtccctctccgctcctcacccttggctgcctggcggggcttgaaagggcaggtggccctggcggcgcgccccgcgagggatgtggcagaagggcgtgcgcctggcgccgaggcggagggaccctcgatgccgtgtggcagcggggcctgccatcgcagcccttcgcgggcactgcccccaggcccagagccagccttcagcgagccgggcaaacgaaggcactgcgcgtttttggcgctgtgagttcaaggttcgcctcgagttctgggtcgggtttgtgcgtctgccttttggggatcagggtggcttgcatggctcggctgcccggtggcccacgggctgtattcgcagcgggcagcacaaggc

SEQ ID NO: 109740 - DNA, 23 bp, Homo sapiens
  chr14:62483117-62483140
  Hypo
agttatggcattggccgggtgtg

SEQ ID NO: 109741 - DNA, 30 bp, Homo sapiens; identical to SEQ ID NO: 76936
  chr14:62523769-62523799
  Hypo

SEQ ID NO: 109742 - DNA, 735 bp, Homo sapiens
  chr14:62583664-62584399
  Hyper
cactgagccaaaccccgctgcttcctcagccgctgaaagtgccgccccacccctctccccaaacccgacctccgtaggggacaccgagccaaggcctgcagcgagtgacctgcccggggaggcgcgggaccgaggctcacctacccgggcccgcgagtctcgcccagccccagcctcccaacccactctgccggccccaacttaggcgagcgcagtcgggacccttctgtcggggctctttgttcgccgcccctcggcgttccagctctcaaccttgctcccagcagcccccgccggcgcactcgacctacaggaaagttgctcccgagctgtggaggggcgtcatcgcctcctagcaacgctcctagcaaccgggtaacatctgctccctgtggtccaatgcgagctgagaacagctgcgcgcccgcctagcgctgcgaacccggagtgagaggcgcttcagagactggagggacggacctgcaggagccagggctgcccgccgagctgcagttgccgctactgccgctgtcagcgcccgactgaagagtgacagccgcaaaagcaggagtgagcaccgaaccccgcgcttctacctaacaggtgcatgcgccgatctggtgagtggacccagctcacaaggtatgtctggattcatccagccaggtgccttcctccgagctcagaagggactcctttccttgagggggaggatagggacgtgttccgggatcc

SEQ ID NO: 109743 - DNA, 1357 bp, Homo sapiens
  chr14:63511856-63513213
  Hyper
caaaaatgtgttctgcggtgccaccagccctctcttgccccccggcatcctgggtctggagagcagcggccaggatccgcggcgggggagggggggatgcaggcaaagaaggtggaggaagaggaggaaaaggtggaagagaagattgagccgaaagaagagggggcgcggcggcggcgacggggtcccctgactgtgtctccagcccgacccggatgagcagctctggggaggaggaccaggcagttcatggtagtagcgctcccccggccgccgctgcccagactgtggcggtgccgcacacggggctcgggaactgcaggctccgcggggcacagtgcgcctgcgccgcccccgctgtcgctgtcccgccggtgctgatgctgaggctgctgctgaggctgctaccgcggcggccggcgcctgggcgcgggctctgcatctctccccctgctggggagcgcaagcgggaactcaagcccccaccctcccaatccccctcagctcagaccgagaccccttccccgcgccttcgtctcccggtctcctcgtccaccccctcgcgcagcgagctccgggctgaacagcgtagcccaacttctgggctgtgcgcctggtggttgctcctctccccggagatcgaggcaagcgatcgctgtccaatcgggccggtggaatgggagaagagggtgccagagagagcagtggccagtcggaggctcacatctcggcgtctcccgctcgggtcccgaatccgggctgctggcgcggacgcggctcccggggcggaggtgcgggcaggctccagctccagccccagccgaggctgagagcagggcagggactggctgggcggcgcgcggggacgcagagcagccacctgacgctgctaccgcccccctccgggctccggcgcctgaaaccttcctgaacactggcgctttccgcaccgcccttaccccaccccggagcgggagcgcgagccctgaagtccgagcgcacagccggcgcccggaatggcccctgcgacccgggccgggcttggcgtctgggggagcgtgcggccgcccaggggagtttcccccaggaccgctgagcgcaggaggcgatccgcgagcccgccaccgctgcaaagttgcgggaaaggttgcacttgatgtgaagagtaggggaagagggtgaataattcacacccgagagagggggagtgaggagggcagtgttagcgatggaaaaacggtaaaggctgtgggggcgaagatgcgccagggtggagcagggcacgaatcacctctaacaaaccccccaatttccaggcgttgagaacggacagcagcggcaccgttacaaacagtcc

SEQ ID NO: 109744 - DNA, 30 bp, Homo sapiens; identical to SEQ ID NO: 35381
  chr14:63670862-63670892
  Hyper

SEQ ID NO: 109745 - DNA, 88 bp, Homo sapiens; identical to SEQ ID NO: 43993
  chr14:64022981-64023069
  Hypo

SEQ ID NO: 109746 - DNA, 37 bp, Homo sapiens; identical to SEQ ID NO: 76945
  chr14:64222413-64222450
  Hypo

SEQ ID NO: 109747 - DNA, 78 bp, Homo sapiens; identical to SEQ ID NO: 76946
  chr14:64760774-64760852
  Hyper

SEQ ID NO: 109748 - DNA, 181 bp, Homo sapiens; identical to SEQ ID NO: 76947
  chr14:64761073-64761254
  Hyper

SEQ ID NO: 109749 - DNA, 59 bp, Homo sapiens; identical to SEQ ID NO: 76948
  chr14:64932461-64932520
  Hyper

SEQ ID NO: 109750 - DNA, 141 bp, Homo sapiens; identical to SEQ ID NO: 76949
  chr14:65005802-65005943
  Hypo

SEQ ID NO: 109751 - DNA, 300 bp, Homo sapiens
  chr14:65007311-65007611
  Hyper
aaatctgttgggtcacgggccagtcactccgacctaggcaagcctgtggtggagctggaagagtttgtgagggcggtcccgggagcggattgggtctgggagttcccagaggcggctataagaaccgggaactgggcgcggggagctgagttgctggtagtgcccgtggtgcttggttcgaggtggccgttagttgactccgcggagttcatctccctggttttcccgtcctaacgtcgctcgcctttcagtcaggatgtctgcccgtggcccggctatcggcatcgacctgggcaccac

SEQ ID NO: 109752 - DNA, 44 bp, Homo sapiens; identical to SEQ ID NO: 76952
  chr14:65008676-65008720
  Hyper

SEQ ID NO: 109753 - DNA, 342 bp, Homo sapiens
  chr14:65008937-65009279
  Hyper
cctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaa

SEQ ID NO: 109754 - DNA, 340 bp, Homo sapiens; identical to SEQ ID NO: 76955
  chr14:65016476-65016816
  Hyper

SEQ ID NO: 109755 - DNA, 149 bp, Homo sapiens; identical to SEQ ID NO: 76956
  chr14:65086478-65086627
  Hypo

SEQ ID NO: 109756 - DNA, 395 bp, Homo sapiens; identical to SEQ ID NO: 76957
  chr14:65170679-65171074
  Hyper

SEQ ID NO: 109757 - DNA, 98 bp, Homo sapiens; identical to SEQ ID NO: 76958
  chr14:65171275-65171373
  Hyper

SEQ ID NO: 109758 - DNA, 92 bp, Homo sapiens; identical to SEQ ID NO: 76959
  chr14:65171678-65171770
  Hyper

SEQ ID NO: 109759 - DNA, 161 bp, Homo sapiens; identical to SEQ ID NO: 43995
  chr14:65233318-65233479
  Hypo

SEQ ID NO: 109760 - DNA, 30 bp, Homo sapiens; identical to SEQ ID NO: 76961
  chr14:65236314-65236344
  Hypo

SEQ ID NO: 109761 - DNA, 532 bp, Homo sapiens; identical to SEQ ID NO: 76962
  chr14:65239262-65239794
  Hypo

SEQ ID NO: 109762 - DNA, 63 bp, Homo sapiens; identical to SEQ ID NO: 43997
  chr14:65273132-65273195
  Hypo

SEQ ID NO: 109763 - DNA, 30 bp, Homo sapiens; identical to SEQ ID NO: 76964
  chr14:65282538-65282568
  Hypo

SEQ ID NO: 109764 - DNA, 30 bp, Homo sapiens; identical to SEQ ID NO: 76965
  chr14:65310281-65310311
  Hypo

SEQ ID NO: 109765 - DNA, 78 bp, Homo sapiens; identical to SEQ ID NO: 76966
  chr14:65345911-65345989
  Hyper

SEQ ID NO: 109766 - DNA, 57 bp, Homo sapiens; identical to SEQ ID NO: 76967
  chr14:65346254-65346311
  Hyper

SEQ ID NO: 109767 - DNA, 179 bp, Homo sapiens; identical to SEQ ID NO: 76968
  chr14:65406280-65406459
  Hypo

SEQ ID NO: 109768 - DNA, 30 bp, Homo sapiens; identical to SEQ ID NO: 76969
  chr14:65493283-65493313
  Hypo

SEQ ID NO: 109769 - DNA, 155 bp, Homo sapiens; identical to SEQ ID NO: 76970
  chr14:65604586-65604741
  Hypo

SEQ ID NO: 109770 - DNA, 29 bp, Homo sapiens
  chr14:65619090-65619119
  Hypo
ttcaagggccgggcgcggtggctcacgcc

SEQ ID NO: 109771 - DNA, 89 bp, Homo sapiens; identical to SEQ ID NO: 76972
  chr14:65694375-65694464
  Hypo

SEQ ID NO: 109772 - DNA, 33 bp, Homo sapiens; identical to SEQ ID NO: 76973
  chr14:66499270-66499303
  Hypo

SEQ ID NO: 109773 - DNA, 93 bp, Homo sapiens; identical to SEQ ID NO: 76974
  chr14:66560626-66560719
  Hypo

SEQ ID NO: 109774 - DNA, 201 bp, Homo sapiens; identical to SEQ ID NO: 76975
  chr14:66792112-66792313
  Hypo

SEQ ID NO: 109775 - DNA, 181 bp, Homo sapiens; identical to SEQ ID NO: 44002
  chr14:67688245-67688426
  Hypo

SEQ ID NO: 109776 - DNA, 40 bp, Homo sapiens; identical to SEQ ID NO: 76977
  chr14:67876449-67876489
  Hypo

SEQ ID NO: 109777 - DNA, 216 bp, Homo sapiens; identical to SEQ ID NO: 76978
  chr14:67878803-67879019
  Hyper

SEQ ID NO: 109778 - DNA, 30 bp, Homo sapiens; identical to SEQ ID NO: 44003
  chr14:67879219-67879249
  Hypo

SEQ ID NO: 109779 - DNA, 143 bp, Homo sapiens; identical to SEQ ID NO: 76980
  chr14:67886180-67886323
  Hypo

SEQ ID NO: 109780 - DNA, 82 bp, Homo sapiens; identical to SEQ ID NO: 76981
  chr14:67886563-67886645
  Hypo

SEQ ID NO: 109781 - DNA, 206 bp, Homo sapiens; identical to SEQ ID NO: 76982
  chr14:67893599-67893805
  Hypo

SEQ ID NO: 109782 - DNA, 30 bp, Homo sapiens; identical to SEQ ID NO: 76983
  chr14:67906990-67907020
  Hypo

SEQ ID NO: 109783 - DNA, 256 bp, Homo sapiens; identical to SEQ ID NO: 76984
  chr14:68067573-68067829
  Hypo

SEQ ID NO: 109784 - DNA, 30 bp, Homo sapiens; identical to SEQ ID NO: 76985
  chr14:68142255-68142285
  Hypo

SEQ ID NO: 109785 - DNA, 86 bp, Homo sapiens; identical to SEQ ID NO: 76986
  chr14:68187960-68188046
  Hypo

SEQ ID NO: 109786 - DNA, 30 bp, Homo sapiens; identical to SEQ ID NO: 44006
  chr14:68231335-68231365
  Hypo

SEQ ID NO: 109787 - DNA, 36 bp, Homo sapiens; identical to SEQ ID NO: 44007
  chr14:68284131-68284167
  Hypo

SEQ ID NO: 109788 - DNA, 200 bp, Homo sapiens; identical to SEQ ID NO: 76989
  chr14:68841379-68841579
  Hypo

SEQ ID NO: 109789 - DNA, 61 bp, Homo sapiens; identical to SEQ ID NO: 76990
  chr14:69014044-69014105
  Hypo

SEQ ID NO: 109790 - DNA, 198 bp, Homo sapiens; identical to SEQ ID NO: 76991
  chr14:69143363-69143561
  Hypo

SEQ ID NO: 109791 - DNA, 40 bp, Homo sapiens; identical to SEQ ID NO: 76992
  chr14:69245934-69245974
  Hypo

SEQ ID NO: 109792 - DNA, 30 bp, Homo sapiens; identical to SEQ ID NO: 76993
  chr14:69657584-69657614
  Hypo

SEQ ID NO: 109793 - DNA, 1557 bp, Homo sapiens; identical to SEQ ID NO: 76994
  chr14:69726355-69727912
  Hyper

SEQ ID NO: 109794 - DNA, 32 bp, Homo sapiens; identical to SEQ ID NO: 76995
  chr14:69728306-69728338
  Hyper

SEQ ID NO: 109795 - DNA, 174 bp, Homo sapiens; identical to SEQ ID NO: 76996
  chr14:69867022-69867196
  Hypo

SEQ ID NO: 109796 - DNA, 30 bp, Homo sapiens; identical to SEQ ID NO: 76997
  chr14:69867731-69867761
  Hypo

SEQ ID NO: 109797 - DNA, 58 bp, Homo sapiens; identical to SEQ ID NO: 35395
  chr14:69950779-69950837
  Hyper

SEQ ID NO: 109798 - DNA, 228 bp, Homo sapiens; identical to SEQ ID NO: 76999
  chr14:69951108-69951336
  Hyper

SEQ ID NO: 109799 - DNA, 372 bp, Homo sapiens; identical to SEQ ID NO: 77000
  chr14:70014616-70014988
  Hyper

SEQ ID NO: 109800 - DNA, 569 bp, Homo sapiens
  chr14:70038456-70039025
  Hyper
ttggcgcgctgggctcgttccttctccagccggctctggcccacgcgccgcgccttctgctgcactgcttcctcggccacctgcgtcgcgtgctgcagccgtcgctcccccgcccgggccagcgcctccaggtgcgcctgatgttcccgctctttgcgctctgccgcctccttggcccgccgaccctgcagctcctctcgccgggcccgctcccgcagctcccgggtgcgctgctccaccaaatgctcgtagttctcctgcgcacggcccaaactggcttccagcgagctccgcaggccctctcgctcctggcgctgctgccgggtccgaccctgtagcagcgcctcgtggcgcgcccgctcggcccggctcagctcccgcttctcccgctgcagctggccctcctgccgctgcttggcgcgggccgcgcgctgggcgcgctccctgcggatctgctcagcccgctcccgcccttcctgtagaccttcctcacgttgcttcaggttctgctcctgctgaagcttgcgcagccgatcctcccgggccgcgcgctccgcccgctcccgccg

SEQ ID NO: 109801 - DNA, 30 bp, Homo sapiens; identical to SEQ ID NO: 77001
  chr14:70236264-70236294
  Hypo

SEQ ID NO: 109802 - DNA, 602 bp, Homo sapiens; identical to SEQ ID NO: 77002
  chr14:70345928-70346530
  Hyper

SEQ ID NO: 109803 - DNA, 86 bp, Homo sapiens; identical to SEQ ID NO: 77003
  chr14:70346797-70346883
  Hyper

SEQ ID NO: 109804 - DNA, 624 bp, Homo sapiens
  chr14:70653682-70654306
  Hyper
ggaagattaatcacacgccgctgcaagtcaccgggtcgccaggggccgaggaggcttcccttttggtgccccaccggaaggccggatgtgttcctatcacgtacccacattccacccccgctcaactccctcctccccccacccccttcgggtgtttcttgaccacccaggagcttggctgcgcctgctgcagtctgcgtttctgataaattgaaaccagttttaattcttctgcccgggagacctaaccgccgaatgcgttcggaggtatgttttttaatcgccaggaaagggggagagagagagaaagagagagagagagagagaggaaaggaggagagaagagaagagaagcggggggcggggggagagagagagagagagagaaggaagctgcgatgagcgggtaaatttatggtactgcattaaaggcatttcttctatttaaccccaccccgccaccaccaccactaccacaccgttaaaaataaaatacaatgaattaagacgaagaactgcttttttccccggagcaaattgctttcatcatctttcccagtggctcgggtcctctgggcaggtcagccagggcctgtaggagcagcagcgctagcctctgaatca

SEQ ID NO: 109805 - DNA, 1764 bp, Homo sapiens
  chr14:70654366-70656130
  Hyper
cgtgtgtgttgggggatcgggggagggttagttatatatttcgattctctccaccgagtcccggatcacgcagaccaccaggggctggagagtgcagcactggagaaaccctccttctccctcgcccccttggccccagcggtgggtgctctggggctgcagctcccgacccgcggcggtggagtcccgagattggggtgagcgcgtgcgtgcgtatgtgcacgcgggcgcgcgccgagtggataacgcgcttccctgctagcccccaaacccggcggacactcacagcaccagaagcacaacacgccctggcccaggtggcacacatatgccgacatgcatccagcacacacaacacagcagtcagtctccccaaacagcacccgctaccaacccagcatgctcacgatccaactgtacccacctgcccaggcatctctctctgcccctccccacccggcggcaccctcctgtagacacccactctgccagatctgcccccccaacactgcatacacaatgtacactttccggggcaccctcaccccacttctcctggcactaaatccacaggaaggcggttcatatgaatgatcttgagaaataacttaaccccgttactcacaatcagggatcctcttaggggcatcccaagccccccaacctctacctcccatgtctcggctgcccgctaagggggaagggcaggaggctcaccccattactcaccgtttcctctcggcctcccgagcggagtgggcaagggaggggggtgaggaaggtacgcgatgcccccgccgcccggcgcctcaccggtcgcagcggctcatcgcccccgcgggctgcccgccggccgcagccgcgtccggggcatgtcagtccgccgccgccgccctcccgccggggttcgtgggctcgcagctgtcagggagctgcggggcagcgcatctggagcgcggggtctgggagggagggtgtctggggccagggcgaggggccccgggaggggtccttccgcacggatttcagaaagagggaaaccccgacccagagcggtgactggaatctacgcccgggagaggcccggagtcccggccgcgggcggcgggggattcctgcaggaaggggcaggaaggcaagcagcccggcgcgccctggcggctccgagggacctgggctcgggcttgcggtcgcgtcgcctgggctttccctgggctgggagcgcgccgggtctccgccttgcacgctgtcaccgcgggagacgtctcggcctcgccgcgcgcagaggggacgcgcggagaggctggtttctgggcgagcggagagctttgcccattaagctgccggaagaagccaaatcaaaaagccaatctccaagcctccaaacggaacgtcaccctatcagctgggagacagcgccgcactgactgacaagccgcgcatatttatcctcgcgcgcggaggggagactctcagaacgctcctcgaccagcagcgaggaagtcgagcccgcatcccgcatcccgcatcccgcatccagagcccccgagggacgaattcagatccaacccctgccccgcggccacccaccctagtcgttggagcctggcgcccgcgcctcccggccggcagcacgtcaaaacggcggcgcgtcctgacctggattccgccgagttgggagctccaggcagcaggcgggcgcgcggcaccggctttccccttgtcctcaggagacgctgcctgcaattccgaaattaagtctcc

SEQ ID NO: 109806 - DNA, 349 bp, Homo sapiens; identical to SEQ ID NO: 77010
  chr14:70701157-70701506
  Hypo

SEQ ID NO: 109807 - DNA, 18 bp, Homo sapiens
  chr14:70725489-70725507
  Hypo
agcactttgggaggccga

SEQ ID NO: 109808 - DNA, 17 bp, Homo sapiens
  chr14:70725747-70725764
  Hypo
aacgaaaaagaagccac

SEQ ID NO: 109809 - DNA, 30 bp, Homo sapiens; identical to SEQ ID NO: 77013
  chr14:70904873-70904903
  Hypo

SEQ ID NO: 109810 - DNA, 138 bp, Homo sapiens; identical to SEQ ID NO: 77014
  chr14:71659705-71659843
  Hypo

SEQ ID NO: 109811 - DNA, 30 bp, Homo sapiens; identical to SEQ ID NO: 77015
  chr14:72286297-72286327
  Hypo

SEQ ID NO: 109812 - DNA, 888 bp, Homo sapiens
  chr14:72398598-72399486
  Hyper
atattccaaatgcagcgtgtggtgtgcatgttgaatacataaaaatgacgaggttaggaacaatatcgctgacggtcgcggtgtcccgttttaatttagagggcgccagcaacacgtcagtgagggagattcagaagccgccgggcacctcaccccgggccgggaatccctaagagaaccttgacgccgctgaagtttccggaccgggccagtttggaattgacgaaagcagcctccgcccggtcgagccagtctctcggttttctcggcggcttcttgaggatgaggcatttctaggttttctcctcctcgagcaaatcacggtctgcgccttccgcggctctgggaacaggtgagccgtgcggcggcgcccgcgggacgcgctcaggtgccggtccccgcccgccggcccctccctgcagcacgcggtccgggcccaggtgccggggcccaggtgccggcgcccaggtgcgcggggcacggggctgcagctccgctcggcatccgacagcgggcgccgctgcagcagctcgcgggccgcggagctgaacggcttcgcgagttggggcagctcctcgcgctcggccctgctcggcggcgagagctccgcctgggcgccgcgttcctacagccgccggagccgccaggcgccgagggaacggacagacctccgcgcacccttgccgaccggggcgggcagaggcgggcaagcggcgaacgcctgggagcgcggagagccaggccagcccggagcgcgccggggacaccctgtgcgccccgagtcccggcaccatgcgacccgccgcgcgtcctcgcgggcccggggcttcgctcttcgctcgctgagcccctgcgctcgccaccacggaaactcggaaagaggaggcg

SEQ ID NO: 109813 - DNA, 459 bp, Homo sapiens; identical to SEQ ID NO: 35410
  chr14:72399780-72400239
  Hyper

SEQ ID NO: 109814 - DNA, 195 bp, Homo sapiens; identical to SEQ ID NO: 77019
  chr14:72720654-72720849
  Hypo

SEQ ID NO: 109815 - DNA, 30 bp, Homo sapiens; identical to SEQ ID NO: 15833
  chr14:72892242-72892272
  Hypo

SEQ ID NO: 109816 - DNA, 30 bp, Homo sapiens; identical to SEQ ID NO: 44013
  chr14:72976891-72976921
  Hypo

SEQ ID NO: 109817 - DNA, 202 bp, Homo sapiens; identical to SEQ ID NO: 77022
  chr14:73029646-73029848
  Hypo

SEQ ID NO: 109818 - DNA, 30 bp, Homo sapiens; identical to SEQ ID NO: 77023
  chr14:73138163-73138193
  Hypo

SEQ ID NO: 109819 - DNA, 30 bp, Homo sapiens; identical to SEQ ID NO: 77024
  chr14:73140382-73140412
  Hypo

SEQ ID NO: 109820 - DNA, 250 bp, Homo sapiens; identical to SEQ ID NO: 44015
  chr14:73140612-73140862
  Hypo

SEQ ID NO: 109821 - DNA, 151 bp, Homo sapiens; identical to SEQ ID NO: 77026
  chr14:73146774-73146925
  Hypo

SEQ ID NO: 109822 - DNA, 319 bp, Homo sapiens; identical to SEQ ID NO: 77027
  chr14:73147249-73147568
  Hypo

SEQ ID NO: 109823 - DNA, 175 bp, Homo sapiens; identical to SEQ ID NO: 77028
  chr14:73149208-73149383
  Hypo

SEQ ID NO: 109824 - DNA, 30 bp, Homo sapiens; identical to SEQ ID NO: 44018
  chr14:73150302-73150332
  Hypo

SEQ ID NO: 109825 - DNA, 37 bp, Homo sapiens; identical to SEQ ID NO: 44019
  chr14:73157349-73157386
  Hypo

SEQ ID NO: 109826 - DNA, 149 bp, Homo sapiens; identical to SEQ ID NO: 5153
  chr14:73167750-73167899
  Hypo

SEQ ID NO: 109827 - DNA, 143 bp, Homo sapiens; identical to SEQ ID NO: 77032
  chr14:73168818-73168961
  Hypo

SEQ ID NO: 109828 - DNA, 151 bp, Homo sapiens; identical to SEQ ID NO: 44021
  chr14:73172944-73173095
  Hypo

SEQ ID NO: 109829 - DNA, 255 bp, Homo sapiens; identical to SEQ ID NO: 77034
  chr14:73174955-73175210
  Hypo

SEQ ID NO: 109830 - DNA, 30 bp, Homo sapiens; identical to SEQ ID NO: 44023
  chr14:73176464-73176494
  Hypo

SEQ ID NO: 109831 - DNA, 67 bp, Homo sapiens; identical to SEQ ID NO: 77036
  chr14:73178102-73178169
  Hypo

SEQ ID NO: 109832 - DNA, 202 bp, Homo sapiens; identical to SEQ ID NO: 77037
  chr14:73178763-73178965
  Hypo

SEQ ID NO: 109833 - DNA, 146 bp, Homo sapiens; identical to SEQ ID NO: 44026
  chr14:73180113-73180259
  Hypo

SEQ ID NO: 109834 - DNA, 80 bp, Homo sapiens; identical to SEQ ID NO: 77039
  chr14:73185163-73185243
  Hypo

SEQ ID NO: 109835 - DNA, 38 bp, Homo sapiens; identical to SEQ ID NO: 77040
  chr14:73185482-73185520
  Hypo

SEQ ID NO: 109836 - DNA, 30 bp, Homo sapiens; identical to SEQ ID NO: 77041
  chr14:73189045-73189075
  Hypo

SEQ ID NO: 109837 - DNA, 146 bp, Homo sapiens; identical to SEQ ID NO: 44028
  chr14:73194579-73194725
  Hypo

SEQ ID NO: 109838 - DNA, 513 bp, Homo sapiens; identical to SEQ ID NO: 77043
  chr14:73195193-73195706
  Hypo

SEQ ID NO: 109839 - DNA, 30 bp, Homo sapiens; identical to SEQ ID NO: 44031
  chr14:73196936-73196966
  Hypo

SEQ ID NO: 109840 - DNA, 30 bp, Homo sapiens; identical to SEQ ID NO: 44032
  chr14:73197190-73197220
  Hypo

SEQ ID NO: 109841 - DNA, 103 bp, Homo sapiens; identical to SEQ ID NO: 77046
  chr14:73197913-73198016
  Hypo

SEQ ID NO: 109842 - DNA, 52 bp, Homo sapiens; identical to SEQ ID NO: 77047
  chr14:73198555-73198607
  Hypo

SEQ ID NO: 109843 - DNA, 30 bp, Homo sapiens; identical to SEQ ID NO: 77048
  chr14:73199030-73199060
  Hypo

SEQ ID NO: 109844 - DNA, 243 bp, Homo sapiens; identical to SEQ ID NO: 77049
  chr14:73202777-73203020
  Hypo

SEQ ID NO: 109845 - DNA, 30 bp, Homo sapiens; identical to SEQ ID NO: 77050
  chr14:73207724-73207754
  Hypo

SEQ ID NO: 109846 - DNA, 30 bp, Homo sapiens; identical to SEQ ID NO: 77051
  chr14:73207963-73207993
  Hypo

SEQ ID NO: 109847 - DNA, 470 bp, Homo sapiens; identical to SEQ ID NO: 77052
  chr14:73209578-73210048
  Hypo

SEQ ID NO: 109848 - DNA, 76 bp, Homo sapiens; identical to SEQ ID NO: 77053
  chr14:73226814-73226890
  Hypo

SEQ ID NO: 109849 - DNA, 28 bp, Homo sapiens
  chr14:73231480-73231508
  Hypo
gagccaccgcgcccggcctgttttcctg

SEQ ID NO: 109850 - DNA, 32 bp, Homo sapiens; identical to SEQ ID NO: 77055
  chr14:73232361-73232393
  Hypo

SEQ ID NO: 109851 - DNA, 182 bp, Homo sapiens; identical to SEQ ID NO: 77056
  chr14:73263871-73264053
  Hypo

SEQ ID NO: 109852 - DNA, 144 bp, Homo sapiens; identical to SEQ ID NO: 77057
  chr14:73273275-73273419
  Hypo

SEQ ID NO: 109853 - DNA, 30 bp, Homo sapiens; identical to SEQ ID NO: 15844
  chr14:73275087-73275117
  Hypo

SEQ ID NO: 109854 - DNA, 30 bp, Homo sapiens; identical to SEQ ID NO: 77059
  chr14:73280813-73280843
  Hypo

SEQ ID NO: 109855 - DNA, 260 bp, Homo sapiens; identical to SEQ ID NO: 77060
  chr14:73299836-73300096
  Hypo

SEQ ID NO: 109856 - DNA, 412 bp, Homo sapiens; identical to SEQ ID NO: 77061
  chr14:73302316-73302728
  Hypo

SEQ ID NO: 109857 - DNA, 19 bp, Homo sapiens
  chr14:73305454-73305473
  Hypo
actccgtctcaaaaaaaaa

SEQ ID NO: 109858 - DNA, 30 bp, Homo sapiens; identical to SEQ ID NO: 77063
  chr14:73306326-73306356
  Hypo

SEQ ID NO: 109859 - DNA, 50 bp, Homo sapiens; identical to SEQ ID NO: 77064
  chr14:73309119-73309169
  Hypo

SEQ ID NO: 109860 - DNA, 48 bp, Homo sapiens; identical to SEQ ID NO: 77065
  chr14:73313912-73313960
  Hypo

SEQ ID NO: 109861 - DNA, 590 bp, Homo sapiens; identical to SEQ ID NO: 77066
  chr14:73318385-73318975
  Hypo

SEQ ID NO: 109862 - DNA, 30 bp, Homo sapiens; identical to SEQ ID NO: 44043
  chr14:73331141-73331171
  Hypo

SEQ ID NO: 109863 - DNA, 30 bp, Homo sapiens; identical to SEQ ID NO: 77068
  chr14:73332342-73332372
  Hypo

SEQ ID NO: 109864 - DNA, 256 bp, Homo sapiens; identical to SEQ ID NO: 77069
  chr14:73333000-73333256
  Hypo

SEQ ID NO: 109865 - DNA, 75 bp, Homo sapiens; identical to SEQ ID NO: 77070
  chr14:73333616-73333691
  Hypo

SEQ ID NO: 109866 - DNA, 36 bp, Homo sapiens; identical to SEQ ID NO: 77071
  chr14:73349481-73349517
  Hypo

SEQ ID NO: 109867 - DNA, 42 bp, Homo sapiens; identical to SEQ ID NO: 77072
  chr14:73352048-73352090
  Hypo

SEQ ID NO: 109868 - DNA, 38 bp, Homo sapiens; identical to SEQ ID NO: 77073
  chr14:73352791-73352829
  Hypo

SEQ ID NO: 109869 - DNA, 76 bp, Homo sapiens; identical to SEQ ID NO: 35411
  chr14:73358964-73359040
  Hyper

SEQ ID NO: 109870 - DNA, 196 bp, Homo sapiens; identical to SEQ ID NO: 77075
  chr14:73359294-73359490
  Hyper

SEQ ID NO: 109871 - DNA, 30 bp, Homo sapiens; identical to SEQ ID NO: 77076
  chr14:73392384-73392414
  Hypo

SEQ ID NO: 109872 - DNA, 23 bp, Homo sapiens
  chr14:73472913-73472936
  Hypo
accgcgcccggccaaaacacatt

SEQ ID NO: 109873 - DNA, 30 bp, Homo sapiens; identical to SEQ ID NO: 77078
  chr14:73591774-73591804
  Hypo

SEQ ID NO: 109874 - DNA, 157 bp, Homo sapiens; identical to SEQ ID NO: 77079
  chr14:73602342-73602499
  Hypo

SEQ ID NO: 109875 - DNA, 30 bp, Homo sapiens; identical to SEQ ID NO: 44046
  chr14:73691528-73691558
  Hypo

SEQ ID NO: 109876 - DNA, 30 bp, Homo sapiens; identical to SEQ ID NO: 77081
  chr14:73704186-73704216
  Hyper

SEQ ID NO: 109877 - DNA, 49 bp, Homo sapiens; identical to SEQ ID NO: 77082
  chr14:73704924-73704973
  Hyper

SEQ ID NO: 109878 - DNA, 30 bp, Homo sapiens; identical to SEQ ID NO: 15848
  chr14:73958845-73958875
  Hypo

SEQ ID NO: 109879 - DNA, 109 bp, Homo sapiens; identical to SEQ ID NO: 44048
  chr14:73959120-73959229
  Hypo

SEQ ID NO: 109880 - DNA, 46 bp, Homo sapiens; identical to SEQ ID NO: 77085
  chr14:74058905-74058951
  Hyper

SEQ ID NO: 109881 - DNA, 196 bp, Homo sapiens; identical to SEQ ID NO: 77086
  chr14:74079595-74079791
  Hyper

SEQ ID NO: 109882 - DNA, 110 bp, Homo sapiens; identical to SEQ ID NO: 77087
  chr14:74208209-74208319
  Hyper

SEQ ID NO: 109883 - DNA, 66 bp, Homo sapiens; identical to SEQ ID NO: 77088
  chr14:74252666-74252732
  Hyper

SEQ ID NO: 109884 - DNA, 241 bp, Homo sapiens; identical to SEQ ID NO: 77089
  chr14:74254402-74254643
  Hyper

SEQ ID NO: 109885 - DNA, 30 bp, Homo sapiens; identical to SEQ ID NO: 77090
  chr14:74273409-74273439
  Hypo

SEQ ID NO: 109886 - DNA, 20 bp, Homo sapiens
  chr14:74529016-74529036
  Hypo
tgactaggccgggtgcggtg

SEQ ID NO: 109887 - DNA, 2518 bp, Homo sapiens
  chr14:74706015-74708533
  Hyper
cgacattgcctgcggcgggagctgccagctttttggaattcctaatcgctcctggccccggtgattggctgctcagctctgaccccacttgggctgccgcctggttggataaaaggggaatctccttgggctccagagcattagacaccggagggggcacctgggaccaacttcgcgaagcgggaagcccggcgggggggtggggggagctaaagacctgcggcctcagcccctccaaagaacagggagatgacggggaaagcaggggaagcgctgagcaagcccaaatccgagacagtggccaagagtacctcggggggcgccccggccaggtgcactgggttcggcatccaggagatcctgggcttgaacaaggagcccccgagctcccacccgcgggcagcgctcgacggcctggcccccgggcacttgctggcggcgcgctcagtgctcagccccgcgggggtgggcggcatggggcttctggggcccggggggctccctggcttctacacgcagcccaccttcctggaagtgctgtccgacccgcagagcgtccacttgcagccattgggcagagcatcggggccgctggacaccagccagacggccagctcgggtaggtgaggagaggttgcgctgctgcctgactggggggcgacagccgggagccccgcgccgtcggctctcgcttgctggaccaggcctccaggcggaaaagttcctgccaggccgggggtcgccgcctgggccttgggccgacgcgcctggtgatggggcccgggaggatgcttcggcgtccgcagggtttcggccccaagcgtttcgggcggccgcgcagttctccagtccccgcgtcgggcagggctcggccacggcactctgttggagccccactgaaaactgggtttggggtgtcggagcccgtggtgcagagtcgccggccgtgtcggagggccccagcaccgctgctccactgcggccccggcctggtgtaggatccgcactcctcgagcccgatgctgttccggctccggccccatccctggtgtccaaagttgtctgattcccaaatcccgcgctggtcaactggggtttatttttcacccccacgagctcagacaacccggccatcgcggcagctaaagcggccgccatcctctcccacgtaagcgccactatatactggagcccggggacgcgcgggctcggggaccctgggtgacctctccgccttctccccgcgctgctttccgggaggtgtgtcgcggcccgctcgaacctccgattcctgtttgagcttggcaattcccccgatttttcgttgcgttttactttgttttacgtggaaaggcaacgaaaaccagcgcgtcgcaggctctcgggcctcgagtagggacgcattgtgccgccttgcgaaaaggacggtgctcggcagcccccagtcttcccggagcccagctccccacgcctccgctccgctcctcgctcctcgaggccaactttccggcccggggcattggggctggccgcgcagggcagggcgcagcagggtcgcgagcgctgccggggatctctgcggccccctaaggctgcctcgctctccgtcgtcccggtcccaagcgcgccggggcctttgcctctcttacaacgaaatctgttcaaaacctccggattcgggccccggcgcgggagaggtcagcctgagctcagggatgggacggccaccggggcgcccgcaggcttcctggggagacagagcaggtccccgccgctcgcggaggcagcccggggtggggccctcgcgggtttcgggcacagcggagcgcgtcccccactctgccgcatgtccctacgcccgcttttcagattctgaagatgtttcctccagcgatcgaaaaatgtccaaatctgctttaaaccagaccaagaaacggaagaagcggcgacacaggtgaggcccccgctttctgttacctctcctgcccgcgcaccccgctgccgtcccccgttccgggatcgggtctctcggaccctattttcgccgacaacggatctgaggtccgaggccgtgccagggcgcagaccacgggttgtttggcggaatctgcccgggggccttggcgtcggcaccggttgagcaggatgagtggccgccgggaaagcggcccggttcgggctttctcctccttgttcaggagaaaggaaaggctccaacacaggccaaactgagccacagagtgggggcggtccccagatccccgcaccagtacattctgagagccacacagacccggcggcgggcagattagctcccacctcctgccagagccggttctttgccctcggcctcaaccgccgcccccatttctctcccggggtccctgtcctctctgccaactccctaagctttctgctcccaccgttctccaaagctggagcgatctctgcactgacagagcattttcttttggcttctgctcattcgtgattctgaccgagtcgcttcccttctgtg

SEQ ID NO: 109888 - DNA, 333 bp, Homo sapiens; identical to SEQ ID NO: 77097
  chr14:74708774-74709107
  Hyper

SEQ ID NO: 109889 - DNA, 86 bp, Homo sapiens; identical to SEQ ID NO: 77098
  chr14:74717661-74717747
  Hypo

SEQ ID NO: 109890 - DNA, 387 bp, Homo sapiens; identical to SEQ ID NO: 77099
  chr14:74724894-74725281
  Hyper

SEQ ID NO: 109891 - DNA, 36 bp, Homo sapiens; identical to SEQ ID NO: 77100
  chr14:74824362-74824398
  Hypo

SEQ ID NO: 109892 - DNA, 30 bp, Homo sapiens; identical to SEQ ID NO: 77101
  chr14:74824734-74824764
  Hypo

SEQ ID NO: 109893 - DNA, 565 bp, Homo sapiens
  chr14:74892548-74893113
  Hyper
ccccagctcactccccgctccgtgcctagctctgcgctcccgcggcgcccccagaccgccccttacctgtcccgccgcggacggtcccgcctcctccgcggggctcgggggctcggcatgggccggtgagcgacggcgcccccgcctcgcggtcgcggtggaactcccaggagggctcccctgctctcgtccccgcgtccctgagcagccgccgcttcagcaccgcggacagctcccgcccgcagcccgccgccgccgcccgccccgccccgcgcggtcccgggagccccgcatcctggccgggccccgccgccgccgccgccgcgcagccctcggcccggcccgaggcggctccgcgccgacttgggagagcagcgaggagggtccccctccttcccgcctcccgccgccgccgcctccctctcgcttccgtgctccgtgctcccttccacgctccggaatcagcccaccaggcactccggacccggctccggggcggggcggggcgggaagtcgggggagcccggaggaggcggcgaagcgaggggcgcgcagctggaacccg

SEQ ID NO: 109894 - DNA, 1330 bp, Homo sapiens
  chr14:75077895-75079225
  Hyper
tgcgaaaggatttaacgtcggggctccgggagagttggtaagaaaggatgaggatgatgatctatctgccttcaactcttcgaaagcggatcaaatcttccaatcccgattttggaacctcggggctgtttcccgaagtactaaagacagagggacgagggtatgagagcggcgccctctcctctcgcctgcacgcccctccacaaatgagccctggctcccctctgtaccctccaaacttccctctcccatgctcaccccgtgagccgccctcgcggcggggttgggggcgcagccccagaccgctgtggggtccccaggcgtgggagagccggcgcggcccgggtccggggtgctggttgctgctggcccaggggagtgcttctccgggtctgcgcaggtggctggacacgccgcgactgctgcgcgcgggacggcctcctggcctccgcctcggtgggcctcctggggctcccccagcccggctgggcccgctccacgggctgcaagcccgcgacaggcgcgtcctgctcccggaacagactgtacaccttggctgcagccgctgccgggtagctgcccccagggcgccgcagtcgattcgcgtctccaccagccggctcgtatctccctacggggtccctttgggcatgacccgcgcccacgaagagagccagggtgagcggcaggaagcctctccaggggttccgcagggcgcgccccgggctgcgggctttggtccgcggcctcatggcgcggggcggctggagagtggtgcgcgcgggcaccgcgaagagctttgtggtcggcacgctggacgcccgcgggctgttctcccggccccgcccggcggccagcttctctgagtctagggggccctgaagcggccgactgggggcccggctctcggcggaacgagggctgcgcgccccgagcctcgagtccgcgctcctactccagctgggctcgcacggctgctgcaccttcgcgcctcctccctgtgcctgcagccgtctgaaggggacccggacggttttatttttggaaacctcccccggctttttcgtctcttttatccacaccaggccccctcctcggagggacagctcagccccctcattaccggagagggagcgaggaattccagcaacacccactttggcaccgggaagccagcgggcggcgagcgggcggcgagggggattaacccgtgcggagcagggggcggcgcggggctgacccaggcgctggtcgggcagatggcgcctgccacgaccgggacactgggccgcctttctcctgctctgggcaagttcgaactgcagacctg

SEQ ID NO: 109895 - DNA, 30 bp, Homo sapiens; identical to SEQ ID NO: 77106
  chr14:75326230-75326260
  Hypo

SEQ ID NO: 109896 - DNA, 30 bp, Homo sapiens; identical to SEQ ID NO: 77107
  chr14:75332119-75332149
  Hypo

SEQ ID NO: 109897 - DNA, 80 bp, Homo sapiens; identical to SEQ ID NO: 77108
  chr14:75389373-75389453
  Hypo

SEQ ID NO: 109898 - DNA, 30 bp, Homo sapiens; identical to SEQ ID NO: 77109
  chr14:75411978-75412008
  Hypo

SEQ ID NO: 109899 - DNA, 30 bp, Homo sapiens; identical to SEQ ID NO: 77110
  chr14:75422033-75422063
  Hyper

SEQ ID NO: 109900 - DNA, 43 bp, Homo sapiens; identical to SEQ ID NO: 77111
  chr14:75422408-75422451
  Hyper

SEQ ID NO: 109901 - DNA, 51 bp, Homo sapiens; identical to SEQ ID NO: 77112
  chr14:75446328-75446379
  Hypo

SEQ ID NO: 109902 - DNA, 18 bp, Homo sapiens
  chr14:75517394-75517412
  Hypo
gcccggccagaaggtcat

SEQ ID NO: 109903 - DNA, 19 bp, Homo sapiens
  chr14:75749479-75749498
  Hypo
aaaaaattttcaggccggg

SEQ ID NO: 109904 - DNA, 209 bp, Homo sapiens; identical to SEQ ID NO: 77115
  chr14:75760140-75760349
  Hypo

SEQ ID NO: 109905 - DNA, 51 bp, Homo sapiens; identical to SEQ ID NO: 77116
  chr14:75791653-75791704
  Hypo

SEQ ID NO: 109906 - DNA, 30 bp, Homo sapiens; identical to SEQ ID NO: 77117
  chr14:75938324-75938354
  Hypo

SEQ ID NO: 109907 - DNA, 34 bp, Homo sapiens; identical to SEQ ID NO: 77118
  chr14:75996120-75996154
  Hypo

SEQ ID NO: 109908 - DNA, 232 bp, Homo sapiens; identical to SEQ ID NO: 77119
  chr14:76001805-76002037
  Hypo

SEQ ID NO: 109909 - DNA, 34 bp, Homo sapiens; identical to SEQ ID NO: 77120
  chr14:76101271-76101305
  Hypo

SEQ ID NO: 109910 - DNA, 69 bp, Homo sapiens; identical to SEQ ID NO: 77121
  chr14:76597656-76597725
  Hyper

SEQ ID NO: 109911 - DNA, 890 bp, Homo sapiens; identical to SEQ ID NO: 77122
  chr14:76604575-76605465
  Hyper

SEQ ID NO: 109912 - DNA, 169 bp, Homo sapiens; identical to SEQ ID NO: 77123
  chr14:76744173-76744342
  Hypo

SEQ ID NO: 109913 - DNA, 109 bp, Homo sapiens; identical to SEQ ID NO: 35428
  chr14:76795936-76796045
  Hyper

SEQ ID NO: 109914 - DNA, 255 bp, Homo sapiens; identical to SEQ ID NO: 77125
  chr14:76819137-76819392
  Hyper

SEQ ID NO: 109915 - DNA, 443 bp, Homo sapiens; identical to SEQ ID NO: 77126
  chr14:76842512-76842955
  Hyper

SEQ ID NO: 109916 - DNA, 810 bp, Homo sapiens
  chr14:76843184-76843994
  Hyper
agagaaagcctttcccgcgggcgctttgttttattatttccatcctggggaccaaaaatgatcccggcaagagagagaaaatcgaacgtgccgcggcggtttggaaactgcaggcggccagtgccgctctcgcctcgcggtctccgtggggcgccccgagggtgcgcacgtggcgcggcggatccagggcgcccgggggatgcgggcccagcgctgcgtcgtaggcaaagttcgttctcggctttgggggaggctgtgaccagcggaacagaagggcaccatttccctgctccgaggcggctttgcgctcgcggtgccagaacctggggttatccgagcggcgtgggcgcgggcggcagccggcgccgcgagaagcgactctcagaaaccgcgggtctccagccccggggcagcgcgccaagagcgcagagtgggaaagtgaactgatcgcctaagcagcgggtggtcaacccgcgtgtcatgtccgggctctcggggatcccactctatccacctacggtttccctcccgacaccctccacggtcgccgctccacctgctcgggtacctgcccgggtctccccttgggcgctgcgcaccccacggcgcccccggcgggtgtcccggaggcaggttgtgtgcgcgtgcaaagtggtccctcggaaggcttaataataataatacataaaactctaggttcttacggacagctttcctgcttaactttgtgctcgtcttcctcttttttttctgacgcaaactaaattctccaagtcagcgtttctccagttccaccgtgctttcatttgt

SEQ ID NO: 109917 - DNA, 180 bp, Homo sapiens; identical to SEQ ID NO: 77129
  chr14:76998049-76998229
  Hypo

SEQ ID NO: 109918 - DNA, 415 bp, Homo sapiens; identical to SEQ ID NO: 77130
  chr14:77227599-77228014
  Hyper

SEQ ID NO: 109919 - DNA, 247 bp, Homo sapiens; identical to SEQ ID NO: 77131
  chr14:77228556-77228803
  Hyper

SEQ ID NO: 109920 - DNA, 258 bp, Homo sapiens; identical to SEQ ID NO: 77132
  chr14:77242433-77242691
  Hypo

SEQ ID NO: 109921 - DNA, 222 bp, Homo sapiens; identical to SEQ ID NO: 77133
  chr14:77519615-77519837
  Hyper

SEQ ID NO: 109922 - DNA, 578 bp, Homo sapiens; identical to SEQ ID NO: 77134
  chr14:77591173-77591751
  Hyper

SEQ ID NO: 109923 - DNA, 188 bp, Homo sapiens
  chr14:77600201-77600389
  Hyper
ggtggcagcagaagccggcgcaggccaggccgatggcgaaccagaggtagagcatgaggatgacgaacatttcagaacccaggacagctcctgcagggcacggggaggggaaacaccagagccgctttacacccaggccaccggcataactgcgatctaggcaggctttccaccgggagggagggaga

SEQ ID NO: 109924 - DNA, 93 bp, Homo sapiens; identical to SEQ ID NO: 77137
  chr14:77606256-77606349
  Hyper

SEQ ID NO: 109925 - DNA, 1560 bp, Homo sapiens
  chr14:77606757-77608317
  Hyper
gtatgtatatatctgcgtgtacagacacgcagcctctgctatctagctttaaaaaaatcaattgaaacaatcgatacactcacactcgctctcgggcaccgggtgaggtgggggcgcaaccagaatacctgtgtcagcgggtcctggccagcacatctctccaacgctggctgcccgggctatttctttgcgaagagcgttttcatttgaggcgaaattaaaatccccccttcgcgcccgcctcccgccctcctgctgagagaaacccaaacaaccctcatggcgccgaaatcctttccatgccgacaagcccgccctgggcgcacgagtggatgcttggccagcctttcctgggatcgaccccgccgccgtgctcagccctcaccacgtccccatcccaccccacgcctcacagccggggttcctggccagcttcggaagccaccgagaaataggattccgtgcgcccgagagaacttttccaggggctaaggaatcggccagccggaggcgcgagaaaagttctgggaaggcggttgcacctaggatgggtggatgccacggggcctccgtccaggctgtcccgtccgcacgggtcgactggtcaccttggaatcccctttgcaggtcccagcgccccccgggaacccgcagcctccgcggagagcgtgggcctctccctaccgctggggcgcagcgcagtgcacgcctgagggtggtcgccgggggctgggcacgcccccagtcctgcgccgccgggggctgcggcggtgctgcccaccccagagagccctcggcctggggctccggcgaagcaagtgccttcccggcgccggtcgccaggggggcgcgggagcagccagatgcgccgcagcgctgggaaggcggcgaaggacaggggctaggggagtgaggggcgctcggcaggcagcctcagccctggccctgcgcgggagaagggacagcagagaccgcccgtggggccccggggtgtagggagctgtccgttcagccctggcgcccgcctcgcccgcggcagagggcggcacagccggagccttggaaagaccggcagcgccggcagccgcgggcttctcggccactgcctcccggacgcacgggaagccgccccccgcgccgccgccgccgcactgccgccgtcgcagaggggtgaggaaatcaactcaccgagctctggtcgccgacaagaggagccccggacgccggctctcgccctgcccgaggctgcaaagttgtggactcggcccggctggctcgcagcctgcgcttcgcttcgggaactgggcaagtagcggggatgtggggaggagggagcgggcagctgctggcttcccacttgggcgccagcgagtaagggccaggaagcggcggggatggcagctgggcaccccccagccccgccacccctccctccgctcctgggggcggtgctctggccgccagtctcagcatcgtggacttgccccctcctcccctctcgattccccttgagcgggctggggcgccctgcctggtttcagcgcccgttccagctgggag

SEQ ID NO: 109926 - DNA, 30 bp, Homo sapiens; identical to SEQ ID NO: 77140
  chr14:77646077-77646107
  Hypo

SEQ ID NO: 109927 - DNA, 165 bp, Homo sapiens; identical to SEQ ID NO: 77141
  chr14:77703958-77704123
  Hypo

SEQ ID NO: 109928 - DNA, 85 bp, Homo sapiens; identical to SEQ ID NO: 77142
  chr14:77736611-77736696
  Hyper

SEQ ID NO: 109929 - DNA, 629 bp, Homo sapiens
  chr14:77736980-77737609
  Hyper
ctggttggcaacaggcgcccacggtcgagagagaggcagaggggctgtgccacccgtcgccgcgccccgctcctctggcgcacatctggcaggcgccccagcgccccggcagcggccagttttccctccttcggggccggtcctgccgcgtgacccctttcccgccgaggcagcctccacccgcatccccgggcgctcgtgtagccctcacctggcaaacaggacggtgccgtgctccagcgggctgcggctcactgcccgccagctctgccggatcagctcgggctccgggcgctccatgctgtcccggggacgcggagcgcggggctgggaccctcagggctcgggtgccgtcaccgcacgtgccgcgccatctcctccgcgacgcggtcccctccgcccctcgtacgccccccgtgcctccgcccggcgggggccgcagccgctccttccctggcgcgggagagaaaaggcgcgcggccagtcgtaggtggagacaccccagctgtgcttccggggaccccgcttggccgctgcgccctgcgccccgcagccgccagagccgccccaccccgcgacgcctgggctgggcgctttaaagccgccacggcccccgccccctccaggcc

SEQ ID NO: 109930 - DNA, 675 bp, Homo sapiens; identical to SEQ ID NO: 77145
  chr14:77964462-77965137
  Hyper

SEQ ID NO: 109931 - DNA, 259 bp, Homo sapiens; identical to SEQ ID NO: 77146
  chr14:77965424-77965683
  Hyper

SEQ ID NO: 109932 - DNA, 30 bp, Homo sapiens; identical to SEQ ID NO: 77147
  chr14:77968899-77968929
  Hypo

SEQ ID NO: 109933 - DNA, 30 bp, Homo sapiens; identical to SEQ ID NO: 44058
  chr14:78141401-78141431
  Hypo

SEQ ID NO: 109934 - DNA, 22 bp, Homo sapiens
  chr14:78165413-78165435
  Hypo
ccttattcggtctctttagcac

SEQ ID NO: 109935 - DNA, 40 bp, Homo sapiens; identical to SEQ ID NO: 77150
  chr14:78247790-78247830
  Hypo

SEQ ID NO: 109936 - DNA, 30 bp, Homo sapiens; identical to SEQ ID NO: 11983
  chr14:78624601-78624631
  Hyper

SEQ ID NO: 109937 - DNA, 36 bp, Homo sapiens; identical to SEQ ID NO: 77152
  chr14:78709766-78709802
  Hypo

SEQ ID NO: 109938 - DNA, 30 bp, Homo sapiens; identical to SEQ ID NO: 44060
  chr14:79111630-79111660
  Hypo

SEQ ID NO: 109939 - DNA, 70 bp, Homo sapiens; identical to SEQ ID NO: 77154
  chr14:79745172-79745242
  Hyper

SEQ ID NO: 109940 - DNA, 82 bp, Homo sapiens; identical to SEQ ID NO: 77155
  chr14:79745475-79745557
  Hyper

SEQ ID NO: 109941 - DNA, 30 bp, Homo sapiens; identical to SEQ ID NO: 77156
  chr14:79745998-79746028
  Hyper

SEQ ID NO: 109942 - DNA, 30 bp, Homo sapiens; identical to SEQ ID NO: 44061
  chr14:81489175-81489205
  Hypo

SEQ ID NO: 109943 - DNA, 204 bp, Homo sapiens; identical to SEQ ID NO: 77158
  chr14:81902032-81902236
  Hyper

SEQ ID NO: 109944 - DNA, 182 bp, Homo sapiens; identical to SEQ ID NO: 77159
  chr14:81902823-81903005
  Hyper

SEQ ID NO: 109945 - DNA, 30 bp, Homo sapiens
  chr14:82028395-82028425
  Hypo
gtaaaccattctgtccgcactggtatccca

SEQ ID NO: 109946 - DNA, 30 bp, Homo sapiens; identical to SEQ ID NO: 77160
  chr14:82090665-82090695
  Hypo

SEQ ID NO: 109947 - DNA, 808 bp, Homo sapiens
  chr14:85996141-85996949
  Hyper
caacttcaataaatccggtaactggaggcaaaaaatagactccgagggctgggtctggtccggatgaaacgctagggctccttcccttccttgaatcttgggcgctggaagccagccacgggcgtcttgccacgcgagtgcccctagacagcaacacacccactggaaacgcacgtgaacaaagctctcgcccccgggagccgctgcctgcggtttcctagtcgatcccagcttctctagggagtgtcaggcgcacacagggttaagttagttccctccctggtaggagggagaggaggaggaggggaaaagcagcatactgtctcaggctgggtaccttgtagttagttgtacgttcgaaacctgtcgccgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgccgcgccagcgtcttccctttccacctccctgaccctgtcggattcggatgagcccattgcaaggagaagacgcagccgtcaggtaaaaggggctgcgttgccaggtgaagtttccagtaaccggccgagctgctgctacgctggcaccacgct

SEQ ID NO: 109948 - DNA, 606 bp, Homo sapiens
  chr14:85997453-85998059
  Hyper
cctgcttgtcctcttcgggctggcgggcactgagctggggccatcacgcctttctagagcgcctgcggaggtggcgaaggcttggagagcatacgaggcggaatccggatcgagtgagttccttgagccgcttgcgtgggacgcagggagagggcgaataacgccctcaggcgctgaatgcaggggcaaggagccagcgagggtggctggagcaggccttgccagctgttaccaagtctctccacaggcttgggggcttggggcctcctggaaagatccctccgccgcgctgaccagtacggggctcgctcccgcactttgaaggctgccgcggtctttcgtcatttataatcaagcccaagatcaaggttgcaagctgaggtcggggtactgacaacgggaatgaagccataggggaagaggataactgggacgggctggacccatacttgatacccgggaaactcctagagcgtgtggtgctcctgccagcggcagttactggtggagctgaggccaccgctactgtcgtcgttggcgctttgcttctggaacctcccagcaagatggcactcactgtctgttcccttccgattagcaccccca

SEQ ID NO: 109949 - DNA, 173 bp, Homo sapiens
  chr14:85998560-85998733
  Hyper
tagttttaaactctccggttgcatctcgcgtggccccaccgacggcgcgtctcggcgtagctcttggcgcgggctcgttctccctcttctgttcagattcagcctcaccggacttgttacaacatgacagcaacttactggaggcaggaagagcagcacgaaataagatgaga

SEQ ID NO: 109950 - DNA, 974 bp, Homo sapiens
  chr14:85999517-86000491
  Hyper
agagggctccaggagcggagcgcgccagagcgcgagggacggagggagaggaggagcgcgggagctgcggaggcgatcccgcgaattcattactgtaaacatatccgggggtgtcaggaggggtaggggtgggggccgcggcgcctacattagcccggccgcgtcggattgaggcagtagtgtggtctgagcagcctccagacccacgccgggcgggcgcagcacttggagcgagccctgcgcccgcccccgcgcagcgccgcacgcccggctccgagctgtccgcacacacgcgtcggaggagagcccgcctagctctcccgccgagtcccgggatcctccaaatccgaggagctccggcgccgcggggcagctttctgccgccttccccgctcgctgtacttcttttggggttcgttggcttggcgaagcggagagggggaggcggaggaggagagaaggcgggggtcgcggcggccgaagccaagagaaagtggcatgcccgaaccctggaggcggtggtggcggaggacgggggaagacgatgccgcagctccgtaggggacgtaggcgagagcaagcgaggcgagctgggcgccccggccccggcccgctgcggggaggcgcgcgccgctctgaggctccggcctccgcacccccgcgccccgacgctgcgggcgacagggcttggctccagcagccgccgccgtcgccgccgccgccacccggaggacccagcaaaagtttggatctgggggagggcgcggcgctgagcgggattaccaccagggctggaaggagacctcgagaacctttgcaggtaacgcgcgcccccaaccctcttcttccatgccccgccgctgcgctcccgcttcctcccagagcccttcctggccctcgcgggtctggcagaaagtaagagggaggcgaagttcaagatcccggggatgagcaccgagcgctggcagatcact

SEQ ID NO: 109951 - DNA, 213 bp, Homo sapiens; identical to SEQ ID NO: 77169
  chr14:86000988-86001201
  Hyper

SEQ ID NO: 109952 - DNA, 23 bp, Homo sapiens
  chr14:87889659-87889682
  Hypo
aggagccaagatggccgaatagg

SEQ ID NO: 109953 - DNA, 40 bp, Homo sapiens; identical to SEQ ID NO: 77171
  chr14:88449385-88449425
  Hypo

SEQ ID NO: 109954 - DNA, 30 bp, Homo sapiens; identical to SEQ ID NO: 77172
  chr14:88458934-88458964
  Hyper

SEQ ID NO: 109955 - DNA, 222 bp, Homo sapiens; identical to SEQ ID NO: 77173
  chr14:88459409-88459631
  Hyper

SEQ ID NO: 109956 - DNA, 30 bp, Homo sapiens; identical to SEQ ID NO: 44062
  chr14:88673478-88673508
  Hypo

SEQ ID NO: 109957 - DNA, 323 bp, Homo sapiens; identical to SEQ ID NO: 77175
  chr14:88789333-88789656
  Hyper

SEQ ID NO: 109958 - DNA, 720 bp, Homo sapiens
  chr14:88789962-88790682
  Hyper
aacgagcggtgggcgcgccgctacttactggctcggccggccggcgggcgggcgtggaggcggcagcggcgcgcttgctggagttgcagccggagacacgcttggttgcctggaaggcgctgcaggaggcggaggaagggccgctgcggctccgccgcagacctcggcctccgggtcacctcttctcaccgctctcaccctgagctctccctccttctcttttctcacttcattttttttcctcccgcgtctggctctctcgcctgagtcccgaacccacgtccccgccgcactccaaggaggcccgtgccagccatgagccttttgttctgggaccgctccgcatctgctgcgctctccccgcccggggaagctcgctcccaaggcacagcttggtcccttccccagctacctgcagccggactggggccgctggtcgttggctggaaaggaggcttgagagaggcacgggggcccccggaggaaagcggagttgccaagacccggcagctcccggaagcggcggccccgggatcctgggaccagcagggcagatgcgaagggacccagacctgttcccggaaaggggctaaacctggagcattcgtctaacgccctctcactgcccctgcttgaagccccacaggggtttgtggtggggcctcagtcttcagaaaagccaggtggtgctgaggtgctcttgaacgggtcactccgagt

SEQ ID NO: 109959 - DNA, 506 bp, Homo sapiens; identical to SEQ ID NO: 77178
  chr14:88792857-88793363
  Hyper

SEQ ID NO: 109960 - DNA, 30 bp, Homo sapiens; identical to SEQ ID NO: 77179
  chr14:89017832-89017862
  Hyper

SEQ ID NO: 109961 - DNA, 356 bp, Homo sapiens; identical to SEQ ID NO: 77180
  chr14:89493134-89493490
  Hyper

SEQ ID NO: 109962 - DNA, 155 bp, Homo sapiens; identical to SEQ ID NO: 77181
  chr14:89493899-89494054
  Hyper

SEQ ID NO: 109963 - DNA, 54 bp, Homo sapiens; identical to SEQ ID NO: 77182
  chr14:89579245-89579299
  Hypo

SEQ ID NO: 109964 - DNA, 102 bp, Homo sapiens; identical to SEQ ID NO: 77183
  chr14:89606032-89606134
  Hypo

SEQ ID NO: 109965 - DNA, 30 bp, Homo sapiens; identical to SEQ ID NO: 77184
  chr14:89606445-89606475
  Hypo

SEQ ID NO: 109966 - DNA, 140 bp, Homo sapiens; identical to SEQ ID NO: 77185
  chr14:89657653-89657793
  Hypo

SEQ ID NO: 109967 - DNA, 194 bp, Homo sapiens; identical to SEQ ID NO: 77186
  chr14:89817840-89818034
  Hyper

SEQ ID NO: 109968 - DNA, 30 bp, Homo sapiens; identical to SEQ ID NO: 44065
  chr14:89895234-89895264
  Hypo

SEQ ID NO: 109969 - DNA, 30 bp, Homo sapiens; identical to SEQ ID NO: 77188
  chr14:89898427-89898457
  Hypo

SEQ ID NO: 109970 - DNA, 58 bp, Homo sapiens; identical to SEQ ID NO: 77189
  chr14:89918692-89918750
  Hypo

SEQ ID NO: 109971 - DNA, 103 bp, Homo sapiens; identical to SEQ ID NO: 77190
  chr14:89938186-89938289
  Hypo

SEQ ID NO: 109972 - DNA, 19 bp, Homo sapiens
  chr14:89941442-89941461
  Hypo
ccaccgcgcccggccaggt

SEQ ID NO: 109973 - DNA, 85 bp, Homo sapiens; identical to SEQ ID NO: 77192
  chr14:89954654-89954739
  Hypo

SEQ ID NO: 109974 - DNA, 41 bp, Homo sapiens; identical to SEQ ID NO: 77193
  chr14:89962244-89962285
  Hypo

SEQ ID NO: 109975 - DNA, 41 bp, Homo sapiens; identical to SEQ ID NO: 77194
  chr14:89962525-89962566
  Hypo

SEQ ID NO: 109976 - DNA, 25 bp, Homo sapiens
  chr14:90002828-90002853
  Hypo
aagattaaataaggtcggcgggcgc

SEQ ID NO: 109977 - DNA, 20 bp, Homo sapiens
  chr14:90006790-90006810
  Hypo
aaatgaggctgggcacggtg

SEQ ID NO: 109978 - DNA, 41 bp, Homo sapiens; identical to SEQ ID NO: 77197
  chr14:90043896-90043937
  Hypo

SEQ ID NO: 109979 - DNA, 30 bp, Homo sapiens; identical to SEQ ID NO: 77198
  chr14:90083564-90083594
  Hyper

SEQ ID NO: 109980 - DNA, 630 bp, Homo sapiens; identical to SEQ ID NO: 77199
  chr14:90084018-90084648
  Hyper

SEQ ID NO: 109981 - DNA, 153 bp, Homo sapiens; identical to SEQ ID NO: 77200
  chr14:90085797-90085950
  Hyper

SEQ ID NO: 109982 - DNA, 20 bp, Homo sapiens
  chr14:90201050-90201070
  Hypo
ttaaccgatagtaaaacata

SEQ ID NO: 109983 - DNA, 62 bp, Homo sapiens; identical to SEQ ID NO: 77202
  chr14:90204670-90204732
  Hypo

SEQ ID NO: 109984 - DNA, 30 bp, Homo sapiens; identical to SEQ ID NO: 77203
  chr14:90323596-90323626
  Hypo

SEQ ID NO: 109985 - DNA, 625 bp, Homo sapiens; identical to SEQ ID NO: 35465
  chr14:90526555-90527180
  Hyper

SEQ ID NO: 109986 - DNA, 419 bp, Homo sapiens; identical to SEQ ID NO: 77205
  chr14:90527512-90527931
  Hyper

SEQ ID NO: 109987 - DNA, 990 bp, Homo sapiens
  chr14:90528157-90529147
  Hyper
ctcccctatctgagccggacagggagccggggtggaaactgcgcccgcatcccagcgccaagcagacgtgaactctgcgcccgttccccgggaccttcagcgttaaggagaactccgaggagagcagggggagtggaggggaacggcggcgacaaagcggatttgaaactaggagtcaaggaggacgtggggagctggcgccacaggagctaccgaggcggcggccgggggagcctcgcggcctgcgggagagcccggcggtcatgggcgagccggcggtggggcgcccgggagctggctgagcgccggggcccttatttcccgggggtgtgggcgagactccgccgacgcccggtgccgtgggcctgggggctgcccccgggggcccggccatggctggccggggtttcagctggggcccgggccacctgaacgaggacaacgcgcgctttctgctgctggccgcgctcatcgtgctctacctgctgggcggcgccgccgtcttctccgcgctggagctggcgcacgagcgccaggccaagcagcgctgggaggagcgcctggccaacttcagccgcggccacaacctgagccgcgacgagctgcgcggcttcctccgccactacgaggaggccactcgggccggcatccgcgtggacaacgtccgcccgcgctgggacttcaccggcgccttctacttcgtgggcaccgtcgtttccaccataggtaagtgtgctggccggactcgctgacaacctccgggcggcctccacttcctccggggggcaggaccgaccctctcatcctttcattcatccatctgggcgcccagccagactccactgacatgagctgtcgcctgatcaacaggtggtattgcctccccgctgctctaatgtggtccaggcaccggcagcttcagcgtcacctggcagcttgttagaaatgcagtctcagtcccctctgcagacctgccgagtcagaatctgc

SEQ ID NO: 109988 - DNA, 67 bp, Homo sapiens; identical to SEQ ID NO: 77208
  chr14:90632615-90632682
  Hypo

SEQ ID NO: 109989 - DNA, 30 bp, Homo sapiens; identical to SEQ ID NO: 44069
  chr14:90650692-90650722
  Hypo

SEQ ID NO: 109990 - DNA, 61 bp, Homo sapiens; identical to SEQ ID NO: 77210
  chr14:90651094-90651155
  Hypo

SEQ ID NO: 109991 - DNA, 32 bp, Homo sapiens; identical to SEQ ID NO: 44070
  chr14:90724207-90724239
  Hypo

SEQ ID NO: 109992 - DNA, 526 bp, Homo sapiens; identical to SEQ ID NO: 77212
  chr14:90849950-90850476
  Hyper

SEQ ID NO: 109993 - DNA, 30 bp, Homo sapiens; identical to SEQ ID NO: 15852
  chr14:90983280-90983310
  Hypo

SEQ ID NO: 109994 - DNA, 46 bp, Homo sapiens; identical to SEQ ID NO: 77214
  chr14:91059788-91059834
  Hypo

SEQ ID NO: 109995 - DNA, 30 bp, Homo sapiens; identical to SEQ ID NO: 77215
  chr14:91065728-91065758
  Hypo

SEQ ID NO: 109996 - DNA, 142 bp, Homo sapiens
  chr14:91580352-91580494
  Hyper
ctttaagaactggggcgggctagctgccgaggagaccacgctgctgcatgggccacgtgagctcaggctgtgggagcggatggagctgctacagtcagcgcttggggctggcctcagcttgtagacccgagccctgcagaac

SEQ ID NO: 109997 - DNA, 30 bp, Homo sapiens; identical to SEQ ID NO: 35471
  chr14:91581588-91581618
  Hyper

SEQ ID NO: 109998 - DNA, 40 bp, Homo sapiens; identical to SEQ ID NO: 44073
  chr14:91691266-91691306
  Hypo

SEQ ID NO: 109999 - DNA, 30 bp, Homo sapiens; identical to SEQ ID NO: 35472
  chr14:91720177-91720207
  Hyper

SEQ ID NO: 110000 - DNA, 38 bp, Homo sapiens; identical to SEQ ID NO: 77221
  chr14:91730743-91730781
  Hyper

SEQ ID NO: 110001 - DNA, 30 bp, Homo sapiens; identical to SEQ ID NO: 77222
  chr14:91743801-91743831
  Hypo

SEQ ID NO: 110002 - DNA, 146 bp, Homo sapiens; identical to SEQ ID NO: 77223
  chr14:91747935-91748081
  Hypo

SEQ ID NO: 110003 - DNA, 55 bp, Homo sapiens; identical to SEQ ID NO: 77224
  chr14:91754739-91754794
  Hypo

SEQ ID NO: 110004 - DNA, 30 bp, Homo sapiens; identical to SEQ ID NO: 77225
  chr14:91757392-91757422
  Hypo

SEQ ID NO: 110005 - DNA, 96 bp, Homo sapiens; identical to SEQ ID NO: 77226
  chr14:91758260-91758356
  Hypo

SEQ ID NO: 110006 - DNA, 325 bp, Homo sapiens; identical to SEQ ID NO: 77227
  chr14:91766265-91766590
  Hypo

SEQ ID NO: 110007 - DNA, 30 bp, Homo sapiens; identical to SEQ ID NO: 77228
  chr14:91837088-91837118
  Hypo

SEQ ID NO: 110008 - DNA, 90 bp, Homo sapiens; identical to SEQ ID NO: 44077
  chr14:91849645-91849735
  Hypo

SEQ ID NO: 110009 - DNA, 30 bp, Homo sapiens; identical to SEQ ID NO: 44078
  chr14:91850063-91850093
  Hypo

SEQ ID NO: 110010 - DNA, 30 bp, Homo sapiens; identical to SEQ ID NO: 77231
  chr14:91850338-91850368
  Hypo

SEQ ID NO: 110011 - DNA, 518 bp, Homo sapiens; identical to SEQ ID NO: 77232
  chr14:92040365-92040883
  Hyper

SEQ ID NO: 110012 - DNA, 326 bp, Homo sapiens; identical to SEQ ID NO: 77233
  chr14:92414011-92414337
  Hyper

SEQ ID NO: 110013 - DNA, 30 bp, Homo sapiens; identical to SEQ ID NO: 77234
  chr14:92672989-92673019
  Hypo

SEQ ID NO: 110014 - DNA, 1820 bp, Homo sapiens
  chr14:92789076-92790896
  Hyper
tttgttagctctgcacgaccaattaattttctcctgcatcttccccccgtggtgggtggcggggtggggagggggtgtgtggcggggcctcgggtcggctcgggggtcggagagcccggacaggagcgactacactgcagaaaccctttttctaagagtccccagcggtgccataacctgtttctctctgcagcagcctcagagggtaaaggaagggctcgttgcagctccatatggaagaaaggagagaaaaagggagaaggaaggggattatattggtcagtagaggtccaactactgaagagaagagtgcacgggggagtgcgccctacgggacgagtacacgtgctgggaagggcggggggtgagaggcgggcaggaggggaggagtagggaggcgagagcagcgggcgggaggcgccacggcctctcagacgctggcgcccgcagccgagaagccagagagaaagttcccggggagagctcgcccctgggagggccgacgtcgagcctgctcgccgcgagggtctcaggtaccgcgcgtccagccagccttcccgcggcgcgcactcggccgcccgggctcggctcgtcgggaagcaggggaacatcgccggctggcagccggggcggccgccgccaaacttggaggaggaggatgctgcgagtgggcgcggcggcgcggggcgcgggggcgcactgagtgctccctacggcgctgctgccagggctgtggccgggcgagccggccgaagcggagcgggcaggtagcggctctagcgccgggactgcgccagccctgcgagcccgggccgccagcgccaccgtgccggcgtcgcctcctcgccacggagccatggtgcgcgcagcgcgcacgcggcgcgcgggactctgagctccggccgcgtcgcgcgtccccaccttcccaaggggctcccccgccgacctcgccctcgggccatgaggctttggcccggagctcctcgcctctgagtcgcgcaccgcctgctccagccccagcgccgctcggccactgattgcactctggccgctgaagctccccatcctctcccagagacggcacccaggcgctccgggatggcgctccgcgggaccctccggccgctcaaagttcgcaggaggcgagagatgctgccgcagcaagtcggcttcgtgtgcgcggtgctggccctggtgtgctgtgcgtccggcctcttcggcagcttgggtgggtgctggtacgggtcccctcttcctggggagttgggggctttggctggggagtctcggggcggctgcgagatgttttcccctccttcctcatcaggttggtcccaagggttcatccagtcccctccccgccgggcaggtagagcgcgcccagaagagctgatggacgctctgggctgtggcgccggttcccctgagctacgagcggcccctgggggggctcaggacgcggctgcaggtgtgtgttactaagacgaaagcaagaaccgcttccgtcccgggagtgcgcccggaatgggcagcgcaactgcggggtgcaggcaggattctcttggtctggggtgggcgaaactgagtggcccgctttcctattctgcagagccgcaggaaccgccactgcgtctcgcccctgccctggttcaaaggggtcccctgggtgccctgaggtgtttgttcttcccaaaccctaaaggcgttggggcagtctgccgcggggggtagctgccatgtttcagcatcgcgtctctcaactccccttaactcccacggagggagaaggcgggtgtgtggagcctcgacccatgccccct

SEQ ID NO: 110015 - DNA, 101 bp, Homo sapiens; identical to SEQ ID NO: 77238
  chr14:92801293-92801394
  Hypo

SEQ ID NO: 110016 - DNA, 191 bp, Homo sapiens; identical to SEQ ID NO: 44080
  chr14:92829024-92829215
  Hypo

SEQ ID NO: 110017 - DNA, 131 bp, Homo sapiens; identical to SEQ ID NO: 77240
  chr14:92839920-92840051
  Hypo

SEQ ID NO: 110018 - DNA, 30 bp, Homo sapiens; identical to SEQ ID NO: 77241
  chr14:92858667-92858697
  Hypo

SEQ ID NO: 110019 - DNA, 1180 bp, Homo sapiens; identical to SEQ ID NO: 77242
  chr14:92979590-92980770
  Hyper

SEQ ID NO: 110020 - DNA, 59 bp, Homo sapiens; identical to SEQ ID NO: 77243
  chr14:93065511-93065570
  Hypo

SEQ ID NO: 110021 - DNA, 21 bp, Homo sapiens
  chr14:93091187-93091208
  Hypo
agggggcggtgctttcttgac

SEQ ID NO: 110022 - DNA, 30 bp, Homo sapiens; identical to SEQ ID NO: 77245
  chr14:93101791-93101821
  Hypo

SEQ ID NO: 110023 - DNA, 107 bp, Homo sapiens; identical to SEQ ID NO: 77246
  chr14:93107944-93108051
  Hypo

SEQ ID NO: 110024 - DNA, 30 bp, Homo sapiens; identical to SEQ ID NO: 77247
  chr14:93109368-93109398
  Hypo

SEQ ID NO: 110025 - DNA, 79 bp, Homo sapiens; identical to SEQ ID NO: 44082
  chr14:93151456-93151535
  Hypo

SEQ ID NO: 110026 - DNA, 395 bp, Homo sapiens; identical to SEQ ID NO: 77249
  chr14:93154887-93155282
  Hypo

SEQ ID NO: 110027 - DNA, 35 bp, Homo sapiens; identical to SEQ ID NO: 77250
  chr14:93379041-93379076
  Hypo

SEQ ID NO: 110028 - DNA, 873 bp, Homo sapiens
  chr14:93389262-93390135
  Hyper
tcagccacagccccccgcctcccacgccacctcttggaaaccagatacccgcctcgcggccaagacccaccagctccaagcggcggaggccagaggtagcgaggggtgaggttagaggtgggggcgagcggggactggacacctggggagtggggaaaggggaagggggcggcaccgctgacgtcatttccggggtcggggtatataagcggggcgcgagggcgctgctgctgccaccgctcctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaaggtgagcgagcgcggggagctcgcgggagagggttccgggcgcccctgcccaccttgaggtccgggcaccgcgcggcgccccgcacccctccacacttcccttcgggcgcggcgagttttcagcaccgcggacagcgcctccgcctcccgcctgaccctgcagtgtggcctccgcctgggacccacaagacacttgggcctgactcccaaccccccggggcaactcccccttgtgcccaccccttgtctgggcttggcgcctcggttgcatcagggccagtgccggttgcgcggtggccggccaaggtcactgcggggaggtgggagcatggctgctcgcaaccctccacccctcttcccctttcatctcacgctccccgcctttc

SEQ ID NO: 110029 - DNA, 30 bp, Homo sapiens; identical to SEQ ID NO: 77254
  chr14:93425612-93425642
  Hypo

SEQ ID NO: 110030 - DNA, 30 bp, Homo sapiens; identical to SEQ ID NO: 44084
  chr14:93454054-93454084
  Hypo

SEQ ID NO: 110031 - DNA, 37 bp, Homo sapiens; identical to SEQ ID NO: 15855
  chr14:93697020-93697057
  Hypo

SEQ ID NO: 110032 - DNA, 159 bp, Homo sapiens; identical to SEQ ID NO: 77257
  chr14:93706719-93706878
  Hypo

SEQ ID NO: 110033 - DNA, 506 bp, Homo sapiens; identical to SEQ ID NO: 77258
  chr14:93897125-93897631
  Hyper

SEQ ID NO: 110034 - DNA, 35 bp, Homo sapiens; identical to SEQ ID NO: 77259
  chr14:94222874-94222909
  Hypo

SEQ ID NO: 110035 - DNA, 36 bp, Homo sapiens; identical to SEQ ID NO: 77260
  chr14:94226375-94226411
  Hyper

SEQ ID NO: 110036 - DNA, 1421 bp, Homo sapiens
  chr14:94254294-94255715
  Hyper
acatccccagagccccgcgtgtacactttagctccgcgcacagctccagaatactgcgtgcataccttggccccatggacacctccagaaacagccaagcacacttactgcgccccattaacccccatacaactcactctcactgtgagcacacttcaaacccggcgggcactactcacctgcgcgcacaaccacagaaacagccgtgcacacacactgatccccgtgcacacccaccgactcctgcctgcaccctcgctgaccctgcatgcacggccccaagaaatctcacgctgcctgcacccacactgcccagccggcctcattgcgcacactgcaacataggcacctccgtgcgctgcccctttgcacgcctccgcccagccccgatctcccgctcccgggcgtgggttcccccacgcctccatctccgcccgcacccttccaacgcctcacgctaccttgcctggcggcggccccagccgaccctgggctcggggaaaagaggtccgcgttccccccgcggcagctctgtttcccagcagccggacagcccccatttaaagccagccgcctccccagtcccccgccctctaggcggggcctccgtcctcaccttggcggctgcgcgggcgcccgggggcttcacatgccggggaggagcgcccggcgctggagcaaaagtttgcgcgccggttgggcctcccgggccgctgagcagaggaccaggagcggcgtcctcgcacggggcgcagggcgcggtggctccggactgcgcctagccgcgcgcggggcgggaggggcggcaccccgctcccagggccagggctggccgccgaggcggaggcagagggcggggaaagtctcctccacgccgcctggagccggccgcgcgagccctccccgggcccgcgttggctccccgcctttcctggtggcgccgcgcggctgcccggggcactggggtgcccgagctctctactaccctcacgctggcccgcgagaggcagcggcgggaggcgccggcagggagctcccgctggggcagcaaagccgtgggtggaggcgaaataaataatccacgaaaaaggaaaacagacgtgagccgagccagagcctctcccgcctcccgcccggggttgcgctccccccgccgccgccgccagcgccgctgcagtgattcctcgtctccatctagcgaggctattgtgtattgggcgcttaattatttattcaccctggaggccgaggattcccacttccatggggttttggcccttgcctgcgcttcccccaagcctctcccgaggctgcggaaaggtggcgaggactgacttgagacccttttttgcgctccatccttgaggactctccccgccgcactccccgcaggctctcccgggcgccggggctgaaaggtg

SEQ ID NO: 110037 - DNA, 39 bp, Homo sapiens; identical to SEQ ID NO: 77265
  chr14:94393706-94393745
  Hypo

SEQ ID NO: 110038 - DNA, 106 bp, Homo sapiens; identical to SEQ ID NO: 77266
  chr14:94394699-94394805
  Hypo

SEQ ID NO: 110039 - DNA, 30 bp, Homo sapiens; identical to SEQ ID NO: 77267
  chr14:94404198-94404228
  Hypo

SEQ ID NO: 110040 - DNA, 396 bp, Homo sapiens; identical to SEQ ID NO: 77268
  chr14:94405641-94406037
  Hyper

SEQ ID NO: 110041 - DNA, 284 bp, Homo sapiens; identical to SEQ ID NO: 77269
  chr14:94641377-94641661
  Hyper

SEQ ID NO: 110042 - DNA, 30 bp, Homo sapiens; identical to SEQ ID NO: 77270
  chr14:94890121-94890151
  Hyper

SEQ ID NO: 110043 - DNA, 40 bp, Homo sapiens; identical to SEQ ID NO: 77271
  chr14:94953764-94953804
  Hypo

SEQ ID NO: 110044 - DNA, 30 bp, Homo sapiens; identical to SEQ ID NO: 44087
  chr14:95200361-95200391
  Hypo

SEQ ID NO: 110045 - DNA, 70 bp, Homo sapiens; identical to SEQ ID NO: 77273
  chr14:95233491-95233561
  Hyper

SEQ ID NO: 110046 - DNA, 30 bp, Homo sapiens; identical to SEQ ID NO: 35492
  chr14:95234025-95234055
  Hyper

SEQ ID NO: 110047 - DNA, 1155 bp, Homo sapiens
  chr14:95234540-95235695
  Hyper
atacagaatgtggcccgtctacatcgccatcactttattgtactgtcacccttaatttaactataaatactacggtgggggctagtcgcgggcggcctcgggctgctgggctgtgcgcgccctgaccccagacgccgaccctcccggctctgtacactatttacagctcctcgttcctctttctcgaccccctcccgcaaggcagcgcgtgtgcaagaaagtagcatcgtctgtctgtgcaagtccttcgagttaggtaagtaatacgggcaagtgtcccgcggccgtcagctgtccgagtccaaatcgcttttaccttcctcttccctcttctccggtgacgccttcgacgacgacgtcttgttccacttctccgcgttctccgactcctctgatgaggaccgcttctgccgcctccatttggcgcggcggttcttaaaccagacctgttgcgcaacggaggacaaaacagttcagatcaaaggcgcgcttcccccagtcccggggcacccggggagcttggtgtggcggcgggacaccccgcgcaggccaacaaaaggaggggagccgctcgctcccgcttccgcgttttcattcaacttcctgggcctaaagcgccctccagcagcctgcgggccgccatcgggatgtttttaaagtgcggggagagccaagcagggctgggcaaacccgactggggccccacctcgcggggaaggaccgctaggcgcccacggcaggccccggcgcctacctccactttctcctcgcggaggtgcactttccgggccagctgctcgcgcgtgcccacgtccgggtacttggtctcctggaagaggttctcgagagcttcgagctgctcgtcagtgaagatggtgcggtgccgccgcttccgccgacagtgcagctggttgagaagctgcagctcggtgcgcgacagcgtgcccacgttcatgtagggcagcatctggtgcggtaccggggacaccagcaccgaaccggggccctcgtagcctgcgacagagtggggcgcacggtcagccgcccgccctcgccaccgcacgcatgcacgcccgccagcccccgaccctcttccacttagaagtcgtctgcaaggggatgctgagaattgggggtgcacgggaatcaggggtg

SEQ ID NO: 110048 - DNA, 476 bp, Homo sapiens; identical to SEQ ID NO: 77278
  chr14:95236030-95236506
  Hyper

SEQ ID NO: 110049 - DNA, 125 bp, Homo sapiens; identical to SEQ ID NO: 35497
  chr14:95237011-95237136
  Hyper

SEQ ID NO: 110050 - DNA, 55 bp, Homo sapiens; identical to SEQ ID NO: 35498
  chr14:95237867-95237922
  Hyper

SEQ ID NO: 110051 - DNA, 30 bp, Homo sapiens; identical to SEQ ID NO: 77281
  chr14:95238321-95238351
  Hyper

SEQ ID NO: 110052 - DNA, 847 bp, Homo sapiens
  chr14:95239334-95240181
  Hyper
ctccagacactctgccggagctctaggggagctcacccctgcgcggcgggacctcccccatcgggttgccccttcaatctgcagccgcgcggaggcaggccccgggaaaggcagtcggcgctcggtgctcgcactgcgcctcggcgggcggaaactcacaagtgtcctcaacgtgctaaacaaaccatcagggccccgcatcgcctggcgcaattggaataacaaatgcgacgcacgcaaattgtccacctcgtgttgctaagcgattgtttgtcggccccgcacgcacagctcagcatgggaggaccgcgagcgtccagaggcagccggcgagcgcttaggtcggaaatgcagtaaacatgccgctgattttccctattatcacccaaacacgatttcacacaaagcaatcaccacgcagaagtctatgaaaatgtgtttgttgaggagtcactcgccccagtaatagtcctcatttttaagatattaaagaatagctcagcggattccacatgcataaggtctatttgccgttcggcatctgtcacggcgcttttgcactgcggtcatcactaaattgattcatagagtgtagattaaattgcttctctgatttaaaacagtgtccaactttggagtatgcgtgtgagtatcttctcccgccccaaggtatttttgtcagggagaaaactgtcgccccactatccttacaccccattccgcataactgtaaaaaaataatgcatcttcgaccccaacttcttacggttcgtttcaggaactttcttaattctctccgtctcctgcccggccacagagcagagttcacaatcggatgcgtttaagt

SEQ ID NO: 110053 - DNA, 30 bp, Homo sapiens; identical to SEQ ID NO: 12023
  chr14:95240484-95240514
  Hyper

SEQ ID NO: 110054 - DNA, 30 bp, Homo sapiens; identical to SEQ ID NO: 77285
  chr14:95313261-95313291
  Hypo

SEQ ID NO: 110055 - DNA, 30 bp, Homo sapiens; identical to SEQ ID NO: 77286
  chr14:95461950-95461980
  Hypo

SEQ ID NO: 110056 - DNA, 55 bp, Homo sapiens; identical to SEQ ID NO: 44088
  chr14:95522889-95522944
  Hypo

SEQ ID NO: 110057 - DNA, 30 bp, Homo sapiens; identical to SEQ ID NO: 77288
  chr14:95897683-95897713
  Hypo

SEQ ID NO: 110058 - DNA, 30 bp, Homo sapiens; identical to SEQ ID NO: 77289
  chr14:95899653-95899683
  Hypo

SEQ ID NO: 110059 - DNA, 72 bp, Homo sapiens; identical to SEQ ID NO: 77290
  chr14:95906284-95906356
  Hypo

SEQ ID NO: 110060 - DNA, 130 bp, Homo sapiens; identical to SEQ ID NO: 77291
  chr14:95922717-95922847
  Hypo

SEQ ID NO: 110061 - DNA, 143 bp, Homo sapiens; identical to SEQ ID NO: 77292
  chr14:95927934-95928077
  Hypo

SEQ ID NO: 110062 - DNA, 98 bp, Homo sapiens
  chr14:96342281-96342379
  Hyper
gcccaaagccacattcgccacgctcccgccggggcgggctcaccgcgcgcctctgggtgccgagcctccacaggccacatagccgccacctgctgctg

SEQ ID NO: 110063 - DNA, 1195 bp, Homo sapiens
  chr14:96342590-96343785
  Hyper
tgccgcagcccggctcgcagcgcgcgtcagcgggggctccccggagcgagtcgctaggtaacggggctggctccgcagacgcggggccggggaagcccgcgcgcgtcatcagcagcggcgccgcggggcggggggcgcagagaccctccccaatcccggcctgccaccacctggctcgcgcgcagccccggcccagaatgccttaacctgcgccgattgctgccgccgaggtgcccctcccctgtagggaccccgacgccgccagccccttcctcctttcccgcaggtgcgcactgctgtgcttgcggccgggtgggcgccccgccgctgcggtcgcggtcgccgctggtaagctgcgctctggggcttggggcaggaagcagtggggggcgctcgaagagcagggcagctacggccaccgtggccgccggaccggccatgtgctaaagtttctggggctcggcgccccgctgggcgcgcagcgcggggagcagacgcgccgtgggtggggcagcgcggtgctgctggcgcccggcccccgcggggtgcagctctgcgcgttctcatgctgtctctctctctttccctccgcgctgcctctccgaggtcctcccgccgagccccggcgcggggcatgaggagcccccgggtgccgcccagagaccagcaggctgcgcgcacacctagccagcggcagacggggacatgagcagcgcgcacggggtcccgcgcccggcggccagccctatccggcggcggccagcgggtcaacgctgcccgggagaatgaggcaggagccggcggcagcctcctttttttccttctcctcgccttcctgcggctccggcgctccgggtccgggccgggctgcggctctgctgcgtgccccgcgcgcccctcaaccgcctccggatgcgcttctcggtaagccaggccctccgcctcgcgaacaaagctcccttcgcagggcccggaggccgcctcagggcccctgtcctaccctccttccccacttacagcctggaaacattcggggcttccgattgaatcgttcaatttcccctgccccgaagccccgcctggaggctgaactgcccgggcagacctggtgctttcttctgccttctggagaaagatgtgggtttgacatgcaggcgggagacctgtctggtctagataacggcatgtgtatgca

SEQ ID NO: 110064 - DNA, 353 bp, Homo sapiens; identical to SEQ ID NO: 77298
  chr14:96505338-96505691
  Hyper

SEQ ID NO: 110065 - DNA, 153 bp, Homo sapiens; identical to SEQ ID NO: 35507
  chr14:96505900-96506053
  Hyper

SEQ ID NO: 110066 - DNA, 177 bp, Homo sapiens; identical to SEQ ID NO: 77300
  chr14:96506343-96506520
  Hyper

SEQ ID NO: 110067 - DNA, 30 bp, Homo sapiens; identical to SEQ ID NO: 77301
  chr14:96671088-96671118
  Hyper

SEQ ID NO: 110068 - DNA, 39 bp, Homo sapiens; identical to SEQ ID NO: 44091
  chr14:96967321-96967360
  Hypo

SEQ ID NO: 110069 - DNA, 30 bp, Homo sapiens; identical to SEQ ID NO: 44092
  chr14:97045401-97045431
  Hypo

SEQ ID NO: 110070 - DNA, 307 bp, Homo sapiens
  chr14:97058822-97059129
  Hyper
gacttatgagatgggcgactctaggaccctcattttccagacgagaaaacggaggcacctgcaggttcagtgacttgcccaaggtcacgcacctggtcagcggcagagacaggactccccccgcccgggcccgcggattgccgggtcggttctcagtcaccgcacaggtgccctggagagtgcgaccaccccctgccctccgccccgcgccggccctcggctcagtgccccgcccttcctggagcacggcctgcgcatgcgcgcgccccagggcccagccctgttcctgctccggctcctgcgggga

SEQ ID NO: 110071 - DNA, 30 bp, Homo sapiens; identical to SEQ ID NO: 77305
  chr14:97081601-97081631
  Hypo

SEQ ID NO: 110072 - DNA, 184 bp, Homo sapiens; identical to SEQ ID NO: 77306
  chr14:97129784-97129968
  Hypo

SEQ ID NO: 110073 - DNA, 109 bp, Homo sapiens; identical to SEQ ID NO: 44093
  chr14:97188235-97188344
  Hypo

SEQ ID NO: 110074 - DNA, 224 bp, Homo sapiens; identical to SEQ ID NO: 77308
  chr14:97262648-97262872
  Hypo

SEQ ID NO: 110075 - DNA, 140 bp, Homo sapiens; identical to SEQ ID NO: 77309
  chr14:97411536-97411676
  Hypo

SEQ ID NO: 110076 - DNA, 42 bp, Homo sapiens; identical to SEQ ID NO: 77310
  chr14:97431047-97431089
  Hypo

SEQ ID NO: 110077 - DNA, 677 bp, Homo sapiens
  chr14:97499277-97499954
  Hyper
atgggtctgggagtccgaaggctcgcggaggagagtgtgatgtggggtctgctcccagagcgcgcgcgctgtggctcttggaaggtggggctctgaggaccggggtcctgcgtgcatagacctggagcccaccttaaagacgctgcttcagggacgcttcaacaagccccaacccacccaactgcgtggcgctccccgcctttgggcgccctgttagggttgggggtgacccctgcagcccctcatgtgcgaatccaggttctcctcccctccaggctgcttcctgcacagcagcaccgagcagcagccacctcagggccagggagcccgagctgcgggatccgccgccccggggccgcagcagcttcagctccttggcgtctgcgccggggtcctcgcggccgccgcgaaccgctccttcagtttcgctatgcggagcgggcgcgggaccccagcaggtgagggcccagggcaggtgccttccctcgccccggctcccgccccagctcctggccggcccagcgcgtcctgctcccgctctcgccgtgctctcggcgctgcatgtccccggggcgcggcgcagcagctggtgccgcggtgggcatctgttcggcctcctctgtccccacgcgtgacctgatcgctgcgacagcggaatcccacggtgcaggcccaga

SEQ ID NO: 110078 - DNA, 170 bp, Homo sapiens; identical to SEQ ID NO: 77313
  chr14:97524036-97524206
  Hypo

SEQ ID NO: 110079 - DNA, 30 bp, Homo sapiens; identical to SEQ ID NO: 77314
  chr14:97673679-97673709
  Hypo

SEQ ID NO: 110080 - DNA, 1043 bp, Homo sapiens
  chr14:97684916-97685959
  Hyper
tgggggaggagggtccgaaaggaaaggctggtgggggggtggggggaagggccccagtgacgactggattcggaattttcctctcacttcgtggtagtgaagaatttaactacaacagtaacaacactaataattctaaaagccgtgggaggtcagagcgggcgctgcccggcgtcacccctgcagcgtccggatcgctccgcataggcaggggtggtgccccctccccggggcacagaaacgccacatcccgggggcgccgcccagaggctgtctctgtttctgtgtcccttcatgaggctctgtcccacaaaggcagcctgagccaggaccctaaagaggcctggtcatcgggaccggagggagttccgcttcccaggccggctctgcaaacgcgagcctgcgccaaggcgccctgcgggtttgctggtggcatcgaggggcagcgcggggccagcgctgggagctccgaacccacacgctccggccagctgcccgggaagcgcccaagcacacgtcccgagtcccagattggattaagttgcccaactacctactttttctctctttaaggagaagcctaattggagaagattcggttttcttcgccatggcaggtccctttctcctgacccgcagttgcaggggctgagggtaggcgcaggtccgccctggggtcgaagccaccatcgggcctcgaggttgcccccctaacatccggcctgcacgcctggcgggggcgcaacagtgtctcacggctcgggagctcgtttttggcttctgagcaaggtatttttttcatctgccgtgtgtttagctgaattcagtatatttttctcgcacttctcgcttttttttttttctttctgaatctgctcttctgctttgcgggcccctaatctctcccgaatctcgggcgcccggcccggcccaggcgagcgctcgcggttggggacgcgggtggggacgcggcggtctgggcgctgcaggatgcgcctggccgcggaggagacgaccagggagcgggtcgccagatcaagatc

SEQ ID NO: 110081 - DNA, 75 bp, Homo sapiens; identical to SEQ ID NO: 77317
  chr14:97708952-97709027
  Hypo

SEQ ID NO: 110082 - DNA, 199 bp, Homo sapiens; identical to SEQ ID NO: 77318
  chr14:97791325-97791524
  Hypo

SEQ ID NO: 110083 - DNA, 35 bp, Homo sapiens; identical to SEQ ID NO: 77319
  chr14:97900295-97900330
  Hypo

SEQ ID NO: 110084 - DNA, 123 bp, Homo sapiens; identical to SEQ ID NO: 77320
  chr14:98967846-98967969
  Hypo

SEQ ID NO: 110085 - DNA, 30 bp, Homo sapiens; identical to SEQ ID NO: 77321
  chr14:99529159-99529189
  Hypo

SEQ ID NO: 110086 - DNA, 96 bp, Homo sapiens; identical to SEQ ID NO: 77322
  chr14:99532931-99533027
  Hypo

SEQ ID NO: 110087 - DNA, 170 bp, Homo sapiens; identical to SEQ ID NO: 35514
  chr14:99584575-99584745
  Hyper

SEQ ID NO: 110088 - DNA, 30 bp, Homo sapiens; identical to SEQ ID NO: 77324
  chr14:99594536-99594566
  Hypo

SEQ ID NO: 110089 - DNA, 30 bp, Homo sapiens; identical to SEQ ID NO: 44096
  chr14:99615561-99615591
  Hypo

SEQ ID NO: 110090 - DNA, 42 bp, Homo sapiens; identical to SEQ ID NO: 77326
  chr14:99626459-99626501
  Hypo

SEQ ID NO: 110091 - DNA, 40 bp, Homo sapiens; identical to SEQ ID NO: 77327
  chr14:99640421-99640461
  Hypo

SEQ ID NO: 110092 - DNA, 30 bp, Homo sapiens; identical to SEQ ID NO: 77328
  chr14:99698209-99698239
  Hyper

SEQ ID NO: 110093 - DNA, 58 bp, Homo sapiens; identical to SEQ ID NO: 77329
  chr14:99713206-99713264
  Hyper

SEQ ID NO: 110094 - DNA, 98 bp, Homo sapiens; identical to SEQ ID NO: 77330
  chr14:99736115-99736213
  Hyper

SEQ ID NO: 110095 - DNA, 158 bp, Homo sapiens; identical to SEQ ID NO: 77331
  chr14:99736273-99736431
  Hyper

SEQ ID NO: 110096 - DNA, 82 bp, Homo sapiens; identical to SEQ ID NO: 77332
  chr14:99736980-99737062
  Hyper

SEQ ID NO: 110097 - DNA, 385 bp, Homo sapiens; identical to SEQ ID NO: 77333
  chr14:99738148-99738533
  Hyper

SEQ ID NO: 110098 - DNA, 70 bp, Homo sapiens; identical to SEQ ID NO: 35520
  chr14:99739091-99739161
  Hyper

SEQ ID NO: 110099 - DNA, 414 bp, Homo sapiens; identical to SEQ ID NO: 77335
  chr14:99739618-99740032
  Hyper

SEQ ID NO: 110100 - DNA, 222 bp, Homo sapiens; identical to SEQ ID NO: 77336
  chr14:99740491-99740713
  Hyper

SEQ ID NO: 110101 - DNA, 30 bp, Homo sapiens; identical to SEQ ID NO: 44098
  chr14:99804005-99804035
  Hypo

SEQ ID NO: 110102 - DNA, 79 bp, Homo sapiens; identical to SEQ ID NO: 77338
  chr14:99847959-99848038
  Hypo

SEQ ID NO: 110103 - DNA, 176 bp, Homo sapiens; identical to SEQ ID NO: 77339
  chr14:99849887-99850063
  Hypo

SEQ ID NO: 110104 - DNA, 30 bp, Homo sapiens; identical to SEQ ID NO: 77340
  chr14:99889404-99889434
  Hypo

SEQ ID NO: 110105 - DNA, 30 bp, Homo sapiens; identical to SEQ ID NO: 77341
  chr14:99891695-99891725
  Hypo

SEQ ID NO: 110106 - DNA, 30 bp, Homo sapiens; identical to SEQ ID NO: 77342
  chr14:99891938-99891968
  Hypo

SEQ ID NO: 110107 - DNA, 85 bp, Homo sapiens; identical to SEQ ID NO: 76240
  chr14:100111198-100111283
  Hyper

SEQ ID NO: 110108 - DNA, 54 bp, Homo sapiens; identical to SEQ ID NO: 35524
  chr14:100111503-100111557
  Hyper

SEQ ID NO: 110109 - DNA, 265 bp, Homo sapiens; identical to SEQ ID NO: 76242
  chr14:100111764-100112029
  Hyper

SEQ ID NO: 110110 - DNA, 483 bp, Homo sapiens; identical to SEQ ID NO: 76243
  chr14:100125656-100126139
  Hyper

SEQ ID NO: 110111 - DNA, 120 bp, Homo sapiens; identical to SEQ ID NO: 76244
  chr14:100148288-100148408
  Hypo

SEQ ID NO: 110112 - DNA, 36 bp, Homo sapiens; identical to SEQ ID NO: 44101
  chr14:100209839-100209875
  Hypo

SEQ ID NO: 110113 - DNA, 30 bp, Homo sapiens; identical to SEQ ID NO: 76246
  chr14:100223391-100223421
  Hypo

SEQ ID NO: 110114 - DNA, 32 bp, Homo sapiens; identical to SEQ ID NO: 76247
  chr14:100259369-100259401
  Hyper

SEQ ID NO: 110115 - DNA, 582 bp, Homo sapiens; identical to SEQ ID NO: 76248
  chr14:100259680-100260262
  Hyper

SEQ ID NO: 110116 - DNA, 30 bp, Homo sapiens; identical to SEQ ID NO: 76249
  chr14:100406078-100406108
  Hypo

SEQ ID NO: 110117 - DNA, 1528 bp, Homo sapiens
  chr14:100437443-100438971
  Hyper
agagagggaatcagtcgccggtgacctcgacggccctcggatcagggatgccccgagtccgagcgggcagggtgctcagcagggccaggtgatgggaatcatggggccatcgagcacggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggccccgcgccttttgtgtcgggctttgaccgccgcgcgcgctcattcacctcagcggccgcgggcggaggggcgcacgcgcgcgcagtcccctcggagggcggtggggcgaacagcaacgcgcgtaccctagctcttggctgctgtgctgagactagcccgcgcgcccgcgcgcctctccctcgaggactcggagccgcccgcgcactcgccaggggccgccgccccgagtctcaggcggacgcgcacgcgttcccgccgcccggaccccagccggctcgccccccgcccccccatcccccggcggcggcccccaggcacgcgcccgcgcacacgccggcccgggcacgcgcccgccaagatggcaggggccggggcccagctgtcagtcgccgccgccgcggcccttccccgcagctagcggccccgacgcccacccggagaagatgagcccccgctgccccccgcagcccagtcagacgcggagccgccgcgcccggggccggctcccccgctagcgcccgcgtcccgcgccccgccgccgccgccgccgccgccgggtcgcccctggcccggcgcgcccgtccccggcagcgacaatgaggtgagtcggggccggcgcctcgtgggaggtggcagcggccagcgtcggaggggctgggctgggggcccgcggtgcccccgagggcgggaggggggctccacgggcgcgggggcttccagagaaccgcgggggctctgcagagattcgggggcattcagagcgcgggaatggcttcgcgagagccgtgggggcgtctggagagccgggagggtctgcagggcttgtggggggcagtgttctgcaaggggcaggcggcgctggctttggctgcttgtggggtcctcttaggctccggggggcctgcggcggcctgggaggcagacccccgcgggcaggtgtggccgtgtcccgaccgcgcgaggaccgaagttggcggaagcccctgtgcggtgccttccagcccggaggaggctggcctgaagcccccaggcgttgccgaagcctccccctgccagcgcccagagccgcgtttgggcttttacaggtgtagtttcccctcgacttggagcccgtcaaccccttcgtctcctaattctcaaccccccttttttttcttcttgcacgccagtaaagtgca

SEQ ID NO: 110118 - DNA, 290 bp, Homo sapiens; identical to SEQ ID NO: 76253
  chr14:100591008-100591298
  Hypo

SEQ ID NO: 110119 - DNA, 30 bp, Homo sapiens; identical to SEQ ID NO: 76254
  chr14:100597146-100597176
  Hypo

SEQ ID NO: 110120 - DNA, 30 bp, Homo sapiens; identical to SEQ ID NO: 15860
  chr14:100611919-100611949
  Hypo

SEQ ID NO: 110121 - DNA, 115 bp, Homo sapiens; identical to SEQ ID NO: 76256
  chr14:100613268-100613383
  Hypo

SEQ ID NO: 110122 - DNA, 458 bp, Homo sapiens; identical to SEQ ID NO: 76257
  chr14:100625468-100625926
  Hyper

SEQ ID NO: 110123 - DNA, 99 bp, Homo sapiens
  chr14:100626178-100626277
  Hyper
ggaccgaggtggccgcgtgccatctgcgcgagtccctgggtccctcgatgcgcgggggcgactgctgccaccgcggcctcccaccggctctgcgcgccc

SEQ ID NO: 110124 - DNA, 92 bp, Homo sapiens; identical to SEQ ID NO: 76258
  chr14:100637026-100637118
  Hypo

SEQ ID NO: 110125 - DNA, 368 bp, Homo sapiens; identical to SEQ ID NO: 76259
  chr14:100643113-100643481
  Hypo

SEQ ID NO: 110126 - DNA, 30 bp, Homo sapiens; identical to SEQ ID NO: 76260
  chr14:100644084-100644114
  Hypo

SEQ ID NO: 110127 - DNA, 297 bp, Homo sapiens; identical to SEQ ID NO: 76261
  chr14:100644399-100644696
  Hypo

SEQ ID NO: 110128 - DNA, 36 bp, Homo sapiens; identical to SEQ ID NO: 76262
  chr14:100747273-100747309
  Hypo

SEQ ID NO: 110129 - DNA, 30 bp, Homo sapiens; identical to SEQ ID NO: 76263
  chr14:100749445-100749475
  Hypo

SEQ ID NO: 110130 - DNA, 35 bp, Homo sapiens; identical to SEQ ID NO: 44108
  chr14:100780162-100780197
  Hypo

SEQ ID NO: 110131 - DNA, 30 bp, Homo sapiens; identical to SEQ ID NO: 76265
  chr14:100801423-100801453
  Hypo

SEQ ID NO: 110132 - DNA, 163 bp, Homo sapiens; identical to SEQ ID NO: 76267
  chr14:100843941-100844104
  Hypo

SEQ ID NO: 110133 - DNA, 104 bp, Homo sapiens; identical to SEQ ID NO: 76266
  chr14:100843537-100843641
  Hypo

SEQ ID NO: 110134 - DNA, 204 bp, Homo sapiens; identical to SEQ ID NO: 76268
  chr14:100938536-100938740
  Hypo

SEQ ID NO: 110135 - DNA, 716 bp, Homo sapiens
  chr14:101033457-101034173
  Hyper
cagagctgggcctgccgcccacacaacgcctcggctcaggctccggaaggaaaacacgggaggggtgttcccaaagtaggggtcagggtgccaggggaagtcgtggaggaagtggcaaatattcaaactggctgatcccaggcctgccgcgcaggtggtcccgtgaagtctaccaaggcttaaagtttggcaccgggagggaggccgcgggggacactccccagaagctgtcgcgggattcccccaaaatggctccaagacgcggctgcctggtccagccgcgaggactccatcccccacccccgccccccagaggcggacacttaaaagctcagagccaggcaactggcagcccgggggctggggcgggtggtggttgggggtggggtggggtcgggggagagagcgccggggcagtgcggaacggcacgaacggaacccggagggtccccggggaccagcgagagtccagggcagggagccagaggggcgctgaggaccgcacaggaccaggcggccccgggtagggggcagcccggccctcagtggcgctagccccagcccccgccgcagcggcccgggccggcggaggagccccgcgcgaggctccccagcgcctcgcggcgcgcacacacgcaccacacacacgcacctggcccgcagccccgccgaggccgcccgcgggccctgggggatgcgctcgggtggagccccct

SEQ ID NO: 110136 - DNA, 59 bp, Homo sapiens; identical to SEQ ID NO: 76270
  chr14:101034412-101034471
  Hyper

SEQ ID NO: 110137 - DNA, 676 bp, Homo sapiens; identical to SEQ ID NO: 76271
  chr14:101034860-101035536
  Hyper

SEQ ID NO: 110138 - DNA, 30 bp, Homo sapiens; identical to SEQ ID NO: 76272
  chr14:101038620-101038650
  Hypo

SEQ ID NO: 110139 - DNA, 30 bp, Homo sapiens; identical to SEQ ID NO: 76273
  chr14:101052393-101052423
  Hypo

SEQ ID NO: 110140 - DNA, 42 bp, Homo sapiens; identical to SEQ ID NO: 76274
  chr14:101052723-101052765
  Hyper

SEQ ID NO: 110141 - DNA, 56 bp, Homo sapiens; identical to SEQ ID NO: 76275
  chr14:101121187-101121243
  Hyper

SEQ ID NO: 110142 - DNA, 30 bp, Homo sapiens; identical to SEQ ID NO: 76276
  chr14:101155496-101155526
  Hypo

SEQ ID NO: 110143 - DNA, 40 bp, Homo sapiens; identical to SEQ ID NO: 76277
  chr14:101192480-101192520
  Hypo

SEQ ID NO: 110144 - DNA, 39 bp, Homo sapiens; identical to SEQ ID NO: 76278
  chr14:101192920-101192959
  Hyper

SEQ ID NO: 110145 - DNA, 404 bp, Homo sapiens
  chr14:101193194-101193598
  Hyper
gcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggtgagttccccggcggcccggctcgcgccccctctggggaagcctgcgactccccgccggccgcccggtgccccgcacgccccgtctcgtgagccccaactccgcccgtcccgcctagccctaagc

SEQ ID NO: 110146 - DNA, 32 bp, Homo sapiens; identical to SEQ ID NO: 44110
  chr14:101198835-101198867
  Hypo

SEQ ID NO: 110147 - DNA, 60 bp, Homo sapiens; identical to SEQ ID NO: 76281
  chr14:101199827-101199887
  Hypo

SEQ ID NO: 110148 - DNA, 186 bp, Homo sapiens; identical to SEQ ID NO: 76282
  chr14:101200566-101200752
  Hypo

SEQ ID NO: 110149 - DNA, 44 bp, Homo sapiens; identical to SEQ ID NO: 44112
  chr14:101201633-101201677
  Hypo

SEQ ID NO: 110150 - DNA, 30 bp, Homo sapiens; identical to SEQ ID NO: 76284
  chr14:101244707-101244737
  Hypo

SEQ ID NO: 110151 - DNA, 248 bp, Homo sapiens; identical to SEQ ID NO: 76285
  chr14:101250082-101250330
  Hypo

SEQ ID NO: 110152 - DNA, 30 bp, Homo sapiens; identical to SEQ ID NO: 76286
  chr14:101280064-101280094
  Hypo

SEQ ID NO: 110153 - DNA, 30 bp, Homo sapiens; identical to SEQ ID NO: 76287
  chr14:101301191-101301221
  Hypo

SEQ ID NO: 110154 - DNA, 70 bp, Homo sapiens; identical to SEQ ID NO: 76288
  chr14:101347653-101347723
  Hypo

SEQ ID NO: 110155 - DNA, 48 bp, Homo sapiens; identical to SEQ ID NO: 76289
  chr14:101349702-101349750
  Hypo

SEQ ID NO: 110156 - DNA, 30 bp, Homo sapiens; identical to SEQ ID NO: 76290
  chr14:101531739-101531769
  Hypo

SEQ ID NO: 110157 - DNA, 45 bp, Homo sapiens; identical to SEQ ID NO: 76291
  chr14:101532265-101532310
  Hypo

SEQ ID NO: 110158 - DNA, 34 bp, Homo sapiens; identical to SEQ ID NO: 76292
  chr14:101532812-101532846
  Hypo

SEQ ID NO: 110159 - DNA, 344 bp, Homo sapiens; identical to SEQ ID NO: 76293
  chr14:101543828-101544172
  Hyper

SEQ ID NO: 110160 - DNA, 34 bp, Homo sapiens; identical to SEQ ID NO: 76294
  chr14:101576586-101576620
  Hypo

SEQ ID NO: 110161 - DNA, 105 bp, Homo sapiens; identical to SEQ ID NO: 76295
  chr14:101591942-101592047
  Hypo

SEQ ID NO: 110162 - DNA, 30 bp, Homo sapiens; identical to SEQ ID NO: 76296
  chr14:101665450-101665480
  Hypo

SEQ ID NO: 110163 - DNA, 62 bp, Homo sapiens; identical to SEQ ID NO: 76297
  chr14:101694557-101694619
  Hypo

SEQ ID NO: 110164 - DNA, 173 bp, Homo sapiens; identical to SEQ ID NO: 76298
  chr14:101713576-101713749
  Hypo

SEQ ID NO: 110165 - DNA, 30 bp, Homo sapiens; identical to SEQ ID NO: 76299
  chr14:101797233-101797263
  Hypo

SEQ ID NO: 110166 - DNA, 30 bp, Homo sapiens; identical to SEQ ID NO: 76300
  chr14:101864688-101864718
  Hypo

SEQ ID NO: 110167 - DNA, 30 bp, Homo sapiens; identical to SEQ ID NO: 76301
  chr14:101908354-101908384
  Hypo

SEQ ID NO: 110168 - DNA, 103 bp, Homo sapiens; identical to SEQ ID NO: 76302
  chr14:101915704-101915807
  Hypo

SEQ ID NO: 110169 - DNA, 190 bp, Homo sapiens; identical to SEQ ID NO: 76303
  chr14:101923096-101923286
  Hyper

SEQ ID NO: 110170 - DNA, 1058 bp, Homo sapiens
  chr14:101923521-101924579
  Hyper
aagaggagagaaaggcgaggcacagtgggtgcgcaaagaaaaagaggttctcagcggagcgtgtgtgaggcggggggttacgggggaggggagacggggcgggtgtgaagtctgtgccgggaaaagaaaaatatgagtgttctcttttgtgtgcgcacaaacagccgagcgcggggaggtcgggcccggggtcacgcggctccgggctgcagctgccgccgtggggcggggggtcccaggcggccaccgggcgtcgcggccgcctgcggcatcagcattccggcggcgcgggcggccgctgtcctcgcgcgaccccagcccgtccagagcgcgccccggcaccgaccctcggggcgaggcgagcgcagcccccgctggccaacaaggtaagcgcggcgcggggagcggtggccgggagcctgggcgccaggcgacccctcgacagggcgcacggaccggttctccgccgcgcgggtcgatgaccgacggggaggcccgagtctggccccgacgccctggcccggtgtccccgacgcgcctggagcccgggagggaggcgcgggcctggcctgggcccaggaggatggagcccgactcagggccgtctctccccgcttgggggtgctcaggagggcccagggtacctgcgcgggcaccttggcggcgggtcaccctccctccgagccactccgtccgtgggcagcggccttaccaggtccgagccggacgctcagcgttgccctccgcgagcccccagcctcccctcgagcgccgcgggagccccaggtgcacacacgcaggcctgggccgggcctccaggcctctgtccttcgggcgggctgggaggtggcctggcgatgcccgccgaggggtggagagggcgaagccagggcggcgtcggcgaggccatcaaaggccgggggtggcggcccgccgcgttgcccatgaccaggccgagggcatgaaaggatctttatcctccagtgacattgccaggccggcgcttttctgcggcctccccctcccgcggccctaattggggccggctgctaatgtga

SEQ ID NO: 110171 - DNA, 1150 bp, Homo sapiens
  chr14:101924858-101926008
  Hyper
ggggccctccccctccggtgcccggcgctggcggggcccagccacgggggcgggctgggggtgccaggctttgggggtctggagggcctgaagcaggtcgcgttgggggtctcactacctaagacagtgactcaggacagtgggacctgggtgctgtgctgcggccaggcagagcctgcgacccgcggcgccccccgcggcctcggcgacagcccggttcccacgtcggcgacggcgtgggtggtcccgcccgcccgggagggctccgagtcttggccgcccggggcgcggggcctgagagcgagtgtctgcgccgcgctgcccgccgcgccagtttccgaggtcgcccgcgggctcatgccctgcgccctggggccccggggaccttctccaagccggcctgacctggtggaggctgtgcgctgcgctcggggaaggccgggctggtgccgggggcagcgggtcccagctctgaagtgccagcgccggcgccccactccccgcctgctacggtgctctcgcccggaaaggcccgaggccctggaaggagccccgcgggggggcgccgtctggagcagccctcaggggcgccgggctgccgcgacgcagtggctgtaattgcttcggggtacctggggatcgatggcgtggcccagccgggtgtctgcgcctctgaggttgcaaatctggaaccagttaggatgcgggaggcagataataaaaagccaaatgggcgccaggtggaggagtgagctccgcacgttccatcaggtggcccgggccgcgcgctcgggcggcggcagagtctctggggcactcggggcgggcggcagcaggtgggacccgcggcccgacccgcgctagggccgcccaccccctcggaccccggccgggtctctccacagcctccgtgcgcgtcccagaaggaaaatgctagcaaaccggaaggccgcacggggccgagccggcctcagcccggccaggagaggccgtcggtgccccgaggaggaaggggacccggcccgggacggccgccccgcggtacccaggaaggacgcccgccgttcccagcaccccagcgtctgaaaaatgaatgtgaactccgcaagcgtgctcccgcggacattttacatgtcggttgttcacattt

SEQ ID NO: 110172 - DNA, 863 bp, Homo sapiens; identical to SEQ ID NO: 76311
  chr14:102026178-102027041
  Hyper

SEQ ID NO: 110173 - DNA, 63 bp, Homo sapiens
  chr14:102027383-102027446
  Hyper
gcggcgcgcgggaagcgaaccggagctccggcgcggctcggcggccgccggggagctcggctc

SEQ ID NO: 110174 - DNA, 30 bp, Homo sapiens; identical to SEQ ID NO: 76312
  chr14:102029131-102029161
  Hyper

SEQ ID NO: 110175 - DNA, 507 bp, Homo sapiens; identical to SEQ ID NO: 76313
  chr14:102029818-102030325
  Hyper

SEQ ID NO: 110176 - DNA, 354 bp, Homo sapiens; identical to SEQ ID NO: 76314
  chr14:102030555-102030909
  Hyper

SEQ ID NO: 110177 - DNA, 98 bp, Homo sapiens
  chr14:102031173-102031271
  Hyper
acccctacctacctccgcgaacgctccttctcatcccgaaaccgccaggaagcaaaggagatcgcggcagggacgcggcccggcgcctgggagagtcc

SEQ ID NO: 110178 - DNA, 54 bp, Homo sapiens; identical to SEQ ID NO: 76317
  chr14:102031526-102031580
  Hyper

SEQ ID NO: 110179 - DNA, 30 bp, Homo sapiens
  chr14:102057206-102057236
  Hypo
gcctggaggcacaggcggtgtgtggacggc

SEQ ID NO: 110180 - DNA, 76 bp, Homo sapiens; identical to SEQ ID NO: 76318
  chr14:102094052-102094128
  Hypo

SEQ ID NO: 110181 - DNA, 118 bp, Homo sapiens
  chr14:102172320-102172438
  Hyper
cgcccccagttcccccggtccgccgcggccgggcatggggaggtgaaggcctccgtggggtgacagggggcgcggggccgcttgtccccagcgcaggaggagccgggacccgacgcgc

SEQ ID NO: 110182 - DNA, 542 bp, Homo sapiens; identical to SEQ ID NO: 76319
  chr14:102247672-102248214
  Hyper

SEQ ID NO: 110183 - DNA, 30 bp, Homo sapiens; identical to SEQ ID NO: 44120
  chr14:102325042-102325072
  Hypo

SEQ ID NO: 110184 - DNA, 51 bp, Homo sapiens; identical to SEQ ID NO: 15865
  chr14:102335848-102335899
  Hypo

SEQ ID NO: 110185 - DNA, 30 bp, Homo sapiens; identical to SEQ ID NO: 76322
  chr14:102356167-102356197
  Hypo

SEQ ID NO: 110186 - DNA, 78 bp, Homo sapiens; identical to SEQ ID NO: 76323
  chr14:102397345-102397423
  Hypo

SEQ ID NO: 110187 - DNA, 54 bp, Homo sapiens; identical to SEQ ID NO: 76324
  chr14:102399668-102399722
  Hypo

SEQ ID NO: 110188 - DNA, 141 bp, Homo sapiens; identical to SEQ ID NO: 76325
  chr14:102418526-102418667
  Hypo

SEQ ID NO: 110189 - DNA, 46 bp, Homo sapiens; identical to SEQ ID NO: 76326
  chr14:102422726-102422772
  Hypo

SEQ ID NO: 110190 - DNA, 93 bp, Homo sapiens; identical to SEQ ID NO: 76327
  chr14:102467269-102467362
  Hypo

SEQ ID NO: 110191 - DNA, 30 bp, Homo sapiens; identical to SEQ ID NO: 44123
  chr14:102474565-102474595
  Hypo

SEQ ID NO: 110192 - DNA, 38 bp, Homo sapiens; identical to SEQ ID NO: 44124
  chr14:102493613-102493651
  Hypo

SEQ ID NO: 110193 - DNA, 117 bp, Homo sapiens; identical to SEQ ID NO: 76330
  chr14:102500433-102500550
  Hypo

SEQ ID NO: 110194 - DNA, 156 bp, Homo sapiens; identical to SEQ ID NO: 76331
  chr14:102521602-102521758
  Hypo

SEQ ID NO: 110195 - DNA, 97 bp, Homo sapiens; identical to SEQ ID NO: 76332
  chr14:102529446-102529543
  Hypo

SEQ ID NO: 110196 - DNA, 94 bp, Homo sapiens; identical to SEQ ID NO: 76333
  chr14:102529981-102530075
  Hypo

SEQ ID NO: 110197 - DNA, 81 bp, Homo sapiens; identical to SEQ ID NO: 76334
  chr14:102530479-102530560
  Hypo

SEQ ID NO: 110198 - DNA, 136 bp, Homo sapiens; identical to SEQ ID NO: 76335
  chr14:102564366-102564502
  Hypo

SEQ ID NO: 110199 - DNA, 34 bp, Homo sapiens; identical to SEQ ID NO: 76336
  chr14:102593144-102593178
  Hypo

SEQ ID NO: 110200 - DNA, 30 bp, Homo sapiens; identical to SEQ ID NO: 76337
  chr14:102654008-102654038
  Hypo

SEQ ID NO: 110201 - DNA, 35 bp, Homo sapiens; identical to SEQ ID NO: 76338
  chr14:102659542-102659577
  Hypo

SEQ ID NO: 110202 - DNA, 61 bp, Homo sapiens; identical to SEQ ID NO: 44129
  chr14:102673269-102673330
  Hypo

SEQ ID NO: 110203 - DNA, 180 bp, Homo sapiens; identical to SEQ ID NO: 76340
  chr14:102682077-102682257
  Hypo

SEQ ID NO: 110204 - DNA, 30 bp, Homo sapiens; identical to SEQ ID NO: 44131
  chr14:102909162-102909192
  Hypo

SEQ ID NO: 110205 - DNA, 30 bp, Homo sapiens; identical to SEQ ID NO: 76342
  chr14:102948168-102948198
  Hypo

SEQ ID NO: 110206 - DNA, 30 bp, Homo sapiens; identical to SEQ ID NO: 76343
  chr14:102959193-102959223
  Hypo

SEQ ID NO: 110207 - DNA, 30 bp, Homo sapiens; identical to SEQ ID NO: 76344
  chr14:102977854-102977884
  Hypo

SEQ ID NO: 110208 - DNA, 30 bp, Homo sapiens; identical to SEQ ID NO: 76345
  chr14:102983823-102983853
  Hyper

SEQ ID NO: 110209 - DNA, 161 bp, Homo sapiens; identical to SEQ ID NO: 76346
  chr14:103007079-103007240
  Hypo

SEQ ID NO: 110210 - DNA, 32 bp, Homo sapiens; identical to SEQ ID NO: 76347
  chr14:103018826-103018858
  Hypo

SEQ ID NO: 110211 - DNA, 803 bp, Homo sapiens; identical to SEQ ID NO: 76348
  chr14:103021316-103022119
  Hyper

SEQ ID NO: 110212 - DNA, 133 bp, Homo sapiens; identical to SEQ ID NO: 76349
  chr14:103216392-103216525
  Hypo

SEQ ID NO: 110213 - DNA, 30 bp, Homo sapiens; identical to SEQ ID NO: 76350
  chr14:103229680-103229710
  Hypo

SEQ ID NO: 110214 - DNA, 177 bp, Homo sapiens; identical to SEQ ID NO: 44136
  chr14:103277520-103277697
  Hypo

SEQ ID NO: 110215 - DNA, 171 bp, Homo sapiens; identical to SEQ ID NO: 76352
  chr14:103389118-103389289
  Hyper

SEQ ID NO: 110216 - DNA, 401 bp, Homo sapiens; identical to SEQ ID NO: 76353
  chr14:103389502-103389903
  Hyper

SEQ ID NO: 110217 - DNA, 85 bp, Homo sapiens; identical to SEQ ID NO: 76354
  chr14:103390113-103390198
  Hyper

SEQ ID NO: 110218 - DNA, 776 bp, Homo sapiens
  chr14:103394683-103395459
  Hyper
ccaggggactgggggcggggtgggcgcggagcaggcccggacccccgcgtggcgccgcctcagcccgtgtctcttgcagctcctgccgctggatggggaactcgtcctggcttcaggagccggattcggcgtctcagacgtgggctcgcacctggactgtggcgcgggtgaggcggtcgggcaggggcggggctctggaaaggcatgttcaggggcggggactggagggaaggcgcgtcgaggggggcgaggaccggagggagggcgcctccgggggcgtggtttagggagtggcggaagtgtcccgaagcggggcttgggaggtcgtgctcagacgcgtggcgtggcgtggcgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtctgcacacgttgggtctgagcactcaggtgaagtctcttcctcgggctggctccggtggggacccggctgcccgcagac

SEQ ID NO: 110219 - DNA, 56 bp, Homo sapiens; identical to SEQ ID NO: 76356
  chr14:103406559-103406615
  Hypo

SEQ ID NO: 110220 - DNA, 30 bp, Homo sapiens; identical to SEQ ID NO: 76357
  chr14:103416858-103416888
  Hypo

SEQ ID NO: 110221 - DNA, 42 bp, Homo sapiens; identical to SEQ ID NO: 76358
  chr14:103456666-103456708
  Hypo

SEQ ID NO: 110222 - DNA, 216 bp, Homo sapiens; identical to SEQ ID NO: 76359
  chr14:103459583-103459799
  Hypo

SEQ ID NO: 110223 - DNA, 49 bp, Homo sapiens; identical to SEQ ID NO: 76360
  chr14:103477626-103477675
  Hypo

SEQ ID NO: 110224 - DNA, 22 bp, Homo sapiens
  chr14:103533487-103533509
  Hypo
gccaccgcgcccagccaatatt

SEQ ID NO: 110225 - DNA, 212 bp, Homo sapiens; identical to SEQ ID NO: 76362
  chr14:103550430-103550642
  Hyper

SEQ ID NO: 110226 - DNA, 131 bp, Homo sapiens; identical to SEQ ID NO: 76363
  chr14:103584461-103584592
  Hyper

SEQ ID NO: 110227 - DNA, 93 bp, Homo sapiens; identical to SEQ ID NO: 76364
  chr14:103589787-103589880
  Hyper

SEQ ID NO: 110228 - DNA, 30 bp, Homo sapiens; identical to SEQ ID NO: 76365
  chr14:103593974-103594004
  Hypo

SEQ ID NO: 110229 - DNA, 425 bp, Homo sapiens
  chr14:103655240-103655665
  Hyper
ccgatttaaaactcgcgccaacgcggctgcgcgccttgtcctccgcccaggaaccctggaggccacggcctcgcccggctcctgcgctggcactggacgtcccgccggctgtacctggcgccccgtggcctcgctcccgaccgctgccccgcagaggcctcccgaccgccgaggccctcgccacgcccgggtgcccccagggggcgccggcttccacccacagagctccccaggcctgggcgggcgcagggagggcgcgaccggggcgcacccgcgcgggaacttggcagagactcgcgggacgtggcgggggcgcctcaggaaacgcgccgcggggctgcggggtcgaggggaggggactagtgtgcaggggccaccctctccccagccccgccccccgagtccagctccgcccctgatgcgta

SEQ ID NO: 110230 - DNA, 43 bp, Homo sapiens; identical to SEQ ID NO: 76368
  chr14:103673852-103673895
  Hyper

SEQ ID NO: 110231 - DNA, 125 bp, Homo sapiens
  chr14:103674155-103674280
  Hyper
ggccgaccgggactccgagcgccaggtgctgatggcgcgggcccgcgaggggccctgcccgttcccgggggtcacggccaagatccagcggaggatggaccaggtgttcacgctggcggtgcgcg

SEQ ID NO: 110232 - DNA, 717 bp, Homo sapiens; identical to SEQ ID NO: 76370
  chr14:103686706-103687423
  Hyper

SEQ ID NO: 110233 - DNA, 47 bp, Homo sapiens; identical to SEQ ID NO: 76371
  chr14:103698810-103698857
  Hypo

SEQ ID NO: 110234 - DNA, 71 bp, Homo sapiens; identical to SEQ ID NO: 76372
  chr14:103699549-103699620
  Hypo

SEQ ID NO: 110235 - DNA, 693 bp, Homo sapiens
  chr14:103739918-103740611
  Hyper
ccagcctgggttgagcggggcggatctgggactccgaggcttcctacgtggggcgggttcccagcggacgcctctgccgcacccctggcggggacccagctgcgccccttcccgcggccctcctagggcctgggtgcttggaggctcgaggccccaagatccatgtcgcccggaatcccggtgcctaggccttgtcgcgggccctgggaccaactcgcgggggtcaggagctgggggttgagagaaagatgatcaggtgggttggagaaaggagacgcttcccgctgggcgagtgagcccaggacgcggcagaagagggcagaccctaggggaccgccgcgtccccaggcgcgcacgcgacccctccccgcgccgaaaatcctctccccgcctcagtctccccgcctccgcctccccacccatagtgtcactccgaccctagccctgggtccaaacgggcaggagaggtcgctggtgcctccgcggtccccgccgcgcgcagaactcggccgagtgcaccggggtctcctggcctctgcgcgcagctggtcctgcagcgtcaggacccgaacgaccccgaggccccaggggctgggccctccagcagccccgcagcagccccgcagcagccccggcaggcaccctccagcggccgtgggcgcctggtagctatggaggcggtagaggtggaaa

SEQ ID NO: 110236 - DNA, 520 bp, Homo sapiens; identical to SEQ ID NO: 76375
  chr14:103745299-103745819
  Hyper

SEQ ID NO: 110237 - DNA, 30 bp, Homo sapiens; identical to SEQ ID NO: 76376
  chr14:103778195-103778225
  Hypo

SEQ ID NO: 110238 - DNA, 30 bp, Homo sapiens; identical to SEQ ID NO: 76377
  chr14:103793396-103793426
  Hypo

SEQ ID NO: 110239 - DNA, 30 bp, Homo sapiens; identical to SEQ ID NO: 76378
  chr14:103814512-103814542
  Hypo

SEQ ID NO: 110240 - DNA, 89 bp, Homo sapiens; identical to SEQ ID NO: 15869
  chr14:103820833-103820922
  Hypo

SEQ ID NO: 110241 - DNA, 30 bp, Homo sapiens; identical to SEQ ID NO: 76380
  chr14:103977805-103977835
  Hypo

SEQ ID NO: 110242 - DNA, 41 bp, Homo sapiens; identical to SEQ ID NO: 76381
  chr14:103988695-103988736
  Hyper

SEQ ID NO: 110243 - DNA, 443 bp, Homo sapiens
  chr14:103989154-103989597
  Hyper
gacgcaggcgaacagcggccgctccgcgctcccgcggctcttaaggggcacaacgcgggccgcccattggcggctatttatagcccattcattccattggcccgcgccgcggggtggtgccgccgctttgtccgccgcccgcagcccccaacaccctggccgcccacccgagctgtcccctcgctgggaccccgcgcagcctgcccagtcccccgcccaagacctcgaggccgaaacctcaggtccttggatatctggatcccctcgcacgcccttgcctctgggcgggaaactgaggcggagagcctccgggcactcgaggacgcttgggttcatccgcatcctcgagcctgcccgcctagtccagccagcccccgcggcggcggcgaggggccgggcgaaagctttcggggcttccgcagcaggtacggcccccgccccac

SEQ ID NO: 110244 - DNA, 80 bp, Homo sapiens; identical to SEQ ID NO: 76384
  chr14:103996379-103996459
  Hypo

SEQ ID NO: 110245 - DNA, 17 bp, Homo sapiens
  chr14:104006077-104006094
  Hypo
cttttttttggagaccg

SEQ ID NO: 110246 - DNA, 89 bp, Homo sapiens; identical to SEQ ID NO: 76386
  chr14:104014163-104014252
  Hypo

SEQ ID NO: 110247 - DNA, 70 bp, Homo sapiens; identical to SEQ ID NO: 76387
  chr14:104048912-104048982
  Hypo

SEQ ID NO: 110248 - DNA, 57 bp, Homo sapiens; identical to SEQ ID NO: 76388
  chr14:104061854-104061911
  Hypo

SEQ ID NO: 110249 - DNA, 27 bp, Homo sapiens
  chr14:104062202-104062229
  Hypo
ttttttttttgagaccgagtctcgctc

SEQ ID NO: 110250 - DNA, 26 bp, Homo sapiens
  chr14:104062469-104062495
  Hypo
gcttgagccaccgtgcccagcctatt

SEQ ID NO: 110251 - DNA, 30 bp, Homo sapiens; identical to SEQ ID NO: 76391
  chr14:104083385-104083415
  Hypo

SEQ ID NO: 110252 - DNA, 30 bp, Homo sapiens; identical to SEQ ID NO: 44144
  chr14:104121128-104121158
  Hypo

SEQ ID NO: 110253 - DNA, 120 bp, Homo sapiens; identical to SEQ ID NO: 76393
  chr14:104159317-104159437
  Hypo

SEQ ID NO: 110254 - DNA, 37 bp, Homo sapiens; identical to SEQ ID NO: 76394
  chr14:104160021-104160058
  Hypo

SEQ ID NO: 110255 - DNA, 39 bp, Homo sapiens; identical to SEQ ID NO: 76395
  chr14:104194452-104194491
  Hypo

SEQ ID NO: 110256 - DNA, 55 bp, Homo sapiens; identical to SEQ ID NO: 44145
  chr14:104194695-104194750
  Hypo

SEQ ID NO: 110257 - DNA, 68 bp, Homo sapiens; identical to SEQ ID NO: 76397
  chr14:104195247-104195315
  Hypo

SEQ ID NO: 110258 - DNA, 42 bp, Homo sapiens; identical to SEQ ID NO: 76398
  chr14:104199986-104200028
  Hypo

SEQ ID NO: 110259 - DNA, 136 bp, Homo sapiens; identical to SEQ ID NO: 44147
  chr14:104202705-104202841
  Hypo

SEQ ID NO: 110260 - DNA, 36 bp, Homo sapiens; identical to SEQ ID NO: 76400
  chr14:104335400-104335436
  Hypo

SEQ ID NO: 110261 - DNA, 30 bp, Homo sapiens; identical to SEQ ID NO: 76401
  chr14:104346851-104346881
  Hyper

SEQ ID NO: 110262 - DNA, 26 bp, Homo sapiens
  chr14:104355130-104355156
  Hypo
gtgtttgatttgacacgccctccccg

SEQ ID NO: 110263 - DNA, 30 bp, Homo sapiens; identical to SEQ ID NO: 76403
  chr14:104367439-104367469
  Hyper

SEQ ID NO: 110264 - DNA, 98 bp, Homo sapiens; identical to SEQ ID NO: 76404
  chr14:104386144-104386242
  Hypo

SEQ ID NO: 110265 - DNA, 38 bp, Homo sapiens; identical to SEQ ID NO: 76405
  chr14:104387082-104387120
  Hypo

SEQ ID NO: 110266 - DNA, 30 bp, Homo sapiens; identical to SEQ ID NO: 76406
  chr14:104486789-104486819
  Hypo

SEQ ID NO: 110267 - DNA, 30 bp, Homo sapiens; identical to SEQ ID NO: 76407
  chr14:104503586-104503616
  Hypo

SEQ ID NO: 110268 - DNA, 30 bp, Homo sapiens; identical to SEQ ID NO: 76408
  chr14:104547888-104547918
  Hypo

SEQ ID NO: 110269 - DNA, 36 bp, Homo sapiens; identical to SEQ ID NO: 76409
  chr14:104560644-104560680
  Hypo

SEQ ID NO: 110270 - DNA, 30 bp, Homo sapiens; identical to SEQ ID NO: 76410
  chr14:104561546-104561576
  Hypo

SEQ ID NO: 110271 - DNA, 34 bp, Homo sapiens; identical to SEQ ID NO: 76411
  chr14:104567474-104567508
  Hypo

SEQ ID NO: 110272 - DNA, 44 bp, Homo sapiens; identical to SEQ ID NO: 76412
  chr14:104568268-104568312
  Hypo

SEQ ID NO: 110273 - DNA, 131 bp, Homo sapiens; identical to SEQ ID NO: 76413
  chr14:104571985-104572116
  Hypo

SEQ ID NO: 110274 - DNA, 33 bp, Homo sapiens; identical to SEQ ID NO: 76414
  chr14:104572793-104572826
  Hypo

SEQ ID NO: 110275 - DNA, 161 bp, Homo sapiens; identical to SEQ ID NO: 76415
  chr14:104573825-104573986
  Hypo

SEQ ID NO: 110276 - DNA, 30 bp, Homo sapiens; identical to SEQ ID NO: 76416
  chr14:104576414-104576444
  Hypo

SEQ ID NO: 110277 - DNA, 30 bp, Homo sapiens
  chr14:104583032-104583062
  Hyper
ccaccggagagctagcgcggccctgggctc

SEQ ID NO: 110278 - DNA, 30 bp, Homo sapiens; identical to SEQ ID NO: 44151
  chr14:104600477-104600507
  Hypo

SEQ ID NO: 110279 - DNA, 1638 bp, Homo sapiens
  chr14:104601737-104603375
  Hyper
gccaggccataggtgcgcgctggcgccgctgaaaacgttctccttccctcgcctgtccaccttccaggtcctgctcaaggcgcctaatatcccctgggcagggtccctgacacttccttaactcccaaagaccttccgcgtgggcctagcgcatttaggcgaacctctctgcctgcttgatcctctcccttcctccctcaagccaggcatctcacccacttgcgcgcgaggctggggcagcccacaggaggagcgcgggacccgggcttgagtttgcacccaggcagagcgcccacccccgcccctagcttcggaccctgaaagtaaagtcgtcgtgcccggcagccagcccgaatcttccagccctcagggagtcggggtcggggcagggaaggccacgggtggcggcacaatcgggatcctggagtggaggcgcagactgcgggtcccgctgcgcacgctccgtggtccggttggggtgggccttggaggtccataggccaaggttgaacgggggctctggagcgtgggcggggtggagtgcacaggtcactgggctctgagcgtttccatgggccaggaccccaacgcgccgtgtcctcaggacagattggagggggaaggggctgcgattatgccccagtcggaagggttttacagcagccgcgctgccctctccctgccggatacccggcagtagacaccgacgtctgggggctagcgaggcaggtgggcgcggaccgcgacccgattctggcttccaacctccgcccagtggcgcgcggggccgtcgccccacacctccagtccgcgtggctggtgtctggctcgccgccggggcggaaggggcgctgtcggcgcaggcgggcggggccggagcgcgggggcgcgcggcgcggagcgagcgcagggctcgggggcgcggggcgcggaggaccgggggcttgacgggcggccctgcgcggtgcggggcgcggcggcggcgggcgcgcggccagtgaacgcgcgggcggggcggcggtggcgggaggcactaggggccgctccccgcgcttccctcttccatggcgctgccccagccgcccgagccgccccgcggcgcgccccgcaaggctcccagcctgctggagatgggggcgctctgcctggactcggagatcatcctgggcttcaccagccacctcctgcggcgacgaggcaaggtgagggctgtcgggaggggggcgggcggcgtaggcgccgtcccgttactttgccgcgcggctcgcgcggccgggggtgctgcgccgggaaggagacggcaggtccggagccgcgtcccgcagcccgggctgggactcgctgccgcactttcccccattagcgttgtccaagtctccctctgccttcaaggctgtgtcccaaccggacccacccggaggctgtggctagggcggagagcgcagcgcagggattctcgggctcaccttgcgccttgctaggatgggcgaagtagggggtcggggcccctgactgatcgtgagcccccgaggtgactccagccttgtgcaccccgtgttctgcggatatgggatgtgagcttgtgcttcccgaagcgccgcggcggtagaagcgctgaagttgcgggtgtggctggcc

SEQ ID NO: 110280 - DNA, 38 bp, Homo sapiens; identical to SEQ ID NO: 76421
  chr14:104603715-104603753
  Hyper

SEQ ID NO: 110281 - DNA, 1513 bp, Homo sapiens; identical to SEQ ID NO: 76422
  chr14:104604105-104605618
  Hyper

SEQ ID NO: 110282 - DNA, 30 bp, Homo sapiens; identical to SEQ ID NO: 76423
  chr14:104608088-104608118
  Hypo

SEQ ID NO: 110283 - DNA, 30 bp, Homo sapiens; identical to SEQ ID NO: 44152
  chr14:104609469-104609499
  Hypo

SEQ ID NO: 110284 - DNA, 858 bp, Homo sapiens; identical to SEQ ID NO: 76425
  chr14:104617582-104618440
  Hypo

SEQ ID NO: 110285 - DNA, 154 bp, Homo sapiens; identical to SEQ ID NO: 76426
  chr14:104618676-104618830
  Hypo

SEQ ID NO: 110286 - DNA, 295 bp, Homo sapiens; identical to SEQ ID NO: 76427
  chr14:104619085-104619380
  Hypo

SEQ ID NO: 110287 - DNA, 193 bp, Homo sapiens; identical to SEQ ID NO: 44156
  chr14:104620411-104620604
  Hypo

SEQ ID NO: 110288 - DNA, 847 bp, Homo sapiens; identical to SEQ ID NO: 76429
  chr14:104622914-104623761
  Hypo

SEQ ID NO: 110289 - DNA, 291 bp, Homo sapiens; identical to SEQ ID NO: 76430
  chr14:104626758-104627049
  Hypo

SEQ ID NO: 110290 - DNA, 184 bp, Homo sapiens; identical to SEQ ID NO: 76431
  chr14:104627651-104627835
  Hypo

SEQ ID NO: 110291 - DNA, 159 bp, Homo sapiens; identical to SEQ ID NO: 76432
  chr14:104628609-104628768
  Hypo

SEQ ID NO: 110292 - DNA, 150 bp, Homo sapiens; identical to SEQ ID NO: 76433
  chr14:104630025-104630175
  Hypo

SEQ ID NO: 110293 - DNA, 64 bp, Homo sapiens; identical to SEQ ID NO: 76434
  chr14:104630660-104630724
  Hypo

SEQ ID NO: 110294 - DNA, 45 bp, Homo sapiens; identical to SEQ ID NO: 44163
  chr14:104630962-104631007
  Hypo

SEQ ID NO: 110295 - DNA, 282 bp, Homo sapiens; identical to SEQ ID NO: 76436
  chr14:104636842-104637124
  Hypo

SEQ ID NO: 110296 - DNA, 33 bp, Homo sapiens; identical to SEQ ID NO: 44165
  chr14:104638185-104638218
  Hypo

SEQ ID NO: 110297 - DNA, 837 bp, Homo sapiens; identical to SEQ ID NO: 76438
  chr14:104639050-104639887
  Hypo

SEQ ID NO: 110298 - DNA, 399 bp, Homo sapiens; identical to SEQ ID NO: 76439
  chr14:104640183-104640582
  Hypo

SEQ ID NO: 110299 - DNA, 532 bp, Homo sapiens; identical to SEQ ID NO: 76440
  chr14:104641305-104641837
  Hypo

SEQ ID NO: 110300 - DNA, 202 bp, Homo sapiens; identical to SEQ ID NO: 76441
  chr14:104642041-104642243
  Hypo

SEQ ID NO: 110301 - DNA, 288 bp, Homo sapiens; identical to SEQ ID NO: 76442
  chr14:104642454-104642742
  Hypo

SEQ ID NO: 110302 - DNA, 1271 bp, Homo sapiens; identical to SEQ ID NO: 76443
  chr14:104643013-104644284
  Hypo

SEQ ID NO: 110303 - DNA, 382 bp, Homo sapiens; identical to SEQ ID NO: 44172
  chr14:104645126-104645508
  Hypo

SEQ ID NO: 110304 - DNA, 990 bp, Homo sapiens; identical to SEQ ID NO: 76445
  chr14:104645716-104646706
  Hypo

SEQ ID NO: 110305 - DNA, 207 bp, Homo sapiens; identical to SEQ ID NO: 44175
  chr14:104647208-104647415
  Hypo

SEQ ID NO: 110306 - DNA, 30 bp, Homo sapiens; identical to SEQ ID NO: 44176
  chr14:104647924-104647954
  Hypo

SEQ ID NO: 110307 - DNA, 283 bp, Homo sapiens; identical to SEQ ID NO: 76448
  chr14:104648592-104648875
  Hypo

SEQ ID NO: 110308 - DNA, 30 bp, Homo sapiens; identical to SEQ ID NO: 76449
  chr14:104674208-104674238
  Hypo

SEQ ID NO: 110309 - DNA, 172 bp, Homo sapiens; identical to SEQ ID NO: 76450
  chr14:104676826-104676998
  Hypo

SEQ ID NO: 110310 - DNA, 30 bp, Homo sapiens; identical to SEQ ID NO: 76451
  chr14:104679828-104679858
  Hypo

SEQ ID NO: 110311 - DNA, 189 bp, Homo sapiens; identical to SEQ ID NO: 76452
  chr14:104682484-104682673
  Hypo

SEQ ID NO: 110312 - DNA, 30 bp, Homo sapiens; identical to SEQ ID NO: 76453
  chr14:104682881-104682911
  Hypo

SEQ ID NO: 110313 - DNA, 87 bp, Homo sapiens; identical to SEQ ID NO: 76454
  chr14:104696332-104696419
  Hypo

SEQ ID NO: 110314 - DNA, 186 bp, Homo sapiens; identical to SEQ ID NO: 76455
  chr14:104705204-104705390
  Hypo

SEQ ID NO: 110315 - DNA, 58 bp, Homo sapiens; identical to SEQ ID NO: 76456
  chr14:104719866-104719924
  Hypo

SEQ ID NO: 110316 - DNA, 32 bp, Homo sapiens; identical to SEQ ID NO: 76457
  chr14:104735865-104735897
  Hypo

SEQ ID NO: 110317 - DNA, 32 bp, Homo sapiens; identical to SEQ ID NO: 76458
  chr14:104759084-104759116
  Hypo

SEQ ID NO: 110318 - DNA, 30 bp, Homo sapiens; identical to SEQ ID NO: 76459
  chr14:104760897-104760927
  Hypo

SEQ ID NO: 110319 - DNA, 310 bp, Homo sapiens; identical to SEQ ID NO: 76460
  chr14:104768148-104768458
  Hypo

SEQ ID NO: 110320 - DNA, 103 bp, Homo sapiens; identical to SEQ ID NO: 76461
  chr14:104770277-104770380
  Hypo

SEQ ID NO: 110321 - DNA, 30 bp, Homo sapiens; identical to SEQ ID NO: 76462
  chr14:104773160-104773190
  Hypo

SEQ ID NO: 110322 - DNA, 30 bp, Homo sapiens; identical to SEQ ID NO: 44181
  chr14:104798505-104798535
  Hypo

SEQ ID NO: 110323 - DNA, 38 bp, Homo sapiens; identical to SEQ ID NO: 44182
  chr14:104800605-104800643
  Hypo

SEQ ID NO: 110324 - DNA, 37 bp, Homo sapiens; identical to SEQ ID NO: 44183
  chr14:104801369-104801406
  Hypo

SEQ ID NO: 110325 - DNA, 30 bp, Homo sapiens; identical to SEQ ID NO: 76466
  chr14:104812509-104812539
  Hypo

SEQ ID NO: 110326 - DNA, 62 bp, Homo sapiens; identical to SEQ ID NO: 76467
  chr14:104820337-104820399
  Hypo

SEQ ID NO: 110327 - DNA, 121 bp, Homo sapiens; identical to SEQ ID NO: 76468
  chr14:104821569-104821690
  Hypo

SEQ ID NO: 110328 - DNA, 30 bp, Homo sapiens; identical to SEQ ID NO: 76469
  chr14:104841778-104841808
  Hypo

SEQ ID NO: 110329 - DNA, 201 bp, Homo sapiens; identical to SEQ ID NO: 76470
  chr14:104842214-104842415
  Hypo

SEQ ID NO: 110330 - DNA, 36 bp, Homo sapiens; identical to SEQ ID NO: 76471
  chr14:104854637-104854673
  Hypo

SEQ ID NO: 110331 - DNA, 30 bp, Homo sapiens; identical to SEQ ID NO: 76472
  chr14:104858976-104859006
  Hypo

SEQ ID NO: 110332 - DNA, 166 bp, Homo sapiens; identical to SEQ ID NO: 76473
  chr14:104862860-104863026
  Hypo

SEQ ID NO: 110333 - DNA, 30 bp, Homo sapiens; identical to SEQ ID NO: 76474
  chr14:104889841-104889871
  Hypo

SEQ ID NO: 110334 - DNA, 263 bp, Homo sapiens; identical to SEQ ID NO: 76475
  chr14:104897587-104897850
  Hypo

SEQ ID NO: 110335 - DNA, 257 bp, Homo sapiens; identical to SEQ ID NO: 76476
  chr14:104899274-104899531
  Hypo

SEQ ID NO: 110336 - DNA, 37 bp, Homo sapiens; identical to SEQ ID NO: 76477
  chr14:104917379-104917416
  Hypo

SEQ ID NO: 110337 - DNA, 30 bp, Homo sapiens; identical to SEQ ID NO: 76478
  chr14:104937788-104937818
  Hypo

SEQ ID NO: 110338 - DNA, 38 bp, Homo sapiens; identical to SEQ ID NO: 44188
  chr14:105026775-105026813
  Hypo

SEQ ID NO: 110339 - DNA, 30 bp, Homo sapiens; identical to SEQ ID NO: 76480
  chr14:105052447-105052477
  Hypo

SEQ ID NO: 110340 - DNA, 68 bp, Homo sapiens; identical to SEQ ID NO: 76481
  chr14:105055027-105055095
  Hypo

SEQ ID NO: 110341 - DNA, 30 bp, Homo sapiens; identical to SEQ ID NO: 76482
  chr14:105059531-105059561
  Hypo

SEQ ID NO: 110342 - DNA, 114 bp, Homo sapiens; identical to SEQ ID NO: 76483
  chr14:105063222-105063336
  Hypo

SEQ ID NO: 110343 - DNA, 332 bp, Homo sapiens; identical to SEQ ID NO: 76484
  chr14:105070904-105071236
  Hyper

SEQ ID NO: 110344 - DNA, 30 bp, Homo sapiens; identical to SEQ ID NO: 76485
  chr14:105084500-105084530
  Hypo

SEQ ID NO: 110345 - DNA, 48 bp, Homo sapiens; identical to SEQ ID NO: 76486
  chr14:105101539-105101587
  Hypo

SEQ ID NO: 110346 - DNA, 30 bp, Homo sapiens; identical to SEQ ID NO: 76487
  chr14:105103478-105103508
  Hypo

SEQ ID NO: 110347 - DNA, 33 bp, Homo sapiens; identical to SEQ ID NO: 76488
  chr14:105103792-105103825
  Hypo

SEQ ID NO: 110348 - DNA, 159 bp, Homo sapiens; identical to SEQ ID NO: 76489
  chr14:105132631-105132790
  Hypo

SEQ ID NO: 110349 - DNA, 99 bp, Homo sapiens; identical to SEQ ID NO: 76490
  chr14:105157485-105157584
  Hypo

SEQ ID NO: 110350 - DNA, 30 bp, Homo sapiens; identical to SEQ ID NO: 76491
  chr14:105173303-105173333
  Hypo

SEQ ID NO: 110351 - DNA, 143 bp, Homo sapiens; identical to SEQ ID NO: 76492
  chr14:105174251-105174394
  Hypo

SEQ ID NO: 110352 - DNA, 43 bp, Homo sapiens; identical to SEQ ID NO: 76493
  chr14:105194951-105194994
  Hypo

SEQ ID NO: 110353 - DNA, 80 bp, Homo sapiens; identical to SEQ ID NO: 76494
  chr14:105195803-105195883
  Hypo

SEQ ID NO: 110354 - DNA, 273 bp, Homo sapiens; identical to SEQ ID NO: 76495
  chr14:105196272-105196545
  Hypo

SEQ ID NO: 110355 - DNA, 38 bp, Homo sapiens; identical to SEQ ID NO: 76496
  chr14:105218308-105218346
  Hypo

SEQ ID NO: 110356 - DNA, 43 bp, Homo sapiens; identical to SEQ ID NO: 76497
  chr14:105235762-105235805
  Hypo

SEQ ID NO: 110357 - DNA, 240 bp, Homo sapiens; identical to SEQ ID NO: 76498
  chr14:105240937-105241177
  Hypo

SEQ ID NO: 110358 - DNA, 30 bp, Homo sapiens; identical to SEQ ID NO: 44194
  chr14:105254641-105254671
  Hypo

SEQ ID NO: 110359 - DNA, 143 bp, Homo sapiens; identical to SEQ ID NO: 76500
  chr14:105268653-105268796
  Hypo

SEQ ID NO: 110360 - DNA, 108 bp, Homo sapiens; identical to SEQ ID NO: 76501
  chr14:105292310-105292418
  Hyper

SEQ ID NO: 110361 - DNA, 1137 bp, Homo sapiens
  chr14:105309697-105310834
  Hyper
tcaccccgggatgcccgcccagcgcgccaagccccccacgctcacctgtaagtgcaggtggtgctggaggccaggccggggccctgcaggggcaggcacacagtggggctccgtcgccgcagcgccccggcggcctcctcctggccgctggccctcccctaaggcttcctcatcctaaacagcaagtgaagccaaacgaaaaccctgtctctcccgccgttccctccctcctggcctccgtcccccgggctcgcctgccccgccgcccggcggaccggtcccttcctgctttccctggcgggtgctttccgctgctctgttacccggagccaggacgcgcatatattcccagaatccgcgctcagtgcgttcggtcccccgggacacctgttctctgcacaggcgcgtctgggcgcagcgggggcagacacgcgttcccgggcagcgactccggaaggcccgagggagtaaatctggccctcccggttcagcacaaagctcccctggccgcctttcaaaaccgaccgcctcccaactctccgcggacacgagtggcggctgcctcccctcccctcccctagggccgcgcacgcctcccgcagggtctcagtgcctcctgggcgggggataattcctgtccccaccggtgtcctgtactcgcggggtcccgggtgtaagttctgggtcccgggctggctccctggtgagcaaagccgcatcgctcgaattccagaaacccttctcgccgagcgcctgcctggctgctgaaagcctggagactgcgctctcggaggtggatttcggaactcaggagagaagaatgagacgctccctagtacccctagtcccccaggggtgggaggggactgtatctcaaaataagattctgcaactcgacttttataggggaaaccaggcacgcatttcaaaatcttctcatccgtccccacctccttgcgccgcttttccgcgcctcctgtgccacggaagctgccctctgctcctgctgtttccagcccggcagcccccagacaggatctagcttggcccagccgggccctgcttcctctgcctggggtcctcaggccatgcaagtgaggaaacccaggctcagaggggccacgtaactcttcccaa

SEQ ID NO: 110362 - DNA, 376 bp, Homo sapiens
  chr14:105433929-105434305
  Hyper
cccaccctcagccaccgcactgggagcggctgttcctacactgcctgtagtggggatggagtgcagaggctcagcgagcggcagacctgcctctggccacagagctgcgcagtggggacccctccagtcactgggctggcaggagcctggcccaggaacacaaacaggaagggggaaatcctgcccgcctcgggataaggctgcgcagccaggctaccggcctcggacccgcgccagtcgggagagagaggaaggcccccagtatcccagtcccccgccaagagcaccgcctcccaggcccgagctcctgaggaagccccgcctcggccgcagagcgcaggggaggccgcctttgcccgcccggcctccggttctc

SEQ ID NO: 110363 - DNA, 356 bp, Homo sapiens
  chr14:105444452-105444808
  Hyper
cggcgcgcgccctcgcgcgtagcccacccgccccaggggagcgggctgcaggcggggaggggcgcaccgctgccgggggttccgggccaggtgggcagcaccatgtggaagcagtcgcacatcgcggcggccaggcggtgcgggcctggcggcccgtcgcgtccagtcgctggtcccggctccggcgcacggggcgggcgggcgggagccgcgctctgccccgctgccctgcgctgccgcgggcggccgacctcggactgcggacaccgcgcgccaggctacccagccgctcagctaggaccccgcccggctccgcccagccctgccgggccactgcggagcgcgctcgcgggcgg

SEQ ID NO: 110364 - DNA, 81 bp, Homo sapiens; identical to SEQ ID NO: 76508
  chr14:105457696-105457777
  Hypo

SEQ ID NO: 110365 - DNA, 99 bp, Homo sapiens; identical to SEQ ID NO: 76509
  chr14:105479261-105479360
  Hypo

SEQ ID NO: 110366 - DNA, 393 bp, Homo sapiens; identical to SEQ ID NO: 76510
  chr14:105511966-105512359
  Hyper

SEQ ID NO: 110367 - DNA, 30 bp, Homo sapiens; identical to SEQ ID NO: 76512
  chr14:105523817-105523847
  Hypo

SEQ ID NO: 110368 - DNA, 30 bp, Homo sapiens; identical to SEQ ID NO: 44196
  chr14:105538919-105538949
  Hypo

SEQ ID NO: 110369 - DNA, 34 bp, Homo sapiens; identical to SEQ ID NO: 76514
  chr14:105590655-105590689
  Hypo

SEQ ID NO: 110370 - DNA, 76 bp, Homo sapiens; identical to SEQ ID NO: 76515
  chr14:105658349-105658425
  Hypo

SEQ ID NO: 110371 - DNA, 111 bp, Homo sapiens; identical to SEQ ID NO: 76516
  chr14:105662505-105662616
  Hyper

SEQ ID NO: 110372 - DNA, 183 bp, Homo sapiens; identical to SEQ ID NO: 76517
  chr14:105662937-105663120
  Hyper

SEQ ID NO: 110373 - DNA, 186 bp, Homo sapiens; identical to SEQ ID NO: 35579
  chr14:105714232-105714418
  Hypo

SEQ ID NO: 110374 - DNA, 127 bp, Homo sapiens
  chr14:105714476-105714603
  Hyper
cagagcagagtggaccgcgctctctgcaagcgctggctgctggcgtccgtagcaagctaaatcgcgaagcatctgaacgaacgaggaagcccaacgaccatcccacaggccgcggccagaggcagac

SEQ ID NO: 110375 - DNA, 455 bp, Homo sapiens
  chr14:105715007-105715462
  Hyper
agcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggtgagcccgtgccccgcggcccccgcgcccgcgcgcgccc

SEQ ID NO: 110376 - DNA, 47 bp, Homo sapiens; identical to SEQ ID NO: 76521
  chr14:105715982-105716029
  Hypo

SEQ ID NO: 110377 - DNA, 129 bp, Homo sapiens; identical to SEQ ID NO: 76522
  chr14:105723744-105723873
  Hypo

SEQ ID NO: 110378 - DNA, 30 bp, Homo sapiens; identical to SEQ ID NO: 44200
  chr14:105739229-105739259
  Hypo

SEQ ID NO: 110379 - DNA, 202 bp, Homo sapiens; identical to SEQ ID NO: 76524
  chr14:105739460-105739662
  Hypo

SEQ ID NO: 110380 - DNA, 30 bp, Homo sapiens; identical to SEQ ID NO: 44202
  chr14:106334145-106334175
  Hypo

SEQ ID NO: 110381 - DNA, 39 bp, Homo sapiens; identical to SEQ ID NO: 77376
  chr15:20499470-20499509
  Hypo

SEQ ID NO: 110382 - DNA, 35 bp, Homo sapiens; identical to SEQ ID NO: 44204
  chr15:22515501-22515536
  Hypo

SEQ ID NO: 110383 - DNA, 36 bp, Homo sapiens; identical to SEQ ID NO: 77378
  chr15:22587476-22587512
  Hypo

SEQ ID NO: 110384 - DNA, 20 bp, Homo sapiens
  chr15:22792239-22792259
  Hypo
gccaccgctcctggccagga

SEQ ID NO: 110385 - DNA, 36 bp, Homo sapiens; identical to SEQ ID NO: 77380
  chr15:22822348-22822384
  Hypo

SEQ ID NO: 110386 - DNA, 93 bp, Homo sapiens; identical to SEQ ID NO: 77381
  chr15:22876959-22877052
  Hypo

SEQ ID NO: 110387 - DNA, 197 bp, Homo sapiens; identical to SEQ ID NO: 77382
  chr15:22977051-22977248
  Hypo

SEQ ID NO: 110388 - DNA, 25 bp, Homo sapiens
  chr15:23035596-23035621
  Hypo
tttgagacagagtctcgctctgtcg

SEQ ID NO: 110389 - DNA, 20 bp, Homo sapiens
  chr15:23084842-23084862
  Hypo
ccggccgcaagatgttcttc

SEQ ID NO: 110390 - DNA, 19 bp, Homo sapiens
  chr15:23087577-23087596
  Hypo
tttgagacagagtctcgct

SEQ ID NO: 110391 - DNA, 264 bp, Homo sapiens; identical to SEQ ID NO: 77386
  chr15:23158318-23158582
  Hyper

SEQ ID NO: 110392 - DNA, 145 bp, Homo sapiens; identical to SEQ ID NO: 77387
  chr15:23182506-23182651
  Hypo

SEQ ID NO: 110393 - DNA, 39 bp, Homo sapiens; identical to SEQ ID NO: 77388
  chr15:23217780-23217819
  Hypo

SEQ ID NO: 110394 - DNA, 127 bp, Homo sapiens; identical to SEQ ID NO: 77389
  chr15:23662038-23662165
  Hypo

SEQ ID NO: 110395 - DNA, 174 bp, Homo sapiens; identical to SEQ ID NO: 77390
  chr15:24515033-24515207
  Hypo

SEQ ID NO: 110396 - DNA, 113 bp, Homo sapiens; identical to SEQ ID NO: 77391
  chr15:25334863-25334976
  Hypo

SEQ ID NO: 110397 - DNA, 150 bp, Homo sapiens; identical to SEQ ID NO: 77392
  chr15:25449793-25449943
  Hypo

SEQ ID NO: 110398 - DNA, 182 bp, Homo sapiens; identical to SEQ ID NO: 77393
  chr15:25477788-25477970
  Hypo

SEQ ID NO: 110399 - DNA, 32 bp, Homo sapiens; identical to SEQ ID NO: 35581
  chr15:25915272-25915304
  Hyper

SEQ ID NO: 110400 - DNA, 1437 bp, Homo sapiens
  chr15:26107394-26108831
  Hyper
accactgtgcctggccgaagactgaggcagggacttcaggccagggggccaggctggcttttcctgcctttcacttcaggtgggagcggctgtggatgaggatgtccagcggccgtcggtttctagccttgggatcattctggccccgacacggagtgacaggggatccccacgcgtccccgcatccagggcgcccctttagctgcggcggaggcacagagaggccttggcggcgctgtggcttcggtcggcaccgggtcccgcgcagccgggccctccaccctgagtggagctgccttctaagcacccagcccctgccaatcactgtgcccaacaccaagttcccggggcgccctgccctgcgccaccgcgcgctcgctcgcccgcccgcccaactcacctgctgaagaccaggcagcccaggtggttgatcttgtggtcggagcggtggcggctgtagtcctcccacaggtccctgaaggccgtgatggccaggatgaagagcaccggcgccagtgccaggccgggctggaaggcgttcaccgccggcacgaagttgagcagcgcgatgaagacaaagtacacgttggccgggcggtggaactgctcgaacaggttcttgggcaggaaggacagcagcgtgtacttggtagtcttgagccggttgtcggccaggtgctgggcacacccgcgccgccgtcgccgctcgcccttggccgcgccagccgcagggtcctcggcgcccgggggcggcagcaggttggagcgcaccgtgcgcgtcctgccctctcggcgcctccgccgtcccggaggcccgggctcctcggtccccgccggctcccgctccatggccgcgtgtcgccgcgcccggctcctccgccgctcacgcccgcccgcgccggcctcttaggttatcatcactcgcggcccgggcgcggcggtgcgagctccccgcctgcgggacgcacggagaccgcggtcagcgcgccgcctggccggcccagcgcgcccagcccgcgcccagccccgtccactcccgtccagccccgccgcccggccgcagtccccagggcgcaagctgggcgggtgccgcacagagcccccttgtcctcgccgcccgcccccggcccgggtcgtttccgccgcggtggccacggccccgccctcgttccgcgcccggactgggccacgccggatagcgggaaacaaaaaaagcccgagctggaaacttcagagaggtttagtttcgtttcccagaagcatcagttcggtcccaaaacgctgcaaacgcgcgctgcctgcagtaggagagaggaaaccgcgaagcgcgagaaaaggcgcccccgtccccaagcagcccgcgcgcccttccaggggccagacctgctccatcctggacggcgaaacgacctcgggagaccccggttaggaccttac

SEQ ID NO: 110401 - DNA, 30 bp, Homo sapiens; identical to SEQ ID NO: 77398
  chr15:26147501-26147531
  Hypo

SEQ ID NO: 110402 - DNA, 30 bp, Homo sapiens; identical to SEQ ID NO: 77399
  chr15:26234528-26234558
  Hypo

SEQ ID NO: 110403 - DNA, 580 bp, Homo sapiens
  chr15:26327329-26327909
  Hyper
aggcttataaatttacgagtttcactgtgttccaaaagaaaggtccagtcattcccacaccgggagtcgaacccgggccgcctgggtgaaaaccaggaatcctaaccgctagaccatgtgggagatgacaagtaaccgttgaattctaaaccaattgaatcatttccgcctgcccttgctttccgccttctgccacgcctccgacaacaaatccctgtctgcgcctgcgcctgcgcgggctttcggtgctgaccgcttgttgatagaggtgtgctccttctcgaaaggcggaggcagggctgggcgctgtggctgctggcactacccagttcttcagcagcgctgtgcctggaggcccccagcccctcgccccccggctcgcgggaggcggcaccagacctcctcaggccctggtccctaggaaactgcagcccggcctcagtttccagaaagctcctccgtgcgatttgggaagagcacggtttgaatggttgaaaatagaggggctgaagaaccgagccgcgcgggcctggctccggggctgagttccctagcgggcgccgagcggagcctgccatta

SEQ ID NO: 110404 - DNA, 35 bp, Homo sapiens; identical to SEQ ID NO: 77402
  chr15:26869355-26869390
  Hypo

SEQ ID NO: 110405 - DNA, 30 bp, Homo sapiens; identical to SEQ ID NO: 12083
  chr15:27016662-27016692
  Hyper

SEQ ID NO: 110406 - DNA, 36 bp, Homo sapiens; identical to SEQ ID NO: 77404
  chr15:27016983-27017019
  Hyper

SEQ ID NO: 110407 - DNA, 161 bp, Homo sapiens
  chr15:27017228-27017389
  Hyper
aacctcgggaccaggcgacagagcgctggaggagctgggagcccacgggcagcggcagatgggagcactaggccggccaggactcccccgcaggaagggtgcgccctcgcggctccgacgccagccaggcccccgagcgcccggggcgggtgcagggagcc

SEQ ID NO: 110408 - DNA, 178 bp, Homo sapiens
  chr15:27017650-27017828
  Hyper
ctccggcgcggggcgcgggcggctctgaggactgggggctatcccaggaggggcgcgggcgaagggcccccactcccacccgccgctgctccgcggatgcggcccccgcctccctccgcccaggccgccgccgccgtgggtcgcgcttcccgcaacggccgcgcgcagcccacttacc

SEQ ID NO: 110409 - DNA, 592 bp, Homo sapiens
  chr15:27018284-27018876
  Hyper
gcggggagggaggagcgcgcgcgggcgcggggcgggggaggaggccggagagtcggaggcggagccgccgcgccgcgcaccctgccctcccccacgctcgcctcggcccgaggccggggccctgggcgctcccctcccgcctcggcggccgccgcacgggactcggacctctgggaccgcggagtgcgggggcgacctgggccggacgctgcgagcggagccgcggctgcgcggagtcgggaggggcggggggtcgtcccctgagccggctcctctgggctctcggcggccgggcgagtgcggggactgtcggcagcctcggcgccggcataagcggcggcggaaacgctgcccgcctaccccggccgccgaagttggccccgcacgacgaccaccgcccgctgcagcgcagcccgagagcccccgggtgccgcgcctctgcccgccggactgcgggccgccgcctcccgacggtgcctgcagaacgccgggaagcccccgcctcacctgcggggctcagagcctcgggtccccagggtccaggagagccagatgggcagcaggagctccaggagcccggagcacatggcgc

SEQ ID NO: 110410 - DNA, 17 bp, Homo sapiens
  chr15:27079519-27079536
  Hypo
ggagtcttgctctgtcg

SEQ ID NO: 110411 - DNA, 687 bp, Homo sapiens
  chr15:27111977-27112664
  Hyper
caggcctctatcacccgactgctgacactgccctcccatccctgctctacaagcgggcggtggtgactacacgaggcgccgaagatgctgttgagggccctggagaaacttcagcagaacagggcctctccccttgcaggccgagccgggggccctgcgccctccccctccgcccagctcggccaagggcgcatttgctgagcgtctggcggcctctaccggagcacctctgcagagggccgatcctccagcccagagacgacatgtggcgctcgggcgaggtgagagcgggcgcgagtgcgccgggggcgctggggggctctgcggcgggcggcgcgcggcccggggcgcggcgcggagcggagctgcagggcggcggcgggagcgcggggcgcaagagccgctccgccgggagtgccggggaagttcgcgctggcagcatggggcggtgacgccgcaccggccttccgcgcctgccagccgggcgagagcaggcggaggagaaggaggatgcatcctcaccgacggctcgcctcccggggccggcgcgcagggtgagccctgggcgcgctgggccggggcagtggggtaagaggacgcgagcggggaagaggaccggccgccccggctcggtccgcacccttctcctcggggcgcctgagcggcaggctgcgtggccggggagga

SEQ ID NO: 110412 - DNA, 703 bp, Homo sapiens
  chr15:27112921-27113624
  Hyper
ctcgcggggtggactcggaccccgcgggggtgtcgcgcgcgtgtcgcgcgggctgctcgaggccaggggacttggagtcgctgctgcaccgcgcgctcccagcccaggaggaaggcgctgcctggcggagcgcttggctcgtacccggggcaggagcaggggaagtctgcgaaagccgggagcgagccggggagggccggggagctggagaccctcggcgtgccgctgcggaccgcgcgggtggcgaccgcgggtgccagggcgacccaggctgcggctccgcagtgcagcccccgcgcccacctgccctggcgcgccggccctggtgagcctctgtgggggtccggagggtcgtgggagcgcagcctctcctgggggtccctggctcggggctgaggggcggcgggaggcgccgcccgggtttcccgcatgcagcgccgcgtgctcgccgcctggctctggcccgggccccgcgacgagccccccggacgcgcccaggcgaccaccgcatggcaccctgcccttcttggcaggagtcgcagaaggccttcgcttccgaggtggaagtacctgttgtgtctcccaattccggagtttgcgggggatgggggttgggggggcttcttgggaaaatgcttcttttcgaagcatactgttcggatgcctgtgagcacctatttgcgttatgcgcatactgagaaat

SEQ ID NO: 110413 - DNA, 610 bp, Homo sapiens; identical to SEQ ID NO: 77414
  chr15:27212788-27213398
  Hyper

SEQ ID NO: 110414 - DNA, 450 bp, Homo sapiens
  chr15:27216067-27216517
  Hyper
atggctggaggaaggcggaccgcgggctcgctctcatggtgccaaccccggggacctttcttcaggctccctgcgggatccccagcctcccctccccctcggagctccgcccccttcctggcctcaaactccgagtccattcaaacctcgccttcctcgccctgcgcgttgtcaggcgtgtaattggggaaactcctccccgccgggaccgcctcggaggcgctgccaggggacagccgcccagctgcccccacctcccagcacagcgcacacagccccggcctgggcacccgcgcccgctcgcggctccaggcggggtgggcggcgccgcgccagggggtccccggcgcccattgctcccgccgcccggttgcgcggaccggcgctagtgcgcgggtgggggcggcgcgccgcggtggcccggcgtcccgtgtgcgtccagtgtgcgcc

SEQ ID NO: 110415 - DNA, 119 bp, Homo sapiens
  chr15:27216805-27216924
  Hyper
ctggagtccctggcgcgccagccgtcggctgggctgcggcacggcgggccgggaggggactgggaagtcggtctgcacctcacctgtcccagctcccttggacacggtcatctgctttt

SEQ ID NO: 110416 - DNA, 30 bp, Homo sapiens; identical to SEQ ID NO: 35597
  chr15:27603952-27603982
  Hyper

SEQ ID NO: 110417 - DNA, 30 bp, Homo sapiens; identical to SEQ ID NO: 77418
  chr15:27884112-27884142
  Hypo

SEQ ID NO: 110418 - DNA, 30 bp, Homo sapiens; identical to SEQ ID NO: 77419
  chr15:28016476-28016506
  Hypo

SEQ ID NO: 110419 - DNA, 34 bp, Homo sapiens; identical to SEQ ID NO: 77420
  chr15:28051056-28051090
  Hypo

SEQ ID NO: 110420 - DNA, 30 bp, Homo sapiens; identical to SEQ ID NO: 77421
  chr15:28076464-28076494
  Hypo

SEQ ID NO: 110421 - DNA, 32 bp, Homo sapiens; identical to SEQ ID NO: 77422
  chr15:28114883-28114915
  Hypo

SEQ ID NO: 110422 - DNA, 271 bp, Homo sapiens
  chr15:28339763-28340034
  Hyper
caaccccaaatcgttcgtgtgggctactgccggccctctctccggctctgcgctctttctgcctgcaaccgtgcccccgaactcgggccctgcgaggtgggggtgggcccgggcccctcctgccgcccctgctgccagcaccgttctctccgaggccctcaacgccccgccgtgccgtggccttcagagcgcgccagacgctcaccaagcctgcccgagccccgcctcccgcagccgtgcccagggcggagtggggcgacggcaccggtgc

SEQ ID NO: 110423 - DNA, 268 bp, Homo sapiens; identical to SEQ ID NO: 77425
  chr15:28340309-28340577
  Hyper

SEQ ID NO: 110424 - DNA, 28 bp, Homo sapiens
  chr15:28340877-28340905
  Hyper
gaacattgttcttcgagttctttaaata

SEQ ID NO: 110425 - DNA, 941 bp, Homo sapiens
  chr15:28341620-28342561
  Hyper
gcaggagaagccctgcggccaagaaggcctgaagaagcccgtccaggggtcagcctcctcctcagccggtcctgggctgagacaggggtgtcccgctgagggcagtgtagggtgcggtgcccccaccccacttcgggcctggaccgagaccgcgagtgtgaccgtatatcccttcaggtggatttttcaacatgtgaacttggttaaaagcttctagaacgttaagccaaacatcgtggctttccatccgttttctgttcttgtttgaaagagtacgcctccttccagcctgggaggaggggcggggcccgggagagggcctcgggaggccgcgggtgggctctgccgagggccgcgttcgcagggccccccgggactggcggccccgcggcaggccaggcgcacctctcggggagaaacgagcagcgccagcaaacgcgcagccgggcacgcggccgcccagccccgctcccagcccggggccaggacccctccccgcggcgccgctgccgcaagcctcctctgctaccccagctgcgggcagtttggcccggcgctgtgccgctgtagttcggtgtcccttcgcccatcctgcaggccagcttggaaactgtgtcccatgctcctcgaaacaccggacctgctccccgccgccctgcggaatgcgcctcctggcgcctcagtgggtggccgggccgagagcacaggcgcgccagccacacctccccacgggtcggacccacacggaccccgccgcgctccgccgaaactgcgcgggtcccgcgggtggccggcgcaagagccacagcccgcgacaagccggctgcctgcaggtcagtgacagaaccccaaatggaaactgcggaaacccaacaaccagcgagtgagctggtagagccagcggccccaaggagctgagggagctccggcttgtggagtct

SEQ ID NO: 110426 - DNA, 589 bp, Homo sapiens
  chr15:28344103-28344692
  Hyper
tggcccaccagggggcgactttttcctgggtcgcctggcagagagccggagggggtgctcagggggcagctgctgcaggcccaggcggactcagccgcgctaggtcggctccgtcgcacccgtctgtgcacactaacctttaggggaacttgccttgcttcctaagccgcgactcagccggggctgtgtaaaccctccctgcctgttcccaggctagtctggctcctcgcctccttcctcccgaccgcggagcacgtgcactttacctgcgcacttgcagatctttctccaggagtgagtttaaggtccgcacctccgctctggatggtgagcggagcacagccttcgaagtaagaactcagagggagctcggcgctcccgcagcgggtcccccacccaggcacgcccccggcccggccccgcccacagcactccccactcggccccgcccacagtgcggccacgcccgtagcacgcccctcccggccacgcccacaaagctgcccacatggccccgcccacagctcgcccgctccgcacccccggcccctcagctccccagcccccggcggcgcgggctgagagcagc

SEQ ID NO: 110427 - DNA, 115 bp, Homo sapiens; identical to SEQ ID NO: 77433
  chr15:28346156-28346271
  Hypo

SEQ ID NO: 110428 - DNA, 1301 bp, Homo sapiens
  chr15:28351758-28353059
  Hyper
gcagggtgggggcaccgggcgcacgcggggaatttccccacgaccacggccacgccaaatgcctgaacctccacggctgccggcaacagcgagcgcagggagggggctgtgcgcgcgggggccctggtggcggagcaggcatcaccccgagagcgccgaggtttgtggtcgcaaccccgggagcaccgctgcgggaggagcggcgtggccgggcagaggcgacttcctcgcaggcagtaccgggccccgcggccgcctccgggcctgtcctggtgccccgggcttccacccggcgggctggcgtgcgggggctggtcttcgccgagatcctgctgggagcgggctctggccccacggtgagcccggccccagcctcggtgatgcgcttcgctgccgcgcggggagggagagtccggcagggtcacgaggcgccggccccggggccgcttgaaacccgaagagaccccgctcgctcgcgcgcccgccggacgaatcctcgcggaggtcccggggcgcagccggcgtgagggtggggtctcatcgcaggggcgccgggagcctccccgctccgctagctcaaccaaggaccgctcagaggggctctcaccctgaacctcggcttttctaaaggaagggcagaccccagatttcccccttctcttctcgaacgtgctttgggtgtttttctgctttcttttttggcaagtcaggacagcgcacagtgcacggagctccgaagctctctcagctactcccggatttctggttaaacctgagggtgagcccgaaagaccgctgccgccggcggccaccccagcgcgggtccgctgagaatggaaacagcaagtgcgcgccggccaggccgccacctctccctcctccaacagcccgggcagccgcaggggccagccccgggccagccagggcccagcacaaaatgccttccagcgacagcagcgccggaagccccttctgaggtcgtggataagcctccgcgcaggggccccgcgctcagcccaccccgcatgcctccgcgccagggcctgctggtgggtggccgcctgccccgggctatcccgggctgggcactggcgccgatcccgcctcgcttgtggagctgcatttggggggaaagatggaccggcagcgtgggacgcagagccaggccaggccgcacgggctgtgcacaaagatatgcccgacaggcggggagaaggcatggcccaccggctcaggagaaagtcctggaggggaggcagtccgcccctggggacaacgcggggggccgtattcggacacca

SEQ ID NO: 110429 - DNA, 206 bp, Homo sapiens; identical to SEQ ID NO: 77438
  chr15:28389827-28390033
  Hypo

SEQ ID NO: 110430 - DNA, 122 bp, Homo sapiens; identical to SEQ ID NO: 44213
  chr15:28517076-28517198
  Hypo

SEQ ID NO: 110431 - DNA, 23 bp, Homo sapiens
  chr15:29008573-29008596
  Hypo
accgcgcccggcttccagaatat

SEQ ID NO: 110432 - DNA, 21 bp, Homo sapiens
  chr15:29029711-29029732
  Hypo
ctgagcgcggtgaatcgcttg

SEQ ID NO: 110433 - DNA, 37 bp, Homo sapiens; identical to SEQ ID NO: 77442
  chr15:29034132-29034169
  Hyper

SEQ ID NO: 110434 - DNA, 550 bp, Homo sapiens
  chr15:29077236-29077786
  Hyper
tgagaaactgacttccgtaggagtgcgggtgtgcgtgcgtgccgcggaaatcccgccttctggcgcctgcggttgccccctggcctcagccggtaggctcccaagtaggaagataaaccgcattgcacgaagcgggagagtccagaggagcggcgaagcgctcctcttccccattggctgcgcccacggagccgccttgcgattggccctaagcgcgggtggctggggttgcgagaggcatcaggatccctggcggcgcctgagccagcggctgctaggaggctgtgtccgcaagccagcggggcgaggcgcctgggccctgcgcgtcaggtcccggcctggggcaccggggctgccagcgtcggaggaggtgcgggcgcggggttggcgggcggccgaacgggggcctgcgcggaccgcccgcggctcagcctccggtctctctccgtctctaagtggtggtggctgtgggtttttctgcaggtgatccttttgagtaatttgtttcacgcaggcgccctgctgtagggtaaagcggcagattcatgct

SEQ ID NO: 110435 - DNA, 88 bp, Homo sapiens; identical to SEQ ID NO: 77446
  chr15:29087614-29087702
  Hypo

SEQ ID NO: 110436 - DNA, 48 bp, Homo sapiens; identical to SEQ ID NO: 44215
  chr15:29112193-29112241
  Hypo

SEQ ID NO: 110437 - DNA, 21 bp, Homo sapiens
  chr15:29119934-29119955
  Hypo
ccactgcgcctggcctgcatg

SEQ ID NO: 110438 - DNA, 30 bp, Homo sapiens; identical to SEQ ID NO: 77449
  chr15:29123489-29123519
  Hypo

SEQ ID NO: 110439 - DNA, 1200 bp, Homo sapiens
  chr15:29130707-29131907
  Hyper
cccccattacagctgcgcggggccgagcaagcagggcgcggcggccggggcaaggtgcggagcctcgcgttcaccggctctacctgcggagcctcgcgttcactggctctacctgcgggaccagacccctgcagctccccagccagcacggccggggcacgcccgggaatctgtgtgctccccagggcccggggcgttcggggcgccgcgccttccagcgcctgggtcccagccccgatcccggagaccggcccggggggacccggggtcccgagtgcaccctcctgccctgcagactgtcccagcgccggggccagggggcgcaggacctcgcgcacgcccggcacggacgcatctttgtcttccctctcttcacggcgcgcgatctagccgggaatcgttttccggccccagtgtgcccggcgcgggtgaggcggaagcggccggggcgggggcgcaggcccggcagccgcaggccggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccaggtaagctggggaacctgggctgcctgacttgccggcggcggcagcctggggccgcccggggcgccgcgaggacccggacgcgtggggggcggcgcggaggttgcggcccgagcgctccagagcgctgccctcccgactcagcgtggctgcggggcggccgccgctgggatatgggggtacagcccggcggccccactcctctctgaccggccgcttccccctcccacgacgggtgggcgggcggggcggggaccaggcggcggctctcgcatcccgcgcggggggcaccgcggcaaggggccacccggcgcggacaagaggcgctgtgtggcggggctgtccgctcgactcctgccgggctggccgggctgcttggcaccggcatcaagtccccgtgccgggcggcaactactgagtttggggtcgcctctgggttcgctgcccccagagaacccaagcccagatcttcgcccccttcccttt

SEQ ID NO: 110440 - DNA, 297 bp, Homo sapiens; identical to SEQ ID NO: 44216
  chr15:29133536-29133833
  Hypo

SEQ ID NO: 110441 - DNA, 166 bp, Homo sapiens; identical to SEQ ID NO: 77454
  chr15:29145324-29145490
  Hypo

SEQ ID NO: 110442 - DNA, 129 bp, Homo sapiens; identical to SEQ ID NO: 77455
  chr15:29158096-29158225
  Hypo

SEQ ID NO: 110443 - DNA, 30 bp, Homo sapiens; identical to SEQ ID NO: 44218
  chr15:29221674-29221704
  Hypo

SEQ ID NO: 110444 - DNA, 68 bp, Homo sapiens; identical to SEQ ID NO: 77457
  chr15:29223705-29223773
  Hypo

SEQ ID NO: 110445 - DNA, 52 bp, Homo sapiens; identical to SEQ ID NO: 77458
  chr15:29263052-29263104
  Hypo

SEQ ID NO: 110446 - DNA, 44 bp, Homo sapiens; identical to SEQ ID NO: 77459
  chr15:29283583-29283627
  Hypo

SEQ ID NO: 110447 - DNA, 22 bp, Homo sapiens
  chr15:29302734-29302756
  Hypo
acaggtgcgagccaccacaccc

SEQ ID NO: 110448 - DNA, 30 bp, Homo sapiens; identical to SEQ ID NO: 77461
  chr15:29389670-29389700
  Hypo

SEQ ID NO: 110449 - DNA, 35 bp, Homo sapiens; identical to SEQ ID NO: 77462
  chr15:29396552-29396587
  Hypo

SEQ ID NO: 110450 - DNA, 30 bp, Homo sapiens; identical to SEQ ID NO: 44219
  chr15:29397531-29397561
  Hypo

SEQ ID NO: 110451 - DNA, 349 bp, Homo sapiens; identical to SEQ ID NO: 77464
  chr15:29407125-29407474
  Hyper

SEQ ID NO: 110452 - DNA, 389 bp, Homo sapiens
  chr15:29407737-29408126
  Hyper
ccacccgtggaggagcgggcgggagaacggggaagaggcaggaggcggccggggcgttggaatcctttcagccctgccgaggttatggtgcctgtttccagcagctctgagcccacgcggaacatgagtcgctgataaacaaggcttgcagttgcgaggggcctcggggtgggtttctggttgaggaacgccggggaatggctgatggaggaagcccctgccgggagcaggagcagcggaaacctacatcggccacacagatcccggcgggggagggagggcaacgctcagaagcagagctgcgcgatgtgcctttctgggctgctcagcccagggcccgagacctgcttgcctgaggaggggcagatgcacggcggctgcaccccgtg

SEQ ID NO: 110453 - DNA, 23 bp, Homo sapiens
  chr15:29408816-29408839
  Hypo
caagactccgtctcaaaaaaaaa

SEQ ID NO: 110454 - DNA, 58 bp, Homo sapiens; identical to SEQ ID NO: 77468
  chr15:29409339-29409397
  Hypo

SEQ ID NO: 110455 - DNA, 30 bp, Homo sapiens; identical to SEQ ID NO: 77469
  chr15:29409660-29409690
  Hypo

SEQ ID NO: 110456 - DNA, 33 bp, Homo sapiens; identical to SEQ ID NO: 77470
  chr15:29410533-29410566
  Hypo

SEQ ID NO: 110457 - DNA, 25 bp, Homo sapiens
  chr15:29449033-29449058
  Hypo
cctcagcaggccaggcgcagtggct

SEQ ID NO: 110458 - DNA, 71 bp, Homo sapiens; identical to SEQ ID NO: 77472
  chr15:29561245-29561316
  Hyper

SEQ ID NO: 110459 - DNA, 22 bp, Homo sapiens
  chr15:29610811-29610833
  Hypo
ccacgcccggccaaattaaggt

SEQ ID NO: 110460 - DNA, 171 bp, Homo sapiens; identical to SEQ ID NO: 77474
  chr15:29721859-29722030
  Hypo

SEQ ID NO: 110461 - DNA, 524 bp, Homo sapiens; identical to SEQ ID NO: 35620
  chr15:29861915-29862439
  Hyper

SEQ ID NO: 110462 - DNA, 352 bp, Homo sapiens; identical to SEQ ID NO: 77476
  chr15:29862870-29863222
  Hyper

SEQ ID NO: 110463 - DNA, 132 bp, Homo sapiens; identical to SEQ ID NO: 77477
  chr15:29863519-29863651
  Hyper

SEQ ID NO: 110464 - DNA, 118 bp, Homo sapiens; identical to SEQ ID NO: 77478
  chr15:30113866-30113984
  Hyper

SEQ ID NO: 110465 - DNA, 30 bp, Homo sapiens; identical to SEQ ID NO: 77479
  chr15:30114780-30114810
  Hyper

SEQ ID NO: 110466 - DNA, 860 bp, Homo sapiens; identical to SEQ ID NO: 77480
  chr15:30260547-30261407
  Hyper

SEQ ID NO: 110467 - DNA, 43 bp, Homo sapiens; identical to SEQ ID NO: 77481
  chr15:31083763-31083806
  Hypo

SEQ ID NO: 110468 - DNA, 60 bp, Homo sapiens; identical to SEQ ID NO: 77482
  chr15:31121966-31122026
  Hypo

SEQ ID NO: 110469 - DNA, 30 bp, Homo sapiens; identical to SEQ ID NO: 77483
  chr15:31126524-31126554
  Hypo

SEQ ID NO: 110470 - DNA, 30 bp, Homo sapiens; identical to SEQ ID NO: 44225
  chr15:31221190-31221220
  Hypo

SEQ ID NO: 110471 - DNA, 167 bp, Homo sapiens; identical to SEQ ID NO: 44226
  chr15:31377678-31377845
  Hypo

SEQ ID NO: 110472 - DNA, 112 bp, Homo sapiens; identical to SEQ ID NO: 77486
  chr15:31455390-31455502
  Hypo

SEQ ID NO: 110473 - DNA, 30 bp, Homo sapiens; identical to SEQ ID NO: 44227
  chr15:31509535-31509565
  Hypo

SEQ ID NO: 110474 - DNA, 30 bp, Homo sapiens; identical to SEQ ID NO: 44228
  chr15:31539632-31539662
  Hypo

SEQ ID NO: 110475 - DNA, 33 bp, Homo sapiens; identical to SEQ ID NO: 77489
  chr15:31564940-31564973
  Hypo

SEQ ID NO: 110476 - DNA, 30 bp, Homo sapiens; identical to SEQ ID NO: 77490
  chr15:31566708-31566738
  Hypo

SEQ ID NO: 110477 - DNA, 30 bp, Homo sapiens; identical to SEQ ID NO: 77491
  chr15:31597382-31597412
  Hypo

SEQ ID NO: 110478 - DNA, 159 bp, Homo sapiens; identical to SEQ ID NO: 77492
  chr15:31599458-31599617
  Hypo

SEQ ID NO: 110479 - DNA, 30 bp, Homo sapiens; identical to SEQ ID NO: 77493
  chr15:31601868-31601898
  Hypo

SEQ ID NO: 110480 - DNA, 56 bp, Homo sapiens; identical to SEQ ID NO: 44229
  chr15:31603992-31604048
  Hypo

SEQ ID NO: 110481 - DNA, 30 bp, Homo sapiens; identical to SEQ ID NO: 77495
  chr15:31668057-31668087
  Hypo

SEQ ID NO: 110482 - DNA, 30 bp, Homo sapiens; identical to SEQ ID NO: 77496
  chr15:31669119-31669149
  Hypo

SEQ ID NO: 110483 - DNA, 142 bp, Homo sapiens; identical to SEQ ID NO: 77497
  chr15:31727629-31727771
  Hyper

SEQ ID NO: 110484 - DNA, 937 bp, Homo sapiens
  chr15:31775237-31776174
  Hyper
gagtttccacaggtacgaggcagatgctaggctagcacacccacttccaacagtatgacttgtttcctatccgtctactacctgagtggcgtcagtgtaggttcaggcaccattaggaacgtttgaccaaacacgtacacggcactgacagaggaggcgccggccttccggtggaccagggcatgtaaaaaagacaccgacacaatggaaaagaaatcctcgaaggtagaacctcgccgcccgcgccgcgccgcgccgctcagggccgggccccgcgcgcctcgcgccgccgccgcagctcctcgcggtagcagtaggagcagtagtgctcggtctcggcgcgcccgtagaacgcacagttctcgcgctggcagcgccgctgcaccggccccgggccgccacggccgcactcaccgttcgagcgcgcggtcggcgcgtcggcgtcggcgaactccaggccgtcgcgcagggcgccgaagccgttggtgtaggtctgcgacttgtgctcggccgcccccgccgtccccgccgcgcccggtagggccccgggcaccgcgcgcgccagcgactcgaccgtgttgacggtgcgcagggcggcggcgcgcgccgggctgtagctctgcgacgacagcgagcggttctgctgcgggtacgtggcgcacggccgcagcgcccccacggccggcgcgcacgcctcgtcccgcgcgcccgacgcctgcacgtggatgacgctctggcgcgctggcgccggggggctgcggccaggcactggtccgctggcgctcgcacgccgcgcgcctccccccggggaggccgtgccgcccgccgccgcccgcgccgcacgccctgccgcgggcccggggctcggccgctccttgagcttgagcaccagctgcgtgggtgggcccggagaggcgcgctccgggaccggcacgcc

SEQ ID NO: 110485 - DNA, 107 bp, Homo sapiens; identical to SEQ ID NO: 77502
  chr15:31778235-31778342
  Hypo

SEQ ID NO: 110486 - DNA, 41 bp, Homo sapiens; identical to SEQ ID NO: 77503
  chr15:31813319-31813360
  Hypo

SEQ ID NO: 110487 - DNA, 70 bp, Homo sapiens; identical to SEQ ID NO: 77504
  chr15:31830234-31830304
  Hypo

SEQ ID NO: 110488 - DNA, 30 bp, Homo sapiens; identical to SEQ ID NO: 77505
  chr15:31862270-31862300
  Hypo

SEQ ID NO: 110489 - DNA, 196 bp, Homo sapiens; identical to SEQ ID NO: 77506
  chr15:31897790-31897986
  Hypo

SEQ ID NO: 110490 - DNA, 30 bp, Homo sapiens; identical to SEQ ID NO: 77507
  chr15:31991592-31991622
  Hypo

SEQ ID NO: 110491 - DNA, 67 bp, Homo sapiens; identical to SEQ ID NO: 35629
  chr15:32162215-32162282
  Hyper

SEQ ID NO: 110492 - DNA, 32 bp, Homo sapiens; identical to SEQ ID NO: 77509
  chr15:32162491-32162523
  Hyper

SEQ ID NO: 110493 - DNA, 407 bp, Homo sapiens; identical to SEQ ID NO: 77510
  chr15:32322366-32322773
  Hyper

SEQ ID NO: 110494 - DNA, 17 bp, Homo sapiens
  chr15:32934467-32934484
  Hypo
tagaaggagggtttgcg

SEQ ID NO: 110495 - DNA, 2080 bp, Homo sapiens
  chr15:33009591-33011671
  Hyper
acaggctcctgctggcggccagcgagcccgccaggttaacgggggcgccggggtcagcgccctcgaagttgggggcctcgggcggggccgccggggagccacgacggccgctcgaccagagcatcccgcagtcccgttccctccagaggggaagaatggccgaatctggcacgatcccacggagatctcgctcttcccagcgcagtctccgctactgagcgcgggaccaacgcaggcgatgccgggcggccgacagggaaagcccagacctggggcagagaaggaatgaggggccgccagccggggggatttcctcccgctcttccctctccaacgggagcggaaaatgtgatttgctgtgcattccaggcgcggttccctggggtgacctctcccagccggcccgggcggggggagcagacaaagaggcgaggcgggcggagaggggaccccgcggggaagcaggaggggtgcggggggcgggggcagtaccgggaaagggggcggatagcgggtctggcggcggcggcggcgcctggccaatggagaggcgcggccccgggcgccgcgctctgccgccggcatttaaacgggagacggcgcgatgcctggcactcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacaggtgagcgcggacgcacccggcagggatgtgagtgggcggagggaagagggccgcaaaccaacccaggacccgctcagttccacgcgcggcagccctccgtgcgcgcaggctcgggtgcgttgttcgcgggggtgaattgtgaagaaccatcgcggggtccttcctgctgaggccgcggacaccgtgacctcgctgctctgggtctgcagggaaacgtaggaaaaaaagttgtcaggagcgggcaggatgacccccacatcccgtttccacctcccggaggcccccgaacacgctcctggtgctggtggcagcagcgcctggcagacgcgcccgcttagcgagggcgcgaagtccaggccgccagagcgcaggagcatccggacctgctagtcggccgctgactgcgcggcgagttgccttgagagggtcccatgtgcttggggcgccgcgctgggtctgggggcgtcttggggcgcccattggagtccgcgggttggagcatccggagaatccatgatgtgtgcatttgccgatccccgaggtgagatggagactggcaagggcagagccgctgtgttcagccacagcggaaaaccgaacggtgggtaatccgacagctgcggtgcggggcgcggccctggccgcggggtccagcgaacccgcagtgctcacaaggcagacaccacacgcgctcgcggaccggccacgcactcgcgggcgctcgcttctctactccagcctcttccccgccccgcgcacgcccgggctgaatggtagacgttctggcgccgggcagcggccaccggctggttcccacttccgcgcgcaccccttaaactgtgttctagaggccccagcctcgccttgcagcgcctcactagctcctgaggactagggactggcggctgaggcgggttggcggctgcaacgagctgggcgtctttcgttctctctcgctgcctggctggctccgctggcccctccacagcttgcggagcaaggccatagcaggggagtgggaggtatattggggctgtcacctccttgctggccggagttatttgtagactacagactccggaagaacagacgcgccaccgctctcgcttggcattgccttcggatcgcagctcctccttgggggtgccccagcttggcgtttatttgcctgcgccaggctctggcgacggtcaccgggccaggcggggagggacggacggcaggtgaccagcctctgctgtgaagaaattcctgcgcgcccggagctgtccctaatgcattcccgggtcgaatccgtctactgccttcc

SEQ ID NO: 110496 - DNA, 77 bp, Homo sapiens; identical to SEQ ID NO: 77517
  chr15:33438087-33438164
  Hypo

SEQ ID NO: 110497 - DNA, 16 bp, Homo sapiens
  chr15:33438284-33438300
  Hypo
tcgggcttcagcctcc

SEQ ID NO: 110498 - DNA, 223 bp, Homo sapiens; identical to SEQ ID NO: 77519
  chr15:33486950-33487173
  Hyper

SEQ ID NO: 110499 - DNA, 97 bp, Homo sapiens; identical to SEQ ID NO: 77520
  chr15:33541637-33541734
  Hypo

SEQ ID NO: 110500 - DNA, 1069 bp, Homo sapiens
  chr15:33602706-33603775
  Hyper
gcaaagcgggcaaagcgagcaaagcgagagggttggtacccagtctgggcgcgctggagctaagcaactggcctttgtttgtgaattggagcagtttaggggacatcctccggtcgccgcggggcgcgcgcctccgctgagtgtgcggtgcggtacccagcggtgcgggggaggctccaccgcgccagcccagggcccccgcaccgcccccgccagctcgacgcgcccagcgttgcgctctccacggagcgggcggccgcagcgcacttggctggggcgagaggcgagaggggtgggcggactgcttggttggcgttggcgctctgcagtgcagtggagtgttagcccagctccctatatggtcggggattagcttggcgctgctgaggctgaggctgagccaggagctggaggaggaggtggaggacgaggacgaaaaggaggaggagaaagagcgcagcagcagtcagcgcacgccgagcggctgccgggggaagcagaggcgccggaggctggggcaccgccgacgcctcgggagccatggccgaagggggagaaggaggcgaggacgagatccagtttctgaggactgtgagtctccgcggcgggggcgaggccgtgggcaggtggggaggagcgcggagcgcggcgaggaggggctggctgcgctgcgccgcggtgccgggtgcccggtgccgggcgctttctccgcacccgcgggctgcagaggcggaccggccacctacccgcggggccgcgaggggctgcgtgggaaggggcaccatctcctgcctctcccttgttcccctaccgccacccctgccccaggccctccacctaggaccgctcgctctccaggcaacttgctacttggtctgaaacccttgatgcccaaacttcagccggggtttgttcgcggttgtcctgacccataagatcggcgttggaagccctcgccccggggtcggccctctgacacctccatactccaccccagccccattcctcttccagggcgcccccacgcacaggggaacctccgggaaggagccagcggggcaggggggag

SEQ ID NO: 110501 - DNA, 37 bp, Homo sapiens; identical to SEQ ID NO: 77523
  chr15:33628963-33629000
  Hypo

SEQ ID NO: 110502 - DNA, 25 bp, Homo sapiens
  chr15:33632111-33632136
  Hypo
ttaccttagtcgtggaacaccaaag

SEQ ID NO: 110503 - DNA, 17 bp, Homo sapiens
  chr15:33633532-33633549
  Hypo
cccggtctgattcagtg

SEQ ID NO: 110504 - DNA, 30 bp, Homo sapiens; identical to SEQ ID NO: 44235
  chr15:33727786-33727816
  Hypo

SEQ ID NO: 110505 - DNA, 30 bp, Homo sapiens; identical to SEQ ID NO: 44236
  chr15:33746640-33746670
  Hypo

SEQ ID NO: 110506 - DNA, 45 bp, Homo sapiens; identical to SEQ ID NO: 77528
  chr15:33879242-33879287
  Hypo

SEQ ID NO: 110507 - DNA, 30 bp, Homo sapiens; identical to SEQ ID NO: 77529
  chr15:33952401-33952431
  Hypo

SEQ ID NO: 110508 - DNA, 229 bp, Homo sapiens; identical to SEQ ID NO: 77530
  chr15:33954397-33954626
  Hypo

SEQ ID NO: 110509 - DNA, 80 bp, Homo sapiens; identical to SEQ ID NO: 77531
  chr15:34014994-34015074
  Hypo

SEQ ID NO: 110510 - DNA, 30 bp, Homo sapiens; identical to SEQ ID NO: 77532
  chr15:34067983-34068013
  Hypo

SEQ ID NO: 110511 - DNA, 30 bp, Homo sapiens; identical to SEQ ID NO: 77533
  chr15:34124561-34124591
  Hypo

SEQ ID NO: 110512 - DNA, 19 bp, Homo sapiens
  chr15:34208027-34208046
  Hypo
actccgtgctgttggagaa

SEQ ID NO: 110513 - DNA, 31 bp, Homo sapiens; identical to SEQ ID NO: 77535
  chr15:34339559-34339590
  Hypo

SEQ ID NO: 110514 - DNA, 30 bp, Homo sapiens; identical to SEQ ID NO: 77536
  chr15:34353236-34353266
  Hypo

SEQ ID NO: 110515 - DNA, 61 bp, Homo sapiens; identical to SEQ ID NO: 77537
  chr15:34394495-34394556
  Hyper

SEQ ID NO: 110516 - DNA, 29 bp, Homo sapiens
  chr15:34630420-34630449
  Hyper
agcatcctagagggcgggcgctgctcctc

SEQ ID NO: 110517 - DNA, 267 bp, Homo sapiens; identical to SEQ ID NO: 77538
  chr15:34634214-34634481
  Hypo

SEQ ID NO: 110518 - DNA, 30 bp, Homo sapiens; identical to SEQ ID NO: 77539
  chr15:34726887-34726917
  Hypo

SEQ ID NO: 110519 - DNA, 812 bp, Homo sapiens; identical to SEQ ID NO: 77540
  chr15:34728824-34729636
  Hyper

SEQ ID NO: 110520 - DNA, 99 bp, Homo sapiens; identical to SEQ ID NO: 77541
  chr15:34729944-34730043
  Hyper

SEQ ID NO: 110521 - DNA, 1024 bp, Homo sapiens
  chr15:34786477-34787501
  Hyper
gaaatgattttaaaacgttttggtggagcgctgcgggaggtgcgtgcgcgccccggccgccgaacaaaggagcaggggcgccgccgcggggacccgccacccacctcccggggccgcgccgcggcctcccgtccaccgccaccatgaccgccaacggcacagccgaggcggtgcagatccggttcggcctcatcaactgcggcaacaagtacctgagggcggaggcgttcgggttcaaggttaacgcgtcggccagcagcctgaagaagcagcagatctggacgctggagcagccccctgactaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcaccggcgctccttcggcggcacggaggaccgcctgtcgtgcttcgcgcagacggtgtcccccgccgagaagtggagcgtgcacatcgccatgcaccctcaggtcaacatctaccgcgtcacccctaagcgctaggcgcacctgagcgcgccgccggccgacgagatcgcagtggaccgcgacgtgccctggggcgtcgactcgctcgtcaccctcgccttccaggagcagcgctacagcgtgcagaccgcggaccaccgcttcctgcgccatgacaggcgcctggtggcgcgccccgagccggccactggctacacgctgcagttccgctccggcaatgtggccttccgcgactgcgagggccgttacctggcgccgtcggggcccagcggcacgctcaaggcgggcaaggccaccaaggtgggcaaggacgagctctttgccctggagcagagctgcgcccaggtcgtgctgcaggcggccaacgggaggaatgtgtccacgcgccagggtatggacctgtctgccaatccggacgaggagaccgaccaggagacctt

SEQ ID NO: 110522 - DNA, 154 bp, Homo sapiens
  chr15:34806487-34806641
  Hyper
ccccgcctgggctcaaaaaacgccggagccgccctgcaccgccctgtcgcggtctccggagcaggctggccgactgagggcgaccatgggtcccaagaaggctccggcagtcgcgggctcccacctcggggcgcggcgacgggggcctagaggg

SEQ ID NO: 110523 - DNA, 513 bp, Homo sapiens; identical to SEQ ID NO: 77545
  chr15:34806875-34807388
  Hyper

SEQ ID NO: 110524 - DNA, 42 bp, Homo sapiens; identical to SEQ ID NO: 77546
  chr15:34876396-34876438
  Hyper

SEQ ID NO: 110525 - DNA, 36 bp, Homo sapiens; identical to SEQ ID NO: 44238
  chr15:34879893-34879929
  Hypo

SEQ ID NO: 110526 - DNA, 30 bp, Homo sapiens; identical to SEQ ID NO: 77548
  chr15:34911483-34911513
  Hypo

SEQ ID NO: 110527 - DNA, 30 bp, Homo sapiens; identical to SEQ ID NO: 77549
  chr15:34915716-34915746
  Hypo

SEQ ID NO: 110528 - DNA, 136 bp, Homo sapiens
  chr15:35014151-35014287
  Hyper
ccagcactcggcgggcgcaggctgagctggtgacccgggcaggaccggagccaaaggattaatccatcacaatgagacgttctattctgggcaggcggcgcgagcagatgctgggcgccggcggaggcagcgtgca

SEQ ID NO: 110529 - DNA, 921 bp, Homo sapiens
  chr15:35046870-35047791
  Hyper
ggaaagaaatccaagcgcgtcccgaccgatggggcagttggcgcggtctagagagagggcacgaacctcgggcgccgtccggggttcgggtctggatcccgcggacgccgggacgaggggcggggcggggtggcagcctgcaggtcctccagcgctcgcccgcccaggagaagtctcagcgccgctctccgccgcaggttgggggccaggggagggtccgaacaccggctctgttcctgctacttcagcgggcacctggcgctccggcgcggcagcctgcgaggccagggccgagcgcgcggagccgaatgctgggctcggggatccgcggccgccgcctctaatccgcccttaagtagtctccgcctgcgtcacgccaggtcggcggaggggagcagagcgcgccgtgcggctgtcgctgcgcgtcggagcccgaggggccggggacgcgcgcggggggagaggggcaagagtcctggaggcccggcggggagcggggcgatttcgaaaggaaggactgcagcgcccctcggggcttctcggggagcccaggtaacctcacctgaccgccagacccaagcaggcggagggggagccgggagcggacgcgtgggtgagtggggaggggagtgagtaggtatcttctcttctctcggtgcatccctcaccttttcgctttttgcctcctggagacaactgaaattccttccctagatggagatgctggctgagggagggcgagtgggggcgaccacttttaaatctcccttaggggacagagtggctgagagtgcttctgcagagtggctgcggttcggtgcctctgtggatccgacagtgaagtgagaaaggcttgatgggaatccatttaggctgaagggtaaatgcaggtgtggagctgtctctcggtataggggtcag

SEQ ID NO: 110530 - DNA, 30 bp, Homo sapiens; identical to SEQ ID NO: 77554
  chr15:35084827-35084857
  Hypo

SEQ ID NO: 110531 - DNA, 192 bp, Homo sapiens; identical to SEQ ID NO: 77555
  chr15:35087595-35087787
  Hyper

SEQ ID NO: 110532 - DNA, 17 bp, Homo sapiens
  chr15:35262895-35262912
  Hypo
agcgagactagcctcaa

SEQ ID NO: 110533 - DNA, 120 bp, Homo sapiens; identical to SEQ ID NO: 77557
  chr15:35310610-35310730
  Hypo

SEQ ID NO: 110534 - DNA, 39 bp, Homo sapiens; identical to SEQ ID NO: 77558
  chr15:35970597-35970636
  Hypo

SEQ ID NO: 110535 - DNA, 258 bp, Homo sapiens; identical to SEQ ID NO: 77559
  chr15:37175038-37175296
  Hyper

SEQ ID NO: 110536 - DNA, 35 bp, Homo sapiens; identical to SEQ ID NO: 77560
  chr15:37180103-37180138
  Hyper

SEQ ID NO: 110537 - DNA, 291 bp, Homo sapiens; identical to SEQ ID NO: 1200
  chr15:37180507-37180798
  Hyper

SEQ ID NO: 110538 - DNA, 337 bp, Homo sapiens; identical to SEQ ID NO: 77562
  chr15:37394400-37394737
  Hyper

SEQ ID NO: 110539 - DNA, 42 bp, Homo sapiens
  chr15:37399219-37399261
  Hyper
tttaggtcagaaggccgagtctcagtgcgagattgaggaagg

SEQ ID NO: 110540 - DNA, 339 bp, Homo sapiens
  chr15:37402997-37403336
  Hyper
aactcaatctcagggcggggtgtgagagctgggggtgagctggctcgggccgggacagaggtctctctgcgtacgccccgctccgcccggcgccaagggaagccgctgtctcttccgtcgagttctgagaccttggcaaacttccctcccccaaccgccggcgtgacttctgagttgtcactaatccgaacctgatattcaccagagctccttcggtcaccgacaacgctccccgctgctgccgcggcctcccgcccgccctcctcggcgtgttttcatttctaagtctacgggcagggattgccccgacccagtgtgtgtgtgcgtgtgtgtgtgtgc

SEQ ID NO: 110541 - DNA, 163 bp, Homo sapiens; identical to SEQ ID NO: 44239
  chr15:38218484-38218647
  Hypo

SEQ ID NO: 110542 - DNA, 30 bp, Homo sapiens; identical to SEQ ID NO: 77566
  chr15:38330892-38330922
  Hypo

SEQ ID NO: 110543 - DNA, 178 bp, Homo sapiens; identical to SEQ ID NO: 77567
  chr15:39110605-39110783
  Hypo

SEQ ID NO: 110544 - DNA, 30 bp, Homo sapiens; identical to SEQ ID NO: 77568
  chr15:39416451-39416481
  Hypo

SEQ ID NO: 110545 - DNA, 378 bp, Homo sapiens
  chr15:39873123-39873501
  Hyper
ctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggtaagtcgcccccggcggccgccgaggaccaaagctgcccgggacatccacctggagcgctgaggcttcagt

SEQ ID NO: 110546 - DNA, 691 bp, Homo sapiens; identical to SEQ ID NO: 77571
  chr15:40211553-40212244
  Hyper

SEQ ID NO: 110547 - DNA, 353 bp, Homo sapiens; identical to SEQ ID NO: 77572
  chr15:40212601-40212954
  Hyper

SEQ ID NO: 110548 - DNA, 17 bp, Homo sapiens
  chr15:40228636-40228653
  Hypo
ggagtttctctctgtcg

SEQ ID NO: 110549 - DNA, 47 bp, Homo sapiens; identical to SEQ ID NO: 77574
  chr15:40368182-40368229
  Hypo

SEQ ID NO: 110550 - DNA, 30 bp, Homo sapiens; identical to SEQ ID NO: 77575
  chr15:40420189-40420219
  Hypo

SEQ ID NO: 110551 - DNA, 84 bp, Homo sapiens; identical to SEQ ID NO: 77576
  chr15:40420940-40421024
  Hypo

SEQ ID NO: 110552 - DNA, 101 bp, Homo sapiens; identical to SEQ ID NO: 77577
  chr15:40423345-40423446
  Hypo

SEQ ID NO: 110553 - DNA, 189 bp, Homo sapiens; identical to SEQ ID NO: 77578
  chr15:40532032-40532221
  Hypo

SEQ ID NO: 110554 - DNA, 30 bp, Homo sapiens; identical to SEQ ID NO: 44244
  chr15:40532791-40532821
  Hypo

SEQ ID NO: 110555 - DNA, 779 bp, Homo sapiens; identical to SEQ ID NO: 77580
  chr15:40544663-40545442
  Hyper

SEQ ID NO: 110556 - DNA, 56 bp, Homo sapiens; identical to SEQ ID NO: 44245
  chr15:40545776-40545832
  Hypo

SEQ ID NO: 110557 - DNA, 30 bp, Homo sapiens; identical to SEQ ID NO: 44246
  chr15:40546043-40546073
  Hypo

SEQ ID NO: 110558 - DNA, 43 bp, Homo sapiens; identical to SEQ ID NO: 77583
  chr15:40574169-40574212
  Hyper

SEQ ID NO: 110559 - DNA, 308 bp, Homo sapiens; identical to SEQ ID NO: 77584
  chr15:40575513-40575821
  Hyper

SEQ ID NO: 110560 - DNA, 169 bp, Homo sapiens; identical to SEQ ID NO: 77585
  chr15:40639225-40639394
  Hypo

SEQ ID NO: 110561 - DNA, 31 bp, Homo sapiens; identical to SEQ ID NO: 77586
  chr15:40676552-40676583
  Hypo

SEQ ID NO: 110562 - DNA, 59 bp, Homo sapiens
  chr15:40729159-40729218
  Hyper
ggcagactgcaaagacgtcccctggccggcaatctggaggctagcgctgggcagatggg

SEQ ID NO: 110563 - DNA, 27 bp, Homo sapiens
  chr15:40856301-40856328
  Hypo
agccaccgcgcccggcccctaaattct

SEQ ID NO: 110564 - DNA, 30 bp, Homo sapiens; identical to SEQ ID NO: 77589
  chr15:41056770-41056800
  Hyper

SEQ ID NO: 110565 - DNA, 30 bp, Homo sapiens; identical to SEQ ID NO: 77590
  chr15:41059436-41059466
  Hypo

SEQ ID NO: 110566 - DNA, 87 bp, Homo sapiens; identical to SEQ ID NO: 77591
  chr15:41078532-41078619
  Hypo

SEQ ID NO: 110567 - DNA, 30 bp, Homo sapiens; identical to SEQ ID NO: 71306
  chr15:41091139-41091169
  Hypo

SEQ ID NO: 110568 - DNA, 30 bp, Homo sapiens; identical to SEQ ID NO: 77593
  chr15:41137117-41137147
  Hyper

SEQ ID NO: 110569 - DNA, 30 bp, Homo sapiens; identical to SEQ ID NO: 77594
  chr15:41158108-41158138
  Hypo

SEQ ID NO: 110570 - DNA, 93 bp, Homo sapiens; identical to SEQ ID NO: 77595
  chr15:41164710-41164803
  Hypo

SEQ ID NO: 110571 - DNA, 412 bp, Homo sapiens; identical to SEQ ID NO: 77596
  chr15:41165245-41165657
  Hypo

SEQ ID NO: 110572 - DNA, 58 bp, Homo sapiens; identical to SEQ ID NO: 77597
  chr15:41291802-41291860
  Hypo

SEQ ID NO: 110573 - DNA, 30 bp, Homo sapiens; identical to SEQ ID NO: 77598
  chr15:41409360-41409390
  Hypo

SEQ ID NO: 110574 - DNA, 45 bp, Homo sapiens; identical to SEQ ID NO: 77599
  chr15:41456235-41456280
  Hypo

SEQ ID NO: 110575 - DNA, 36 bp, Homo sapiens; identical to SEQ ID NO: 77600
  chr15:41495761-41495797
  Hypo

SEQ ID NO: 110576 - DNA, 1060 bp, Homo sapiens
  chr15:41786804-41787864
  Hyper
gctccgccggcgggtcgtggcgctggccctggggcgtctaagaagcggggcgaggagcaggcgacccgccgcggggactgggcgaagcgggggtagcggaccttgttggctgtgggttaggacaggagggatcggaggggctgagccttgccgggtgaaccctcggaaggagagaggcgaaggagagtttcccttaccccccgccccctctccggtgccgcggccgcacccccgccgttgccacggtttccctctcctgagtgggagtggagcggcgctccaggctctgctcgggagccgctgccgtctgctcccagcgcccgcacgaggcgtggacgcaggggagggaggggcgtgggcctgggagctctggctgggagcggaacgcagcccacccagtgcgcgccctgcctcccatcttcccggctcgccgctcctgagcgcggcagagaggggcggtaaactgaggctgcaagggggcaggatcactctgctagtctctgcctctgatagcctgggtgttctgggaccaggtctgaccctcggaaaacacagccctgggcactgttaagtcattcctgacgcccgccacttagggatgtgcggctcccgggacaccctccttgttcccctcgttttaaccaaggccaaataccttgaataactgtccgtggtcagcgcgaaggactttctttagatccacgtttcgcaagtgtccctgaggccgaggaagaggcgaggggcgcccccggcctcgggcgtctggggcctgcccataagtccgggtcggcgcggcggggcggggagagctgtggccgcgcgcctgctccgccgcacaatcggctgggacaaggcagggaagctgtggcgacctgcaggggttcacaagcccggaggccgatggggtttgtcagtgacaccagaggggaaaagcctcacagagcaggaacaccccccgccgccaggtgctgggtgcgccggctcggtcactagcctgccgcttccccttcttccccggtggtcagagcagccccggacccaggatcgtttctggggtaac

SEQ ID NO: 110577 - DNA, 74 bp, Homo sapiens
  chr15:41788152-41788226
  Hyper
cctcggggacctgggcgaccccgccgccctccgagccgtcgggagccggtgcaaatcgccgctgagggcccttc

SEQ ID NO: 110578 - DNA, 1221 bp, Homo sapiens; identical to SEQ ID NO: 77603
  chr15:41804641-41805862
  Hyper

SEQ ID NO: 110579 - DNA, 30 bp, Homo sapiens; identical to SEQ ID NO: 77604
  chr15:41806074-41806104
  Hyper

SEQ ID NO: 110580 - DNA, 95 bp, Homo sapiens; identical to SEQ ID NO: 77605
  chr15:41835731-41835826
  Hypo

SEQ ID NO: 110581 - DNA, 103 bp, Homo sapiens; identical to SEQ ID NO: 77606
  chr15:41877608-41877711
  Hyper

SEQ ID NO: 110582 - DNA, 30 bp, Homo sapiens; identical to SEQ ID NO: 44250
  chr15:41878349-41878379
  Hypo

SEQ ID NO: 110583 - DNA, 45 bp, Homo sapiens; identical to SEQ ID NO: 35664
  chr15:41913327-41913372
  Hyper

SEQ ID NO: 110584 - DNA, 224 bp, Homo sapiens; identical to SEQ ID NO: 77609
  chr15:41913733-41913957
  Hyper

SEQ ID NO: 110585 - DNA, 73 bp, Homo sapiens; identical to SEQ ID NO: 77610
  chr15:41914167-41914240
  Hyper

SEQ ID NO: 110586 - DNA, 973 bp, Homo sapiens; identical to SEQ ID NO: 77611
  chr15:41952201-41953174
  Hyper

SEQ ID NO: 110587 - DNA, 62 bp, Homo sapiens; identical to SEQ ID NO: 77612
  chr15:41954254-41954316
  Hyper

SEQ ID NO: 110588 - DNA, 49 bp, Homo sapiens; identical to SEQ ID NO: 77613
  chr15:42151201-42151250
  Hypo

SEQ ID NO: 110589 - DNA, 30 bp, Homo sapiens; identical to SEQ ID NO: 77614
  chr15:42159399-42159429
  Hypo

SEQ ID NO: 110590 - DNA, 77 bp, Homo sapiens; identical to SEQ ID NO: 77615
  chr15:42448018-42448095
  Hypo

SEQ ID NO: 110591 - DNA, 91 bp, Homo sapiens; identical to SEQ ID NO: 77616
  chr15:42562561-42562652
  Hypo

SEQ ID NO: 110592 - DNA, 399 bp, Homo sapiens; identical to SEQ ID NO: 77617
  chr15:42684673-42685072
  Hypo

SEQ ID NO: 110593 - DNA, 41 bp, Homo sapiens; identical to SEQ ID NO: 77618
  chr15:42748507-42748548
  Hypo

SEQ ID NO: 110594 - DNA, 40 bp, Homo sapiens; identical to SEQ ID NO: 44254
  chr15:42784374-42784414
  Hypo

SEQ ID NO: 110595 - DNA, 79 bp, Homo sapiens; identical to SEQ ID NO: 77620
  chr15:42868395-42868474
  Hyper

SEQ ID NO: 110596 - DNA, 141 bp, Homo sapiens; identical to SEQ ID NO: 44255
  chr15:43020219-43020360
  Hypo

SEQ ID NO: 110597 - DNA, 30 bp, Homo sapiens; identical to SEQ ID NO: 77622
  chr15:43213577-43213607
  Hyper

SEQ ID NO: 110598 - DNA, 198 bp, Homo sapiens; identical to SEQ ID NO: 77623
  chr15:43467727-43467925
  Hypo

SEQ ID NO: 110599 - DNA, 30 bp, Homo sapiens; identical to SEQ ID NO: 77624
  chr15:43502442-43502472
  Hypo

SEQ ID NO: 110600 - DNA, 30 bp, Homo sapiens; identical to SEQ ID NO: 77625
  chr15:43508293-43508323
  Hypo

SEQ ID NO: 110601 - DNA, 16 bp, Homo sapiens
  chr15:43511842-43511858
  Hypo
acagaataaaaagaac

SEQ ID NO: 110602 - DNA, 30 bp, Homo sapiens; identical to SEQ ID NO: 77627
  chr15:43519643-43519673
  Hypo

SEQ ID NO: 110603 - DNA, 30 bp, Homo sapiens; identical to SEQ ID NO: 77628
  chr15:43527822-43527852
  Hypo

SEQ ID NO: 110604 - DNA, 35 bp, Homo sapiens; identical to SEQ ID NO: 77629
  chr15:43622105-43622140
  Hyper

SEQ ID NO: 110605 - DNA, 101 bp, Homo sapiens; identical to SEQ ID NO: 77630
  chr15:43661891-43661992
  Hypo

SEQ ID NO: 110606 - DNA, 342 bp, Homo sapiens; identical to SEQ ID NO: 77631
  chr15:43810570-43810912
  Hyper

SEQ ID NO: 110607 - DNA, 160 bp, Homo sapiens; identical to SEQ ID NO: 44258
  chr15:44037474-44037634
  Hypo

SEQ ID NO: 110608 - DNA, 23 bp, Homo sapiens
  chr15:44090533-44090556
  Hypo
actgcacccggccattactcctc

SEQ ID NO: 110609 - DNA, 274 bp, Homo sapiens; identical to SEQ ID NO: 77634
  chr15:44092138-44092412
  Hypo

SEQ ID NO: 110610 - DNA, 208 bp, Homo sapiens; identical to SEQ ID NO: 77635
  chr15:44115848-44116056
  Hypo

SEQ ID NO: 110611 - DNA, 170 bp, Homo sapiens; identical to SEQ ID NO: 35669
  chr15:44486726-44486896
  Hyper

SEQ ID NO: 110612 - DNA, 24 bp, Homo sapiens
  chr15:44827765-44827789
  Hypo
tttttttttttgagacgggtctaa

SEQ ID NO: 110613 - DNA, 27 bp, Homo sapiens
  chr15:45046196-45046223
  Hypo
agccgcagtgcccggctgcttcaaaca

SEQ ID NO: 110614 - DNA, 30 bp, Homo sapiens; identical to SEQ ID NO: 77639
  chr15:45389393-45389423
  Hypo

SEQ ID NO: 110615 - DNA, 597 bp, Homo sapiens
  chr15:45403593-45404190
  Hyper
ggggcccgttctgcccggtggcggggtcgggcgccgcccacatgagcagggggttctgcgagtctcgggggaaagcggggtcgggccccgacgccagctgtccccccgagaagctccgcagcgcgtcgctccaggagtgcgaggagccatagatggcgctgccgtccagccagcccgtcacctggttggcctgcggggcacgcggcgggtgagcccgggtcgagaggcggcggcgggccagggaaggccggggcccggcgggtgtccgcggctggggagtgggcgcctctcccctccaggccctgccaggcccgaagcccaggccccacctggctggggtgcggtcccttcccgccgccttccccgcctcaccaggtcccgggggttgctgggactccgtccggtctcggggtcccagcggctcctctggaagggcagcaccacgtccccgcgctggtcggggtcgaacacggggtctccaggtgggatgcggatgttgaggaactcggcggggcaaccgggcgtttccacgctcaccacgtcggaaagaacatggtagcctgcgggcatggggcgccaatacgtgacaaaccgtcc

SEQ ID NO: 110616 - DNA, 249 bp, Homo sapiens; identical to SEQ ID NO: 77643
  chr15:45404917-45405166
  Hyper

SEQ ID NO: 110617 - DNA, 139 bp, Homo sapiens; identical to SEQ ID NO: 77644
  chr15:45405416-45405555
  Hyper

SEQ ID NO: 110618 - DNA, 443 bp, Homo sapiens
  chr15:45406452-45406895
  Hyper
ctgggctgggacacccgtgtggcacgtcgcccacgctgctataaaaggggtcccgcgcgacttccaaactcagcgccaacccgcagaaccaggaaagtaacggctacagacagtgagaaatagtttcgctcgccggctagaaaaactctgtcggtaccaaccccagagcgttgagagcagcccacctccacgcttccttaacggagaggtgcaggactcagacttcaccagcccactcggtcccagccttgtacgcaaagagacgccaaggacgcgctctcccgcgtccaggcagccccagcttgctggcttgcctgcccgcctgcgtgcagcactcggccggcgtgcagcatgaccctgtggaacggcgtactgcctttttacccccagccccggcatgccgcaggcttcagcgttccactgctcatcgttattctagtgtt

SEQ ID NO: 110619 - DNA, 57 bp, Homo sapiens; identical to SEQ ID NO: 77647
  chr15:45409154-45409211
  Hyper

SEQ ID NO: 110620 - DNA, 578 bp, Homo sapiens
  chr15:45421268-45421846
  Hyper
ccgtggaacctcacacgaagcgcccccgggggtgtgattaaagagggaaccaggtcccgacgttctgtgaacaaacgcgcgcccttactctcagtggggctcccgtccgacccccactcctctcctaactcacgtaaggacccggctgtgaccggacaaaccgggtctggggtgcttccagtcactcttcaagtcactcccaaacttctcagactgcacccgaggctctgcggcgccgcctccctctcccggcctggtacagagaagggctgggtgcgccaggacagtagtaccggggtctgccagctccgcagaggtccctccaatcccccctcctcctctgcgcccccccacccatgcccagcaatcccagcagctccagcgcaaacctagcgacgcagttccgggtctggcggggcgcgggcgcggctcgcagggcggtgggacccccaagacctcacgaggatccccggagggagacgtgactccggggtcttagaggggtttaggtcggatgggtgacttgctttgacgcctggcctggtctgtgggtggcaggtgatcgatggccttggact

SEQ ID NO: 110621 - DNA, 524 bp, Homo sapiens
  chr15:45427335-45427859
  Hyper
aactcccggctgccccgccgagttcctcaacattcgcatcccgcccggagaccccatgttcgaccccgaccagcgcggggacgtggtgctgcccttccagagaagccgctgggaccccgagaccggacggagtcccagcaatccccgggacccggtgaggcggggaaggcggcgggaagggaccgcaccccagccaggtgggacctgggcttcgggcctggcagggcctggaggggagaggcgcccactccccagccgcggacacccgccgggccccggccttccctagctcgccgccgcccatcgacccgggctcacccgccgcgtgccccgcaggccaaccaggtgacgggctggctggacggcagcgccatctatggttcctcgcattcctggagcgacgcgctgcggagcttctccaggggacagctggcgtcggggcccgaccccgcttttccccgagactcgcagaaccccctgctcatgtgggcggcgcccgaccccgccaccgggcagaacgggcc

SEQ ID NO: 110622 - DNA, 290 bp, Homo sapiens; identical to SEQ ID NO: 77653
  chr15:45471645-45471935
  Hypo

SEQ ID NO: 110623 - DNA, 387 bp, Homo sapiens
  chr15:45479446-45479833
  Hyper
agagtttggggcttccgtctcagattagtcggttgagaatctgaacaaaggtgggtgaaggctcggaaccccggggtcaggggctcgcgtctgccagaagctgagacaccgaggggcccgggccaggccacctttgtccctctcgcagcctccagacccctgaccgccttccctcctggccatcccggcccggcgcggcactcaccctatcgctgctggcggggggtccggagatccgctcatcagcaggcggcgccgggggccccggggtctcgacccgaataaggcggtgtgggggagagccgtggcgcgggggcggcgtgggtccgggggcgacaggggtggcgagggcggcggagccggacgaccccccggagtaggggtctt

SEQ ID NO: 110624 - DNA, 30 bp, Homo sapiens; identical to SEQ ID NO: 77656
  chr15:45480705-45480735
  Hyper

SEQ ID NO: 110625 - DNA, 26 bp, Homo sapiens
  chr15:45544198-45544224
  Hypo
tctcggcctcccgaagtgctgggatt

SEQ ID NO: 110626 - DNA, 427 bp, Homo sapiens
  chr15:45670588-45671015
  Hyper
tccgatgtagtgcaccgcctcggcgccgcggctcccgccgcgcagacaccgcacccgcagcatcgccctggcccggctggtccacgcgcggaatgttcctggcctctgggccgcgtcggtccaagccttcccgagagcgcgcccggagcggggtgggcgggcgcgcggggcccgaggccttttgtagccgcgctccgccccggccgccccccgcggccccattggctgccgggaacaggtggtggggccggcgtagcgccccgaattaggaactgtcgggaagcgccgcggccgctggctcgagcctccgatgcttgcccttttttagccagcggggccactgacggcttctgttgcacgtccggacccggacccagacccgagcgtcgcaagaaggcccgttggagtctcgcgcaactgggcagga

SEQ ID NO: 110627 - DNA, 30 bp, Homo sapiens; identical to SEQ ID NO: 77660
  chr15:45742581-45742611
  Hypo

SEQ ID NO: 110628 - DNA, 154 bp, Homo sapiens
  chr15:45996505-45996659
  Hyper
gtgcaagtaatggtacgcggagagggcgcgcgaaagcgcctggctcgttcctggagcccgggctgcggacgccccctgcgtgctgcgaaacctgaggggtctcggtccttcctggccttttataggccgtgcctagaaacgcttggcttgacca

SEQ ID NO: 110629 - DNA, 797 bp, Homo sapiens
  chr15:47476715-47477512
  Hyper
ggggagctctggcggcgtccaggatgctccagcctcccggcgcgccgcggccggcgcagagacccgaccgcgaggcccgccgcccggttcccgtgcgcagcatggcccgaggcggcggcagagttgttggcactgataagacccgtcttttgtgtcttgcccgatcccggagctgtgccaggccggggggagggagcggaagccactttatggctcgtggccccacctcttgcccccaccccaaatcctccgggatttcaaaatgccgcggactcgggcgcaagtgagcgccaaacccgcaagctgggcgagttggatccgggtcggcagccggctgaaccgccacgctgccccgctttttttattttctttttagatacggcatctaattggtgggtgctgggaggcagggctggttgggtgagcacgagtacctgggtgtagggaacgacctaccttcttgctttccttggggtttagaggggaaggggtgggggcacccagagccccgaagcccggagcgtcccgcgctagcgggcttgcgcgcggccggcgagcaggcgttctctgggtgggtcccttgtctggctcattgttcgcggtgactgttcttggggccaggctgagcgacacagacaccgctcaccgggctgtaaataaaagtgacgacttggaggagtgggggtcaaggctgccgggagggaaaaggcttgcccattttagaaaccgacttggagctcggaagagcaaacgtagtcgacagagaaaaccgctcctgagtgcgaaacttagatctg

SEQ ID NO: 110630 - DNA, 35 bp, Homo sapiens; identical to SEQ ID NO: 77666
  chr15:48003206-48003241
  Hypo

SEQ ID NO: 110631 - DNA, 146 bp, Homo sapiens; identical to SEQ ID NO: 35687
  chr15:48009524-48009670
  Hyper

SEQ ID NO: 110632 - DNA, 88 bp, Homo sapiens; identical to SEQ ID NO: 77668
  chr15:48009881-48009969
  Hyper

SEQ ID NO: 110633 - DNA, 808 bp, Homo sapiens; identical to SEQ ID NO: 77669
  chr15:48010089-48010897
  Hyper

SEQ ID NO: 110634 - DNA, 232 bp, Homo sapiens; identical to SEQ ID NO: 77670
  chr15:48011225-48011457
  Hyper

SEQ ID NO: 110635 - DNA, 30 bp, Homo sapiens; identical to SEQ ID NO: 77671
  chr15:48470064-48470094
  Hyper

SEQ ID NO: 110636 - DNA, 253 bp, Homo sapiens
  chr15:48470373-48470626
  Hyper
gcaggtgcgggctgtcgccaccagtggccccgggcacctcggccttgttggcgtccgccatcccgccgccgctgcctccgcctcggccgcctgagctgaggggctccgagcgcgacaatggcggctgccggggaagcggtaacggatcccgatttgaaaaggccccgagcgctcagtaacccggatctcgcgagaaccggtcgagactgggtgactgggagatggtgtgtgccgggtgcggggggtgggagtg

SEQ ID NO: 110637 - DNA, 50 bp, Homo sapiens
  chr15:48483818-48483868
  Hyper
acgcgcgcgcgcacacgtacttcggcgggcgcccacgtcctctgtctcac

SEQ ID NO: 110638 - DNA, 30 bp, Homo sapiens; identical to SEQ ID NO: 77674
  chr15:48666415-48666445
  Hypo

SEQ ID NO: 110639 - DNA, 20 bp, Homo sapiens
  chr15:48906097-48906117
  Hypo
ctgggcgacagagtgagact

SEQ ID NO: 110640 - DNA, 87 bp, Homo sapiens; identical to SEQ ID NO: 77676
  chr15:48911244-48911331
  Hypo

SEQ ID NO: 110641 - DNA, 1864 bp, Homo sapiens
  chr15:48936726-48938590
  Hyper
gagagtcatcctgcccgttgttctggatcttgaaacttgggagacccacaccaaaggagggaaccggttcctttaccctttaagcgcgtcgtgtcctccaccgcctcttctcttggcccgactggctctggtttccttcacgttcccagcctccaaattggcgtccgccccatggctcgtgtaggacgctaaaagcacggtaaatcccagggcgatctccagcagacgccctcgacgcatgatgccgagccgccaccggctcccgccgcctcttgccgcgcccggggctcggtctgcggccgccgctgcgccctgaagcgcaccgcgccgccggggtcccgctatcccgccgcccgtcccccgggccgggctcctcccgccttctccaggcgctgctcccacttcaggcggcccctgccagctgcaacacagagacaaatccccgaggcggggagactttcagggcatcgggatgctgaagcctcgcggtccccattcccaagcccaacccgtgcgccgcctgcgcgtggcgcagttaatttgggtaagggaagaccgtttggtccacagctggctggaaagcccaggcccccggcggcagcagccccggccgatccctcggcctcccgggccccgccagaagagcgcggcgcaaagtacccatatccccagcggtcctaagccccgggcgagctctctgggtttattttttttagcggcacgaattgcgcgcgatgcgcgctctgaacgccccactcctcagcctgccctctccgccaggctggaagccagccgcgccgtccccgccgactccgggcgatgccaccgccccccgaacatctgacgcggagcccggcaccaagagccccgggccaggaagctgtcaggcaggggagggccagcgccagctgtggacgttccgggacagcccctcaccccagtccctgtccctgccctcggcgcggcgcaaacgcaaaagcctccgtggccgcagctccagccccggtggccgcccgacccccgtcgggaccccggctgcacccactggagaagcggcggctccgactcccgaggaggcggcggcggctgctcccagtcgtggccgctacagccactgctcggctccgctcgcagctgtcccagctgtggctcctgtccgcttgtggcacccacagtctctgccgcggctcccgcagccccctcctttccccacctcttcaagtatcgtccgcgcagcggtttctcgcgagagaaatactttttttaaaaaaagaaagaaaaagaaaatgacaccccctccttcgtcgccctcatcaccaccccaccccccggccccatccatcctccctttccactcccctttgccagcctccgcctcggtgcggggcctctcgctcgcaggattagcgcagtgggaggaggcagaggtgatcaggtcctgcccggcctgggactttttgtcttgaggtggggaggggagaaatgggaagaggtggagtagcggttttagcccgctctgcggctgcgaggtttagatccgagattaacctctcccgcgataggtgaagccctaccggagcagaaagctgttccacctgcaccaagaatgcgcgctggagacggttgccccggaggccctggcccgagagaaaaccagtccccgctgcccgcgcctcccggtagcgcgctccctgcgcctctcccgccggacactcagcagacgccggaggccgggaggctaagactgggcgcgtcgcaggccgggaccgcggcagaggctgctgtgccgaccgaggagagggctctgccgcccccacttgccctgggtgtcgagagcccactccagacgcggctcttctgaggc

SEQ ID NO: 110642 - DNA, 204 bp, Homo sapiens; identical to SEQ ID NO: 44264
  chr15:49182759-49182963
  Hypo

SEQ ID NO: 110643 - DNA, 78 bp, Homo sapiens; identical to SEQ ID NO: 77682
  chr15:49255775-49255853
  Hyper

SEQ ID NO: 110644 - DNA, 139 bp, Homo sapiens; identical to SEQ ID NO: 77683
  chr15:49572508-49572647
  Hypo

SEQ ID NO: 110645 - DNA, 157 bp, Homo sapiens; identical to SEQ ID NO: 77684
  chr15:50124618-50124775
  Hypo

SEQ ID NO: 110646 - DNA, 19 bp, Homo sapiens
  chr15:50716090-50716109
  Hypo
ccaccgtgcccagcctcgc

SEQ ID NO: 110647 - DNA, 102 bp, Homo sapiens; identical to SEQ ID NO: 77686
  chr15:51202472-51202574
  Hypo

SEQ ID NO: 110648 - DNA, 422 bp, Homo sapiens; identical to SEQ ID NO: 77687
  chr15:51385846-51386268
  Hyper

SEQ ID NO: 110649 - DNA, 417 bp, Homo sapiens; identical to SEQ ID NO: 77688
  chr15:51559380-51559797
  Hyper

SEQ ID NO: 110650 - DNA, 209 bp, Homo sapiens
  chr15:51633966-51634175
  Hyper
tcaacgctgcgggcacggtgttcgcgctgtgccagtggcgcgggctgagctcggcgctgcgggctttggaggcgcagcggggccgggagcagcgcgaggacagtgccctgcgctccttcctggccgagttgagccgcgcgccgcgcggggcgtccgcaccaccccaagacccggccagctcagctcgcaacaagcgcagccacagcggc

SEQ ID NO: 110651 - DNA, 320 bp, Homo sapiens; identical to SEQ ID NO: 77691
  chr15:51973774-51974094
  Hyper

SEQ ID NO: 110652 - DNA, 26 bp, Homo sapiens
  chr15:52000764-52000790
  Hypo
ctgccttgccgggcgcggaggctcac

SEQ ID NO: 110653 - DNA, 239 bp, Homo sapiens
  chr15:52404682-52404921
  Hyper
tcagcgccaccagctcgaagcggttcccggggtagccgaggtaggcggagaaaaaggaccggtgaatctgccgtaacctggcggccgcggagcgcagcacggcggcctcgggcgtggatggcgccggctcgggggtgccgggttcccgggcgcagtaccccaggtagtcggccagcaacagctcggtgcgctcccgcagcgggtcggccatggtggtgcgctcccgcaactggtcaacc

SEQ ID NO: 110654 - DNA, 41 bp, Homo sapiens; identical to SEQ ID NO: 77693
  chr15:52967811-52967852
  Hypo

SEQ ID NO: 110655 - DNA, 2833 bp, Homo sapiens
  chr15:53075403-53078236
  Hyper
tcacacccacagggacgcgaattccgattttataagcaggtgtgcacgtgcactcagatactcacacaaagccgcgtggagggacgaaaagatcaaccacccgatcgacgaggataggtttgatcttttcgattacctcagtgtgccagtgtatattcccggctgggcctagcgccctaagaaacttcggaactttagctgttaatttttgttttcttactatgacttcccaaagacattctatctgcctaccggggcgaagagaaatgggaccaggcgtcagggcggtgggaccctgtccagggtcctgactccgcgccagggctccagaccagtcggcctccgaaggccctttcacccaccccacacaagaggaaacaaagacttctcagctcaaggcctcagggctgcctcctgactccggtcagtttgcaggaagaggaaacaacaaaacaaaggaaccgccaatccgccgggtattatatccctcagctccaacctccgacttcggaccgccagggtcaccttctctacgctgaccccgcttttcttaaatgaaaacacgccaacaaaagcatacttcggatacaaaatccaagtacgcatcttttttggggaggttagagctgaggtgtacttcggaagatgagaattttgttttcatgaattgggtaacacccaggcattgttaggtaccccgacagaccctctagatatccttctcttcctccttcacactttcttcctatcaaaatagttattgttttgaaattcactagaacaacgacgttctaaaaacaaaggcgcagcaagcatccctttcttcgctgccgcgggctgaaccacggacgctcgcgggtcgcccagccccgacggcccgcagggggcgcgcgccgcagccgcagcacagcccggctacccccagaaagggagccgaatggagggaagcagggagcgcggagggctcgaggcttgcagataaggagaggcgcatcctgggatttgggtcctctgctgctacaacacaaccgtgctattgttggcactgtccgacccaagtgtcggtggtaagcggcgatgtcggggctgggtctctagcaaccgctgtgccctgggtcaggctggtcgccccagctaccgggatccctctccggatgcttccagggcgataggtgctgcacccattgacgggatagccgcatacctccgaacaggtagtggagttcgtctctggcaggcatcctagctgcgctgacaccaaggtcgccacacaatagccatcagccccccttaagccccagaagtaggtttcccctgccccagccatagcggttccagtcgtcgccacgagcccacttcttatccccaagcgcacctccctctcctcacccgggtttatgcccgttacacagagagaactacacagggggaactatggtcctacaccctcgaggggacagacaccggccgtgagacaggcaccacgcagagccttctggtgactgtccgcaggagcgagaccttttttggttttgcagtcggctaggtgtgtgtgtgtgagggtccccagttgactaccgggatgcactgccacttttcggcctggcgggctctgggactccttggtctccgtaggaggccatcctaggccttcggaggaggcgctcccagctggcggcgcccctcgccccgggctcagaggcggacacggtcggtcgcgccctgctggccctttgttcgcgccgcagcgggctgggagcagctgcgcgacaccagacccacagcgccaagacgcgaagcgcgaggaaaccgctgcgcttgactccttctcccccaactcttggacccaggaacgcttccagctcctgcgtcccacacgcccagtcctggcttctctcccggcccagaagtcttcaaggattgaagggctctgcctagggccccgcactcctgcctgactcccatggcccagaaaagcagggggacatttgaaatgtcaccccgggataaatattaacaaaaaagcaaatggacttgtgcaggggccagttatcaatcaaccaggccgcaaggccactcagggcaaacacagcccaggttgggctgggcgagactttctcatggccgccccccgaccgaacccctccccccttggctcaggtccttcttaggtcgttctggggcaaacaccggacgggaagggggcgccgccaactcccccgcggggtttggaggtttcctcgcctccaagtcccgcagggcagggtcggagtgcccaacacccacccccgcccgaacctcgggcctgcgcgccgccttcccctgggtccgcggtgctgcgcttgctgttgggtgtgtgtcgctgtctctttccgagccggcagctcctgctgtgtggccgaagccctctggaatctttaattggaaactaatcttggtcttgatagacgcccacgtcagaggcgcgccacccacccacaccccccgcctcatcccggaggagacgcggcgagaaccctgtcgctctgctctttaatggggcagcagcaagtagtacatggagggaacatatattgatttttaaaaggtagttaatttggtgggaatttcctcctgtcgcccttcttccaccagccgctgttatttcgtgaccggaaggcgcctccccaaacacagcgccacgtgcaagagggttttgaccctctgcaacaggctgccggcaactggaggacagaggggcgtggagaagccaccactctcccgctgcggagcgaaggaaccgagctcagtgagccctgacctcgcaaggtggttggaacgagactggggaggg

SEQ ID NO: 110656 - DNA, 251 bp, Homo sapiens; identical to SEQ ID NO: 35704
  chr15:53078741-53078992
  Hyper

SEQ ID NO: 110657 - DNA, 863 bp, Homo sapiens
  chr15:53079219-53080082
  Hyper
acggagcagtcaggacgaggagcagccccttcgcccactccctccggaacctcagttgctcgcgggcagcccacgggtggagatatggtgccggtagcacaagagctagagagtggaaaaccgggggccagcgattcgctggggcgcccagcgagcctcttctcccctgactggttcccgggcgcaggctgcaggaacctgcatgaggactttgcctggggcgaacgaaggcagagctgggctggaaaacctggcagggcagagtctcagccagcgcggtgctttgggaccggtggcctgcagcgcccaaacccaaagaacgctttgggtcgcttcggggcacgaatcgcaggctggtcggcacctgccacccccagcttctcattggcaggcacgagttggaggagggggctttggcctcacgctttgattttagactgtgaaacggctcagtgcccccggctcagagcggattgactgtctctcgttctccagggacgaattaatggagaacgatcagttaattaacaaaccctcattccggcttttaccttttctcttcgccaaggctcaggcctgggcgctgggctgagatggaggtggaggtggggggtgggggagtggggggggagggggcatggaccaggagtcaatcaacttggcaaccgccggccggatctcatcaaacccaggccaccctccgctgtccttagctctacctcccctcatgttctctaccctcaagggtcgccgaatcctcctgaaatccccggtggggttcgggctgggctcagctttcttctctgcctatccgcggtctcggggagccaggcgcggtgtctgcgctgcgccaaggagagctt

SEQ ID NO: 110658 - DNA, 1721 bp, Homo sapiens
  chr15:53080299-53082020
  Hyper
actgggaccttgggacggtcagcctccctctcctttccacagccaattccatgcgcagagagcgtcctaacccttacaactcgtctgtgctacacacccaccgcccaatggctctgaaactttttgcccatactcttagattgaggtcaccccagccagcgccaaaagaatgagcgcgggagggggtcacagcagccagttcggccaaacatcgacgctgctccggcacgctccagcccagcgcctgggatgtgtcagaggtacctgcgaggaacatttgcgtgcgattccacgcacgcgttgcatccctcttcccaaacccggatcgctgaactgagaggtggcgcagagtgtctcaccaggtgcggggatttctctccgcctcaggccgtacgagcttccctcgctgtccctgagcgcaaatgagcctcttcagtcgccgaggcccggccgcttagctctcggagccttccacagcccaacaccctgagccctggagtaggcaatttgctcccacagccctgtgctggcccttccaggcacagggagtcccccttctaggggtaggggcgggcgggatgaagcgcacccagccctctctcctacccttcctcctttggtcccttcggctttcgtgtaccttatctcccgcgcgcccagctccttggccggctcacctgctaagcggagcgcggacatgcgctggaactccggctcctgcagccacttccacatcctccggaaggtctcccggccggatttgagtttgctccagggtttggggttgcgcagcaggtccgagagggtcccctgggagcggcagagcaccctctgcgcgaagatggcctgtgggatgctgtagcgcttgagctcggtggtgatacgctgcgccacctctttggtattgatctcttccatctgccctgaattacttccattgctgacctgcgcgccggtcaccgaagggttgggctcccgggctgtgcccaggagttgcccgtggccctgggcgttcaggtgggcgtggggatggtgcggaggaaggccgttgatgggcaccatgccggccgaggtgggcgtgaggtgctgctccccgtggcggccgagcatggccgggtggtgggcttcgaagccgttgggggtgagcatcttgtcggtgggcatggcggcccccgggtgggcatagtgggggagcccttgctgggagttgtggatgctgcccagaccggagctggagaggggcgagaggctctggcccatgccggccacgtccttgtggtagggggtatagaggttattcatggaggccagcccgcgctcatcccgcatgagcgtgaagctaccgctcacgttgcccgccaggcgctggtggtggtgcgggtggtggtggtgatggtggtggtggtgatggtgggggaacttgtccgagactgtggagatgggaggcagcggctgcagaggggtcaaggtggtgtaggtggtgggcatgctcatacctgggggagtctcgcaggccatggtcatggtgggatgcagggggccggccaggctgtgctcaggggcccggtggtggtggtggtaatctccgccgccgctgccgccgtccagcagggacgccatgcccatggagcgcgggtgcgcggggggcaggtggctgccgcggtgcgccacggagctgcgcgcgtgggggctgccgcccagcaggtcggcaggggcgggca

SEQ ID NO: 110659 - DNA, 846 bp, Homo sapiens
  chr15:53082303-53083149
  Hyper
ccaccttcccctctgcgtcctcggcttttttttttttaatattaatttccaaagaggatccgcgccgttgggagagcgcagtgccccagcccgcccgcctcggccacctctcgcccctctctttcttaaaattctgaggtctccggctcccctgccgcggcccgcgcgcctgccgcgtctgctgcctgcccgccccgctggccagcttgagccatggctctgttactgttacagactctgtggccgcggttcggtagccgccgccgccgccgccgcagcggcccgccctcacgcccgccaggcgcagcgcgcatgcgcgaggcccgcccccgccccctaggtcgcggcgcgccaggcccttggcgtcccggtacaaatgaaggagggggcccagcgccttccctgcggcgctggatggccagggagctgcgggcacgtgcgaaagattggcgcagagcgcgacctggggccgccgctgcaatcccaggagactcgcgcctggctcgctcgcctcccttgcttgagtgggctctgtcctcccagcccggggacgctcgtgtcgggcttctagcggctggagtgctgtgcttggagacatcgcccctctctctccagttgctgcttcccggtgcagcttgcccggggagctggggactgtgtcatcaccccttcggctctagcccactaagctttatttcccggggggctgctgggagtgcgctttcccacccttgaattcacggcctattgggggatgggggttggggtggggtggggtgcagattgcttaaagggctgggtccgtttggcggccgttgacccggcacccttcgtcctcccagatac

SEQ ID NO: 110660 - DNA, 30 bp, Homo sapiens; identical to SEQ ID NO: 77709
  chr15:53089890-53089920
  Hyper

SEQ ID NO: 110661 - DNA, 30 bp, Homo sapiens
  chr15:53090730-53090760
  Hyper
cgtcccccgtgcctccgtgggttctttacc

SEQ ID NO: 110662 - DNA, 97 bp, Homo sapiens
  chr15:53090981-53091078
  Hyper
gagggggtgggggagcgaaaggttaaatcctgaccctggaggaccgcgggaaagttcagagcccgagggtcaatctcaggcccgagttcccatcccc

SEQ ID NO: 110663 - DNA, 3062 bp, Homo sapiens
  chr15:53095628-53098690
  Hyper
aacgaaaaagctcaccgccagacagcttccagcactcgaaccaatacaagtaaagcacatttgcaaatgtgtttgactgtttttgtaggtttaagaagactacgtttttctgaccacttcaaaaaaacaaacacgaattcagccgctgctttaataacctctgaccagaggagctgattttgccaccgagttatcggtcagtgctgcgaggtcagtggcctgtgatcatgtttatagcaggtttggcttggatttggtgacacagccagcaaacctgggagattatgaaaccgtgaaccagcccagggaagtgtagtcaagtttcagtttgggcatttctccgggtgagggaatccggtgggctccatttctacaaggctcacaaacgcaggtgcagttcggccgccgcacgctgcctggcgggagaaacgcgcacaaaccgcagacgcgtgctcctgtagttgccactagctcggggcacgcccgtgttatttacaccctgctcgggggcccccctctcatttgttactttaaactcatggggaggaactgttagctgccgtggcgggactggcaggctgggaggggggcgcccccgctcggctcccgggccgtgacgcggccgctgccctccgcccctggcttccaccctgtttgcatggccacaagctcagcggtggaccagcgtggccaggcccccggagcccttgccccggcctaccgcccctacttcttccccctcaccaccccccccaaacgcttgtgagactggcttaccctggtgggcgagtcgcagcgcattagcggatttcatggcaagttgcttctgtgacatgagatcaggttcgcgttcgaggatttgccccctaggagggaaggaaaggagagtcaatctgcataatttcaaatgagaaataaatagggaaacagggaactgaatttcaagccccctaattcctccctccccccgaacctgtgagccaccccgcaccccccacaacacgccccgtgcacaggtaaaaaaaaaaaaaaaaagtaatcagcacacgtcgcaggtgataccttttattgtgctcattttaaagacaggaacaggatggcctcctgcccgaagactttctctgcagccaggcccggggcaggagggtcagctgggcagcatccgggcccgcggattcctgcaaggtcgcgaggtgagaggtgcggggaggatagacctcgggctcggcgcacagggtctgggccagacgcacaagcccaaattccctccagcttcttcggctccatctttaagtccaggcaaagatcaattccctctctctcttgaacacacacatttgcagccataaataaacagctcccagctaaatcaggaaccggagaggagaaagggaaaaagaaaggagaaaagagaaggattgagaacccaagcgcgagtctcgcctcttccgggcgccgactggctctttttggtcaggccagcctcgcatttggggatgcaacttgcatttgaatagctgcctgggcttgttatggacccgggaaagctctgaaagggaatcactatgcaaattgtcccagttacaatcgaaaggttcgatctccaggagctgcctgacggaagttgatgtcagctatctatgcattagggttgcattaccgccttcgtcggcctcctcgccacccccgctcgcgcctgcaggggaggctttttttttttttgcttatgtttatattttccctcagtaattaaaaaaaaataaaaaaagaaaataaaaggctgaaggtggtggcatagctggctagggcctgggaggcccacgggctgagaggggaggaggtgcggaagggcggggttgggtggcggggggggtcgttcttttgcagcaggtgttgatggtgcgtttgaaatcaaacatttagatttttttttcgctttgccggacgaggcggcggcggcggcggcggggggttggggcggcgatgtctgcctcctcccgcccgcttgatcctacaatgccggctgcggatcaatacccgctcactgtaatcccagtaattgtagggctcgcagcttttattttaaagaaataggacactagggcgccggcaggcggctgaggcagaacggttgggctgcggtgcctccgggggccttttggggcgccttttaccccagagctcagaaagctccgggcagcggggtggtggcgggatggccagtagccagggcccacctggcggcccgccgggatgtggaggcccactgggttccggcccggcatggcgctggcgagaaggcgccgctgggcgcgtagggtaggcagcacgcgggatttagccttttcccgacctgcgcgcgggccctggcgggaaggccaggtccgggatgggcgtcttgggcttgggcgccgactgtgggcggtcttggccccagaccccgacgcgtggggacccaggatgctggaactcaggccttcggcctagaaagacagaggttttgtctcctttctgccgccttccagggccggaggccgggccaggctcccgggtggcctagctcgggcctagtctgcgtctggccctcggtctgggaattggcagggacgctaggacctggtgatctaacgcccgcgcggcctcttacgccggggtttcctccaggtgctcgttgccacgcgttcgcccgacgcccgcagatcccgtcgcgcccgcaggctaggccagctccgcaagccgcctgctacctctgccgcccgccccttgctggcagagtccgggcaggactgccggggcctggggccgcagtccccgcgccgctggccgcccgcagcttctggcgcccccgaaaatgaccatctgtcattcaattaaggtttcagggcagctgatgggggagccagggtcagcgaccccaggacaaaacggcctgctgcctcggataggagaagttcaaatgttaaatgcagaatattgtgccctctcccagtccggggccccacccggccgcaggtccggccagtggacagcagtagggtgaagggcaacggtcattagcactt

SEQ ID NO: 110664 - DNA, 145 bp, Homo sapiens; identical to SEQ ID NO: 15900
  chr15:53976280-53976425
  Hypo

SEQ ID NO: 110665 - DNA, 311 bp, Homo sapiens; identical to SEQ ID NO: 77715
  chr15:54051665-54051976
  Hyper

SEQ ID NO: 110666 - DNA, 465 bp, Homo sapiens; identical to SEQ ID NO: 77716
  chr15:54270462-54270927
  Hyper

SEQ ID NO: 110667 - DNA, 30 bp, Homo sapiens; identical to SEQ ID NO: 77717
  chr15:54633940-54633970
  Hypo

SEQ ID NO: 110668 - DNA, 22 bp, Homo sapiens
  chr15:55452971-55452993
  Hypo
gagccaccgcacccagccaaca

SEQ ID NO: 110669 - DNA, 43 bp, Homo sapiens; identical to SEQ ID NO: 44269
  chr15:55689108-55689151
  Hypo

SEQ ID NO: 110670 - DNA, 86 bp, Homo sapiens; identical to SEQ ID NO: 77720
  chr15:55699080-55699166
  Hypo

SEQ ID NO: 110671 - DNA, 92 bp, Homo sapiens; identical to SEQ ID NO: 44271
  chr15:55806620-55806712
  Hypo

SEQ ID NO: 110672 - DNA, 1364 bp, Homo sapiens
  chr15:55879812-55881176
  Hyper
cacaaagtcgggaggcgagggatccgcgcggatgtctcgggggccagcgggcgcccgggccgcgcgctcggatcgcagcctcggccccggggtgccggcgggacgcgggctgcgcggacttaggcccggacagagccccatggcctcccggcggccgggcacggggccccgcgcacctcactcaccccggttcccccaatccggcacccttctcggttacctcgaactctcttcagcgaaatgggatccttctcctgttctgctgacattacagaccgcaaagcatgactcccccccaggccgcgggaattcggtctctttgatgctgcggcggcggctcctcctcctcgcggggccgctgcggctgcgaggcaagcctcggagccgaggcacggccgagggcggtggggacgcgggccgactttgcaaagtttgggaggaggacgaggcctcggggcggcggggcggcggggcggcgtgcgggcaccggcggggctcagcggcggtggccgggagcgcggcctgggggcggccccccacccggggccggcatgtgctgagggcgagtgcgccgccgccgccgccgcctcctcccactccttcttcttcgccgccgcctcaggagccgctgacaggggaagcaggaggctcgcggcccggccctggcggcacactcacagcgccctctgaggaggaggtctgctctctcgccgctcccgagtcgcagacacaaaagcccccagactggagccgcctgtaaaacccgctctggggcgggcgagggacgtggcgcggccccgcggcttccccgccctgagctccccagccccgcgcggggacgggcttcggggggcgggggccgctgcctcgtcccgcggcgcctcccgccaccgccgccgcctcgcgctccgcctcggcccagcccccacggcccgcgcgcgcctcttgctccaagccggggctcgcgggcccgcggctcttgcagcccgggtgggcagcgcgcgcctaggggccgccccgccccgcgcccggcgctccctcgccgaccgccaggcccgagaacgcccgaccccgcggccgacgctaccgggcccagctttcgcaaggaaagggcatctccgaacttcgtcggaggccacagcagcaggcgtctcggcctcgcagctagggatcggaaagatgaacgtaccatgcgaggaaactttgtaagcgggagctggagagttctcggcgggcatgtggggatccagattccccgactccgtgtccgcgtggccgtggtgtggacacctgtctgtagaatgcctccacttggtattttaacgacttgactcttcaagaaagagcgacgtagaataaatacc

SEQ ID NO: 110673 - DNA, 20 bp, Homo sapiens
  chr15:55933134-55933154
  Hypo
gaacccgggaggcaacaaac

SEQ ID NO: 110674 - DNA, 1123 bp, Homo sapiens
  chr15:56034387-56035510
  Hyper
ttcccccctcctttccggggcacaaatcggccacttcacttccaaccctgccaattccaccctcccatctcctcctggctggatccagatccggcaagctggtgccgattggggttatgagttcacctattccctctcgcagccctaaaaagtgggggaactcccacaacagacacgggaagccgcgaggaaccgcggcgccccctgcacggcgaggctgccactaaggaaacaatataaataaagccacgtgcagccgcggcggccccggcgggctggcgacccggagtccggccggtcgcggaggcgcggacgcggccggagccgggacaatggcgcgagaaggaagagaccagagtggacagcggccgccagaactccgcagccacgggcgcgcggcgcggaggggcgtgcgcccggagaagctcccgcagccctgcccaagcagcgcagaggccgcaagcaactagtgtctgcagctggcggttccggacaggccgcagggcgagagcgggggccgggggtcagcgccaccacggaggaccccgccgcgcgctccccacgccccatcgtttcctctttccccatcccactcgcgcccgctcccgccccacagcggtaagagaaagcagaagaaagcgcgcccacctggcaaaggactgagcagcagcaggagcaggagcgcgcggagcagcatccccggcggtcgcagccgggcgaggggtcgcagaggaggcgccattcagcgtagccgcgcgggcatgctccccggccgcccagagcccctgtccgtctgcggcccccgccccgggcgctctctgctctgcggctggtcgcacgcagcctggctccccgctccggctccggcaccggcgtggcgagcgtctctgcggcggcgaggctggtgctcggacggccgctcgcgagaagcaaggggcctgagagtccggctgggggcggagtgaggcggcggctgcagagggcgggggcggcggagtggacagcgccgcggccgcgggcctgggactactttctacatctggcccttggtctgggccagggaggtcggcgcggccggcggagggagacgctgggagggggccagtggcggccgggtcggagc

SEQ ID NO: 110675 - DNA, 84 bp, Homo sapiens; identical to SEQ ID NO: 77729
  chr15:57618488-57618572
  Hypo

SEQ ID NO: 110676 - DNA, 30 bp, Homo sapiens; identical to SEQ ID NO: 77730
  chr15:57967966-57967996
  Hypo

SEQ ID NO: 110677 - DNA, 1059 bp, Homo sapiens
  chr15:58357149-58358208
  Hyper
aaaattcacatgaaacgctgacgttggagttactgtacttatcagtcaggtttccgtgaaatttgtcaaaccggccagagcgctggtgtcttgacaattccttacgggaaagcccctcagcaccctccgggctgtggaggacctgattgggaccaacagccgaggggcccggaaggcggaggaccgagaggcgacggccaggctgcgtggccaagctgacggggaaccccggcctccatctgaggatactaagcggttccgacgccttcccccgcggcagtcgggaccgggagaatcggacagaaaccagcctcagagtccggggcaggagccgttgacggctgcccctcaacgctgcgcttcgggttgggttaagtccccaaggcgtcctcagaccacggcggggcttcaaacgccccagtcccgaagacaggcagggggtccctctgctgcgccgggatgacaggctggccccgacgaccccggccccgtcccgcagccctcacccgctgaagagatcggggaaaccgaagaaggttctagaaagtctccgtggacgacgggcgctgggcggccgcttaccttggtgtacttaatttcgagattgggcgtgggcgacggcaggaggtgcagcgacgccatgagggcggcggggtcggccttcacctcgccgggcatctctatcttgctggaagtcatggtggcgggccgggtgtccctagcccgcggcgtggggcagtgcgggctgtgcgcgcggtccgcggcccgggggcgcgctcgcctgtatataggcaggtgtcaagctggggctcttcttattggacgtgagggccgaggcgcggggggctggtccatcctacctaggacgcccggcgcagcctccatttacataaagcccgcgccgcgcggccgggacgcttggcgcccacggtcaagtccgcccggcgctcccgccccccggccgcggagaccagcccacgccgcctccacagtcctcgacggtgggagcggaacttgcgccgcggcccgcgggcctcggccagccggacttggtctccg

SEQ ID NO: 110678 - DNA, 305 bp, Homo sapiens
  chr15:58358458-58358763
  Hyper
tccgttctcctcctccgggcaggggcgccaggctctcggcagctacgccctctcccccgaccccccgactcccctcagccgggccgaggtgcatggtggccagagggtcagggagaggtggcagtgggtgcgagtccccctcgcctcgggctcagaatgaggatccctgcgagcgggtcagcgcggggcggcccttgccaggcgtcgcccgcccagttgctgccctctgccggccgggaccgcccgggcggcttgcgctgtggcgggaggatatgggcagtgatcatccccggctcctccgagga

SEQ ID NO: 110679 - DNA, 101 bp, Homo sapiens; identical to SEQ ID NO: 77734
  chr15:59158436-59158537
  Hypo

SEQ ID NO: 110680 - DNA, 30 bp, Homo sapiens; identical to SEQ ID NO: 44273
  chr15:59243729-59243759
  Hypo

SEQ ID NO: 110681 - DNA, 24 bp, Homo sapiens
  chr15:59279029-59279053
  Hypo
tgaatgatacggaaaatatgagtg

SEQ ID NO: 110682 - DNA, 30 bp, Homo sapiens; identical to SEQ ID NO: 77737
  chr15:59445742-59445772
  Hypo

SEQ ID NO: 110683 - DNA, 64 bp, Homo sapiens; identical to SEQ ID NO: 77738
  chr15:59453450-59453514
  Hypo

SEQ ID NO: 110684 - DNA, 159 bp, Homo sapiens; identical to SEQ ID NO: 35730
  chr15:59729656-59729815
  Hyper

SEQ ID NO: 110685 - DNA, 30 bp, Homo sapiens; identical to SEQ ID NO: 77740
  chr15:59846186-59846216
  Hypo

SEQ ID NO: 110686 - DNA, 21 bp, Homo sapiens
  chr15:59950342-59950363
  Hypo
aaactccgtctcaaaaaaaaa

SEQ ID NO: 110687 - DNA, 23 bp, Homo sapiens
  chr15:60085007-60085030
  Hypo
tcattatccggatgaaaagtata

SEQ ID NO: 110688 - DNA, 18 bp, Homo sapiens
  chr15:60121321-60121339
  Hypo
actgactcacggccccgg

SEQ ID NO: 110689 - DNA, 80 bp, Homo sapiens; identical to SEQ ID NO: 77744
  chr15:60286430-60286510
  Hyper

SEQ ID NO: 110690 - DNA, 872 bp, Homo sapiens
  chr15:60286804-60287676
  Hyper
tattcactaatccagcgcattgccaaatacccccttaattctgcttaacactaaaagggttttgagcaccataatgagattcttctgtctgctaattaattgacacgctcctgaatattcatatgagctagcaccaatacgttcctaattgcaccgtggaatagatctcagaggaaagtaaatcgccatagacttaattaaaataatgtattccagatccagcacggggaaagatgagacatttgccttcgagctcgctaagaaagtggcacctggttggtggaggggagagataccaaatgtcggcgcccagcctgaaataagtggcatgggacgcgcagggagggcgttcagcttcagaaagcagcggctacgctgggtccaaacccggcggctcgggaggccatagctcctaggtgcgtccgagctcctgctaccctgcgcggtgttgtcctaccggaggaagtggctgatgggcagtctaggatcccggcccctgacccagggccctctcctccctgcggtcctggtccgggtcatggtcccggggctggtctgaagtgctgtctacagagggcacttggggaaacatcgtaggtccggaaattcccagggaaagtttttgcaggagttgtggacgccgcagcagccccaactctcccaacccagcttgcgacccgagagaagtcgctcacacttctctttgggggagggcgacagttccggggaggacgcttggatcccgaaaatgacgggatccaggtcccacaaccctcaggaagcgctgcggtcttcaaaactgcgcagctaaattcctgggcgcattctccctttcttggcgagtccagtgcccgtgccggggagcattccag

SEQ ID NO: 110691 - DNA, 30 bp, Homo sapiens; identical to SEQ ID NO: 77747
  chr15:60288131-60288161
  Hyper

SEQ ID NO: 110692 - DNA, 171 bp, Homo sapiens; identical to SEQ ID NO: 77748
  chr15:60288412-60288583
  Hyper

SEQ ID NO: 110693 - DNA, 132 bp, Homo sapiens; identical to SEQ ID NO: 77749
  chr15:60288786-60288918
  Hyper

SEQ ID NO: 110694 - DNA, 316 bp, Homo sapiens; identical to SEQ ID NO: 35735
  chr15:60289310-60289626
  Hyper

SEQ ID NO: 110695 - DNA, 30 bp, Homo sapiens; identical to SEQ ID NO: 35736
  chr15:60289876-60289906
  Hyper

SEQ ID NO: 110696 - DNA, 48 bp, Homo sapiens; identical to SEQ ID NO: 77752
  chr15:60292201-60292249
  Hyper

SEQ ID NO: 110697 - DNA, 2262 bp, Homo sapiens
  chr15:60295917-60298179
  Hyper
agtcaagtcaaatttcgacctaactctccggggactggggggcaagggtgtgttttcattattataacccatgcaaccaaccccgggtagtgctaagcgcaggaaaagggtcggcttcaggggaaagccgtgcctaaagttacctaacgatacaaaccggatacaacgcagaggaaacagaataccccagccaagcaatttccatgtcaaacatcatccgcgcggctgctccatctgtgaacgtgagtggtcgcctggctccctcttccgcggcggccgcttcctcataccttcacacggcgcacaccggccggcgcgtccagctgcctgcccagtggccgaggctcttccccctcgcccagtcttgagctggaagtgattcctattggccaaggtgtccatgtaaataggtgtgaaagaaaccagagctggccgggctctcccttctcgctcagtcccctccctctgcagcccccgctccccctcctcttcctcctcctcccaaggcgattgtcatatgatagctaagaagtggcacattaatgaagcgccgctacaggggtcttttctgctcctgtcaccgcttaaaactatcagatggttcgagggaggacatggaggcagccacctagctcagcggagacgcggagcccacagcagcgccctccggagccctaacacgtcgctgccaccatccgcgccgggactccgcagccgagctcggccgcccgcaggacgctccaggagcgtcgcggaccgggcggcacgggacgctgcggggctgagctcaagagcccaggttcgcgccgagtccaaccggacccggacgctgcgcgcggagtgcgcgtcgagtgcgcgccgagagagaagcggcgcgcagcggcgtcctcccggatgcggacgcgcaacttgaagcaactttaaggtgagcagctctctgttccgtccctgccccctattctggccccagtaccgacttacttcccggctatcctcgcgccgttcgccggcttcccctcccgcgcccactaagcccgcaaagttgctggcgaaagagtccgggcgctggctgatcgagcgccgcaggccccacccccgacccccgaagtctgttactcggtctggctgaccccgccggtgtctctgtgcatccatgctacctttccctattacccacccccttcccagatccgagcagtccgccggcccgcgcggacccagagcaagaagagggcgaggaagaagatgcctcggcccggccgcaacacgtacagcgaccagaagccgccctactcgtacatctcgctgaccgctatggccatccagagctctcccgagaagatgctgccgctgagcgagatctacaagttcatcatggaccgcttcccctactacagggagaacacgcagcgctggcagaacagtctgcgccacaacctctccttcaacgactgcttcatcaagatcccgcggcggccggaccagccaggcaagggcagcttctgggcgctgcacccaagctgcggggacatgttcgagaacggcagcttcctgcggcgccgcaagcgcttcaaggtgcttaagtccgaccacctggcgcccagcaagccagccgacgcggcgcagtacctgcagcagcaggccaagctgcggctcagcgcgctggcggcctcgggcacgcacctgccacagatgcccgccgccgcctacaacttgggcggcgtggcgcagccctcgggcttcaagcaccccttcgccatcgagaacatcatcgcgcgggaatacaagatgcctggggggctggccttctccgccatgcagccggtgcccgctgcctacccgctccccaaccagttgactaccatgggcagctcgctgggcaccggctggccacacgtgtatggctccgccggcatgatcgactcggccacccccatctccatggcgagtggcgactacagcgcctacggcgtgccgttgaagccgctgtgccacgcggcgggccaaacgctgcccgccatccccgtgcccattaagcccacgccggccgccgtgcccgcgctgcctgcgctgccagcgcccatccccaccttgctctcgaactcgccgccctcgctcagccccacgtcctcgcaaacagccaccagccaaagcagccccgccacccccagcgaaacgctcaccagcccggcctccgccttgcactcggtggcggtgcactgacccgcaggagcccacgccccctctcgttctcctccccac

SEQ ID NO: 110698 - DNA, 30 bp, Homo sapiens; identical to SEQ ID NO: 77757
  chr15:60615951-60615981
  Hypo

SEQ ID NO: 110699 - DNA, 30 bp, Homo sapiens; identical to SEQ ID NO: 77758
  chr15:60789762-60789792
  Hypo

SEQ ID NO: 110700 - DNA, 321 bp, Homo sapiens; identical to SEQ ID NO: 77759
  chr15:60883283-60883604
  Hyper

SEQ ID NO: 110701 - DNA, 32 bp, Homo sapiens; identical to SEQ ID NO: 77760
  chr15:60896339-60896371
  Hypo

SEQ ID NO: 110702 - DNA, 30 bp, Homo sapiens; identical to SEQ ID NO: 44275
  chr15:60915264-60915294
  Hypo

SEQ ID NO: 110703 - DNA, 30 bp, Homo sapiens; identical to SEQ ID NO: 77762
  chr15:60924136-60924166
  Hypo

SEQ ID NO: 110704 - DNA, 30 bp, Homo sapiens; identical to SEQ ID NO: 77763
  chr15:61065077-61065107
  Hypo

SEQ ID NO: 110705 - DNA, 127 bp, Homo sapiens; identical to SEQ ID NO: 77764
  chr15:61113449-61113576
  Hypo

SEQ ID NO: 110706 - DNA, 30 bp, Homo sapiens; identical to SEQ ID NO: 44276
  chr15:61305596-61305626
  Hypo

SEQ ID NO: 110707 - DNA, 250 bp, Homo sapiens; identical to SEQ ID NO: 77766
  chr15:61519861-61520111
  Hyper

SEQ ID NO: 110708 - DNA, 89 bp, Homo sapiens; identical to SEQ ID NO: 77767
  chr15:61520408-61520497
  Hyper

SEQ ID NO: 110709 - DNA, 742 bp, Homo sapiens
  chr15:61520754-61521496
  Hyper
ccgaaaacacacccccgactcgggcagccagggccgaaactgtcaagaggagaaaaggtaaagcggaaggagggtggccataaacagatttttttgccccttcttaaaaggacactgccgctttaaaagtttctttcccgggcccccactccccgcatctccgtattttgggggagcgtatttaattgaggcaacgcagctttcctccagtgtttgcagaaaaatcaaagccaggggggtgagcccgccggctgtcaaccttcccgccgcctcccccgccccactctgctcccgcaagccgagaacgggctgcaaaagtttgcaacatttctggggggcggaggggggaggggaggggggtcctccgggctcggggcgccgccgcaggctcgcgcgcggccgccggaccccgcgccccgggcgcccgctcccggccgccccccgctccgcgcccgggctcccgccgccccctccccagcccctctccagcctcctacctctgctggtgctggaatagctctgtctgcgcaccggggcaggcggctcgctcttgcgggcggattcctggttcagcggggtctccctggagccggcggccgcgtccgcgccgctgctgcctggctcgctggcggcggggtcgggggctgccggagctgactccatgttttttcccaatgtagagatcgctggagatggcgagctccgagactccctctatcttctgttttcagagcaactctat

SEQ ID NO: 110710 - DNA, 22 bp, Homo sapiens
  chr15:61521556-61521578
  Hyper
cgaccggcgaaagcaggaggga

SEQ ID NO: 110711 - DNA, 165 bp, Homo sapiens; identical to SEQ ID NO: 77771
  chr15:61521809-61521974
  Hyper

SEQ ID NO: 110712 - DNA, 139 bp, Homo sapiens; identical to SEQ ID NO: 77772
  chr15:61739721-61739860
  Hypo

SEQ ID NO: 110713 - DNA, 37 bp, Homo sapiens; identical to SEQ ID NO: 77773
  chr15:62068181-62068218
  Hypo

SEQ ID NO: 110714 - DNA, 30 bp, Homo sapiens; identical to SEQ ID NO: 44277
  chr15:62361320-62361350
  Hypo

SEQ ID NO: 110715 - DNA, 44 bp, Homo sapiens; identical to SEQ ID NO: 44278
  chr15:62367703-62367747
  Hypo

SEQ ID NO: 110716 - DNA, 159 bp, Homo sapiens; identical to SEQ ID NO: 77776
  chr15:62456236-62456395
  Hyper

SEQ ID NO: 110717 - DNA, 245 bp, Homo sapiens; identical to SEQ ID NO: 77777
  chr15:62456686-62456931
  Hyper

SEQ ID NO: 110718 - DNA, 158 bp, Homo sapiens; identical to SEQ ID NO: 77778
  chr15:62457138-62457296
  Hyper

SEQ ID NO: 110719 - DNA, 80 bp, Homo sapiens; identical to SEQ ID NO: 77779
  chr15:62684233-62684313
  Hyper

SEQ ID NO: 110720 - DNA, 91 bp, Homo sapiens; identical to SEQ ID NO: 77780
  chr15:62821527-62821618
  Hypo

SEQ ID NO: 110721 - DNA, 243 bp, Homo sapiens; identical to SEQ ID NO: 77781
  chr15:63334477-63334720
  Hyper

SEQ ID NO: 110722 - DNA, 74 bp, Homo sapiens; identical to SEQ ID NO: 77782
  chr15:63334921-63334995
  Hyper

SEQ ID NO: 110723 - DNA, 72 bp, Homo sapiens; identical to SEQ ID NO: 77783
  chr15:63335932-63336004
  Hyper

SEQ ID NO: 110724 - DNA, 35 bp, Homo sapiens; identical to SEQ ID NO: 77784
  chr15:63390437-63390472
  Hypo

SEQ ID NO: 110725 - DNA, 501 bp, Homo sapiens; identical to SEQ ID NO: 77785
  chr15:63673771-63674272
  Hyper

SEQ ID NO: 110726 - DNA, 249 bp, Homo sapiens; identical to SEQ ID NO: 77786
  chr15:63753342-63753591
  Hypo

SEQ ID NO: 110727 - DNA, 30 bp, Homo sapiens; identical to SEQ ID NO: 77787
  chr15:63756300-63756330
  Hypo

SEQ ID NO: 110728 - DNA, 82 bp, Homo sapiens; identical to SEQ ID NO: 77788
  chr15:63779643-63779725
  Hyper

SEQ ID NO: 110729 - DNA, 30 bp, Homo sapiens; identical to SEQ ID NO: 77789
  chr15:63795471-63795501
  Hyper

SEQ ID NO: 110730 - DNA, 43 bp, Homo sapiens; identical to SEQ ID NO: 77790
  chr15:63795851-63795894
  Hyper

SEQ ID NO: 110731 - DNA, 30 bp, Homo sapiens; identical to SEQ ID NO: 77791
  chr15:64210208-64210238
  Hypo

SEQ ID NO: 110732 - DNA, 30 bp, Homo sapiens; identical to SEQ ID NO: 44280
  chr15:64440388-64440418
  Hypo

SEQ ID NO: 110733 - DNA, 91 bp, Homo sapiens; identical to SEQ ID NO: 77793
  chr15:64443195-64443286
  Hypo

SEQ ID NO: 110734 - DNA, 38 bp, Homo sapiens; identical to SEQ ID NO: 77794
  chr15:64649878-64649916
  Hypo

SEQ ID NO: 110735 - DNA, 30 bp, Homo sapiens; identical to SEQ ID NO: 77795
  chr15:65036371-65036401
  Hypo

SEQ ID NO: 110736 - DNA, 152 bp, Homo sapiens; identical to SEQ ID NO: 44282
  chr15:65043526-65043678
  Hypo

SEQ ID NO: 110737 - DNA, 50 bp, Homo sapiens; identical to SEQ ID NO: 77797
  chr15:65068204-65068254
  Hyper

SEQ ID NO: 110738 - DNA, 32 bp, Homo sapiens
  chr15:65116283-65116315
  Hyper
ccggcctcggcgaaacgcgtgaagaggcgcgc

SEQ ID NO: 110739 - DNA, 30 bp, Homo sapiens; identical to SEQ ID NO: 77798
  chr15:65118647-65118677
  Hypo

SEQ ID NO: 110740 - DNA, 35 bp, Homo sapiens; identical to SEQ ID NO: 77799
  chr15:65119226-65119261
  Hypo

SEQ ID NO: 110741 - DNA, 29 bp, Homo sapiens
  chr15:65127732-65127761
  Hypo
tgagccaccgcgcccggcctggatttatg

SEQ ID NO: 110742 - DNA, 48 bp, Homo sapiens; identical to SEQ ID NO: 77801
  chr15:65204187-65204235
  Hyper

SEQ ID NO: 110743 - DNA, 30 bp, Homo sapiens; identical to SEQ ID NO: 77802
  chr15:65214117-65214147
  Hypo

SEQ ID NO: 110744 - DNA, 37 bp, Homo sapiens; identical to SEQ ID NO: 77803
  chr15:65322459-65322496
  Hypo

SEQ ID NO: 110745 - DNA, 227 bp, Homo sapiens
  chr15:65360172-65360399
  Hyper
tggcgacgccctggacggccacgcaggtctgcggccggtgggccccgcgcagtgcgcccgcccgtcggggcccaggggagcgggatgcaggcttccctggagcgcgcggccccggacccgtcggcgtccgcgccctcggccccgcgtccagcgggctgccaccccgcggggaggaggggccggtggagcctggcgggcggggccaccccaagcgccaccaaattcct

SEQ ID NO: 110746 - DNA, 50 bp, Homo sapiens; identical to SEQ ID NO: 77806
  chr15:65622968-65623018
  Hypo

SEQ ID NO: 110747 - DNA, 197 bp, Homo sapiens; identical to SEQ ID NO: 77807
  chr15:65625104-65625301
  Hypo

SEQ ID NO: 110748 - DNA, 287 bp, Homo sapiens
  chr15:65647864-65648151
  Hyper
cggcgggccccttcccggcggccgggcccgaggcgggggccggttcccacagccgaccgggccgcgcgccgcctttgaagtggccgcagctgcgccccggcccgcggctaatccccgccgacgcgggcgtcccgcccccccgcccctcccgcatagcaatagtgtccgcgctgaatggcgctggctaattacctcgctcgcaccaccgcgggtgaatgagagaatccggcattgtgcgcggcgaatggagaaaataagacagccattgtcctcgcacgccaaacgag

SEQ ID NO: 110749 - DNA, 1174 bp, Homo sapiens; identical to SEQ ID NO: 77810
  chr15:65669070-65670244
  Hyper

SEQ ID NO: 110750 - DNA, 151 bp, Homo sapiens; identical to SEQ ID NO: 35762
  chr15:65670634-65670785
  Hyper

SEQ ID NO: 110751 - DNA, 564 bp, Homo sapiens; identical to SEQ ID NO: 77812
  chr15:65713759-65714323
  Hyper

SEQ ID NO: 110752 - DNA, 84 bp, Homo sapiens; identical to SEQ ID NO: 77813
  chr15:65714747-65714831
  Hyper

SEQ ID NO: 110753 - DNA, 580 bp, Homo sapiens
  chr15:65715098-65715678
  Hyper
tcgctcctgcctctccgggcgcccgcccttaccgcgcgcggccaacaggcagaaggtcaacgcgaggagcccgcggccgcggccggcgtccccccgcgccatggggctgggctcgggccgccgccgccgccgccgcctccccgtgcttcggccgccgccgcggggggagagcgcgccgggcgtcagtggcccggggaggcgcggcgccgcgggcgggggcgcggcctcgggggcccgggcccgagctggggccggcgcgggggccagggccgctgccgcctcacccgcccctccatcgccatcttgggcgagcggcccgggagggggcgcccggcgagtgtggccaccctggccccgccggggaccctgcgcccgcgcgccacggccctgcgcctcgcgggggctcctctcggcccgggtctgtgtcccggtgcctcgccctctccgggtcgccgcgggcccccgtgaggccgcctgttgctgggtctgtctcttagtctccccgtctctgagtcttctggtctctctgcctcagcgtctctatttcttctccctgttgctgcctcggggtctccacctc

SEQ ID NO: 110754 - DNA, 95 bp, Homo sapiens; identical to SEQ ID NO: 77816
  chr15:65826384-65826479
  Hypo

SEQ ID NO: 110755 - DNA, 103 bp, Homo sapiens; identical to SEQ ID NO: 44285
  chr15:65862091-65862194
  Hypo

SEQ ID NO: 110756 - DNA, 30 bp, Homo sapiens; identical to SEQ ID NO: 77818
  chr15:65946844-65946874
  Hypo

SEQ ID NO: 110757 - DNA, 83 bp, Homo sapiens; identical to SEQ ID NO: 77819
  chr15:66017661-66017744
  Hypo

SEQ ID NO: 110758 - DNA, 33 bp, Homo sapiens; identical to SEQ ID NO: 44286
  chr15:66147762-66147795
  Hypo

SEQ ID NO: 110759 - DNA, 30 bp, Homo sapiens; identical to SEQ ID NO: 77821
  chr15:66198204-66198234
  Hypo

SEQ ID NO: 110760 - DNA, 41 bp, Homo sapiens; identical to SEQ ID NO: 77822
  chr15:66596944-66596985
  Hypo

SEQ ID NO: 110761 - DNA, 192 bp, Homo sapiens; identical to SEQ ID NO: 44287
  chr15:66598802-66598994
  Hypo

SEQ ID NO: 110762 - DNA, 104 bp, Homo sapiens; identical to SEQ ID NO: 77824
  chr15:66647729-66647833
  Hypo

SEQ ID NO: 110763 - DNA, 97 bp, Homo sapiens; identical to SEQ ID NO: 77825
  chr15:66649671-66649768
  Hypo

SEQ ID NO: 110764 - DNA, 30 bp, Homo sapiens; identical to SEQ ID NO: 44288
  chr15:66788210-66788240
  Hypo

SEQ ID NO: 110765 - DNA, 30 bp, Homo sapiens; identical to SEQ ID NO: 77827
  chr15:66789348-66789378
  Hypo

SEQ ID NO: 110766 - DNA, 26 bp, Homo sapiens
  chr15:66798718-66798744
  Hypo
agataaggccgggcgcgatggttcac

SEQ ID NO: 110767 - DNA, 185 bp, Homo sapiens; identical to SEQ ID NO: 77829
  chr15:66963175-66963360
  Hypo

SEQ ID NO: 110768 - DNA, 62 bp, Homo sapiens; identical to SEQ ID NO: 77830
  chr15:66963672-66963734
  Hypo

SEQ ID NO: 110769 - DNA, 72 bp, Homo sapiens; identical to SEQ ID NO: 44292
  chr15:66964011-66964083
  Hypo

SEQ ID NO: 110770 - DNA, 33 bp, Homo sapiens; identical to SEQ ID NO: 77832
  chr15:66995234-66995267
  Hyper

SEQ ID NO: 110771 - DNA, 30 bp, Homo sapiens; identical to SEQ ID NO: 77833
  chr15:67322314-67322344
  Hypo

SEQ ID NO: 110772 - DNA, 39 bp, Homo sapiens; identical to SEQ ID NO: 44293
  chr15:67457364-67457403
  Hypo

SEQ ID NO: 110773 - DNA, 81 bp, Homo sapiens; identical to SEQ ID NO: 15907
  chr15:67545405-67545486
  Hypo

SEQ ID NO: 110774 - DNA, 30 bp, Homo sapiens; identical to SEQ ID NO: 77836
  chr15:68074740-68074770
  Hypo

SEQ ID NO: 110775 - DNA, 620 bp, Homo sapiens
  chr15:68112054-68112674
  Hyper
gcctggtccaggcagcggaaacccagagggtacggcctcccaccaaatccggaccctctccagcctcagtctctggtccgcaacaggagtgaggtgggcccggagctctgagcaccttctcaccggctccaaggcccccgccttctcctcacttttggtctcgggttggggcccggcaggccccgcccagcctccttcacttccttgggccagggccgccgccgcgccgggctctgccctatgtggccgttggattaatatccagatattaagtaaacactaaattagcaaaactacaagaaaattttacagccctttgcatttggcaatcattgagtgttaattagaaattcattacaattaaaaccctgcctaaacagggcctgcgcgccttaattacatctgatttttaattcagaatacgtgtttacacagtaagcgctacgtaccccgtgattatccccaatcctctttatactgtactaattatgtaaattaaacctaattaactgacgaaaactgccgttaattcaactagtaaaagatatgtgcttgcggaggaggcgcgtccgcgcagcctcagcccaagccggagcccaaatggacgccaaacccggggc

SEQ ID NO: 110776 - DNA, 30 bp, Homo sapiens; identical to SEQ ID NO: 77840
  chr15:68112976-68113006
  Hyper

SEQ ID NO: 110777 - DNA, 1295 bp, Homo sapiens; identical to SEQ ID NO: 77841
  chr15:68113226-68114521
  Hyper

SEQ ID NO: 110778 - DNA, 192 bp, Homo sapiens; identical to SEQ ID NO: 77842
  chr15:68114819-68115011
  Hyper

SEQ ID NO: 110779 - DNA, 1371 bp, Homo sapiens; identical to SEQ ID NO: 77843
  chr15:68115216-68116587
  Hyper

SEQ ID NO: 110780 - DNA, 30 bp, Homo sapiens; identical to SEQ ID NO: 77844
  chr15:68116962-68116992
  Hyper

SEQ ID NO: 110781 - DNA, 1481 bp, Homo sapiens; identical to SEQ ID NO: 77845
  chr15:68117203-68118684
  Hyper

SEQ ID NO: 110782 - DNA, 3844 bp, Homo sapiens
  chr15:68118886-68122730
  Hyper
aacttcaactcctggcgtcgtcacctcaaactcagtgacaagtcggccacagacgaactgagccatgcttgggaggacgtcaaggccatgtttaatggcggcacgcgcaagcggaccttctccctacaaggaggcggcggaggcggtgccaatggcgggtcgggtgggcaggggaagggtggtgctggcggcggtggcggcggtggcccagggtgcggtgcagagatggccccaggcccgccgccccacaaaagcctgcgctgtggcgaagatgaggctgccgggcctccggggccacctccaccccacccgcagcgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggtcctggcactgggagcggcggcggcggcgcggggacaggcgggggtgcggggggcccgggagccagccacttgcccccgggggcaggggcgggcccgggcggcggcgccatgttctgggggcatcaaccctccggggcagccaaggacgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggccggcccgcatttggggacttggcagccgaagacttggtgcggagacctgagaggagcccgccaagcggcggcggcggctacgagctgcgagagccttgcgggcccctaggaggccccgcgccggccaaggtgagccccgcgcccgccccgccagtggcgccttcccacctaccctgtgcgcggcagggctgcggggccgggcggagaacgggaattttgttccgcgcaggcgtgggagcagcaggcctcggccactctccgcaggcccagccttgggcgcgctgcgaaactgggcccacccgcaccctccagtgagggtttcgaagggaagggaagctgggggcggcgggaggactggggaacttgtgtgctttgtttttgttgatgggaatggggaggagaccggctgagactgccagacacagagacagaaaaggggtgtggagaaagaaagaggaggtaagaaaggaacccagagccagagaaaagcgctcgcccgggtgggcatcagagccccaaggaagaggagaagagaggacagtgtggcctctccctgagtcgggccccagcagtaccgggtccccggaatctcccaccaccccaactcgcagttttccgagtctcttcgcactcccgccttgggaaccacagggttcgttgctgggaagctgtctcgggaccgcgtgcggagcgggaggggggctctcaagctggcagggccggggcttgaggggcaggatgcagccaggctggagtcgttggccattttgaaagtgagtgcgcatacctgtacattcggttcattaaaacacgaatcattaaccggatgcgaaaggcgtcatttatgccgcggacggggcactggcgggagggaaaatgcctaaaaggaggcgggtgcagagggtggaggacactttgaacgcccctcggcttgggagccgctttgtgtttagagtaattttcccgagggcgctaacaattaccctgaatctacaagggggcaagggtgcgccgcgtgcgtcactgtgcccgctcaagtccagcgggcgcaccaacctttgccactccgtcggctttccctcttggccgcggggtagggctgggcgtctttgggccgccgcagggcgccaccctaatcgcctgtcatttctcggccgtcgcaggtgttcgcgcccgagagggatgagcacgtgaagagcgcggcggtggcgctggggcccgcggcctcctacgtctgcacccccgaggcccacggtaacgcctgtcgcggccgctggccactgtaatgggggaaccgcagacagagggccggggtcaaggaaggcctgcgaaggaagacaaggagagagacgcagagaaagagggagagggaaagaaaaataatgaaaacaaggaagctaagctagtactcccaacaacttccaatctttagttacttaaaaacaacagtgacaacgccctctccaccacacgcacacacatgctgcagtacacccagacacggcgttaaacccttaacaaaatcacgcccgacacggccttcaaatcctctcatttattcagcaagtgtgtttggccgcggggtcccctttggctaggccggatcggggcggaggatgggggcacatggccgcgcgcttgggtaccccagaagcgccagggtagctgaggcccatcgcggggtggtgggggccgccctgcacttgcgcgccttaccaggttcctcacagaggaggggttgggggcagcggaaaatcgggcaggtcgaggcagccgaaccccggacgatgtccccccacccaccccgaaggtcgcagcctgggccgcgttctcagcaggagtcgggcggacagacccggcggccacgcgcgctcgcggtgccccagtatctgcgcgcgatgtaggtcgctcgtccctggtgggctcggctgctcgcctagctcttttccaaggggctggggcgggggcctgaagcccggagatgagcagaccaggcgcgggggtggggggtgcccggcccaaagcctcagggcgcgctcctgggcgcacagccgggaaccagaggcggccacgacgcttttaattagggctggggcgccccgaccgcggcagctccggcagtatccgggtcacggtttctttgcctctcttgaaattcggtttgttgccttcaagagccagataaggaagacaatcactcgcccgccgatgatttggaaacgaggaaatcctatccagaccaaaggagtatctcccagccaagtcctgcaaatacagacagaggtgagccagcccttgaacccatcgctctccaccgcacccaggagctgggacccaggtcgcccaggttcccagaggcttgcgagaaaggctttta

SEQ ID NO: 110783 - DNA, 1021 bp, Homo sapiens; identical to SEQ ID NO: 77851
  chr15:68125223-68126244
  Hyper

SEQ ID NO: 110784 - DNA, 100 bp, Homo sapiens; identical to SEQ ID NO: 77852
  chr15:68126468-68126568
  Hyper

SEQ ID NO: 110785 - DNA, 224 bp, Homo sapiens; identical to SEQ ID NO: 77853
  chr15:68126905-68127129
  Hyper

SEQ ID NO: 110786 - DNA, 1010 bp, Homo sapiens; identical to SEQ ID NO: 77854
  chr15:68127492-68128502
  Hyper

SEQ ID NO: 110787 - DNA, 250 bp, Homo sapiens; identical to SEQ ID NO: 77855
  chr15:68260400-68260650
  Hyper

SEQ ID NO: 110788 - DNA, 241 bp, Homo sapiens; identical to SEQ ID NO: 77856
  chr15:68549380-68549621
  Hyper

SEQ ID NO: 110789 - DNA, 65 bp, Homo sapiens; identical to SEQ ID NO: 35785
  chr15:68569420-68569485
  Hyper

SEQ ID NO: 110790 - DNA, 80 bp, Homo sapiens; identical to SEQ ID NO: 77858
  chr15:68569712-68569792
  Hyper

SEQ ID NO: 110791 - DNA, 30 bp, Homo sapiens; identical to SEQ ID NO: 77859
  chr15:68631675-68631705
  Hypo

SEQ ID NO: 110792 - DNA, 810 bp, Homo sapiens; identical to SEQ ID NO: 77860
  chr15:68723523-68724333
  Hyper

SEQ ID NO: 110793 - DNA, 49 bp, Homo sapiens; identical to SEQ ID NO: 77861
  chr15:68851848-68851897
  Hyper

SEQ ID NO: 110794 - DNA, 53 bp, Homo sapiens; identical to SEQ ID NO: 77862
  chr15:68870354-68870407
  Hyper

SEQ ID NO: 110795 - DNA, 265 bp, Homo sapiens; identical to SEQ ID NO: 35787
  chr15:68870820-68871085
  Hyper

SEQ ID NO: 110796 - DNA, 134 bp, Homo sapiens; identical to SEQ ID NO: 77864
  chr15:68871386-68871520
  Hyper

SEQ ID NO: 110797 - DNA, 87 bp, Homo sapiens; identical to SEQ ID NO: 77865
  chr15:68871739-68871826
  Hyper

SEQ ID NO: 110798 - DNA, 30 bp, Homo sapiens; identical to SEQ ID NO: 77866
  chr15:69109310-69109340
  Hyper

SEQ ID NO: 110799 - DNA, 198 bp, Homo sapiens; identical to SEQ ID NO: 77867
  chr15:69136224-69136422
  Hyper

SEQ ID NO: 110800 - DNA, 30 bp, Homo sapiens; identical to SEQ ID NO: 77868
  chr15:69265691-69265721
  Hypo

SEQ ID NO: 110801 - DNA, 17 bp, Homo sapiens
  chr15:69324757-69324774
  Hypo
tttttttttctgagacg

SEQ ID NO: 110802 - DNA, 192 bp, Homo sapiens; identical to SEQ ID NO: 77870
  chr15:69366538-69366730
  Hyper

SEQ ID NO: 110803 - DNA, 36 bp, Homo sapiens; identical to SEQ ID NO: 77871
  chr15:69367021-69367057
  Hyper

SEQ ID NO: 110804 - DNA, 152 bp, Homo sapiens; identical to SEQ ID NO: 77872
  chr15:69591361-69591513
  Hyper

SEQ ID NO: 110805 - DNA, 93 bp, Homo sapiens; identical to SEQ ID NO: 77873
  chr15:69754330-69754423
  Hypo

SEQ ID NO: 110806 - DNA, 30 bp, Homo sapiens; identical to SEQ ID NO: 15908
  chr15:70075720-70075750
  Hypo

SEQ ID NO: 110807 - DNA, 38 bp, Homo sapiens; identical to SEQ ID NO: 77875
  chr15:70347537-70347575
  Hypo

SEQ ID NO: 110808 - DNA, 120 bp, Homo sapiens; identical to SEQ ID NO: 77876
  chr15:70617030-70617150
  Hypo

SEQ ID NO: 110809 - DNA, 30 bp, Homo sapiens; identical to SEQ ID NO: 77877
  chr15:70708037-70708067
  Hypo

SEQ ID NO: 110810 - DNA, 217 bp, Homo sapiens; identical to SEQ ID NO: 77878
  chr15:70877477-70877694
  Hyper

SEQ ID NO: 110811 - DNA, 46 bp, Homo sapiens; identical to SEQ ID NO: 77879
  chr15:71054883-71054929
  Hyper

SEQ ID NO: 110812 - DNA, 43 bp, Homo sapiens; identical to SEQ ID NO: 35791
  chr15:71055227-71055270
  Hyper

SEQ ID NO: 110813 - DNA, 123 bp, Homo sapiens; identical to SEQ ID NO: 77881
  chr15:71055857-71055980
  Hyper

SEQ ID NO: 110814 - DNA, 18 bp, Homo sapiens
  chr15:71117912-71117930
  Hypo
tttttttttttgagacgg

SEQ ID NO: 110815 - DNA, 219 bp, Homo sapiens; identical to SEQ ID NO: 77883
  chr15:71145980-71146199
  Hyper

SEQ ID NO: 110816 - DNA, 328 bp, Homo sapiens; identical to SEQ ID NO: 77884
  chr15:71146426-71146754
  Hyper

SEQ ID NO: 110817 - DNA, 30 bp, Homo sapiens; identical to SEQ ID NO: 77885
  chr15:71184469-71184499
  Hyper

SEQ ID NO: 110818 - DNA, 30 bp, Homo sapiens; identical to SEQ ID NO: 77886
  chr15:71185265-71185295
  Hyper

SEQ ID NO: 110819 - DNA, 442 bp, Homo sapiens; identical to SEQ ID NO: 77887
  chr15:71408156-71408598
  Hyper

SEQ ID NO: 110820 - DNA, 30 bp, Homo sapiens; identical to SEQ ID NO: 77888
  chr15:72040931-72040961
  Hypo

SEQ ID NO: 110821 - DNA, 225 bp, Homo sapiens; identical to SEQ ID NO: 77889
  chr15:72102723-72102948
  Hypo

SEQ ID NO: 110822 - DNA, 17 bp, Homo sapiens
  chr15:72411795-72411812
  Hypo
tggaggtcatttagccg

SEQ ID NO: 110823 - DNA, 197 bp, Homo sapiens; identical to SEQ ID NO: 44301
  chr15:72412112-72412309
  Hypo

SEQ ID NO: 110824 - DNA, 30 bp, Homo sapiens; identical to SEQ ID NO: 44302
  chr15:72462639-72462669
  Hypo

SEQ ID NO: 110825 - DNA, 249 bp, Homo sapiens; identical to SEQ ID NO: 77893
  chr15:72476661-72476910
  Hyper

SEQ ID NO: 110826 - DNA, 147 bp, Homo sapiens; identical to SEQ ID NO: 77894
  chr15:72490031-72490178
  Hyper

SEQ ID NO: 110827 - DNA, 766 bp, Homo sapiens; identical to SEQ ID NO: 77895
  chr15:72564641-72565407
  Hyper

SEQ ID NO: 110828 - DNA, 399 bp, Homo sapiens; identical to SEQ ID NO: 77896
  chr15:72581446-72581845
  Hypo

SEQ ID NO: 110829 - DNA, 125 bp, Homo sapiens; identical to SEQ ID NO: 77897
  chr15:72743646-72743771
  Hypo

SEQ ID NO: 110830 - DNA, 29 bp, Homo sapiens
  chr15:72768983-72769012
  Hypo
tcagccaccgtgcccggcctgtagaagat

SEQ ID NO: 110831 - DNA, 177 bp, Homo sapiens; identical to SEQ ID NO: 77899
  chr15:73611026-73611203
  Hyper

SEQ ID NO: 110832 - DNA, 92 bp, Homo sapiens; identical to SEQ ID NO: 77900
  chr15:73615572-73615664
  Hypo

SEQ ID NO: 110833 - DNA, 121 bp, Homo sapiens; identical to SEQ ID NO: 77901
  chr15:73617637-73617758
  Hypo

SEQ ID NO: 110834 - DNA, 30 bp, Homo sapiens; identical to SEQ ID NO: 77902
  chr15:73639194-73639224
  Hyper

SEQ ID NO: 110835 - DNA, 1325 bp, Homo sapiens
  chr15:73659600-73660925
  Hyper
aatgcagcccagacccgagaagaccagtgactgaacccagaggaaagttcccccagcgcggtgcaggagggggcctgggggtgtctcggagcctagaggcgccctgcctctcttggagctcccagcgcaaggcaggaaagttaactccggctgggaggcagggtcaggaggaggcatgcctgccaccgcgcagggcacccacaggatcatcgctgtggccccttacctgaagtcactgtaggggtggataatccaaaatccggccgacttgaccctctcctgttcgcgctccacggctttctggctgccgaacatccttagggagaatttgttgaccccgggttggagcatggccccgaactggcgctgcatgaagccggcctggcccaggcgcacctcggcctccgggaggatctggtcgccggcagccgcgcctccctccactttgatagcggtgtccaccgagggctgctcgcaggaggcggaggccggctgcggtggctgctggggcggcggcggcgaggctgcgggctgcgccgaggcgccggggcgctcgggctcggccgccaggcctgggggcgtcctgtcctcgccgggggacgcgtcgccctcggcgatgagccgccgctcctccgcggagtcatgcaggtgtccgtgactgctgccgctccccgtgccgccgctgccgccgccccggctgcccagcgaggccaggctcccgcggaagcgcctgcagtcgccgttcgtgctggacttgcccgcgccgcgggccggcccttcgctgtccgctgccccgagggccgagctccgggactccgtgccacccgcggccgccgagggggagggcgagggcagtggccgcagccggatgctcctgcggctggggtcttggcggcccccggccccctcctcctcggcgtcctcttcctcgtccatgatccacgccttggcccccacctgctgcgggaggctgtagagccgcttgcgcatggacggcggcagcttgtccatggcgccaggggccggggtcggaccgggccgggggcaggagcgcggcgccgcggacgggctccaggtccgcccgccggtcagtccgcccgtggggacgcgtcctttgccgccggcgtgggggcagcctcaggcgcccatgcttgggcaggctgcgcgccgcggggaggatcctagtcccgctccgagtccccgggctcgccgcgctacacctcctcccgggcccggctgggcgcggggaccccgcgctcccttcttgcctccctccctccctctggcgttcaggggcgcggcgcgccgcccggctccaggcgccc

SEQ ID NO: 110836 - DNA, 292 bp, Homo sapiens; identical to SEQ ID NO: 77906
  chr15:73661569-73661861
  Hyper

SEQ ID NO: 110837 - DNA, 30 bp, Homo sapiens; identical to SEQ ID NO: 44306
  chr15:73919229-73919259
  Hypo

SEQ ID NO: 110838 - DNA, 557 bp, Homo sapiens
  chr15:74044686-74045243
  Hyper
ggggtcgggaatgagcgagggtccggcagatttggggctccgaggccacaggtgaccggggcgcggggaggccgaggagacgccgggcaggtcccagcgcgtgagccaaagtcggagggctgggagggcgccgggatcccctcagcccacgcccggcattccccgggctctgcaccgtccgggattcgctctgtccagtccagatcggccgggtccgtgttccgctggggtctgccctgccctaccccgcccggagtgagctggcaccgccgggcgcccgggacgcgctcagcccggacccagaacgtccgtgccccggcacccgcggcgtccggagcggccgcgagggtctgctcagcccagccccgcggtcggccctgggcgagaccgctcccacggctcagttcacgttccgaaaggtccggaatccaccgggtccccgaggaggggcgatgtcagccgcggggacccggtccccgccgggcccagccgagagcgcgcgaagccgggggccccggccgggctgggttcggcggcccgggcgcaggcgggagcag

SEQ ID NO: 110839 - DNA, 243 bp, Homo sapiens; identical to SEQ ID NO: 77910
  chr15:74045655-74045898
  Hyper

SEQ ID NO: 110840 - DNA, 137 bp, Homo sapiens; identical to SEQ ID NO: 77911
  chr15:74219483-74219620
  Hyper

SEQ ID NO: 110841 - DNA, 38 bp, Homo sapiens; identical to SEQ ID NO: 77912
  chr15:74264561-74264599
  Hypo

SEQ ID NO: 110842 - DNA, 143 bp, Homo sapiens; identical to SEQ ID NO: 77913
  chr15:74392457-74392600
  Hyper

SEQ ID NO: 110843 - DNA, 293 bp, Homo sapiens; identical to SEQ ID NO: 77914
  chr15:74420441-74420734
  Hyper

SEQ ID NO: 110844 - DNA, 955 bp, Homo sapiens
  chr15:74421964-74422919
  Hyper
gcgcctccgcctcctcgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaat

SEQ ID NO: 110845 - DNA, 86 bp, Homo sapiens; identical to SEQ ID NO: 77916
  chr15:74428149-74428235
  Hyper

SEQ ID NO: 110846 - DNA, 386 bp, Homo sapiens; identical to SEQ ID NO: 77917
  chr15:74428737-74429123
  Hyper

SEQ ID NO: 110847 - DNA, 505 bp, Homo sapiens
  chr15:74658090-74658595
  Hyper
gtgagctcgggtgaacgcagcgagcgagggcagaggccagcagaggcgaggagtggatgctgcagggccgcaggccgggcagagaaacgcataccgggtcgctccctgcttcgccgccgcctcctggcagggccagcgaagccagtgctccagcgcccccgtaacacctcaaagcgcacggagtccgtgttggggaacttggcggcagagtgactgggacctaggacctgcggtggggccgccgccgcctccgcggggccgagcgcctggacctcgccctgaggtaaacgcgggtcgacccggggggcggatgggctcgggctgtgtcgaggggaggcggaggtgagcgacccgcgaagagcgcaggagcaggccgggggccacgctagggcggacccaatttcggaatagcgcggcccgggcggcggcgtgcgctgggaggaatgctgggtctgtcgctagcgccaaacttgaccacgctgcgaccttttcactctgtgctctg

SEQ ID NO: 110848 - DNA, 157 bp, Homo sapiens; identical to SEQ ID NO: 77921
  chr15:74679719-74679876
  Hypo

SEQ ID NO: 110849 - DNA, 30 bp, Homo sapiens; identical to SEQ ID NO: 77922
  chr15:74686156-74686186
  Hypo

SEQ ID NO: 110850 - DNA, 104 bp, Homo sapiens; identical to SEQ ID NO: 77923
  chr15:74790274-74790378
  Hypo

SEQ ID NO: 110851 - DNA, 17 bp, Homo sapiens
  chr15:74818772-74818789
  Hypo
taataactcctttgccg

SEQ ID NO: 110852 - DNA, 46 bp, Homo sapiens; identical to SEQ ID NO: 77925
  chr15:74903896-74903942
  Hypo

SEQ ID NO: 110853 - DNA, 30 bp, Homo sapiens; identical to SEQ ID NO: 77926
  chr15:74911209-74911239
  Hypo

SEQ ID NO: 110854 - DNA, 188 bp, Homo sapiens; identical to SEQ ID NO: 77927
  chr15:74911445-74911633
  Hypo

SEQ ID NO: 110855 - DNA, 30 bp, Homo sapiens; identical to SEQ ID NO: 77928
  chr15:74953756-74953786
  Hypo

SEQ ID NO: 110856 - DNA, 35 bp, Homo sapiens; identical to SEQ ID NO: 77929
  chr15:75018960-75018995
  Hyper

SEQ ID NO: 110857 - DNA, 214 bp, Homo sapiens; identical to SEQ ID NO: 77930
  chr15:75118706-75118920
  Hyper

SEQ ID NO: 110858 - DNA, 171 bp, Homo sapiens; identical to SEQ ID NO: 77931
  chr15:75119374-75119545
  Hyper

SEQ ID NO: 110859 - DNA, 30 bp, Homo sapiens; identical to SEQ ID NO: 77932
  chr15:75134683-75134713
  Hypo

SEQ ID NO: 110860 - DNA, 101 bp, Homo sapiens; identical to SEQ ID NO: 44311
  chr15:75143124-75143225
  Hypo

SEQ ID NO: 110861 - DNA, 87 bp, Homo sapiens; identical to SEQ ID NO: 77934
  chr15:75205464-75205551
  Hypo

SEQ ID NO: 110862 - DNA, 238 bp, Homo sapiens
  chr15:75248605-75248843
  Hyper
gccacacctcgcgtacgctccggtagcgcagccgcgtgacctggtgcaggcccgccaggcggcgcttgaggatctcggcgcacgtgacggttttggtggtggcccggccgcagccgctgaagacgatggcgcgcgtggctggctgcgccatgctggcggtggcgaaggccatcaggttccggatcttgctgccttccttgacccgcatgtgcaccgcgcccggcgccaggtctgcgaa

SEQ ID NO: 110863 - DNA, 30 bp, Homo sapiens; identical to SEQ ID NO: 35815
  chr15:75250808-75250838
  Hyper

SEQ ID NO: 110864 - DNA, 766 bp, Homo sapiens
  chr15:75251045-75251811
  Hyper
tcctgggagtggctgcggcgactggaccttggcaccgcaatgtgtgaatggctgaccccctccccgtctcctggtgggatcaggaaccctcggggtatgctccgaaccgggacttcggtctcggtccagtctccatgggccccacacagcggtgggggctggaggcacagcagccttgggaagaaacaaagactgtccgcagcgcgtagcggggcgtggagaaccgagggctgtgtaaggtcaggccctgagaaaaagcccccgaaaggctggaagttacgttggaacgggctggttgtggaaggagcgagctctccgtccccgggagtatgcaagtttgggctgcacgatcacttggaagggattgggcggagttctgtcatttggagaaagggtcctgggagcttcaggtttgtgtagggcgaggacggggcggttctgcgtccggccaggttggccctcgaggacccagccgtccccaacctcctaaactgctgtcggatgtagaagactcgcattcactgctctccacagtcggtgaagggagaacgccgaaaagggccgcattccctcctgccggtcccctccccttcccgcgctccctctgcagcacttaaaatgtaaatgtacatcgtgattagccgcggggtcgctaattacagctgaagccattcattacactgtcagcgcgcgtcgcagcccgccggctgtgcgctccctcctagccgtgaaggggtgtagggggtgggggcgggagatgcgggga

SEQ ID NO: 110865 - DNA, 30 bp, Homo sapiens; identical to SEQ ID NO: 77939
  chr15:75288351-75288381
  Hyper

SEQ ID NO: 110866 - DNA, 336 bp, Homo sapiens
  chr15:75470896-75471232
  Hyper
ctgtggggggtggggcggggccggtggccgcgactccaccccgcgcccctagtcgagtaaacaagccacgggcggcgcctgggggccgctcctgcaagccggggcgctgggttacatcacggttccctggagactcccgccccagcggccgggtccctgaggcccgcgcccgcccgccgcctgtgtccgagaagcagagagctggcaagggcccgccagggcgggaaggctcccacgttttctccggaggcccctgggactttgttgcaattgggttcagcccgggcatgggctgaacgtggacgcgcgggaaccgcgcctcggtttccccatctg

SEQ ID NO: 110867 - DNA, 30 bp, Homo sapiens; identical to SEQ ID NO: 77942
  chr15:75516785-75516815
  Hypo

SEQ ID NO: 110868 - DNA, 50 bp, Homo sapiens; identical to SEQ ID NO: 77943
  chr15:75990686-75990736
  Hypo

SEQ ID NO: 110869 - DNA, 122 bp, Homo sapiens; identical to SEQ ID NO: 77944
  chr15:76005149-76005271
  Hyper

SEQ ID NO: 110870 - DNA, 38 bp, Homo sapiens; identical to SEQ ID NO: 77945
  chr15:76012901-76012939
  Hypo

SEQ ID NO: 110871 - DNA, 56 bp, Homo sapiens; identical to SEQ ID NO: 77946
  chr15:76195506-76195562
  Hypo

SEQ ID NO: 110872 - DNA, 86 bp, Homo sapiens; identical to SEQ ID NO: 77947
  chr15:76197435-76197521
  Hypo

SEQ ID NO: 110873 - DNA, 100 bp, Homo sapiens; identical to SEQ ID NO: 77948
  chr15:76351669-76351769
  Hyper

SEQ ID NO: 110874 - DNA, 30 bp, Homo sapiens; identical to SEQ ID NO: 77949
  chr15:76372926-76372956
  Hypo

SEQ ID NO: 110875 - DNA, 30 bp, Homo sapiens; identical to SEQ ID NO: 15913
  chr15:76510088-76510118
  Hypo

SEQ ID NO: 110876 - DNA, 524 bp, Homo sapiens
  chr15:76627514-76628038
  Hyper
aggtggaggcggagctcaaaagccggacgctactggacgaggcttaaagcgctcgccccagcgcggggccggtgaggaacgttcaccgtggaccatggtcgaataatgttagcgtgcactcggggcctcgccctagccttctgcaaagcctcggcctgcgccctcggctgcatccgtttcgacgccaaccaacctcatgctcttagtagaacggcagtagcgaccgcgccctcaggcccacaagcccgaaggtctgggcagggtctggaatggcggtggagacactttatccgcaggcgtttcacctcgcgccccacccaggcgcacaccaagttcttggtactccttttaatgggaaaacaagaacagacaccatggttggataaatgttatttataattcatgggccggtctttgaaccctttcaaacaaaacccacagcgatttctttgaaagaatgcctggactgtgctcagagctctcagattttctcaggaccaacgagccgccgcctcgcagatacc

SEQ ID NO: 110877 - DNA, 893 bp, Homo sapiens
  chr15:76628327-76629220
  Hyper
gaggggcagcagcagcggcagcagcagcaaggatggagtcaggacccgtcccagtcccgggtgagcgcttttggatctgggttctggctcaacccacgtaatgccccaatctaaagttttctacgtgtgtgtggataggaaagtctaaatagagtttatcagaacccaggtggtcattctctacactctctctagcttggacccgaagaacaaaggcacatgagaggagaaaggtgaccagctggacgatgacggtcacgtccaaacggatcccccttgtcctcggctctctcgtcctgagagtgggtttaatttttttttttttaatttatataagaagggagctcttaaaggagagccatctccaccctcaggtatccatcacccagctccagcgcgcctgggaaaaccgccccgaaagtccaagaggaagctcagagttgtaacggccgcggagccagctcggcggtgacgcaaggtccagtccagattgccaggcccggggcatgagagaggatccttgtaggtttcggaggtgggggggctgcactccattgttcactccgggccaatcagggttggcccacttcctcccagccaatctcccttcacccccagcctccaacccaacccaccccgcccatcagcccctggatccccatcacctcccccgcatccccggcagttctggggaagcttcgtgacgccacaggtcccgcccccagctccggcccggggctagtgcgtgttgacgtcatgctgcgtgcgggccggtgcggaatcgctccttcaactccgcggggcagtaggagttagttagcaaagagccgaggccgggcgcgcgaccctcgtccttctgcccctggccgcacactttgcgcacatctcttttt

SEQ ID NO: 110878 - DNA, 1344 bp, Homo sapiens
  chr15:76629665-76631009
  Hyper
gtctgagaggatgagcggggactgccgaaagacgatgtgtctgtgttgggataggaggcagccgctgtgagtgggagtgtgtgagcggaaatgccaggacagcaccgttaggtgttgatatccaggcgtccgcagtgcctgtgtatttactctcttcttagtttcgtgtttgcgtttagtttcaagacacgtcgacaaaacgactgtcattaatgaatgtaataacgaaatatttggggtgggggacagaagaaaccttcagcaatccacaagatactggtttttcgtttccaatgccctggacctttagagagctcatcatctttccttatggtcgcaagtcttgaaagaaagagcaagagagcgagcgggttgggttggggctggagtagccgaggccggcctgggtccgggcagtcaggcctgacgcggccccgcgcccttccccggcagagaagcccgggacggccatgtgcgtgggctgcgggagtcagatccacgaccagtttatcctgcgggtgtcgcccgacctcgagtggcacgcggcctgcctcaagtgtgccgagtgcagccagtacctggacgagacgtgcacgtgcttcgtgagagacgggaagacctactgcaagcgggactatgtcaggtgaggccggcgggaacgcgggctgggccaccgcgcgcaggggccggggccgggactggggatggcggcctgcccgcgcgccccggccctgcccagggagaaggccatccgcatcccgcacgggtgccgcagcgctcccccgggcccgggaatgcccgcaggcgggtcaccgcagtctcctggtggccacaaagtgtcctgggcgcgcgccggagccgtagcagccagggagatgagggcggccgcaggcccagcgctgacaccgccgcaccttgggcccgcaggctgttcggcatcaagtgcgccaagtgccaggtgggcttcagcagcagcgacctggtgatgagggcgcgggacagcgtgtaccacatcgagtgcttccgctgctccgtgtgcagccgccagctgctgcctggggacgagttctcgctgcgggagcacgagctgctctgccgcgccgaccacggcctcctgctcgagcgcgccgcggccggcagcccgcgcagccccggcccgcttcccggcgcccgcggcctgcatctgcccggtaagcgcgccggggcctgtgccggggtgagcggggtgtatgtgcgtgcgtgtgtgtaggggtacgcttgtgtccctaacgagaagttgtcagttgtgtgtggttccgtctgccgggatagtgtttttctgtatcagtgcggaactgtgtgctg

SEQ ID NO: 110879 - DNA, 672 bp, Homo sapiens
  chr15:76632131-76632803
  Hyper
gccctcgtaggcccccggcatattcgcacctcccacccagtcccctgggcagcgcctcgccctgggtccacgtcggtccctttccctctccagagtcctgggcaagcctctttcctcttcctctgaaactccgacttcttccggagggcttcgctcgttccgagggtcctgcgactggaggaggcacatccctgagcagccactccctccccgcagcggcctgtcgccgagctcccgcgccctgcttgagctcgggagagatcgctgcggggcagtccggcccgggagcgagagaaagaacgaaaatgcacagctctctccgagtaaggcgaacagatggagaggaagacgaacaattaaacgaaacaaacagaataaaacagaaacgaaatcgggccccggggggctgggccacccggaggttgggctcggggcgggtgggtggcggcccctcgctaacctctggcctcaccctgtcctggcagacgctgggtcgggccggcagcccgcgttgcgcccgcacgtgcacaagcagacggagaagacgacccgcgtgcggactgtgctgaacgagaagcagctgcacactctgcggacctgctacgccgccaacccgcggcccgacgctctcatgaaggagcagctggtggagatgaccggcctgagcccgcg

SEQ ID NO: 110880 - DNA, 30 bp, Homo sapiens; identical to SEQ ID NO: 77960
  chr15:76633746-76633776
  Hyper

SEQ ID NO: 110881 - DNA, 48 bp, Homo sapiens; identical to SEQ ID NO: 77961
  chr15:76634240-76634288
  Hyper

SEQ ID NO: 110882 - DNA, 785 bp, Homo sapiens
  chr15:76634951-76635736
  Hyper
gggggtggggctgggcgcatgcgcgctgagggccctcccagaagcaggagcgccccattggcgacccctgggcacctggcggcccaggcccgcgggcaggaggcgggacccgtttgggcgggaaacctgcggcacttgtggcggttgagcggcggactccggcctagggttatgcgggcgagggcgcgccccgctcccggaaccagccttggcctggcgcctgccgagccccgagccccactctcgctcggcgccgcgggccctcccggcgcttccttccccagcggtccgcggccctgggtgaggctcgaagccccgcgcgctgcccctggccctgcagcacagcagtgaggccaaccccggccagagcgggcggccgtgacgggccgtgccccgcgctgtccccggagtggatgcgcgacgtgatcaatccgcggcatttattaattccacagtctagacagaggcgggggccgggcggcggctgcttatctgcgtttggcatcacctgcaagcgatacaccgaggggccgcaacgagcccccgctaggagcgcggctgccgggaaaataagtccacccagaaccagtctggcgtgtccttggtttattttctttccagaccgaagtggagggggtcgggggtggcccgggtgggagggagctgggaatggcccctggatatgccgtgcccaggtcacttggtgtgacatttcaaacccctgcgacttgttttcttgaaaactggctttagtgatcgcaggaaataaccgagagatactgaat

SEQ ID NO: 110883 - DNA, 809 bp, Homo sapiens
  chr15:76638317-76639126
  Hyper
ggtcagctgttagggcgtgggggagggagggggcagggagcagggacgaggaagtggaagaataggggattgtgaggagtgatttctttccagattatcgagactcaagactttccagaacgtggcaaagagccctggaagaaatgtcccaggaacgccgcggtcaggaccgaggctccccggggccaggttcagggttcgaggtcccagcctcgcaactgctggcgtctggagggcgggagagtggccgggcccgaagctgcggctccgacgtacagttgcgagtctggggcggtgggccccgcagagctccgggggaagggagccgccgccgctgcggggaattggcttgggcaacgccgctgagtgttcaaacgtcgctgctcccgggccttgggcagcctctcctacctgacccaaattctgggctgcaaagcccgggcgaagttgtcgctttcactccgaatacgcccagtcgcaccgtcaacttcataggctgggcccggcagaggcctttcgcctccgcccagcggtctccgctgcggcccctcagcctctggagagccggggggcggccctcgccccggcagaaagcaacctgtggcggcactgcgtccccgcgagctacaaccagacgcggccgcgctcacctgggcgttgcgctcccccgagccccggagagtttagaagccgtaaaagcccggggagctggagcttaaatcgcccggaccgggccggggcgcccgaaagcagtgaactcgagacccccaggaaccgcgtgcgccgggaggcaccgggacgctcccggg

SEQ ID NO: 110884 - DNA, 115 bp, Homo sapiens
  chr15:76639564-76639679
  Hyper
ctcagcccggccctgcggctccgggagttgctgagcactcgcggccagcggctggagtcctgggtcccgctctctggtgcccggcggcggagtcgccacgcgaggctggaggggt

SEQ ID NO: 110885 - DNA, 30 bp, Homo sapiens; identical to SEQ ID NO: 77966
  chr15:77198053-77198083
  Hyper

SEQ ID NO: 110886 - DNA, 26 bp, Homo sapiens
  chr15:77448975-77449001
  Hypo
atcttggctcccgaaataaaataatt

SEQ ID NO: 110887 - DNA, 78 bp, Homo sapiens; identical to SEQ ID NO: 77968
  chr15:77852833-77852911
  Hypo

SEQ ID NO: 110888 - DNA, 247 bp, Homo sapiens; identical to SEQ ID NO: 77969
  chr15:77906751-77906998
  Hypo

SEQ ID NO: 110889 - DNA, 39 bp, Homo sapiens; identical to SEQ ID NO: 77970
  chr15:77908085-77908124
  Hypo

SEQ ID NO: 110890 - DNA, 444 bp, Homo sapiens; identical to SEQ ID NO: 77971
  chr15:77924553-77924997
  Hyper

SEQ ID NO: 110891 - DNA, 260 bp, Homo sapiens; identical to SEQ ID NO: 77972
  chr15:77925465-77925725
  Hyper

SEQ ID NO: 110892 - DNA, 258 bp, Homo sapiens; identical to SEQ ID NO: 77973
  chr15:77927171-77927429
  Hyper

SEQ ID NO: 110893 - DNA, 950 bp, Homo sapiens
  chr15:78111427-78112377
  Hyper
agccccaagcgtgcacgccccccacggacgcgcacccagcaccccacccccgccgctgcccccgaggctcccgcccaatcagaggccgcgcgcgccgcgccgccggcgggcagacacaccggctccccggcctgcgcccctgcggccctggccccgctgcagcgtcccggcccggccacactcaccgtcccgggcgcgccgtccgcgcgcggctccgctccgggccggcatcccccggctcggctgcctccggtccccgctccggcctcggttcccgctccgcagggctcggctccgcgatggtggccgcggcggcgagcgcggcagggagggcgtgtgtatgcgcgtgagagcgcgcagcgtgtgcatgtgcgtgtgcgcgggagggtcccggctcccctgcgcgtcccgctcctgcctcctgctcgccacgatgcgatgccggcagaatctctaccgcgcgcccccactgcccggcgcccacactcgcgcacacacgcgcacacccaggcgcgcacacccggctccgcactcccgactcgccctcctggagcgctcacaaagaccccctgccgggacggccggagcctgcggagcgcggccctgggcccctccgggacccgccggccttaggtgccccgctgctccccgtagggaccccgcgggcggcccggctcccgcaccctgcctggccgggccgcggccgcgctcccagcccgaacctgggcccaggtgccgactcgggcttctcgcactcccgcgggaagcgccggccccctccgcggcgccgccgcccttctcccccccttccagtccggcctctccggcgcctccctgccttgtcccacctgcccagcccggtcctcgttctccccgctgctctccgtctgtctcgccgccgccctctcccgcgccccttcctccccaccgccctgcgctgcctctcacat

SEQ ID NO: 110894 - DNA, 408 bp, Homo sapiens; identical to SEQ ID NO: 77976
  chr15:78236748-78237156
  Hyper

SEQ ID NO: 110895 - DNA, 30 bp, Homo sapiens; identical to SEQ ID NO: 44317
  chr15:78252931-78252961
  Hypo

SEQ ID NO: 110896 - DNA, 48 bp, Homo sapiens; identical to SEQ ID NO: 77978
  chr15:78277490-78277538
  Hypo

SEQ ID NO: 110897 - DNA, 79 bp, Homo sapiens; identical to SEQ ID NO: 77979
  chr15:78327585-78327664
  Hyper

SEQ ID NO: 110898 - DNA, 30 bp, Homo sapiens; identical to SEQ ID NO: 77980
  chr15:78486343-78486373
  Hypo

SEQ ID NO: 110899 - DNA, 166 bp, Homo sapiens; identical to SEQ ID NO: 77981
  chr15:78501776-78501942
  Hypo

SEQ ID NO: 110900 - DNA, 30 bp, Homo sapiens; identical to SEQ ID NO: 44320
  chr15:78503615-78503645
  Hypo

SEQ ID NO: 110901 - DNA, 56 bp, Homo sapiens; identical to SEQ ID NO: 77983
  chr15:78506312-78506368
  Hypo

SEQ ID NO: 110902 - DNA, 43 bp, Homo sapiens; identical to SEQ ID NO: 77984
  chr15:78556892-78556935
  Hyper

SEQ ID NO: 110903 - DNA, 168 bp, Homo sapiens; identical to SEQ ID NO: 77985
  chr15:78557205-78557373
  Hyper

SEQ ID NO: 110904 - DNA, 23 bp, Homo sapiens
  chr15:78571000-78571023
  Hypo
cttttttttttgagacggagtct

SEQ ID NO: 110905 - DNA, 214 bp, Homo sapiens; identical to SEQ ID NO: 77987
  chr15:78596058-78596272
  Hypo

SEQ ID NO: 110906 - DNA, 167 bp, Homo sapiens; identical to SEQ ID NO: 77988
  chr15:78609740-78609907
  Hypo

SEQ ID NO: 110907 - DNA, 30 bp, Homo sapiens; identical to SEQ ID NO: 77989
  chr15:78617409-78617439
  Hypo

SEQ ID NO: 110908 - DNA, 888 bp, Homo sapiens
  chr15:78632506-78633394
  Hyper
tccccagttggagagcgggtgcccgcacctctggaggctgaggcacaactgggctgggagttgagcgcataccgagtaggggctgcgggggagcgggggcagggccggcggggcggggccagaagcccggcggggttgggggcgctctcctagtgactcaaggcgcgcagcgctgggcgcaaagcgccagtctccgccttgcgagctcagagtgtgcccgctgcgccgccgctgtccgtacctgccgccgccgccaccgccaccatgcccaacttcgccggcacctggaagatgcgcagcagcgagaatttcgacgagctgctcaaggcactgggtaagctggtgcagagggcgcgccccgacggggagatgcggcccggaggtgccctggtcccggaagtgccccggtcctggagggggtggaagttggggagcccaggcaggagggagtccccggggcaatagatcgccttgtctcccaggcgcaccgggtctcggagaagctggtagagatcccggaacccacgcgttcagcgaacgtttgctgaatgtttggcgccctcctcgatggtgcggactttatctcgtgctagatcatagcgaggagagattactggagagcaaggaggatcagggacttaaatttggagactcaaatttgggaccaggctctgccacgaattcactgtgcaactcgaggaaagtcacttaccctctctgtgcctcagtctctcatctcgaaaacaagggcgagggcagggaaacgagtggatcaattttaaggcccctttctaaagttagggtatgaccagtgcccgaccggtcccgagactggcggcgaggccccgtgacccaagcctgtggtgcaccctgcgcaggtgtgaacgc

SEQ ID NO: 110909 - DNA, 1461 bp, Homo sapiens
  chr15:78912231-78913692
  Hyper
tcccaggcaggaggtcggttgagagcgtatggcgttctgagtagtgcaggcctcggcaccgagggcggaaagcgctctgagctcacagccgcacgacagaccgccggcctgggccctccaggaattccctgcagccttgcccggtccccgactctcgctacccaccagccctcccaggcacccaagagcctcccagcggcgggccagggccggcttcccccagcaggctcctctggagagcgggaggaagacaggaggcgctctcccggtggagggtccctcagcgacgcagccaggagcgctaggaggctacaaccggaggagaggctggcgctccagctccagccccagtcccgaagcgactcccctcttcccgaggtggccttggccaagtcttcagccatctccgtcaaatgaggaggtgggcgggatgcagacggtggagcgggaggcttgggcgcgccagtttgggagccagtgcgcggggcagggcgacgggcagcgcggggacgcgaatccccaactcctgcgcccaagacgaaggacccggtctcgacctccccatcacccggcgcgtaccagcgcccgctcagtgactcccaggtttggtggtggctaggggtgggaggtgagccgaaagggaaaaagccaccccacccaagtcgccgccgggctggagccagtctgcgcgggttccgagtccccggcgacggcgccagccctctccgctcgcccgcgcggtgttctcgccggcagcccctccggaccccgcgccccttctcgggcgcccgtccctccggagccctaacgcctgtgcgcgtacctggcagcagagacagcagcagcagcagcagcagccgcggcggcgacagcgccaggggcagcgagagcgggccagagcccatggctggtggccgggctggccgcggacccggacggtcgggagcgggcgcggcggtcgcagagacggcctctccccgcgcggctccagcgcagaccccagacctggagccgtgcgggcggagacgcgcggggctcctctccgcttcgccgccgctgggtttccagcgccctcggacccgcgggaggacaggaaccatccggagtgaagctgcgccaggcgcgggcgggcgggcgggcgtgcgcggggcggggcgtacgtgcggtaggggaaggggctccaggtcccagtccccagcgccgggcgagctccttctccgccgggctgggtgctccggccggcggcgtccgaccagatctgagcaggtgctgtcaccaccaccaggaaggagagggactcagtttctgtcccaggtttccggggcgtgtgcagctcccgcagggggttgggaccaccgggctaggcgggcgccgtaggagagacgctaacacaccctgggaaggacgccttgtgtatctcatgctattaaataattgttaaatattttagccgggagcagt

SEQ ID NO: 110910 - DNA, 312 bp, Homo sapiens; identical to SEQ ID NO: 77996
  chr15:78933373-78933685
  Hyper

SEQ ID NO: 110911 - DNA, 68 bp, Homo sapiens; identical to SEQ ID NO: 44323
  chr15:79055979-79056047
  Hypo

SEQ ID NO: 110912 - DNA, 71 bp, Homo sapiens; identical to SEQ ID NO: 77998
  chr15:79057076-79057147
  Hypo

SEQ ID NO: 110913 - DNA, 92 bp, Homo sapiens; identical to SEQ ID NO: 77999
  chr15:79059735-79059827
  Hypo

SEQ ID NO: 110914 - DNA, 102 bp, Homo sapiens; identical to SEQ ID NO: 78000
  chr15:79064055-79064157
  Hypo

SEQ ID NO: 110915 - DNA, 41 bp, Homo sapiens; identical to SEQ ID NO: 78001
  chr15:79103265-79103306
  Hyper

SEQ ID NO: 110916 - DNA, 30 bp, Homo sapiens; identical to SEQ ID NO: 78002
  chr15:79104054-79104084
  Hyper

SEQ ID NO: 110917 - DNA, 27 bp, Homo sapiens
  chr15:79163864-79163891
  Hypo
agagggaaactccgtctcagaaagaaa

SEQ ID NO: 110918 - DNA, 1479 bp, Homo sapiens
  chr15:79381789-79383268
  Hyper
ctcaggaaaccagagcgcagcgctatagccgcgactgcggcggcggcggcggcgcagggggcgggggaggagagaagcgcccacttcgtcccgctgcctccgcagcagccctggccctagccccggcgcatcagagcggtccttgggaatctttgggcttgttgctccggcggccgccagctgggagcccaccaccgctcgatggtaccgaaccgacccgtgtagccccataaccccagcccaactccgaggagctagcgcagaccgctctccgccctcagctgcggcgaggcaagggctggcagcgctcggacgcctccgtcttgcccttcccatgcctaagcgcggggaattacacgttcccggtgtagaacagacgatcggggctattagggctgggcggtgggagtgggggttgggagcaccatttttggctggacgtgtgtccagactcatcgtctctggtccttaggaccccatcttcctctgcatctccaggtgtcggcccctctgtacccgcctcccacggggctcgtccggcgaagggcagccgcagcccacatctactccccgccctcaatccctgccccctctgcccgccgcagtcactcgcctggctgggagcaagcctcccctctcgctgagggtgcagagagcgcctagggcgccaagagtagaggggccaaagttcaagcgccatcagccagccgaaggccctgagcccccagggccgcggccgggacgcagggaggtcaggacgcgacgctcgcctcacctgtttctccagcggctccttggccgacagcgccggcttgggggagggcgcgcggtcgcagacgcagccctccagcaggtaaagccccgagggccgcgagctcgagtcgctctcgaagtagaagagcaggttctgcagcagcgcgaaccacttggtttgccattttgtgttgtccgaactccgcttgctcaggtagcctttgcgcgtgccgtccttgcgcgccagcagtcccagggacgcgacgtggccatcattcagccggatccccttctgcatggtgctcagaggccagcgagaccccacgcgcttacatcttctccgcgcagcagccccccgtccgtgcgcgctgcgcgctgcctctctctggcgctcgctcgctcgctccctctagctctcccctccccccaaatatctacactccaggatctggcgccgagccgcggcttcttgaatccagatataccattccccgctggaacctcttctccgctccgcagagccccagtacccggaagatgccgcccgaccctcctccggtgccgggcaaactgagggactggcgatctgcgcgctggcgaggggcaggcggagtcatgtgacgccgatccctcgaagagcccgtttcagcagcgcggacagggacacacgcacgcagccccgccgaggcgcagagccgcgcgcaggctgcaacttggtgcctcctc

SEQ ID NO: 110919 - DNA, 818 bp, Homo sapiens
  chr15:79383328-79384146
  Hyper
tcccctcatctccccttctctccctcggatgttaaaaagcaaatcagatcaattttcgtttaacccaatgaaaccccgaaggctcgccatcccgggagtttgcgtctttgcgccccaccgcggcgcactgtagacctggggttaagtgccagttgtcattttctcctccaaaggctcgccccccccccccactttatttctaatacgaggtggaaggaggaaggtgggtggcgaaatagagctgcaaaagcgtccagtcctagtctttgcatagtcagccgggtcacattgaattccagcatccggctgcactcccggcggcttccccagctacctgaggacagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgcgctggcgcaatgataccttaatgatagattttccgttcttatttttagctctcattcgcctacacagttacacggcatttatccgagaacgtcacagcgcccgcatgctgcaccgggagggcgcgcgggccgccgggcgagccgggagctggggcggggagcgcgcatcgctgtctgccgcagagggcagcgagctcgccccgacccggagcaagccgcgcctggcccgggcgctttgcagcggggatgggtgccc

SEQ ID NO: 110920 - DNA, 243 bp, Homo sapiens; identical to SEQ ID NO: 78008
  chr15:79502049-79502292
  Hyper

SEQ ID NO: 110921 - DNA, 720 bp, Homo sapiens; identical to SEQ ID NO: 35852
  chr15:79574779-79575499
  Hyper

SEQ ID NO: 110922 - DNA, 481 bp, Homo sapiens; identical to SEQ ID NO: 78010
  chr15:79575852-79576333
  Hyper

SEQ ID NO: 110923 - DNA, 30 bp, Homo sapiens; identical to SEQ ID NO: 78011
  chr15:79672460-79672490
  Hypo

SEQ ID NO: 110924 - DNA, 1446 bp, Homo sapiens
  chr15:79724051-79725497
  Hyper
cttgccactgggggccgcagtcaccttcagcataggggagtggggagacgcgaaccccgcgggtggctccgggtggtgggctccctccagcgcgcagcttccgctcgctttcccctcggcgctgcagccgcgacctgggaccgaacggacaccgccttcccggggctccggcggcgctctgactcccactttcctccgccgcagcctctggcagggcacccccttggcgcgacgccgcgcccctccccgggaccgccccctcggtcccccagggtgcgctcagttgctgcccgtgcgccccgccagcttgagcgccccgggcgggcggcggtggagaagcccagcccagctctccccagccgcgttcccggcccgcgctgctcccagcctgcaagcccatgacgtggcgacgccgaccgagacacaaagaccgaggctgagaccgccaggggttgagggtgaggccgcgtcccggggccgctggagcgcgggcgtcatgcgagactgtcccggctgcgcgccgccccagaggagtccgagcgcccccttcagccgcggcgcgctggccctggccgggactgcagccaggtgggcgccgcgcgtgtgagcgccgcgcgtgtgagcgcagacctggactcgggcggcggaggcgaaagtcgctccatccgcggggtgcaaccctgggcgcggaatccgggctgccgggtgacagtgaccagctgactctggagcctaccggaggcgcggcatcggaggccgtgcggaccactgccgaacagccgctggagacccgcagagaagggcgggccctgcgcccggggcgcctcggaggtaagttcggagagcccgggccgggcggagggcgggagcgcacgagtgtgtgtgtgtgtgtgtgtgttcgcggtgtgcccgcggctcggtgcacacgcgcgcgggttgtaaagtcaggagctgcgggagcgcctccctgcctcggcttggccccggagcattgcgggccgcggaggtgtgggggcccttgtcgctgcgctcagggcagcggcggaaaaggtgtgtgcggatgcggggcggggccgcacctggtggacagagcagggattcgggaagagaagccacggaagatgatcatgcagtttggggcaagttttcctggttgagcatcgcttcaggaaacggtgttttgagggttaaatatgtgagctatctgtgcaaaaagcctgacacatcagaggcgcgaagtaagatggaaagctggacaagccccaggtggaccgaccggtgcatccaattcttaaattgagatttccagtcacgttgatgtggaatgggatcgttgttcttcccgagggtttgataaggatgctcaacttcacctgtcagaaagcacgggagctgggcctggcccgcggggagcgtaagctcgctcacacgcggtccaactcaggc

SEQ ID NO: 110925 - DNA, 24 bp, Homo sapiens
  chr15:80217740-80217764
  Hypo
gagccaccgcgcctggccagtgat

SEQ ID NO: 110926 - DNA, 30 bp, Homo sapiens; identical to SEQ ID NO: 78017
  chr15:80279955-80279985
  Hypo

SEQ ID NO: 110927 - DNA, 30 bp, Homo sapiens; identical to SEQ ID NO: 78018
  chr15:80473548-80473578
  Hypo

SEQ ID NO: 110928 - DNA, 30 bp, Homo sapiens; identical to SEQ ID NO: 78019
  chr15:80513587-80513617
  Hypo

SEQ ID NO: 110929 - DNA, 30 bp, Homo sapiens; identical to SEQ ID NO: 35858
  chr15:80543967-80543997
  Hyper

SEQ ID NO: 110930 - DNA, 463 bp, Homo sapiens
  chr15:80544203-80544666
  Hyper
cggcagggctcggcccgacttcagcgagcagatcctccgcctgcggccggtgacccgcgcgacgccccggcggcaccgacaatgctgtgctccagccccgcaggcgccgcggcagcgggtcccgggatgctcccgcggtccttacctggcgaggcccgtcccgtgcgctcccggggtcctggctgggccggcgccgagcccagggcgaccgcggatcgccggctacggcgtttcccggtgacgggggcgcgggctcgcggggcgcggggggcgctgcccaggcccggctcggcaggagtcagagcccccagcggcgcgggcgagcccgggccagcagccgagagggggctctgagcggagccgcggccgtcctggcattttaaaggcgaggcagctggacgctgttcaagcggaaacgcagagagaaacttcagcccccggggcagagcgttggcagcgaggg

SEQ ID NO: 110931 - DNA, 149 bp, Homo sapiens; identical to SEQ ID NO: 78023
  chr15:80624470-80624619
  Hypo

SEQ ID NO: 110932 - DNA, 225 bp, Homo sapiens; identical to SEQ ID NO: 78024
  chr15:80696318-80696543
  Hyper

SEQ ID NO: 110933 - DNA, 30 bp, Homo sapiens; identical to SEQ ID NO: 78025
  chr15:80697219-80697249
  Hyper

SEQ ID NO: 110934 - DNA, 69 bp, Homo sapiens; identical to SEQ ID NO: 78026
  chr15:81072720-81072789
  Hyper

SEQ ID NO: 110935 - DNA, 115 bp, Homo sapiens; identical to SEQ ID NO: 78027
  chr15:81073160-81073275
  Hyper

SEQ ID NO: 110936 - DNA, 30 bp, Homo sapiens; identical to SEQ ID NO: 78028
  chr15:81198888-81198918
  Hypo

SEQ ID NO: 110937 - DNA, 21 bp, Homo sapiens
  chr15:81282983-81283004
  Hypo
aaaaaaaccaaaggccgcacg

SEQ ID NO: 110938 - DNA, 21 bp, Homo sapiens
  chr15:81283124-81283145
  Hypo
aaaaaacgcttcattctttat

SEQ ID NO: 110939 - DNA, 30 bp, Homo sapiens; identical to SEQ ID NO: 78031
  chr15:81771801-81771831
  Hypo

SEQ ID NO: 110940 - DNA, 169 bp, Homo sapiens; identical to SEQ ID NO: 78032
  chr15:82042432-82042601
  Hypo

SEQ ID NO: 110941 - DNA, 19 bp, Homo sapiens
  chr15:82097045-82097064
  Hypo
ttttttttttttagacgga

SEQ ID NO: 110942 - DNA, 19 bp, Homo sapiens
  chr15:82097326-82097345
  Hypo
cgcccggcctggcttttat

SEQ ID NO: 110943 - DNA, 60 bp, Homo sapiens; identical to SEQ ID NO: 78035
  chr15:82156125-82156185
  Hypo

SEQ ID NO: 110944 - DNA, 219 bp, Homo sapiens; identical to SEQ ID NO: 78036
  chr15:82205602-82205821
  Hypo

SEQ ID NO: 110945 - DNA, 23 bp, Homo sapiens
  chr15:82231172-82231195
  Hypo
tcttcataaccttggcgtaggcc

SEQ ID NO: 110946 - DNA, 82 bp, Homo sapiens; identical to SEQ ID NO: 78038
  chr15:82231255-82231337
  Hypo

SEQ ID NO: 110947 - DNA, 713 bp, Homo sapiens; identical to SEQ ID NO: 78039
  chr15:82336570-82337283
  Hyper

SEQ ID NO: 110948 - DNA, 329 bp, Homo sapiens; identical to SEQ ID NO: 78040
  chr15:82339878-82340207
  Hyper

SEQ ID NO: 110949 - DNA, 30 bp, Homo sapiens; identical to SEQ ID NO: 78041
  chr15:82396478-82396508
  Hypo

SEQ ID NO: 110950 - DNA, 438 bp, Homo sapiens; identical to SEQ ID NO: 35864
  chr15:83314955-83315393
  Hyper

SEQ ID NO: 110951 - DNA, 1093 bp, Homo sapiens
  chr15:83315985-83317078
  Hyper
ctctccggcgccaagcgaaggtgtgaagccacgtgacctgcccaggattgggaagccgcacgaggggcttgagccctccaccttaaaggtgccgcgaccgccgccgtcgtggggctctccacagagcacggggtctacgccgtcagcagccccgccccgtcccgcccgggcgcccccaccgcgcgccgggtgctaaagagacccgcagggggcgtgagcttccagcgccagcggcttcgggtctcccgtgcgacggcagtgtgagaaagaaacgttccgggcgccggtgctcctttatgtccggtcagctcccgtctggacagacgctcgaggccgcctggaggccgcagtgcggctcggaggccccaccggccgcccccgcagggctgcggcgcctttaagcccaaaggccctgagtcacgaggaggctccctgcccccctcgccctccacccctccacgaggccccacgcccgcgggcacgtgaccgcgccccgcccgggactcgcccgcacggggcgggggatgggggtaccgcggcgccggacccggctgcgcgcggaccgttagctactgcggccgggacgcggccccgcccaggcgagcggcgggtggctcttaccagcgggaacgccatggggccggtgtggccctgcggggctgacgggctgaccggccagccggcgggcgagagacgcgcacgcacgtgggcactatttttgcagcgggccgcgcgcagccccgcaccccggcagcttatgaagctcctacgagccgctcctcggagccgccccccggccggatgcggagcacctgtgtcggccccgcccgggccctcgcctccgccccctcgcgccccgcccctcctagcaggccgagccgaggagggctccgccgcccacccggaacccggcggggactgccgccgctgctagccacagctgccccctggggggccagagacctaagcctgagcgcgccatcacctaagtgacccttgccgagtcactgtctgccctgggcctcagtttccctcttaacgaaagagggcacgatttacaagcccctgcgagcggcggcgatcgcttcgtcag

SEQ ID NO: 110952 - DNA, 865 bp, Homo sapiens
  chr15:83348876-83349741
  Hyper
cgcagaagcggccctcggacagcgaggacagcccgccgtcgcaggctcacccggcgcttgatggacatggtggccacgttctggagcacaacgtactgcacctcactgcggagaggacgggtcagagcaccccgggcccctcggttggggcaagggtcagcggatgaggggaaaaggtggggcaagtcgttgcggggagaggaccagtgcggagggcaggactacggtcagtgtggagcgggtgggcagaggtggaagcggctggtgggcgtgagggggcggagccgggcagcccgtggggcggggcaggaggcgagggagggggcggggctgggggcggagcgcacctgtggctgcgcagcaggcgcaccagcgccttggcgatgacgcccacttccgccttgggcgccaggtggaagtagagctgcgccaccgccatcaccaccgcggcgctgcggctctgcagcaggggtttggtgttgcgcagcagcagccggtggtcggggtccatgacatagggctttcgggagggggcggccgcggcggccgtctcctcagaccccgcgcccttggcctcgtcctcctctgagccgtagaaggctttttccgcgttctcctctagtagggattcctggacggggagaccgacgggtctgtgggcgcctccccgggacacacttcggcccgctctgcctgggctgggcccacttacgttctgggtggggctcaggaactgcgtgcgggcgtagcgggtgagcatgctgatgatgaccacctggccccactcctccacgtcgatcagcaggttacagagtttccggtagtttttgtgaatcaggtcgatgcgctccgggcagacctcctc

SEQ ID NO: 110953 - DNA, 86 bp, Homo sapiens; identical to SEQ ID NO: 78048
  chr15:83378001-83378087
  Hyper

SEQ ID NO: 110954 - DNA, 754 bp, Homo sapiens; identical to SEQ ID NO: 78049
  chr15:83378288-83379042
  Hyper

SEQ ID NO: 110955 - DNA, 30 bp, Homo sapiens; identical to SEQ ID NO: 78050
  chr15:83390208-83390238
  Hypo

SEQ ID NO: 110956 - DNA, 453 bp, Homo sapiens; identical to SEQ ID NO: 78051
  chr15:83620954-83621407
  Hyper

SEQ ID NO: 110957 - DNA, 29 bp, Homo sapiens
  chr15:83622331-83622360
  Hypo
agtcaagggacaggtcgggcgcggtggct

SEQ ID NO: 110958 - DNA, 76 bp, Homo sapiens; identical to SEQ ID NO: 78053
  chr15:83655953-83656029
  Hypo

SEQ ID NO: 110959 - DNA, 1134 bp, Homo sapiens
  chr15:83775821-83776955
  Hyper
gccaggtttaaaaaccggatgccggctccgtgcagcagcccgccgatggctactggagcggagaggttccgaggtttcaggggcattttgtcctttcccacttctgggccgtgggctcccccatagacgatcccgcgggcccttcctcctctgacaccctcggatctggttccacctttcccggaccgcagctcagccccgcgcctctccagctcttcgatgaccggttcccggccgtgccccgggccctccctcggagcgcgcgccgccaggggcacctgtccctgcgcgggggtgtcgccgcccctcggcgccgccgggcgcttgccgctgagccgtggcgcccctggcaggagcactgcaaggacgcctcccgggactgcaccgcggccctgcgcacttggggcgacggggccaggcgcgggggacggctgcgggctgggagggcgcgcggaggagacaccgctgaggggacgccgctgagggcgccacgcggggggcgcggctgaggcgcctcgaagggcaagcgccaagggggcgcgggcgccgccggaagctggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgagtgagtgagccggcgcggcgggggtcgcgccgaggggcggcgggagttggctcgccgcgacgggagcctcgcaacttttccgagggggctgggaccgtccgccgcgggacagaggttcgtggccgcaggggctccccgcgcctggccagactaggggggcgccccaggggtcgcacgggccgggtcttggagccgggccctgaggtgcccaggctggcgcatttcgggatgttggtgccagcaccgcgccaggtgcccggggtcacaggcgtcaatacggccatgcccctgccctggaggggcccaggggccggtggggagcggaacaaacacggacactacgaacctggccgtgtcagctcgtttgtgccttgttctttttgcatctcacgggaacgtttccatgtatggactttcgcatacttatcatt

SEQ ID NO: 110960 - DNA, 1540 bp, Homo sapiens
  chr15:83875670-83877210
  Hyper
gacagccgctcaccccgctgccgtacctgccccgacgttcgcccgggacccagggtatccaccaatgaccctgcccggagccgaagcctccgtcgcaggcccgctgcccggcggcgtggcttcccggtcggcaccggctttccaggaggaaggcagcgtcgggcctgcgggggccggacccgccttcgaaagtgggcggaaggatggccgccctggcggagtgcgggcgaggccgggagcccttgcctcagccccggcccggtcttcttcgtgccgcgccgccctcagccctcaccacagccggccgcgagctgcgggctcggggctgaggcgatggggaaagggggcgggcgcgccatcatgaaggggaaaatggtgggcgggcgggcccgcgcgcggccgcggtactcacccgggccggccagtgcgggtagcccttcatcttggcgaagaccaggtcgcccgctttgtactcgcggggccgcggacgcgccatcccagccgctccccttcctggtagtccttggtcgccgcgaagatgccgggaggccgcccccccgcgggccgacgaattgcgccgcgctccccgcgggcctcaagccgggcggacgagcggccgctccgacgaggggaagcggcgaggcggcggctgaggcaaggggtgggcggggggcgcagcaggcccggcaaatcacggcccggcagcgggggaggggagcccccggccgttcggcgctcgcccgcgtccggccgcgccaaggtccccgccgccgccgccgccgccgccgcgcgcgctgctcaccagcgccgcgtcgcctgcctcatgccgccgctgccggtctccctcccgggctcccgggcgcggcgcgagcgccgggcctcgcgtctgctccgaattccttctcgggcagcgaccgcaaacacgatcttattattgttctcgcgcgcgctcagcatcccccccccgccccgcttcccgcttcccgctcccctccccttccctcccgcgcgggccggttaattcctaggtacacggccggctttcgcggagaaaccgagcgcgccagcccggcttctcggctggcgggcgggcggtgggcgcgtcctcccccagcaccgaagcccgcgccgggcgggcgggagtgcctactccggaggacgcccgccgcctgctctcttttgttcttggcccggagctgcctgccgcagcccagccaatcaccacccggccgcccccttcccctcccgtccgtgccactctgggggttctccccactcgcgccccccgctcccacgcccacctcccgctgactcgaccctctcctggctacccccagccagccacttccgcggctgctctctggtgagtgggggacaaaggcgctccaggcctgggggacggcggcgcgaggggaccctctgctgggcaccaagctgccggaaagagcaccgctccggagtcagcgaccttattggattcttgccccaggtctgcccttaacaatgcagtgtgacccacctagggcgagctatttaatcg

SEQ ID NO: 110961 - DNA, 1041 bp, Homo sapiens
  chr15:83951781-83952822
  Hyper
accaggggacgttaccgaacccccgagcgtctgatgccccccgccccccaaccacacacaacttcactcacacaattaaggctgggagatggcattccacttaactgtcagactcggagcggtggcagccccgcagccacaaagagatgccttaaatgagaagaacatgtttctacaccgcatttgtgaaagtttggctcggagctacgcgctgattaatatcagatctccttcactcgcctcgccacaatcttgtcacatctggctgacaaatcccgaggaactccggcaaagccaggcggcggcggggctccgggtctgggcggcggctccggaggagcagcgggagaccccgcagcggcctcctccttctccgcccgcggcccccagcctcgccgccgccgcccggctcccagcacggaaccgacggggcgctcccgagacgggcgagccacgcgctcgcaggtcccaaggccaggctgggcgggactgttaagggagctcgaagtcgggggccgggggcttcccgtcccggcgcttcccatgcaaacccctgaaggaagcggcaggcgcagccgcgggctccgcagcccaggcccacttcctgtcactccaggaaaacctcggagcggcggacgcggctcggcccggcttccagcccagagcccaagcgccttagccccgtcccagcgctttctgaaagacgggccacctcgcgcggagccgcgacaaggactccagggtccgcagtgaagctggtcaaatctgccccgcacacggtcaacgctcggtctgtgtcccggaagctttcggaccggacctgtctaaatagcgactttcagtcgtgggttttttgttcttgtgggtttgttttgttttttgttgttgttgttgctctacaaaagatttgtcccgcagtggacgggagcctcctcacggccgcccgcccgtctccgcagttctcctcagtgaccggaggctgccgcgcgccccgttctccagagaaacaatccccggagagaaagacggccagtgtgaaat

SEQ ID NO: 110962 - DNA, 918 bp, Homo sapiens
  chr15:83953076-83953994
  Hyper
gagccccaacccccccgccgccgcctcccggccggagaccacggtccctcccgccgcgcctcggggccgcgctgccgcgcaggtagccagctggccctcgggaggtggccctcgggtacccacgggagccggagcccagcggcgtcccgggccgcctgctccgcgcacagagaatccccgcgcccgcggagggcgccgcgcttacctcggccatcctgcgaccgctgcggtgccggggctgccggcgcgtctcccgggcccgggccgccccgcgtccgccccggctcggcgggcgccgccgcatccacgctccggccgtcggggcgcgacccggcgaagtgggcggctccccaagcgcccaggctgcgcagcacgatggccgcccccgccgcgcaccgcgtgtgcccgcacgcccgccccctgcgccccggggacgcctctccgcccctccccctgcccctccgcccaccgcgcggtcgccccacgccgcgggcgctgcttcgccgcccgggaggccgcctcccgccccgggaccggataacgccctaaatcagcgcagctgaggcgaggccgtggcccccgcagaccgcggagacctcgccggcggccggcgcggaggtgtctgcccccgccgggcttgaaggcacttgttggtaaaagacacagacgtgtcggtgtttgcctctcccggggaagggcgaaacgctctgaagttctctggcgctcttctcaggagatgattcggcctcccctcctaccctggggcgccctcggggtctcactgccgcggaggaagaaggcagcgccgccctcgcctgcagaaacctcattcccgagaaagtgcgggacgagcgtcttgggatgtggaagaagggggtcgccaggaggttttcttaagaactcaaaacaagcgccccc

SEQ ID NO: 110963 - DNA, 34 bp, Homo sapiens; identical to SEQ ID NO: 35885
  chr15:84034378-84034412
  Hyper

SEQ ID NO: 110964 - DNA, 30 bp, Homo sapiens; identical to SEQ ID NO: 78067
  chr15:84063249-84063279
  Hypo

SEQ ID NO: 110965 - DNA, 1183 bp, Homo sapiens
  chr15:84115713-84116896
  Hyper
ttgtccctccctaggcgcatttctgagccttcctttcttaaacatacaccgagcgaaaatgcgccggagggaggcgatgttgcctgtgagccaaagccggttcggcaccaagacagaagcagagagaactgatctctctcccggtacccatgacaatctcagagctagatctatatcgtcccgcgcccagcaagaagcactgtgtgactgtactcccccgacccccaggacatccccacgcccagcttcccaggccggtcttctgcgcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccaggtagggaggcgcagaggagggaaggagggagggggacgcggaggctgcggccccccgaggctcccgggcctttgggactcctgttccctgaagggcctctctcggggctcaatttcttcccgcctaggagggcgcgagggtggggtgaggggccgcctgctctctcctcggcgtcttggcgccttctccttcccattccctggcccccggctctgccctgggccgttgtaaatcggagagattctgcggagcggagggcagaggtggcggccgcggggactcgggaggcggagacggagtgggcgtgggggggcccctacccgcgcgaggggaggacgaccacagggagtacgatgccggcagggcctcccccgagtctccagccgtttggttgggagagcctcgtggggggcccatcctccaccggccaccggcgcctccagagatgctgtgtatttggcgcttggctgtgtcccgctgagctccccgcgcgcgcatcgaaatggccccgtctggactgtgcccggctccccggctggggctctctaccgcggtccttcccctcc

SEQ ID NO: 110966 - DNA, 92 bp, Homo sapiens; identical to SEQ ID NO: 78074
  chr15:84225557-84225649
  Hypo

SEQ ID NO: 110967 - DNA, 997 bp, Homo sapiens
  chr15:84322390-84323387
  Hyper
acggcatccctgctccggctccggctgaggcggggcggccaggctggcttgcggcgcagcggccgcctttccccagtgcgcctgccggcggcggcggtggcggcgtcggcaatcccggctcttggcacaacgcctggcggccggcccagggcgaggagtggcttccaggaagcgggcggaggagcgttccagccgagtcccgccgtcgccgcggccccgcgcgctccgagcggcccgggcctggccccacacggcgtctcttcgcgcccccggcgcctccagctcaagccgagggcgcggtgccggcgcgcaggctgacgggcgcctgggcgcgccgtgcacttgccgggcggtgcaggtggcggcgcgcgccctccgcctctgggccggggccagcgcagcgctctgcgcgcccggagggggcgggagaggcggggcagcccccgtcccagccccatttaacttcgcggcggcggcggcgactgcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggtgggtgcaccgagctcggcgcagggcggcccctcaggggtcgggggaaggcgctccccagagggagtaagacttggagcagtggcctctctaagcaagttgggggtctccaagcagagtcggggcgtgccacgcgggccccagggggcctcaggactggggtgctcctcactgctgggcacctcgggtcgggcgcgcttcgtgccgtcccggaaggttcagggagagtctttcggcggcagttcgcgggctgaggggcgttcttgattatgggggaactccacagggttggagtttttcaggattgggagttactaagcagaaacctcgcgggtccgaaggtccggccggttgaccac

SEQ ID NO: 110968 - DNA, 36 bp, Homo sapiens; identical to SEQ ID NO: 78077
  chr15:84543445-84543481
  Hypo

SEQ ID NO: 110969 - DNA, 49 bp, Homo sapiens; identical to SEQ ID NO: 78078
  chr15:84582058-84582107
  Hypo

SEQ ID NO: 110970 - DNA, 935 bp, Homo sapiens
  chr15:84748531-84749466
  Hyper
attatttacctggcccgggtggcattttactttgcatccttgattgggagtctcaggggctacgaacaaacgttttatccccgggtagccggcgggtgcggagcgagtattcgtggggcgggataagtgcggaagtcgctgcgccctcgtcccttcatctccgggggacggccactctcagggttcccgaggagcccgctccgtgcacctaggccctaggtcggctcccaagccctggcccgccgctacaccagcggtttcttacccgcaagtacaaatgtgacacagacaccagctcctcgtgctcttggctcccagggtttctttcaccgcgcctcagcacctgcagcttctccactcttacagcgcccgccgtcgtcaaggcaacagagggatgcccggtgacagactcggcgccggcttccggcgccgtaagagaagcgtccgcgcgggcgttctggacccgcagagttctcggcgtttccgaagctcttggtgtggccgggacccgggagaaggagcagggctggtggggctgctgcagccggtgagtgtgtgctggcgctgggggctggaacctcctaggccagtctctgggcggtgccgcaggaccctgctcgctgcggctctgaggcggaaacaggggctggggccgagcgcgggctggaagctttggtccctggagtgtcgcttccagtctggggccgaggcggtcgcctgtgtagacccgggatcctcaaatagaacgaatccgggaccctgcagaaatgaagggcatgtagtgtagaggtttttcctttttatttagaaaggaatgaaagaccgacagtgcacctgcttggatagtaagcacgtgacccaaaactttgttggggctctatgggcaggaataaagctgggtatttgacctcgcgcgaggacgagcgagaatgtca

SEQ ID NO: 110971 - DNA, 89 bp, Homo sapiens; identical to SEQ ID NO: 78081
  chr15:84950082-84950171
  Hypo

SEQ ID NO: 110972 - DNA, 196 bp, Homo sapiens; identical to SEQ ID NO: 78082
  chr15:85143051-85143247
  Hypo

SEQ ID NO: 110973 - DNA, 30 bp, Homo sapiens; identical to SEQ ID NO: 78083
  chr15:85200338-85200368
  Hypo

SEQ ID NO: 110974 - DNA, 30 bp, Homo sapiens; identical to SEQ ID NO: 78084
  chr15:85681092-85681122
  Hypo

SEQ ID NO: 110975 - DNA, 40 bp, Homo sapiens; identical to SEQ ID NO: 78085
  chr15:85728807-85728847
  Hypo

SEQ ID NO: 110976 - DNA, 27 bp, Homo sapiens
  chr15:85886665-85886692
  Hypo
gattttaacttgcgttagtgaactaat

SEQ ID NO: 110977 - DNA, 30 bp, Homo sapiens; identical to SEQ ID NO: 78087
  chr15:86251040-86251070
  Hyper

SEQ ID NO: 110978 - DNA, 30 bp, Homo sapiens; identical to SEQ ID NO: 78088
  chr15:86606387-86606417
  Hypo

SEQ ID NO: 110979 - DNA, 37 bp, Homo sapiens; identical to SEQ ID NO: 78089
  chr15:87115915-87115952
  Hypo

SEQ ID NO: 110980 - DNA, 30 bp, Homo sapiens; identical to SEQ ID NO: 78090
  chr15:88649077-88649107
  Hypo

SEQ ID NO: 110981 - DNA, 38 bp, Homo sapiens; identical to SEQ ID NO: 78091
  chr15:88783191-88783229
  Hypo

SEQ ID NO: 110982 - DNA, 30 bp, Homo sapiens; identical to SEQ ID NO: 78092
  chr15:88798166-88798196
  Hyper

SEQ ID NO: 110983 - DNA, 2676 bp, Homo sapiens
  chr15:88798564-88801240
  Hyper
cgtccaaagtctccccgcgagcagccagctcgcaacttgtttacttgtcagcatgttttgctgtttccaaatggaaatagttaaacacctcggctggatcgcgagcagtccctatctgtcaccttccctgccggctaagcgctgccgccgctgccaccgccgctgccgcctctgccaaagaatcgaacctcgtctactttattccacttgagcgtggccaaactgttgctatttagtggggagcaaaaaaaaacaatttgcaccatcgaaacgagccagcaactggttgggaggcgggcggtagctgggccccgcgtgccctcggcggccggggtcctctccggggagaggcacacacacgcatagccggatcgcgcctcgccagggccggagtcacctggaatgcgcagccggagagcatctcccgagccagagcgagcctgacgcgcgcccagcgggcggcgggcagcggcgagctggggcgggcggagggccggctcccggccgcgggtgggcaggagggagacgcagagcgcgggggaggcaggctggggagcggccgcctgacttacatggaagtgatattccttgagatgtccgtgatgttgatactggcgttcccattgctgttccctgaatcctgcccttccaggagggggaagaggttcccatcgtccggccgccggcaattgatctcagtcttgctgcagacacaatttgcagggcaagccagcacggagcccacatagtccagccagacgcttcccagcaagaaaatccgccagaaactacacttggctgggcaaagagagacatccatctccgatcgctgcttctaaaaaagaggaggaggagaggagaggggggtggggtggggggagtggggagagcagggggggaaggaaacaaagacggcgagggaggggggaagggggagggggggcctctgcctttgaaacgccgagcgatcagatgcaaaatccttcagcgtctgaaaccatcgcggacgccgccgccgccgccgccgccgccgggtgggagccgcgaggagcgcctagtggcgcggtctgccgggcatggtggccggctcggcgatcgctgactcgccgggtccgggggctctggaagcgaggcgcgctctccgactccgagactttgcagggttgcaacagacggtggggaggcaaaaaaaaaaaaggaaaaggaaaaaatggtgctaaagtcaccaagtcccacctactgggcagaattaaaacggacacaccacgcacctgcaaaacacacacactcactctcacacatacacacacccggagcccgaggaaaggaagagaaggaagatgcagtaggagctgcagcagccgccgcgaatggctcgccgcgcggctgcagaaatgtacaagtgctccgagccttacgaaacgcacgggttatcggagcgtcttcctcggctccctccctcccttcctccctccctcctcccctccctcgtcgcggcctcctccccccgccccccgcccgggctgggagcggcaggagagcggaatctccccctccctcccctccccacacccgtctctctccccgcctgtcctctccctcctccccacccacccacccacccactcgccggctcgcggctgtagccggcaccgccacccgcagcctcgcggcagcccgcccgctccacgcctcgcagcgcggcgcccgctagccgcagcccgggggaaaccgagaccgaagggaaaaagttgcatttgagattgcgagggtcggggctggggagggagagttggcgagctggctgcacgacacggaaaggcgctctcctttccactttttggccctcgcgctacccggttttgctgcaatccggaccgcggtaggaagtgaaatgaacgtggcggaggtgattggggagtgctcccaagccttgggtggggggcgctcccaagcctgggtgggtggggggcgcaggctcacggacggcgacggggggtgccggagcgcacagacaccccagagaagcacccagagccggggaccgggaccgcagacgcgcagtccttggtctgaatgacactcatttccgtaatctagagtctggggctctggtcttggctgggaggggactgcgggacatggcacgctaggtgccccccgtgcccgctgcgctttcttggaggtgggttttgcattcggccttgagcaggcatggatcggggaaggaagaaacaggggtcgaaagggctgcgctggagagccgaggtggccccgggcgagctgtgcgtgcaagagaaatggccgggggaaattgagatgcaaggggcatattttggcaagcgccacgccagcaccgtcagaggccggcttctcgggctcagctctcgggtgagctgagctggctgccgggtgagggggcgggcgggctgctttctccggattcgggggcgcagaacctcctccttccctcccacacaagcaccccttcctggtagggacgcaaagcaggtgcagctttcgacgagagctcagatctcatccgggaaagaagtgtgtgtggggggggccccgcttttgcgctggtagggatttttttcttaataaaacataaagatgccaagtgtgagctgtttgctgaaaaaaaaaaaaacgagcattcgctgtgggaaagga

SEQ ID NO: 110984 - DNA, 30 bp, Homo sapiens; identical to SEQ ID NO: 35901
  chr15:88801449-88801479
  Hyper

SEQ ID NO: 110985 - DNA, 38 bp, Homo sapiens; identical to SEQ ID NO: 44336
  chr15:89142361-89142399
  Hypo

SEQ ID NO: 110986 - DNA, 30 bp, Homo sapiens; identical to SEQ ID NO: 44337
  chr15:89145873-89145903
  Hypo

SEQ ID NO: 110987 - DNA, 1860 bp, Homo sapiens
  chr15:89147588-89149448
  Hyper
agcccggggaggggacgggactggctctggtgtctcttctggtccgggcacaactggattcagcactaatgacggactctaccccagcggagcgctggaccctggcaggagtcgcaggctgcccgctgctggcccgcggaccggcaccccctcccccaaagctgttgccatggccacaggggacatttgatgtgaagcgcggctcccccctctccactcgctttctccgctcgccttcaggatgacgtcatgaacatccgtggccctgacaggccacccgtgggttggtctcagctttaaagcagctgttctcctctggcccggcagccgcggcgactgtgtttgcacccggcggaccatgccaggactacggacccggacaggactgatggcctcagagaggcaagtattcaaggggcacttcacaaacagcttcctcaaaccccaccccctcccccgcactgcgctgctacttgcactgcggctcctggggggaagcaaagtaccggcagctgggtggtgaggggctttcttccagaaagaaacggagagcaagtggtcttcctccctagccgcggcgacccatgccaggtaaaaatcccagccgaggtccccggtcccgtcccctcctccaggtcaagggctcgggactggagaagcagccaactggagctgatattcgggaagctaagcctgaggctgctctggagggccggagaagcgagcggccaggcttggcacccgccaaatgtgccttgccaaaatgaagaggaaggaaggcgactccggagcccagcaggtgagcgctcctacgggatgctgggcaggctagaggtgtgggggcgtctggttccagtacctgcccggggcgacgcggaaacccagcttgcagtttgtttcgctcggtcccgcgcccagtaggagaaagacggccccacagcctcgcgggagccggctctcgcaacccagccgccccaagcccgccgtcgcccctcctcccgcgcttctcgcccctgattctagatgcagctgacttgttgcatgcagaagagcagctgggttcggcgttccaagcctctcctctttgctttgcctgccaccagatctgagcgccaggctggccagcacccagagagcccagagccgcaggaaaaaatgtgaaaagtaccaggagaccactgggtaatcgccccagtgcaaagggcctttcttcctacccaccgcaattgcagcaaataactccagggaggggaatcagaggcgccggggattgcgccctgggagagccctatctgctgaaagagagcgcctaatgccgttacttcccagtgtagcctttccactcggcagaccaagcgcctctccttcgagtcgctacccgcttggagtcggctcagaatcaggctgctaaaggtccctggagcccctcccccagcgaatccgagcctgcagcttcagcaccagaggctggacagcgccccggccctagggtgcccatggtcggtgcctgcgcacggctcggcctcccagcccacgccacttgcgctcgcggcccctcagaccccacgcggaggaggtcaggaggtgacacaggttcgcggaagaaagcgggactcatcttcctcatttctccagggatttaggtgtgggattctaggagagcattctctctcgctctggccacgaccagtggaaaaacttggcgccaaatttaggcagtggtgcggggagcagaggcacgattgcaggcggtgagcaaaggggcaagcgggacagaggatctactgtgagccccaggctctggtgttccgtgaaaaatcgccacatttaaatcctgcgctcccccgtgctccctctcgc

SEQ ID NO: 110988 - DNA, 69 bp, Homo sapiens; identical to SEQ ID NO: 78105
  chr15:89195448-89195517
  Hypo

SEQ ID NO: 110989 - DNA, 606 bp, Homo sapiens; identical to SEQ ID NO: 78106
  chr15:89248377-89248983
  Hyper

SEQ ID NO: 110990 - DNA, 113 bp, Homo sapiens
  chr15:89312771-89312884
  Hyper
cgtccagcctggctccgcgcagccgggcctgtcccgagcctcctgtaagctgcttctgcgccctgaacgctgcctgttgtcccctccagagcgcctcgcggctcctcctcctc

SEQ ID NO: 110991 - DNA, 1300 bp, Homo sapiens
  chr15:89346003-89347303
  Hyper
gtccttggtctctcccggggaatttgaagacccagagactcgcagctccccgtgagcctccccgctgacgccttacctccccctctccaccatcccctgccatcccggtgtacgccacccccaaaaaaactttcagccagctcctcggtgagggtcgttccaaatcgtggccgacagtagcgggctgcaccctccttagatcgcgtcgtggccagcctcagctgcagaaccccgccgggcgcccgggagccctgtcccgccgcggcggcctcagagtccgggcacttggggattctctgagggtgcagccctcctgggcccctccgactgcggagctgccgaccgcaatgcagatgcgggccctccagcccttctcgcgccgccttcctcccgccagccccggagctgccgggtccgcgccgccccggggagcgctcctctcccgccctgagcgcaggccggcttccccatcggcgcgccggtccggagccagggtccagcgcgctccagacgcctctgccttcccctccccctgtcggccgcccctcggtccctgggggtggggtttccctttgcgctcgccccctcccgcccccacccctcacgggccctcccctcccccgcccgtccctatgtatgtgtcacagcgcgccatgcccgcccgcccgcccacctacctccccgccgctccagagggggctcgcagagctgaggacgcgcgcagcgctgctcaaggtctctctctctcagcaccctcgccggccggcgtctgacgcgggtgccagggtctccgggcacctttcagtgtccattccctcagccagccaggactccgcaacccagcagttgccgctgcggccacagcccgaggggacctgcggacaggacgccggcaggaggaggggtgcgcagcgcccgcgcagagcgtctccctcgctacgcagcgagacccgggcctcccggccccaggagcccccagctgcctcgccaggtgtgtgggactgaagttcttggagaagggagtccaactcttcaaggtaactgtctccttccctccagagcgaggctctcccagggcgcccggcgagccaggaacgggactgagactgcacgccccggggctgggggctgcactgccttggtctccgccctagagctatgtgtgccgggggcgcagcacatccaccggctgcgtccgcggtggagttgagcaaactttttggctgttgcagactcagtgaatggggcaaaggaacacgtgaggaggggcacttgtctcctagtccgccaggatgaagga

SEQ ID NO: 110992 - DNA, 30 bp, Homo sapiens; identical to SEQ ID NO: 78111
  chr15:89383259-89383289
  Hypo

SEQ ID NO: 110993 - DNA, 57 bp, Homo sapiens; identical to SEQ ID NO: 78112
  chr15:89390579-89390636
  Hypo

SEQ ID NO: 110994 - DNA, 208 bp, Homo sapiens; identical to SEQ ID NO: 78113
  chr15:89422160-89422368
  Hypo

SEQ ID NO: 110995 - DNA, 218 bp, Homo sapiens; identical to SEQ ID NO: 78114
  chr15:89437619-89437837
  Hyper

SEQ ID NO: 110996 - DNA, 91 bp, Homo sapiens; identical to SEQ ID NO: 78115
  chr15:89438330-89438421
  Hyper

SEQ ID NO: 110997 - DNA, 84 bp, Homo sapiens; identical to SEQ ID NO: 78116
  chr15:89438779-89438863
  Hyper

SEQ ID NO: 110998 - DNA, 20 bp, Homo sapiens
  chr15:89448511-89448531
  Hypo
taataaatcattcatcgggg

SEQ ID NO: 110999 - DNA, 39 bp, Homo sapiens; identical to SEQ ID NO: 78118
  chr15:89651830-89651869
  Hypo

SEQ ID NO: 111000 - DNA, 30 bp, Homo sapiens; identical to SEQ ID NO: 78119
  chr15:89760580-89760610
  Hypo

SEQ ID NO: 111001 - DNA, 449 bp, Homo sapiens; identical to SEQ ID NO: 78120
  chr15:89876378-89876827
  Hypo

SEQ ID NO: 111002 - DNA, 208 bp, Homo sapiens; identical to SEQ ID NO: 78121
  chr15:89876887-89877095
  Hypo

SEQ ID NO: 111003 - DNA, 498 bp, Homo sapiens; identical to SEQ ID NO: 78122
  chr15:89903388-89903886
  Hyper

SEQ ID NO: 111004 - DNA, 107 bp, Homo sapiens; identical to SEQ ID NO: 78123
  chr15:89904905-89905012
  Hyper

SEQ ID NO: 111005 - DNA, 145 bp, Homo sapiens; identical to SEQ ID NO: 78124
  chr15:89905745-89905890
  Hyper

SEQ ID NO: 111006 - DNA, 145 bp, Homo sapiens; identical to SEQ ID NO: 35911
  chr15:89906124-89906269
  Hyper

SEQ ID NO: 111007 - DNA, 194 bp, Homo sapiens; identical to SEQ ID NO: 78126
  chr15:89908822-89909016
  Hyper

SEQ ID NO: 111008 - DNA, 30 bp, Homo sapiens; identical to SEQ ID NO: 12296
  chr15:89909322-89909352
  Hyper

SEQ ID NO: 111009 - DNA, 1800 bp, Homo sapiens; identical to SEQ ID NO: 78128
  chr15:89910390-89912190
  Hyper

SEQ ID NO: 111010 - DNA, 30 bp, Homo sapiens; identical to SEQ ID NO: 78129
  chr15:89912514-89912544
  Hyper

SEQ ID NO: 111011 - DNA, 699 bp, Homo sapiens; identical to SEQ ID NO: 78130
  chr15:89913180-89913879
  Hyper

SEQ ID NO: 111012 - DNA, 1365 bp, Homo sapiens
  chr15:89914120-89915485
  Hyper
gccactggctccccacgtttgggcttcatttttgtctccggtttgtgctactctttcttcatccaaaaaggcgttggagatcccgagaatctgctgcagcttggaagccagaatcttagagaatctcggatacttctcaccccattcctttcattttacacctagaaatggtgtaaaaaggcccagtggctcacggaaggtcgcacagaaggccactgacagggcagcgatcagtacagccaccgtggtgggcgaggcatccggggcttccttttctctggtccacgaactcccaactccgaacgctgtgggactgcatgggcctctgcccgggccaatgaaatgcgctgccgagaggaggctgcggcgcggcctgaggccggatctccacaggccggagagttctctgccggccgcggccggacctcccgggaaatgggaccagagcgcggagggagcctggccaggaggcctcctaggactcagccgcgacgctgaaaagcatgaagggtcggaattaggcactcatttagcgagcgttactaatccgaagttacagcgctaattccctgatccggccgctcccacacgcagcgccgggattagaggcgcggccgccgcccgccccgccctcataccccaaacgcgcccgccccgcgccctcgaggctgcgggctcagggctaatccgccgcgccgcgctcgcctggcccgagcgcgcggcgggtcgggctcggccagctggggcgagccggcctgttcgctggctcgggcgcccggttccgggctgggcaaggagcgcttggccatgagccgcgggacagcccaggcgggacggatgcgccctccagggcccaggcgaggccgcgcggtgcagaaccgccgggatttctccaacccgggtatgcgcacccacagcagcggcctttggaggccgcggcgccattttagtggccttccttcccccttggcatctgtcgtgtatggtgtggctgggtgtccccagctccccccatcccgctctgactttggctgccccctccgccagcctggatagagtgaccaatcagctctgacctagggtgggatgcgcgtcaccatggcgacggctagggcgccctggcagtgctgcccatcgcagagggcaagtcttcactccgcctagatgggtgtgaagggaaggtggggacaggtgggggggaggggcggatggagggaggccgtgatgcctcgtccgcattcccaccccattttgcctagggtcagttcagctgggtcaggcaggggacaaatggatggtgtggaaggggcctgggtaggggcctgggtttgtcctggggcggctcttccacgagtcctctcatcc

SEQ ID NO: 111013 - DNA, 132 bp, Homo sapiens; identical to SEQ ID NO: 78133
  chr15:89918751-89918883
  Hyper

SEQ ID NO: 111014 - DNA, 829 bp, Homo sapiens
  chr15:89921939-89922768
  Hyper
ccaagattcacacctcgtctacaccagggcaccgcctgggcctacggccttccgaacccgaagcgcccgcagcccagagctggcatcaggccatcaggccgggaaggtcgtcgcaggccccagagtgcgggcgcggggggcgcgcgcccacaggacgcccggggttgggtaggcaggagagaagggcgccagcaggcccgcggctgtttcccctcggtccgcacagcgggcccgggaggccattttgagagcgcgaagaggggcggcaagatggctgcgtgggcacccggaaggtcgccgcgccaagggcccgctgagcccctcctcccattcgtccagccgcgcggcccacagaagcggaacgcgcgtcgagagcgccctgtccgctcgccccagacagatgcccggttattcattaccgcgaggcctagaggaaagagtggctgccgtcttcctgcccacagcccgccggaccctccgtcgcggctgcccggtccccggagccgcagccgccgagcccggctgtgcgtgtcgtggctgctggggagaaagaggcttccggtaagagcccccctgactgggctgcccaccccgggcaggggcggaaacggccttccccgcgtggggaacaatggcgttattttggagtctgcaaccgcgagcgcttcaagctctttgattattttcgaggagtgttaggtgcgtggctaactcccgcgttttcttggaaccacgaagcccaaaatggcgagcgggccgtggccgccctcctggggctgagtgtggtccggagcgctgagagtggccagggagccgtgggcctccatcg

SEQ ID NO: 111015 - DNA, 1175 bp, Homo sapiens
  chr15:89942626-89943801
  Hyper
cgccccccagcagcccgggccgcgtttgaccactagtagggcagaaccactgaccggcaggcggcgctccccggggctcccggctcgagccccagggcaccgggaggagtaaggaccccgagcgggagggagacgactggggggcgcgcggcacaaagagctttttattcaaatttgtttagagtttcgcgaatttgcatgaaaaatgtgtgagaaaagccagctccggtgacctcatccgcacctgccattaacgttcaattagcggctgaatagcggccgccgacgcgacgtgcagagaatccggcctgccccgcgcagcgagggcggcgggccaggcccgggatagggtgggaccgagggagggggacgcggcgtagggccccggcctactcctctggcccggagacccaggacctcgtccgcactccaactctccgagggaacgcggggatctcaggactcacgagcccaagattgtttggagcgcgccgggagccttaggatgcctggctccctctgggcgcagaaaagggcgggcttgcctcctccccaggacggaaggtggccggaagagccccgtcccagctcagatgggcttccccgccatcttccggacaaagtgtcaagtacaagttcaagttcagggccaggcccgggggggggcgctgagccttacccggccgcctttgttctctggcataatcgctcccacgtccccctcccgggcggggcccagcagagacccccgccccgccccgccccgccgcgccccgcaggagcctcctcctcccgccggcgcggcgcctgtgccctggtcccggtgtccccgctcggtgccaccgaaggatctaggggctcgggccggggagggggtggaggggggagtggaggcgcgatacgaacccgtgggagcctccccaaccccgcagtcccagcggcaaactgtgcttggtcggacggatgcccgcgcggaggtaagagccctttgcgggattcgcccgtatccctgtgccccgccccccgcctgggactacgcgggccccaaggagcggggcggaggatggtgtgctgaaaaccggctgggcagccccgctgggcctccggtggggtggggggcgcactgtcgctccagggctctggggagtacgaggcctgggcggtgggtatggagg

SEQ ID NO: 111016 - DNA, 125 bp, Homo sapiens; identical to SEQ ID NO: 78137
  chr15:89945164-89945289
  Hyper

SEQ ID NO: 111017 - DNA, 571 bp, Homo sapiens
  chr15:89949371-89949942
  Hyper
ttcggggccccctaccgaggccggccatgatcttgagggcggcataggggaggccgcgctctgtccaccccagcctggtgatgccgttcgcttcttgtgcccggtattgtgggctacatgcctttccggcgtacggagctgagcgtccaggccagtgcccctcaacctctcagtaatgtttacccgaggccgtcgtgcaatgagactattcgcatggcattgtcaacgcggcggcgcgcgcgtctcggccctccgcggcttgccagactgtcctgcaaaccacctcacccgtctctttggcgcaggagactcaggctgtaaccggagaaaacacttcaccctggaaccctaactcaggtcctggcaaaagatgcgagaggaagacttgctctcttaataaatctcggccgcccgcacatctggcccctagacctgctcggtagaggactggctggtggatgcgcggtccaggccgtgggcactcgacccacctctattttccttcccgaggcgcccctggattaccactttcggtttgcgcttacatccgggatgtcgaatttcccaggga

SEQ ID NO: 111018 - DNA, 2894 bp, Homo sapiens
  chr15:89950236-89953130
  Hyper
gcaggcctgaggagtcgggctgaaggtgcgccagccattattgcctcagacctccggacgctacgtaccccaagcacctgagctactagtggtatatcagacaagatttctgggagcagccccaggagtccctccgcccgctcccagtccgcaagcgcagaggatcctgcgctctgtcccccaaggtcttggcgtttgctgagctctctccgcgcgcgtcgaggagaggccgcctctcgtgagcaaaagctgggagttgttagagattccgcagccgctctgagggcgagatcgggtttgtcccacgacctcggcgccaggaagctgtagaaagagacagaccccaattttctccccttggagttgaaacaaaacctgaaagcccgaggttgcccgcaccgccagaggtggcgcctaggcggcgggggcgaccagagccgcgtgcccgcgcggttcccaggcctgggttctgtttcttcctattttagttagttacttagccggttagctaatagacagctcacaggcagcatttatgcaaacgccaagcctggacccacgctgagtctccgcggccgccagacctatagttgcccggctgggctcccagaggagtgaagaagggaaattcctagtaattaaaggggaggttttcccggggcgccccttggtgaagtggccttggcttccagtgaggaacaaaggactaaggtgcctgcgcgcagcgcgccctcggggcccggcgcgaccagctttcacgcctctcccagctcccacgcctctcccagctccacggcggccgcgggctttgtgagctggggccgcgcgccgcgctgcacctgcccggatttaagtaccttggcgaggcagcgcaggcggctgttctaatcgccgtctccaagtacctgctcatgaataaacaccaaccccatttatcaggtacttagcgctcattgtgaaggggaaattggcccttttctgaaattgtctatccacaacccatctgcgcagttctggttgcagaattcccctcacccttgagacacacacacacacacacacacacacacacacacacacacacactcgcaacacgaggctcctccaagctaagataaactcgcttttcttccggtaagtgcgcgattgagccgcgacaataggcggcgaggaggaggccgttgggtcaatagcctgcgtctctcccattgataggaaaagtcagtgcgcggaatgcagggccttaggaaagccctgtccggcgttccagccacaggggtcacacttgcatcaacatgcgggcacgctgccccttgggtaccccaaacattgagcaaaatattggaaaggtggaccgaggtgtctgtggtgcctgccagcattggtcgggtgggccccagctgtaccctgggttcccctactttcccccagttgggccccacatctgggtctggctcttaagtcttgggcatatgggatagagaatttaaggatccagatactttgcaatccccgggctagtaggaggaaaagtggctcctctgggaacccggatgggccgaacagcagcttccggcagaggccctcaggtttcagagttctccaagtggggagaagggcggcctgctcagcccgcgcacccgtggcagcaccacagagggaataaaagcagggtaaacaatttgaagatccccacgaaggcaagagagtaaatttacaaactcatttgcgtccggaatacttgcttctttttcactcatacattccttctaaaatgtgggctttctgtgtacatgggcgcgcattcccaggactcggttccctgggtggaattcacccaggaatacaatcgattttctgaacctgcgtaaggccacaggcagctctgaaaatgaaagcgtttgctaagtgggggagatctcaccgatcgaacgtttaaaaatggctttgtcttcattcagctctcccgatttattctgtgttttacaaatagaagctcagagcttctgtcgcccagtccttgcatgactcatggcggtggccacacgggtttcagggataacgggatgtttagaaaatcgctgcatatcggagtttcctagcacgttccatttatactgaacgcaggcggccgctgaaaatccagcctcgactcttgctaatgactgggtaggaccctcggggtcctgcgacggtgctggagggtgttcccggctccgatgtggggaggcctgcgcggggactaggttctcgagaggcgagcgggcgcgccagagaacccgagactgctgcggggccggatgcgggatccctgggctgcggttctacgcagaaacgccaatggccatgcctccccagctcctcccagccccagtcactaggccggcgcctggcccggagatcctcccagagccctggcggtgccatcatgccggagaagacaagctcggccccgctggaattcgctccaaacacagatgctcatttttggaatattctagaaaaataacaagatcttgtttgtcgttatgattcacgggaggtaactgatgggagggccatttacatgagggcagacactgtggggcgaaggtgacttctggacgtaggctttaaagtaggaacggctccaaattcccaatatctccggccttaccggttgcaaatcggacccctgcgggaaaaccagacacttctgtttcgtggctttcgggctgcctccagcccacgcaggctcgtttagtccccgtggagtcagccccgagccttcctagtcctggaacaagggctccaggtcgcggccgcgggaagccgccaagagggcggggagtagggattccctccagctccgcagggcatctcacaagcgccttcttctgcgccatctccccacc

SEQ ID NO: 111019 - DNA, 988 bp, Homo sapiens
  chr15:89954197-89955185
  Hyper
gcttaactcccatgacgtcagatcaccacttagagcgtcttgatgcccaggctagaaggatctcggttgcaccagctttccccactgcagtttcaggttttgtcccgacagactttcagcaagcggcttagctcagccctggcgctgccttccaggaaagaggggcagcagcagcctcggctgagccgggtgcccttgtgggctatctggtgggggctcgcgggtccttgccttctctgcctggggtaggtgggaggtaggttcttgaacttcccggggcttctccctggcacactttggctgccacatcacggatggaaacgctgaggccaatgggctcaggttcgctagcagcaggcagccggccctggtgtgcccgctgtggcctgggtgctctgcatacccccgcgcgcgcttgctctgtgtggggggctggcagataggggtgttcctaggggccacgcggggggaagggggtggcggggccggtcttgcgcttcccacgctccatctgttcagttcactctggtggtctctgttccagtctggcctagggatccctggctccccacggccaagccgagaactagcgggcgcaggttgcattgtgcagactcccggggtcaggtcgcagggtcacgtgcacgcgtcgggcctcctccgggcgctcctattccagatccgccgacagagggcgccgggggcccgagaggagcatgttcgggcgcctctcccgggtccctggcgccacgctgtggggcttggtggttcagagccacacctgacaccctcacgtcccaaaccgggatagtcgcaccgacaaaaatcacaggaaggagcgcgcagttgactgtgggcgggcgggacggcggagccacttacagcgggacctgcgagggtgtgggtacgggactccccaacggaccctctagtttgtaaccgtgcgaacactggagggattcattatgtgcaccgtggaggcgcggac

SEQ ID NO: 111020 - DNA, 273 bp, Homo sapiens
  chr15:89956300-89956573
  Hyper
gtgcctgcaaagccacggctcctaatcagggtaatttaatatattttaagcccccggcggctttattttccctccttttcgagtttgttttaggcattcacagctctcaccccgtcattagacggccttatttgacggatggaaggagctgctatgagaccacagccctttgtgtcccccacataagctgggcttccccgtaattagaatggtattcccagccattgaggcttttcatgaggcagaacaaaaactccccgagatgaatatccc

SEQ ID NO: 111021 - DNA, 221 bp, Homo sapiens; identical to SEQ ID NO: 78148
  chr15:89959838-89960059
  Hyper

SEQ ID NO: 111022 - DNA, 148 bp, Homo sapiens; identical to SEQ ID NO: 78149
  chr15:89962805-89962953
  Hyper

SEQ ID NO: 111023 - DNA, 629 bp, Homo sapiens; identical to SEQ ID NO: 78150
  chr15:90039431-90040060
  Hyper

SEQ ID NO: 111024 - DNA, 329 bp, Homo sapiens; identical to SEQ ID NO: 78151
  chr15:90109270-90109599
  Hypo

SEQ ID NO: 111025 - DNA, 257 bp, Homo sapiens; identical to SEQ ID NO: 78152
  chr15:90198157-90198414
  Hyper

SEQ ID NO: 111026 - DNA, 102 bp, Homo sapiens; identical to SEQ ID NO: 78153
  chr15:90293464-90293566
  Hyper

SEQ ID NO: 111027 - DNA, 62 bp, Homo sapiens; identical to SEQ ID NO: 78154
  chr15:90304847-90304909
  Hypo

SEQ ID NO: 111028 - DNA, 259 bp, Homo sapiens
  chr15:90319855-90320114
  Hyper
gagaaactgcgcatgcgcacgctggcccgcgccctgcacgagttgcgccgctttctgcctccctccttggcgccggccggccagagcctgaccaagatcgagacgctgcgcctggccatccgctacatcggccacctatcggccgtgctgggtctcagcgaggagagtctgcagtgccggcgcaggcagcgcggggacgcggggtccccttggggctgcccgctgtgccccgaccgtggccccgcagaggcgcagacgc

SEQ ID NO: 111029 - DNA, 46 bp, Homo sapiens; identical to SEQ ID NO: 78157
  chr15:90349846-90349892
  Hypo

SEQ ID NO: 111030 - DNA, 567 bp, Homo sapiens
  chr15:90357883-90358450
  Hyper
gcagaagtccagctccgcacgcgccaagcgctgggtctgcagctccctcggttcccgcgcacccaactgccccacgacccctacccgcgcccgcagcccccgccctcccgccccacttgcctgggccgccgggcgctggaacctggaccctggaccctggcgggttccgagctgcgccgccgccgtccctgcccctccagcactggactcctcctttcccgtctttttaaagggaagtaaccggacccgaccactactccacccgattcacccctagcgggccgcccgcccgcagctccgcccgggctcctcccccgtccgcccgcggcttcccgggagccccccagggctcctccgctcctccgacggcccggccttccccccggggcctgggatgcaccagggctcctgctgcccccgacggggtccctgtcgccgcagcccgcgggacccgccggccacatctggacggcatctgccgcgggggaggggctcagagcctcgccctgagtgtcccgcagggagccttgtgcatccggggcaggaagccagcgcatcccgtgcaga

SEQ ID NO: 111031 - DNA, 157 bp, Homo sapiens; identical to SEQ ID NO: 78160
  chr15:90455810-90455967
  Hyper

SEQ ID NO: 111032 - DNA, 30 bp, Homo sapiens; identical to SEQ ID NO: 44342
  chr15:90501049-90501079
  Hypo

SEQ ID NO: 111033 - DNA, 149 bp, Homo sapiens; identical to SEQ ID NO: 78162
  chr15:90501280-90501429
  Hypo

SEQ ID NO: 111034 - DNA, 218 bp, Homo sapiens; identical to SEQ ID NO: 78163
  chr15:90541900-90542118
  Hypo

SEQ ID NO: 111035 - DNA, 58 bp, Homo sapiens; identical to SEQ ID NO: 78164
  chr15:90630550-90630608
  Hypo

SEQ ID NO: 111036 - DNA, 43 bp, Homo sapiens; identical to SEQ ID NO: 44345
  chr15:90667422-90667465
  Hypo

SEQ ID NO: 111037 - DNA, 82 bp, Homo sapiens; identical to SEQ ID NO: 15920
  chr15:90703242-90703324
  Hypo

SEQ ID NO: 111038 - DNA, 29 bp, Homo sapiens
  chr15:90741425-90741454
  Hypo
ggcgtgagccaccgcgcctggctggtaaa

SEQ ID NO: 111039 - DNA, 30 bp, Homo sapiens; identical to SEQ ID NO: 78168
  chr15:90747910-90747940
  Hypo

SEQ ID NO: 111040 - DNA, 30 bp, Homo sapiens; identical to SEQ ID NO: 78169
  chr15:90753833-90753863
  Hypo

SEQ ID NO: 111041 - DNA, 296 bp, Homo sapiens; identical to SEQ ID NO: 78170
  chr15:90755756-90756052
  Hypo

SEQ ID NO: 111042 - DNA, 30 bp, Homo sapiens; identical to SEQ ID NO: 78171
  chr15:90835095-90835125
  Hypo

SEQ ID NO: 111043 - DNA, 158 bp, Homo sapiens; identical to SEQ ID NO: 78172
  chr15:90859564-90859722
  Hypo

SEQ ID NO: 111044 - DNA, 80 bp, Homo sapiens; identical to SEQ ID NO: 78173
  chr15:90866273-90866353
  Hypo

SEQ ID NO: 111045 - DNA, 36 bp, Homo sapiens; identical to SEQ ID NO: 78174
  chr15:90891911-90891947
  Hypo

SEQ ID NO: 111046 - DNA, 100 bp, Homo sapiens; identical to SEQ ID NO: 78175
  chr15:90896116-90896216
  Hypo

SEQ ID NO: 111047 - DNA, 98 bp, Homo sapiens; identical to SEQ ID NO: 78176
  chr15:91185735-91185833
  Hypo

SEQ ID NO: 111048 - DNA, 132 bp, Homo sapiens; identical to SEQ ID NO: 78177
  chr15:91189343-91189475
  Hypo

SEQ ID NO: 111049 - DNA, 25 bp, Homo sapiens
  chr15:91313690-91313715
  Hypo
ccaccgtgcccggccaatccccaca

SEQ ID NO: 111050 - DNA, 27 bp, Homo sapiens
  chr15:91366968-91366995
  Hypo
atagaccctggccaacggatgaaatga

SEQ ID NO: 111051 - DNA, 214 bp, Homo sapiens; identical to SEQ ID NO: 78180
  chr15:91409404-91409618
  Hypo

SEQ ID NO: 111052 - DNA, 472 bp, Homo sapiens
  chr15:91427507-91427979
  Hyper
tgggccattctttcccggccccctcctcccttccgtttccgtggccgtgcggccggctagaggctgcggcccagcgcggagcaggggggctggcaggcgtcggggcggtcgggccggtcccgcccgccccttcccctccacaggcccgccccggggcctgggccaactgaaaccgcgggaggaggaagcgcggaatcaggaactggccggggtccgcaccgggcctgagtcggtccgaggccgtcccaggagcagctgcccgtgcgggtacctctagccccggggcctggaggagcggtgggagctgggggcgcggcaggcaggggcagagcaggcgttccgagggccagagacccacccaggtgggggtaggggccgcggaagggcggggatggccgcaggggcagggctcaggctgtgggcgcctgaggcttcagctggggcaggcttggcctgtcgaggacctgggcaa

SEQ ID NO: 111053 - DNA, 61 bp, Homo sapiens; identical to SEQ ID NO: 78182
  chr15:91500770-91500831
  Hypo

SEQ ID NO: 111054 - DNA, 30 bp, Homo sapiens; identical to SEQ ID NO: 78183
  chr15:91504803-91504833
  Hypo

SEQ ID NO: 111055 - DNA, 863 bp, Homo sapiens; identical to SEQ ID NO: 78184
  chr15:91642936-91643799
  Hyper

SEQ ID NO: 111056 - DNA, 201 bp, Homo sapiens; identical to SEQ ID NO: 78185
  chr15:92456345-92456546
  Hypo

SEQ ID NO: 111057 - DNA, 361 bp, Homo sapiens; identical to SEQ ID NO: 78186
  chr15:92459330-92459691
  Hypo

SEQ ID NO: 111058 - DNA, 30 bp, Homo sapiens; identical to SEQ ID NO: 78187
  chr15:92687159-92687189
  Hypo

SEQ ID NO: 111059 - DNA, 221 bp, Homo sapiens; identical to SEQ ID NO: 78188
  chr15:92701704-92701925
  Hypo

SEQ ID NO: 111060 - DNA, 30 bp, Homo sapiens; identical to SEQ ID NO: 78189
  chr15:92911893-92911923
  Hypo

SEQ ID NO: 111061 - DNA, 80 bp, Homo sapiens; identical to SEQ ID NO: 78190
  chr15:92936360-92936440
  Hyper

SEQ ID NO: 111062 - DNA, 1872 bp, Homo sapiens
  chr15:92936662-92938534
  Hyper
ctgcctggctgaaaccgccttctcgccgcgcgctgggggctgtccccaggtgttggtctttgtgtcgagaaaactttgcgaggaggcgagggagctggacaaagagcgggcgagggagggcgtttgccagcctgaggggtgcgccgggcggtgcgcgcacttccctgggctcagctccgtacccggtcgctcgcggtggccagagcccagtctctctaggccaggagtggcgtccggctgcatccccgcgccctcgggagctgaataaagccaggcgggagaagcaaaggctagcgcctggacgctggagttggtgggaggaggcgagcagaggcgcggagcaaagctgtcaaactgcgcgcggagccgggcgcggggcgggggaagggagaggagggagggaggggcaggcgggagccgggagggagcgagcgggctcgccgcgcctgagcaacccctgcctgtcgctgccgctgccgctgccgctgccgccgccggcccggactcgtccggagcgcagggtgtctgcccagctgcgcgcggcgcgcggaggctccggcgtccgccgctgcgccctccggcccctgctcctcgcgccggcccgcgtgggtcccggcgggcgcgaacccaccatgcagctgcagttccggagctggatgctggccgcgctcacgctgctcgtggtcttcctcatcttcgcagacatctcagagatcgaagaagaaatcgggtaaatagctgctcccaggcccgtgccacgagccctggcgggatctctccctccttctgtactctccaccctccgaccccctttgtgtgcgccgcgccccgctgtagctccgctggagagatggggacggtttggcagaaggtggcggcgacaggggcccgggacggtttggggagaggagggtgggggcgcggctgctgtggggtgtccccgggcggggttcacgggaagcccccagctggcccgcgtcgggaagcggactcgcccaccctgcccccctgcctggcgtgtccaagcgcagtgtcgccggggtcgagggagggcgccggggagtgtctcgggcgggcggaggggccgagagtggagggaggcaggagtttctttgtctccagcacggccgctttctcgccttggcaaagtgggcagggggcgcgcagggatctctgagctgggggaggggttcctggggccggagcggagggcggggttctgcatgggctactgggaagcggaatgtcccctgcacacacagacaggcacacgcgcctcccgccggcccgggagcccggcgtaggagctggcaccactagagaagggctcgcatagctggactgagaccccccgccctcgcctggctttggacgttcagccaagccacggcaaccccggcgaccctgggttcctgtgcgctcgcagcgcggagacggagacatttcgggaaagtctgtaccgccgcccggtgggcttctgggccctcaggcgggcgatctggcgctttttttctcccgacctcgccagaggtagggtgggaccgcgagcccggatcctcccggctccggacttcctggagtgcgcacttgaggcgcgggacgcaccggctgtgtgtcccaggggctgagactcgcgccccgccccgcagccttcggctcgccgggccgggcccctctccggaacctccaaagggcggtagacgacaggtggggaggcagccggggttctgaggaggcccgaggagagcttcctggccctgggcaaggggaaggtgaggtctcaaagagggcagaaggtctcttcttctgtgggatttgtgctctgccaggcgctcttctcgagtcccgcgccgcgtgcgcccctcctttgtc

SEQ ID NO: 111063 - DNA, 193 bp, Homo sapiens; identical to SEQ ID NO: 78196
  chr15:93160460-93160653
  Hypo

SEQ ID NO: 111064 - DNA, 649 bp, Homo sapiens; identical to SEQ ID NO: 78197
  chr15:93198390-93199039
  Hyper

SEQ ID NO: 111065 - DNA, 346 bp, Homo sapiens; identical to SEQ ID NO: 78198
  chr15:93257518-93257864
  Hyper

SEQ ID NO: 111066 - DNA, 160 bp, Homo sapiens; identical to SEQ ID NO: 78199
  chr15:93360190-93360350
  Hypo

SEQ ID NO: 111067 - DNA, 141 bp, Homo sapiens; identical to SEQ ID NO: 78200
  chr15:93364648-93364789
  Hypo

SEQ ID NO: 111068 - DNA, 340 bp, Homo sapiens; identical to SEQ ID NO: 78201
  chr15:93594841-93595181
  Hypo

SEQ ID NO: 111069 - DNA, 98 bp, Homo sapiens; identical to SEQ ID NO: 78202
  chr15:93595410-93595508
  Hypo

SEQ ID NO: 111070 - DNA, 589 bp, Homo sapiens; identical to SEQ ID NO: 78203
  chr15:93609289-93609878
  Hypo

SEQ ID NO: 111071 - DNA, 84 bp, Homo sapiens; identical to SEQ ID NO: 78204
  chr15:93615607-93615691
  Hyper

SEQ ID NO: 111072 - DNA, 852 bp, Homo sapiens
  chr15:93615901-93616753
  Hyper
tgcgccctccccacacggctccatctcacggcaactcgggcagggtgcccctctccgggtccccaagggcaggcatcgcacccacgacggggtgcgggagaaacaaaagacccgtggaaataggaggcggggtccggaggaggtccggagaacttgagcccggactcactcgcgcacatctggcccagcattgaggggcggcccagggacccggccccgcgcgcccggccggcagtgccttacctgcggggaagctgcagagaaggaaggcgagggtcggccagaatcccagggctgaacgtcctgcccctctccccatacccatccatccagctcggcctgttaccactagcctctccctggaagaagagttcagaaaaaaagaagaaaataaatcacgctgcgaagaaagggcagcctcgctccgccggcgggagcagcgagccgggaggctccgtccacctcggccgcgggcgcccggcgcgctccccttcccgcgccgccccccgcgcgcccctccctcgccatccatcactcggttctccgccaatgtcgacgcggccccgcgccccagccgcctgcgcaccgccccctcgcgctcgggtttcagcgaggccggcgaggtagccggaggcggccgggcggggacccaggctgcccggccgcagcgctcgccgtgaggacctcggaaaaccacggccctagatcagagggcgcgccacgctccccgaccctcgcgccatctccagcccgcggctgtccttgcaaaccaggcccagcacccttgggaggccgcagggcatgaggcggggcaggacgcccccttaatcccctccacgaatatccaatcca

SEQ ID NO: 111073 - DNA, 1721 bp, Homo sapiens
  chr15:93631545-93633266
  Hyper
gtcgccgtgccctcccgtccacttaggaaagccggggcggcttggcaatgggcatcctcggccctcaatccaaggtccgcaccttcccgtacgccggcgcgccgaggcaaagggccgccgggacgcgagcccacgcggtgcactgcgccgacatccccgagggcaggagatggccaggcagctccgcagccgggcgtcgagcgggaggcgggggcccgggcggcgcgggccaatgggggttcacggcgggacagtcgggtggccggctccgtccggggctccgcgagccgggctgagggaaggagctcccagcccgcacacggtgtaagggacgtgtgccgggtctgcccaaccacgcgcgctggcggctgcccgggggagagtattttaggaaaaaagaacaaacaccaaaccacaaaaactttcctgctgccaacagctaaagcgatagaggcgcagcaaagctccaaatgtgggcaagatgggagcaagatgagacgcggggctaaggaagaccaaagcagcgccgtggccccggcatgtgtcggcggcgcctcggagatgtcagagccgggtctgcccggctcccgacccgcgcttaccttggcggctgcatgagcccctgcggcccgcggggggtggcgctggcggggctgcgggagaagagggggtgtcggggcgccgctcgtctgccccggggcaaggtgggaggggctccgctggcgctggtccccgccgccccggccggctcagcagcggcccggggagcgcctcctgctcccgggctgcatgcctgcgagcgcctggcggagccggcccgggagcgaacggccagtgcttccccggcccagcggctcgggcggcgcagccagcgctcgggagacaactgcagagtggggcggccgggaccagccccctccctcgcccggcccccgcccgccgccgagcgcggcgtcgcgaggttcgtttgcgcgccgaggggagggggcgggccgggcgcccgggccgcgggcggggggcgcgcgcgggcggggccggcagggaggggcggggaggagcggggtgcgggctcgcgttgccccgccccgccgcggccccaccctcccgcatcagcaccggctgggtgggtgcggagtgcgccagcggccaagtcaagactccttgaatgctcaggttagggggcgcgggcggcaagtgcggcgactccccggggcgcctccaactttccgaatcgcccgcagggttgcggtggagcgcacggtgtccttcagttaggcggtggtcgaggggagttcctctgagatttctggagaaggcggttacatccaagacaaatgctgttgcgctctgcggagacgcacctttgttctatagagattttgttgttgtttaagaatcttcctgaaaaaactaatacatatgtattacatgctaacacacgcatacattcttgcgtagaattgtacataactcaggagtgtctagagtgaaaagaccgtatcgcactccctcccacggccgcggctctcccacggccgcggctcccccgcggtaaccttcggtcagggtgtgctctgccgcggttctttccagtctctgcgcttttacatgcacacgcacagattgcgagtggaatctcctgggcttttcaaaagaatgttttcaacattaagcgcatgcacacagtggcttgaacacggccacgtcgggagcagtaaatc

SEQ ID NO: 111074 - DNA, 30 bp, Homo sapiens; identical to SEQ ID NO: 78209
  chr15:93689707-93689737
  Hypo

SEQ ID NO: 111075 - DNA, 39 bp, Homo sapiens; identical to SEQ ID NO: 78210
  chr15:93792256-93792295
  Hypo

SEQ ID NO: 111076 - DNA, 156 bp, Homo sapiens; identical to SEQ ID NO: 78211
  chr15:93798049-93798205
  Hypo

SEQ ID NO: 111077 - DNA, 185 bp, Homo sapiens; identical to SEQ ID NO: 78212
  chr15:93820319-93820504
  Hypo

SEQ ID NO: 111078 - DNA, 33 bp, Homo sapiens; identical to SEQ ID NO: 44362
  chr15:93902389-93902422
  Hypo

SEQ ID NO: 111079 - DNA, 30 bp, Homo sapiens; identical to SEQ ID NO: 15927
  chr15:94347602-94347632
  Hypo

SEQ ID NO: 111080 - DNA, 30 bp, Homo sapiens; identical to SEQ ID NO: 78215
  chr15:94347911-94347941
  Hypo

SEQ ID NO: 111081 - DNA, 157 bp, Homo sapiens; identical to SEQ ID NO: 78216
  chr15:94443196-94443353
  Hypo

SEQ ID NO: 111082 - DNA, 40 bp, Homo sapiens; identical to SEQ ID NO: 44364
  chr15:94478454-94478494
  Hypo

SEQ ID NO: 111083 - DNA, 197 bp, Homo sapiens; identical to SEQ ID NO: 78218
  chr15:94495950-94496147
  Hypo

SEQ ID NO: 111084 - DNA, 19 bp, Homo sapiens
  chr15:94557099-94557118
  Hypo
tttttttttttgagacgga

SEQ ID NO: 111085 - DNA, 30 bp, Homo sapiens; identical to SEQ ID NO: 78220
  chr15:94736260-94736290
  Hypo

SEQ ID NO: 111086 - DNA, 33 bp, Homo sapiens; identical to SEQ ID NO: 78221
  chr15:94774077-94774110
  Hyper

SEQ ID NO: 111087 - DNA, 23 bp, Homo sapiens
  chr15:94778186-94778209
  Hypo
agccctggtggtggtcgggcaca

SEQ ID NO: 111088 - DNA, 30 bp, Homo sapiens; identical to SEQ ID NO: 44365
  chr15:94925846-94925876
  Hypo

SEQ ID NO: 111089 - DNA, 30 bp, Homo sapiens
  chr15:95388121-95388151
  Hyper
tggggctgcgcgccccgccgggcccggaga

SEQ ID NO: 111090 - DNA, 371 bp, Homo sapiens
  chr15:95388358-95388729
  Hyper
ctcgcggcctcctggcgaggcgcggccggcggaaaagcttggtggggtggccgcggcagcgacacgcgcggccggccccgggaaaacaaaggggggatgtgtgtggccaagagtccggaaatggggcgccggtgggggccggggcggcgcagctctgcctcctggagcctattgtttgccgggtgcacatgcacacgcgcttaacaagaaattaacacatcctgccgccgcttatctatccatcgatggccaaacagacggcgcagtcactttgcacggagagggcttttaatgtaatgaccaggccggagaagaatatctcaagcccttcgtagaagttcctctttgtttccgtacggcccttgatacca

SEQ ID NO: 111091 - DNA, 22 bp, Homo sapiens
  chr15:95507939-95507961
  Hypo
ccgcgcccggccaagttctggt

SEQ ID NO: 111092 - DNA, 125 bp, Homo sapiens; identical to SEQ ID NO: 78226
  chr15:95634811-95634936
  Hypo

SEQ ID NO: 111093 - DNA, 30 bp, Homo sapiens; identical to SEQ ID NO: 78227
  chr15:96663096-96663126
  Hypo

SEQ ID NO: 111094 - DNA, 30 bp, Homo sapiens
  chr15:96864245-96864275
  Hyper
gaattggaggattaccggggaaggaatgcg

SEQ ID NO: 111095 - DNA, 105 bp, Homo sapiens; identical to SEQ ID NO: 78228
  chr15:96864500-96864605
  Hyper

SEQ ID NO: 111096 - DNA, 268 bp, Homo sapiens; identical to SEQ ID NO: 78229
  chr15:96864954-96865222
  Hyper

SEQ ID NO: 111097 - DNA, 30 bp, Homo sapiens; identical to SEQ ID NO: 78230
  chr15:96865796-96865826
  Hyper

SEQ ID NO: 111098 - DNA, 75 bp, Homo sapiens; identical to SEQ ID NO: 78231
  chr15:96874258-96874333
  Hyper

SEQ ID NO: 111099 - DNA, 84 bp, Homo sapiens; identical to SEQ ID NO: 78232
  chr15:96876537-96876621
  Hyper

SEQ ID NO: 111100 - DNA, 30 bp, Homo sapiens; identical to SEQ ID NO: 78233
  chr15:96883798-96883828
  Hyper

SEQ ID NO: 111101 - DNA, 74 bp, Homo sapiens; identical to SEQ ID NO: 35961
  chr15:96884425-96884499
  Hyper

SEQ ID NO: 111102 - DNA, 30 bp, Homo sapiens; identical to SEQ ID NO: 78235
  chr15:96889448-96889478
  Hyper

SEQ ID NO: 111103 - DNA, 295 bp, Homo sapiens; identical to SEQ ID NO: 78236
  chr15:96897310-96897605
  Hyper

SEQ ID NO: 111104 - DNA, 240 bp, Homo sapiens; identical to SEQ ID NO: 78237
  chr15:96897853-96898093
  Hyper

SEQ ID NO: 111105 - DNA, 43 bp, Homo sapiens; identical to SEQ ID NO: 78238
  chr15:96903332-96903375
  Hyper

SEQ ID NO: 111106 - DNA, 638 bp, Homo sapiens
  chr15:96911366-96912004
  Hyper
gctttcaggtgaattcgttccgggcgttcggtgtccctgggcttgcctaggggtactggggacccttagtgggccagaacccgaagctgaacgtgaataagggacagggtaggacctgaaattgcagagacatagaaaatcaatacgtggtcgggagtcaactgcgcgcgaccaagggctctgccctccctctctccgttgatttggacgctgggaagctgcccgccgtccttccccaccccctttgcccagccttggcaagacctctccggaaacatactcgcgttaaggaactgggaaagcttcctggcccggagctaggagcccgacgttggggctccttgctgagtgagacgctcagtcctgtgctccccgccccgccccaggcgcccagtcccgctgggatccatctcctcagccccggtttcccgctctgcgagcgggggaagaacctgggaactgcaggatccgccacctcggtttttcagacacagcctctggcctctttccttggcctgccaaacctttgttcacttctctcacccgttgtctgctctgctctatccctcagcagggttctcgtttggacaagagggcccaatcctttgctttgctactcctcgcgtcttgtagaccct

SEQ ID NO: 111107 - DNA, 680 bp, Homo sapiens
  chr15:96952609-96953289
  Hyper
actttctcccgcaaccgcgccccggaccgcagtaatcccggcggggcagggccggggagctggggacggggtggtctttagggtggcggcttcccccgaccccggacccgggaaccggccgccggcgcggggcgcgatctgcactgccggtcccacaggagttaaaccccgaggcagacaaaagggaggccgccgcggctcctttgctcggctgtcagttgaaaagagaaccgccgccctctggacttcaactcccgacggaaaaggcattttattatgggttatgacaagttgcagagagacgcggacaactcagtaagaaggagcggcgagcggaatcaaaaatgctcgagatgtttgcaagacagagcgaacacggcttcaaatgacaggtgttagcaggactccagacgggatctgcgggatcggccgggtgggagccgcaccgcacggcgccgggtcggggagagaacccggcctggggaggccgcggggtgcccccgccgcgccgcccaccagccccgcgcggcccggagccgaccccgcctcctcttccgaaagtcctaagtcaggacagcggcagatcgtcccagaaaatcagcgccaactccctctgctcaaatttgctactttgtgttttagttccaggcgggaagtctacactgcgctccctcccagcc

SEQ ID NO: 111108 - DNA, 67 bp, Homo sapiens; identical to SEQ ID NO: 78243
  chr15:96959305-96959372
  Hyper

SEQ ID NO: 111109 - DNA, 456 bp, Homo sapiens
  chr15:96959693-96960149
  Hyper
aagcgcgtgtgttaacgaaccccaagcgaatttcggggcttgaaagcgctaccggggcagccagattactacctcccactctcacctccatccctccccgccccttgcccgtcccacgggcctcagatttgggcgtagggctgggtagggcgcctgggaggagccagagggggcggatcaggccgggatttggcgccaggtacccccacccgcccgcgtcccggggtcgccagctgactccatgtgagcccacttggcaccggccccccgagggatcctgcgacgcgaggggtgcccatttgcagtgatccgcggactctcgaaccctaaaccccggggcccagctctgccccggcgtggatcttcgggaaaccggagcggaggctcgtggagacctgggaggagctgcgctgactggggcaggggacgcccagattggatcggttccgagctctc

SEQ ID NO: 111110 - DNA, 318 bp, Homo sapiens; identical to SEQ ID NO: 78245
  chr15:96960508-96960826
  Hyper

SEQ ID NO: 111111 - DNA, 180 bp, Homo sapiens; identical to SEQ ID NO: 44366
  chr15:97006353-97006533
  Hypo

SEQ ID NO: 111112 - DNA, 30 bp, Homo sapiens; identical to SEQ ID NO: 78247
  chr15:97395096-97395126
  Hypo

SEQ ID NO: 111113 - DNA, 30 bp, Homo sapiens; identical to SEQ ID NO: 78248
  chr15:97894937-97894967
  Hypo

SEQ ID NO: 111114 - DNA, 30 bp, Homo sapiens; identical to SEQ ID NO: 44367
  chr15:98417575-98417605
  Hypo

SEQ ID NO: 111115 - DNA, 24 bp, Homo sapiens
  chr15:98454971-98454995
  Hypo
cacccggcccggcacatttatttt

SEQ ID NO: 111116 - DNA, 114 bp, Homo sapiens; identical to SEQ ID NO: 78251
  chr15:98504114-98504228
  Hyper

SEQ ID NO: 111117 - DNA, 41 bp, Homo sapiens; identical to SEQ ID NO: 78252
  chr15:98776804-98776845
  Hypo

SEQ ID NO: 111118 - DNA, 372 bp, Homo sapiens; identical to SEQ ID NO: 35973
  chr15:98836021-98836393
  Hyper

SEQ ID NO: 111119 - DNA, 114 bp, Homo sapiens; identical to SEQ ID NO: 78254
  chr15:98961307-98961421
  Hypo

SEQ ID NO: 111120 - DNA, 109 bp, Homo sapiens; identical to SEQ ID NO: 35974
  chr15:98965273-98965382
  Hyper

SEQ ID NO: 111121 - DNA, 302 bp, Homo sapiens; identical to SEQ ID NO: 78256
  chr15:98971690-98971992
  Hyper

SEQ ID NO: 111122 - DNA, 254 bp, Homo sapiens; identical to SEQ ID NO: 78257
  chr15:99091118-99091372
  Hyper

SEQ ID NO: 111123 - DNA, 55 bp, Homo sapiens; identical to SEQ ID NO: 78258
  chr15:99091608-99091663
  Hyper

SEQ ID NO: 111124 - DNA, 30 bp, Homo sapiens; identical to SEQ ID NO: 78259
  chr15:99168900-99168930
  Hypo

SEQ ID NO: 111125 - DNA, 90 bp, Homo sapiens; identical to SEQ ID NO: 44371
  chr15:99183400-99183490
  Hypo

SEQ ID NO: 111126 - DNA, 39 bp, Homo sapiens; identical to SEQ ID NO: 78261
  chr15:99192902-99192941
  Hyper

SEQ ID NO: 111127 - DNA, 37 bp, Homo sapiens; identical to SEQ ID NO: 78262
  chr15:99193206-99193243
  Hyper

SEQ ID NO: 111128 - DNA, 216 bp, Homo sapiens
  chr15:99193451-99193667
  Hyper
gaagccccaggacacgtctccaagcgcccgtcgctgcctcccgtcgcccaacgtgcttttgcccctcgggctcctcgggttcctggccttgcccgtcactttggcccgctcctcgttgggttacctgcccccggcgtcccggggctgggcggtggggtgaggggaagcgctctctgggcagccccccgggaagtgcgaggccgggagtcttcctca

SEQ ID NO: 111129 - DNA, 95 bp, Homo sapiens; identical to SEQ ID NO: 35977
  chr15:99193974-99194069
  Hyper

SEQ ID NO: 111130 - DNA, 260 bp, Homo sapiens; identical to SEQ ID NO: 78265
  chr15:99250288-99250548
  Hypo

SEQ ID NO: 111131 - DNA, 127 bp, Homo sapiens; identical to SEQ ID NO: 78266
  chr15:99254559-99254686
  Hypo

SEQ ID NO: 111132 - DNA, 18 bp, Homo sapiens
  chr15:99295597-99295615
  Hypo
tagagtgtttattaacga

SEQ ID NO: 111133 - DNA, 30 bp, Homo sapiens; identical to SEQ ID NO: 78268
  chr15:99347955-99347985
  Hypo

SEQ ID NO: 111134 - DNA, 30 bp, Homo sapiens; identical to SEQ ID NO: 78269
  chr15:99428631-99428661
  Hypo

SEQ ID NO: 111135 - DNA, 47 bp, Homo sapiens; identical to SEQ ID NO: 78270
  chr15:99454637-99454684
  Hypo

SEQ ID NO: 111136 - DNA, 81 bp, Homo sapiens; identical to SEQ ID NO: 78271
  chr15:99456350-99456431
  Hypo

SEQ ID NO: 111137 - DNA, 54 bp, Homo sapiens; identical to SEQ ID NO: 78272
  chr15:99460214-99460268
  Hypo

SEQ ID NO: 111138 - DNA, 38 bp, Homo sapiens; identical to SEQ ID NO: 44377
  chr15:99484067-99484105
  Hypo

SEQ ID NO: 111139 - DNA, 132 bp, Homo sapiens; identical to SEQ ID NO: 15933
  chr15:99484456-99484588
  Hypo

SEQ ID NO: 111140 - DNA, 30 bp, Homo sapiens; identical to SEQ ID NO: 78275
  chr15:99501229-99501259
  Hypo

SEQ ID NO: 111141 - DNA, 123 bp, Homo sapiens; identical to SEQ ID NO: 78276
  chr15:99503981-99504104
  Hypo

SEQ ID NO: 111142 - DNA, 30 bp, Homo sapiens; identical to SEQ ID NO: 44379
  chr15:99506147-99506177
  Hypo

SEQ ID NO: 111143 - DNA, 30 bp, Homo sapiens; identical to SEQ ID NO: 78278
  chr15:99507385-99507415
  Hypo

SEQ ID NO: 111144 - DNA, 30 bp, Homo sapiens; identical to SEQ ID NO: 44380
  chr15:99974913-99974943
  Hypo

SEQ ID NO: 111145 - DNA, 30 bp, Homo sapiens; identical to SEQ ID NO: 44381
  chr15:99981097-99981127
  Hypo

SEQ ID NO: 111146 - DNA, 28 bp, Homo sapiens
  chr15:100274301-100274329
  Hypo
gcggtggctcacgcccgtaatcccagca

SEQ ID NO: 111147 - DNA, 39 bp, Homo sapiens; identical to SEQ ID NO: 77344
  chr15:100346202-100346241
  Hyper

SEQ ID NO: 111148 - DNA, 60 bp, Homo sapiens; identical to SEQ ID NO: 77345
  chr15:100378951-100379011
  Hypo

SEQ ID NO: 111149 - DNA, 24 bp, Homo sapiens
  chr15:100426310-100426334
  Hypo
aggcacggtggatcacgccggtaa

SEQ ID NO: 111150 - DNA, 834 bp, Homo sapiens
  chr15:100881258-100882092
  Hyper
gccgcaggcgctgagcgagacgagggagccggggtggccgagcacacggcccgagtagaagcacagctcggcggggcggccgcggcgccgggccgcgcccgcctcctccacctcgaagcctcgggacaggaagcgcaggtcgcggcgcagctgaaggtacaggtcgcgcccgaaggccggcaggtgcagcagcagggcgcgctctccgggccgggcgcgcggggcggctgggggcgtgcgggggcgtcgccgccgtcggggcccgggggctgcgggcagcggcggcaggtgcacgtcgtcggggcgcacccgccacgggagcaccacctccacgtcggccgccgcgtcgccgacagctgcggggagagaggagacgcgtcagcgcggcggggcccgcccggacgcccgccctcccgctggccgccagccgcgccagcgcggggacagcgcgacccggagccggcgctgccttcccttccctcgcccggcacctccacgctggcccgcgccacccggggagggtctccggcgcagccgcgcgagcacctcccggaacggcgccgcgcatcggcgagcggagacccggcggcggcgcgcctgccacggagccacccgattcccgtactccggccgcggcccgcgcctcctccgctcgggcgccgtcagcggtcccgccgccgcccccgggccgccaggacgccgcgagaacgcagagggaaggtagccgcaggacgcggggtgaagagggctgtgggagggggcgctacctgtgcccgggtccagtccccaaaccagcagcagcagcacgggcaggacgagcggaggcagcagggc

SEQ ID NO: 111151 - DNA, 30 bp, Homo sapiens; identical to SEQ ID NO: 44383
  chr15:100888957-100888987
  Hypo

SEQ ID NO: 111152 - DNA, 656 bp, Homo sapiens
  chr15:100913423-100914079
  Hyper
cccagggcacccctccgacccccgctgcgaggggtttcccgcgggaggtggacgaagcgtgggccaggacaggcgcctggcactggggtttcagagccgcgagtaggccctgaaggccgggagggaccgccagtccccactggaagccgcttccgtgcagcccgggacaggtgcgcggcgcccctcgccttcgcctccgcttctgctcttcccctcgcggccccgcgcgcccgcgccctccgcccagaccccggtgcagcccggccaggcgcggcggcggcggcgtctccagcgagggaaggtcgtcctcacgcgctccggcctcagggcgcctctccgcccggcctcgcagccttcccgtcctgcccacggccgaggccgcggctgtcggggtggcctggacgggtgcagggctgggcgggggcggcaggacttgaaccggcgcctgctctcgcggaggcagcagcagagctcacccctttctcgggaaatggtttatcgtggataaaacgcagtccccaaagcgaaggtccgacgggcggccagacgcaccccggggaccttcaggtggacacacggggcctccgcgcgccgagccgcgagggaagaggggcggcgggagggagggagcagtgggcggccggggagcctggcag

SEQ ID NO: 111153 - DNA, 30 bp, Homo sapiens; identical to SEQ ID NO: 77352
  chr15:101089996-101090026
  Hypo

SEQ ID NO: 111154 - DNA, 30 bp, Homo sapiens; identical to SEQ ID NO: 77353
  chr15:101417814-101417844
  Hypo

SEQ ID NO: 111155 - DNA, 30 bp, Homo sapiens; identical to SEQ ID NO: 77354
  chr15:101419441-101419471
  Hyper

SEQ ID NO: 111156 - DNA, 655 bp, Homo sapiens
  chr15:101420348-101421003
  Hyper
cggctctccagaaaccgcacctttcgcgggacgtctcgggcgggatcgcaggcggcggggctcggcgctgtgagcctcgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtccgggaggcagatggcggagctgcagttggaagactggggaagcgggtcctccgagcaaagcgcagcgggcgccttccgtgcttagtttatacccggctcagcagcagaacgaggaggagtaggaaggtgctcgcttactgacgaaacctccccggagcccagaggtcccggtgtttacacacaaggcgcgcgctccggaaggtcgcagacctgggcctttgggaagcggtgggtcgcgaggccgcagaagcgcacggttctctgcctcctcgctctgtgggctgggaggctacagcgttggcagaacggcgagattacctgcccggggcagaaaggaa

SEQ ID NO: 111157 - DNA, 243 bp, Homo sapiens; identical to SEQ ID NO: 77359
  chr15:101459070-101459313
  Hyper

SEQ ID NO: 111158 - DNA, 329 bp, Homo sapiens; identical to SEQ ID NO: 77360
  chr15:101460006-101460335
  Hyper

SEQ ID NO: 111159 - DNA, 313 bp, Homo sapiens
  chr15:101513556-101513869
  Hyper
gttttctgggcagggcgggaaagcgtctggatgtccacacccccgggaggtggcctgtctttcccccgtgggcaccgcagcgggacagcgtggctgagacccgcggctctctcgccaaagcccctgcgcctccgctgctgtcggcgaggtcggcccggccgctcccccgcgggccgctgtccccggtgccctggaagggctccaggtggcggtctcgctgcagaatcctccgagctgcgctcgccgcccggtgccttcgcagcggccccggttgggttgcgggtcgcggggcggcgagcgcagggagcgtcgc

SEQ ID NO: 111160 - DNA, 30 bp, Homo sapiens; identical to SEQ ID NO: 77362
  chr15:101535285-101535315
  Hypo

SEQ ID NO: 111161 - DNA, 34 bp, Homo sapiens; identical to SEQ ID NO: 77363
  chr15:101558833-101558867
  Hypo

SEQ ID NO: 111162 - DNA, 30 bp, Homo sapiens; identical to SEQ ID NO: 77364
  chr15:101633788-101633818
  Hypo

SEQ ID NO: 111163 - DNA, 126 bp, Homo sapiens; identical to SEQ ID NO: 77365
  chr15:101785815-101785941
  Hypo

SEQ ID NO: 111164 - DNA, 30 bp, Homo sapiens; identical to SEQ ID NO: 77366
  chr15:101889834-101889864
  Hypo

SEQ ID NO: 111165 - DNA, 151 bp, Homo sapiens; identical to SEQ ID NO: 77367
  chr15:102028841-102028992
  Hyper

SEQ ID NO: 111166 - DNA, 374 bp, Homo sapiens; identical to SEQ ID NO: 77368
  chr15:102042955-102043329
  Hypo

SEQ ID NO: 111167 - DNA, 40 bp, Homo sapiens; identical to SEQ ID NO: 77369
  chr15:102043695-102043735
  Hypo

SEQ ID NO: 111168 - DNA, 47 bp, Homo sapiens; identical to SEQ ID NO: 77370
  chr15:102096642-102096689
  Hypo

SEQ ID NO: 111169 - DNA, 160 bp, Homo sapiens; identical to SEQ ID NO: 77371
  chr15:102154203-102154363
  Hypo

SEQ ID NO: 111170 - DNA, 22 bp, Homo sapiens
  chr15:102193729-102193751
  Hypo
gagactccgtctcaaaaaataa

SEQ ID NO: 111171 - DNA, 30 bp, Homo sapiens; identical to SEQ ID NO: 77373
  chr15:102270624-102270654
  Hypo

SEQ ID NO: 111172 - DNA, 30 bp, Homo sapiens; identical to SEQ ID NO: 44386
  chr15:102276370-102276400
  Hypo

SEQ ID NO: 111173 - DNA, 39 bp, Homo sapiens; identical to SEQ ID NO: 77375
  chr15:102306422-102306461
  Hypo

SEQ ID NO: 111174 - DNA, 34 bp, Homo sapiens; identical to SEQ ID NO: 78343
  chr16:114441-114475
  Hypo

SEQ ID NO: 111175 - DNA, 57 bp, Homo sapiens; identical to SEQ ID NO: 15935
  chr16:142626-142683
  Hypo

SEQ ID NO: 111176 - DNA, 23 bp, Homo sapiens
  chr16:192028-192051
  Hypo
accgtgcccggcctgcataacat

SEQ ID NO: 111177 - DNA, 106 bp, Homo sapiens
  chr16:204415-204521
  Hyper
ccccaggacaggctgcggcccctcccccgtcctggaggttccccagccccacttaccgcgtaatgcgccaataaaccaatgaacgaagcagcgtccacctggtctc

SEQ ID NO: 111178 - DNA, 23 bp, Homo sapiens
  chr16:208745-208768
  Hypo
ttttcttttttgagacggaatct

SEQ ID NO: 111179 - DNA, 1852 bp, Homo sapiens
  chr16:215124-216976
  Hyper
atcctctgtcctgaccgagaagtaccgctgagcgccgcctccgggacccccaggacaggctgcggcccctcccctgcccttcaccctcccacagttcctgccctgactccaataaatggatgaggacggagcgatctgggctctgtgttctcagtattggagggaaggaggggagaagctgagtgatgggtccgggggcttcgcaggaactcggtcgtccccactgtcgtcgcggcctggggttcacttggggggcgccttggggaggttctagcccctgagcaccggagctgcggcccgggtggagcggagcagtcccgggccggcccgcggcgtctcctggggtccttgagtcggacgggcgtttgtgcgtctcccggcttcccatatcgcacaaagattgtcacttcactaagcgtattggaagcgtgtcggggctcagggaacttttccacaaagcctgacgtccgaatcccgggactctggcagctacgggggtccctgaggccggtccctccccgactcctaagagagtagggggtttcctgcccggtgttctctctccggttcctcccatgtgctccctcctggcagagcagtaactttacccgaggggagtaaacagatgcccctaaagtctgcagtaaaggtgcccacgcgcaacggcgtgggtcaatgccagaaaccctgggatcccggaggtcgaggcctccacacagacgggaacccgggctggttacgttccccggcgcaggccgagggtccccgcgttcccgccgcgctcgggccgataaggacgggcggggtgcccggaggctctataaggaggccagggcggcgggcgcggcccccagagcacgtcaggcggcgccatgctcagcgcccaggagcgcgcccaaatcgcgcaggtctgggacctgattgcgggccacgaggcgcaattcggggcggagctgctgctcaggtcggtagaggcggggtctccgggagctcagggaggtggagatgagggttttgggcgcgtgggccgccaacgccatccaaggtccttcgggtgcggatccccgggctctgggcggtgtgggcgctagtgaagccccacgcagccgccctcctccccggtcactgacctggtcctgcaggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctgcgcgtggacccagccaactttccggtgaggcctttccggccggggcaatggtgcagcgcgcagccggggtgggggggctctgggggtccctagcggggcagaccccgtctcaccggccccttctcctgcagctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaaccatctgcccctgcctgtgtggtctttggggagctagcaaagcgaggtcactattgttggccagtgaagctcagggacctaaaaggagcctcctagaactctcaaatgcgccccacccccggaggtttgtcctcccatggcgaggagtgcgatggggcagagggagcactgtgatgtggcgggggtagggagggtggccttcgacttcaacccttg

SEQ ID NO: 111180 - DNA, 214 bp, Homo sapiens; identical to SEQ ID NO: 78634
  chr16:223318-223532
  Hyper

SEQ ID NO: 111181 - DNA, 856 bp, Homo sapiens
  chr16:230196-231052
  Hyper
ggaatggcgccactgcactcaccgcacccggccaatttttgtgtttttagtagagactaaataccatatagtgaacacctaagacggggggccttggatccagggcgattcagagggccccggtcggagctgtcggagattgagcgcgcgcggtcccgggatctccgacgaggccctggacccccgggcggcgaagctgcggcgcggcgccccctggaggccgcgggacccctggccggtccgcgcaggcgcagcggggtcgcagggcgcggcgggttccagcgcggggatggcgctgtccgcggaggaccgggcgctggtgcgcgccctgtggaagaagctgggcagcaacgtcggcgtctacacgacagaggccctggaaaggtgcggcaggctgggcgcccccgcccccaggggccctccctccccaagccccccggacgcgcctcacccacgttcctctcgcaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccaggtgagcggctgccgtgctgggcccctgtccccgggagggccccggcggggtgggtgcggggggcgtgcggggcgggtgcaggcgagtgagccttgagcgctcgccgcagctcctgggccactgcctgctggtaaccctcgcccggcactaccccggagacttcagccccgcgctgcaggcgtc

SEQ ID NO: 111182 - DNA, 99 bp, Homo sapiens; identical to SEQ ID NO: 78662
  chr16:233798-233897
  Hypo

SEQ ID NO: 111183 - DNA, 32 bp, Homo sapiens; identical to SEQ ID NO: 78750
  chr16:280197-280229
  Hypo

SEQ ID NO: 111184 - DNA, 34 bp, Homo sapiens; identical to SEQ ID NO: 78804
  chr16:299951-299985
  Hypo

SEQ ID NO: 111185 - DNA, 154 bp, Homo sapiens; identical to SEQ ID NO: 78809
  chr16:300225-300379
  Hypo

SEQ ID NO: 111186 - DNA, 197 bp, Homo sapiens; identical to SEQ ID NO: 78887
  chr16:318060-318257
  Hypo

SEQ ID NO: 111187 - DNA, 309 bp, Homo sapiens
  chr16:318498-318807
  Hypo
agcaaggccagctcacgaaggaagacttgggcagggaggatcagggacgcctggcaaggatccaccctatggaatcgggcctcgtcagtggggtgacaatgtcagagttgtctataaatcgggggggaggccgcggcctcgaggtgggaaagcaggtgccggcgcacctgtggacaaattctggaacgcgtttggcgagggaggaataggcgcagctccggaaggcagtgacctcgaggcagcctcagcacggcactctcttgggtcctcttccaggctcacactgggcgacagcggagaggctcttgg

SEQ ID NO: 111188 - DNA, 38 bp, Homo sapiens; identical to SEQ ID NO: 44391
  chr16:319924-319962
  Hypo

SEQ ID NO: 111189 - DNA, 18 bp, Homo sapiens
  chr16:322126-322144
  Hypo
gcccggcctaatatgtca

SEQ ID NO: 111190 - DNA, 181 bp, Homo sapiens; identical to SEQ ID NO: 78905
  chr16:323418-323599
  Hypo

SEQ ID NO: 111191 - DNA, 30 bp, Homo sapiens; identical to SEQ ID NO: 78908
  chr16:323853-323883
  Hypo

SEQ ID NO: 111192 - DNA, 57 bp, Homo sapiens; identical to SEQ ID NO: 78911
  chr16:324217-324274
  Hypo

SEQ ID NO: 111193 - DNA, 48 bp, Homo sapiens; identical to SEQ ID NO: 78913
  chr16:325498-325546
  Hyper

SEQ ID NO: 111194 - DNA, 285 bp, Homo sapiens; identical to SEQ ID NO: 78916
  chr16:330222-330507
  Hyper

SEQ ID NO: 111195 - DNA, 57 bp, Homo sapiens; identical to SEQ ID NO: 78917
  chr16:330921-330978
  Hyper

SEQ ID NO: 111196 - DNA, 153 bp, Homo sapiens; identical to SEQ ID NO: 78918
  chr16:332609-332762
  Hypo

SEQ ID NO: 111197 - DNA, 256 bp, Homo sapiens; identical to SEQ ID NO: 78923
  chr16:337560-337816
  Hypo

SEQ ID NO: 111198 - DNA, 30 bp, Homo sapiens; identical to SEQ ID NO: 78932
  chr16:351930-351960
  Hypo

SEQ ID NO: 111199 - DNA, 30 bp, Homo sapiens; identical to SEQ ID NO: 78934
  chr16:356089-356119
  Hypo

SEQ ID NO: 111200 - DNA, 519 bp, Homo sapiens; identical to SEQ ID NO: 78946
  chr16:410195-410714
  Hypo

SEQ ID NO: 111201 - DNA, 611 bp, Homo sapiens; identical to SEQ ID NO: 78947
  chr16:410995-411606
  Hypo

SEQ ID NO: 111202 - DNA, 309 bp, Homo sapiens; identical to SEQ ID NO: 44397
  chr16:412764-413073
  Hypo

SEQ ID NO: 111203 - DNA, 143 bp, Homo sapiens; identical to SEQ ID NO: 78954
  chr16:428930-429073
  Hypo

SEQ ID NO: 111204 - DNA, 23 bp, Homo sapiens
  chr16:440317-440340
  Hypo
aatggggtccagggccgagggct

SEQ ID NO: 111205 - DNA, 30 bp, Homo sapiens; identical to SEQ ID NO: 78978
  chr16:468101-468131
  Hypo

SEQ ID NO: 111206 - DNA, 37 bp, Homo sapiens; identical to SEQ ID NO: 79022
  chr16:501346-501383
  Hypo

SEQ ID NO: 111207 - DNA, 24 bp, Homo sapiens
  chr16:505034-505058
  Hypo
gcgaaactccgtctcaaaaaaaaa

SEQ ID NO: 111208 - DNA, 30 bp, Homo sapiens; identical to SEQ ID NO: 79040
  chr16:511064-511094
  Hypo

SEQ ID NO: 111209 - DNA, 72 bp, Homo sapiens; identical to SEQ ID NO: 79041
  chr16:511477-511549
  Hypo

SEQ ID NO: 111210 - DNA, 39 bp, Homo sapiens; identical to SEQ ID NO: 79175
  chr16:607668-607707
  Hypo

SEQ ID NO: 111211 - DNA, 747 bp, Homo sapiens
  chr16:609865-610612
  Hyper
gcaaggaagggagcccggctccgctggctcagtccgcggcacccctgtcccccaggacagcccccaggggccctggctcgggtgggccggcggctgtcaggggccagagccctgatggataagcgctgacggcccctctcccgcgccccgcgccgctgacacccatcacgccgcggcggggacccgggagacctggcggcctctgtgcacccccgcggcagcctgcgggcaacgggggcgggaggcgccgggcgcccctgactcggccgcacacctgcgccgcagtccgctctccgtccgctgcctcccgggttcccggccgctccaccgcgcgccccgagagctgagccggtcccggcgcacgaggccggtgagtgcgcgccagggggcggcggggggcgcgcgggcggcgggggcgcggggttcgggccgggggctgctccttccctcccgccgcgagcgcggtcggaggtcgcagcgccccccggagcccggagcccaggcgcacgcgcgcccgcctctgccgccaacttcgggaggtgcgagcggcgtcggggggacgcgggcggcggcggaggctgcgggagtcgctgccgctcgagggaccgcggacccgggaggtccggctcccggcgccgggcctcagtttcccccacgggagccgcatcccacccccagagccccagcgcgtccgcggggtccgagtcgcggccggcgcggggcggggaggggcgggaagtttgcgcc

SEQ ID NO: 111212 - DNA, 205 bp, Homo sapiens; identical to SEQ ID NO: 79178
  chr16:611376-611581
  Hypo

SEQ ID NO: 111213 - DNA, 370 bp, Homo sapiens; identical to SEQ ID NO: 79179
  chr16:611950-612320
  Hypo

SEQ ID NO: 111214 - DNA, 287 bp, Homo sapiens; identical to SEQ ID NO: 79180
  chr16:612869-613156
  Hypo

SEQ ID NO: 111215 - DNA, 496 bp, Homo sapiens; identical to SEQ ID NO: 79181
  chr16:613552-614048
  Hypo

SEQ ID NO: 111216 - DNA, 30 bp, Homo sapiens; identical to SEQ ID NO: 44404
  chr16:614353-614383
  Hypo

SEQ ID NO: 111217 - DNA, 502 bp, Homo sapiens; identical to SEQ ID NO: 79183
  chr16:614755-615257
  Hypo

SEQ ID NO: 111218 - DNA, 55 bp, Homo sapiens; identical to SEQ ID NO: 79192
  chr16:623234-623289
  Hypo

SEQ ID NO: 111219 - DNA, 112 bp, Homo sapiens; identical to SEQ ID NO: 79195
  chr16:643882-643994
  Hypo

SEQ ID NO: 111220 - DNA, 553 bp, Homo sapiens
  chr16:666712-667265
  Hypo
acttggaaatacattcgccttggagaattcaacttcaaaatgcatacgaagtaggtcagggtggaaataaaggcactgccctttctccaggcacgctggagtccacgccctgcctttgcccaatgccctctgagggagaggccctgtgccttgcacccagcgcgggccacaggcggaggccccattccaggcaagccgtgcccatggagaggctggcctgctaggctgtggggcccgatggcctgacactgtatggaccacgctcctgccctgccctgccccgccctgcccgtggcccgtgtgcagaagtgggcaggcctgggttgctgggccagagccccgagatttccccctgccccactggctgagtgtgggggagctgcttctccacttccgcgtgggtcttggccctgggaggccagtggccgaggctggtctcgcgggcgctcgctccaggagtggcgcgtcccctcagcgccctgtgcttcctcgcagggatcgactacaagaccaccaccatcctgctggacggccggcgcgtgaagctggagct

SEQ ID NO: 111221 - DNA, 77 bp, Homo sapiens; identical to SEQ ID NO: 79208
  chr16:667484-667561
  Hypo

SEQ ID NO: 111222 - DNA, 55 bp, Homo sapiens; identical to SEQ ID NO: 79214
  chr16:671371-671426
  Hypo

SEQ ID NO: 111223 - DNA, 30 bp, Homo sapiens; identical to SEQ ID NO: 79241
  chr16:677437-677467
  Hypo

SEQ ID NO: 111224 - DNA, 72 bp, Homo sapiens; identical to SEQ ID NO: 79242
  chr16:677837-677909
  Hypo

SEQ ID NO: 111225 - DNA, 217 bp, Homo sapiens; identical to SEQ ID NO: 79248
  chr16:680959-681176
  Hyper

SEQ ID NO: 111226 - DNA, 228 bp, Homo sapiens; identical to SEQ ID NO: 79285
  chr16:700101-700329
  Hypo

SEQ ID NO: 111227 - DNA, 64 bp, Homo sapiens; identical to SEQ ID NO: 44412
  chr16:700572-700636
  Hypo

SEQ ID NO: 111228 - DNA, 39 bp, Homo sapiens; identical to SEQ ID NO: 79312
  chr16:721687-721726
  Hypo

SEQ ID NO: 111229 - DNA, 703 bp, Homo sapiens; identical to SEQ ID NO: 79315
  chr16:725275-725978
  Hyper

SEQ ID NO: 111230 - DNA, 467 bp, Homo sapiens; identical to SEQ ID NO: 79316
  chr16:726580-727047
  Hypo

SEQ ID NO: 111231 - DNA, 336 bp, Homo sapiens; identical to SEQ ID NO: 79327
  chr16:731331-731667
  Hypo

SEQ ID NO: 111232 - DNA, 1210 bp, Homo sapiens; identical to SEQ ID NO: 44416
  chr16:734741-735951
  Hypo

SEQ ID NO: 111233 - DNA, 27 bp, Homo sapiens
  chr16:740887-740914
  Hypo
tgtgagccaccgcgcctggcctgtttt

SEQ ID NO: 111234 - DNA, 338 bp, Homo sapiens; identical to SEQ ID NO: 79338
  chr16:741169-741507
  Hypo

SEQ ID NO: 111235 - DNA, 49 bp, Homo sapiens
  chr16:745495-745544
  Hyper
gagaggtcaaggctgcgcagcttgcgcaggttctcggccacgagctcca

SEQ ID NO: 111236 - DNA, 1062 bp, Homo sapiens; identical to SEQ ID NO: 79346
  chr16:750349-751411
  Hyper

SEQ ID NO: 111237 - DNA, 166 bp, Homo sapiens; identical to SEQ ID NO: 79360
  chr16:755523-755689
  Hyper

SEQ ID NO: 111238 - DNA, 144 bp, Homo sapiens; identical to SEQ ID NO: 79361
  chr16:756288-756432
  Hyper

SEQ ID NO: 111239 - DNA, 30 bp, Homo sapiens; identical to SEQ ID NO: 44418
  chr16:760916-760946
  Hypo

SEQ ID NO: 111240 - DNA, 36 bp, Homo sapiens; identical to SEQ ID NO: 79371
  chr16:766969-767005
  Hypo

SEQ ID NO: 111241 - DNA, 273 bp, Homo sapiens; identical to SEQ ID NO: 79378
  chr16:775524-775797
  Hypo

SEQ ID NO: 111242 - DNA, 126 bp, Homo sapiens; identical to SEQ ID NO: 44420
  chr16:798233-798359
  Hypo

SEQ ID NO: 111243 - DNA, 665 bp, Homo sapiens; identical to SEQ ID NO: 79410
  chr16:809389-810054
  Hypo

SEQ ID NO: 111244 - DNA, 66 bp, Homo sapiens; identical to SEQ ID NO: 79421
  chr16:815699-815765
  Hypo

SEQ ID NO: 111245 - DNA, 223 bp, Homo sapiens; identical to SEQ ID NO: 79423
  chr16:816004-816227
  Hypo

SEQ ID NO: 111246 - DNA, 102 bp, Homo sapiens; identical to SEQ ID NO: 79434
  chr16:821742-821844
  Hypo

SEQ ID NO: 111247 - DNA, 16 bp, Homo sapiens
  chr16:822480-822496
  Hypo
ccgtctcaaaaaatga

SEQ ID NO: 111248 - DNA, 213 bp, Homo sapiens; identical to SEQ ID NO: 79437
  chr16:822897-823110
  Hypo

SEQ ID NO: 111249 - DNA, 145 bp, Homo sapiens; identical to SEQ ID NO: 79440
  chr16:824015-824160
  Hypo

SEQ ID NO: 111250 - DNA, 480 bp, Homo sapiens; identical to SEQ ID NO: 79441
  chr16:824923-825403
  Hypo

SEQ ID NO: 111251 - DNA, 250 bp, Homo sapiens; identical to SEQ ID NO: 44427
  chr16:837308-837558
  Hypo

SEQ ID NO: 111252 - DNA, 654 bp, Homo sapiens; identical to SEQ ID NO: 79470
  chr16:845850-846504
  Hypo

SEQ ID NO: 111253 - DNA, 78 bp, Homo sapiens; identical to SEQ ID NO: 79474
  chr16:847008-847086
  Hypo

SEQ ID NO: 111254 - DNA, 145 bp, Homo sapiens; identical to SEQ ID NO: 79547
  chr16:858656-858801
  Hypo

SEQ ID NO: 111255 - DNA, 130 bp, Homo sapiens; identical to SEQ ID NO: 79571
  chr16:863747-863877
  Hyper

SEQ ID NO: 111256 - DNA, 207 bp, Homo sapiens; identical to SEQ ID NO: 79610
  chr16:870938-871145
  Hypo

SEQ ID NO: 111257 - DNA, 70 bp, Homo sapiens; identical to SEQ ID NO: 79658
  chr16:877732-877802
  Hypo

SEQ ID NO: 111258 - DNA, 30 bp, Homo sapiens; identical to SEQ ID NO: 79661
  chr16:878827-878857
  Hypo

SEQ ID NO: 111259 - DNA, 79 bp, Homo sapiens; identical to SEQ ID NO: 44432
  chr16:882403-882482
  Hypo

SEQ ID NO: 111260 - DNA, 139 bp, Homo sapiens; identical to SEQ ID NO: 44433
  chr16:882542-882681
  Hypo

SEQ ID NO: 111261 - DNA, 71 bp, Homo sapiens; identical to SEQ ID NO: 79685
  chr16:883188-883259
  Hypo

SEQ ID NO: 111262 - DNA, 128 bp, Homo sapiens; identical to SEQ ID NO: 79688
  chr16:883606-883734
  Hypo

SEQ ID NO: 111263 - DNA, 187 bp, Homo sapiens; identical to SEQ ID NO: 79760
  chr16:888838-889025
  Hypo

SEQ ID NO: 111264 - DNA, 194 bp, Homo sapiens; identical to SEQ ID NO: 79850
  chr16:891650-891844
  Hypo

SEQ ID NO: 111265 - DNA, 37 bp, Homo sapiens; identical to SEQ ID NO: 79877
  chr16:894468-894505
  Hypo

SEQ ID NO: 111266 - DNA, 334 bp, Homo sapiens; identical to SEQ ID NO: 79878
  chr16:894865-895199
  Hypo

SEQ ID NO: 111267 - DNA, 30 bp, Homo sapiens; identical to SEQ ID NO: 79915
  chr16:899159-899189
  Hypo

SEQ ID NO: 111268 - DNA, 65 bp, Homo sapiens; identical to SEQ ID NO: 79927
  chr16:901765-901830
  Hypo

SEQ ID NO: 111269 - DNA, 42 bp, Homo sapiens; identical to SEQ ID NO: 79928
  chr16:904733-904775
  Hypo

SEQ ID NO: 111270 - DNA, 300 bp, Homo sapiens; identical to SEQ ID NO: 79934
  chr16:924548-924848
  Hypo

SEQ ID NO: 111271 - DNA, 30 bp, Homo sapiens; identical to SEQ ID NO: 79935
  chr16:925813-925843
  Hypo

SEQ ID NO: 111272 - DNA, 66 bp, Homo sapiens; identical to SEQ ID NO: 79936
  chr16:928296-928362
  Hypo

SEQ ID NO: 111273 - DNA, 30 bp, Homo sapiens; identical to SEQ ID NO: 79937
  chr16:929536-929566
  Hypo

SEQ ID NO: 111274 - DNA, 30 bp, Homo sapiens; identical to SEQ ID NO: 79939
  chr16:939019-939049
  Hypo

SEQ ID NO: 111275 - DNA, 30 bp, Homo sapiens; identical to SEQ ID NO: 79940
  chr16:942296-942326
  Hypo

SEQ ID NO: 111276 - DNA, 39 bp, Homo sapiens; identical to SEQ ID NO: 79941
  chr16:943022-943061
  Hypo

SEQ ID NO: 111277 - DNA, 187 bp, Homo sapiens; identical to SEQ ID NO: 79942
  chr16:943459-943646
  Hypo

SEQ ID NO: 111278 - DNA, 58 bp, Homo sapiens; identical to SEQ ID NO: 79943
  chr16:945674-945732
  Hypo

SEQ ID NO: 111279 - DNA, 82 bp, Homo sapiens; identical to SEQ ID NO: 79944
  chr16:946275-946357
  Hypo

SEQ ID NO: 111280 - DNA, 30 bp, Homo sapiens; identical to SEQ ID NO: 79945
  chr16:949510-949540
  Hypo

SEQ ID NO: 111281 - DNA, 565 bp, Homo sapiens; identical to SEQ ID NO: 79946
  chr16:962833-963398
  Hypo

SEQ ID NO: 111282 - DNA, 83 bp, Homo sapiens; identical to SEQ ID NO: 79947
  chr16:965804-965887
  Hypo

SEQ ID NO: 111283 - DNA, 30 bp, Homo sapiens; identical to SEQ ID NO: 44442
  chr16:968262-968292
  Hypo

SEQ ID NO: 111284 - DNA, 90 bp, Homo sapiens; identical to SEQ ID NO: 79949
  chr16:968556-968646
  Hypo

SEQ ID NO: 111285 - DNA, 30 bp, Homo sapiens; identical to SEQ ID NO: 79950
  chr16:969209-969239
  Hypo

SEQ ID NO: 111286 - DNA, 30 bp, Homo sapiens; identical to SEQ ID NO: 79951
  chr16:977343-977373
  Hypo

SEQ ID NO: 111287 - DNA, 114 bp, Homo sapiens; identical to SEQ ID NO: 79952
  chr16:981729-981843
  Hypo

SEQ ID NO: 111288 - DNA, 30 bp, Homo sapiens; identical to SEQ ID NO: 79953
  chr16:982069-982099
  Hypo

SEQ ID NO: 111289 - DNA, 30 bp, Homo sapiens; identical to SEQ ID NO: 79954
  chr16:983721-983751
  Hypo

SEQ ID NO: 111290 - DNA, 34 bp, Homo sapiens; identical to SEQ ID NO: 78281
  chr16:1009722-1009756
  Hypo

SEQ ID NO: 111291 - DNA, 132 bp, Homo sapiens; identical to SEQ ID NO: 78284
  chr16:1018120-1018252
  Hypo

SEQ ID NO: 111292 - DNA, 42 bp, Homo sapiens; identical to SEQ ID NO: 78285
  chr16:1022772-1022814
  Hypo

SEQ ID NO: 111293 - DNA, 582 bp, Homo sapiens
  chr16:1030275-1030857
  Hyper
gtctgcggacgggggcgggcggccgctgggggcaccagctctcggccgggccagaacagggggtaggaggcgcgtcctgtgcggtcggtggcggccccaggtgggtgcggtgcgctggcaggaagcggcagcacgacccccgactttgcatctggacttttctagtaacggaccagctccttctgccgaccgggccggggagaccgcgtggctcagtggctgcagcggccaccggcccgggcgtgggggctttgagggcaccggcgcggtaggtcacccgggtttcgcgggccgcaagctcggagacgcgcgtgtcccgcgttggctgcctgacccggaatggcgcagccccttcgcctccagcgcgctggttgaaaggatccgagccaccctcggggacggccgggccgaggccacctcgcggggcggccttgggcggggacccggacccgcggttggacgttcgcctcggggggggcaatgtcccctctccgaccccgcggtccccaccagggcggcacaccccgccctctccccgcctccgcaggcgcccagggctcacaggctcggagcggcctccgc

SEQ ID NO: 111294 - DNA, 199 bp, Homo sapiens; identical to SEQ ID NO: 78290
  chr16:1031067-1031266
  Hyper

SEQ ID NO: 111295 - DNA, 138 bp, Homo sapiens; identical to SEQ ID NO: 78291
  chr16:1031386-1031524
  Hyper

SEQ ID NO: 111296 - DNA, 706 bp, Homo sapiens; identical to SEQ ID NO: 78292
  chr16:1031741-1032447
  Hyper

SEQ ID NO: 111297 - DNA, 30 bp, Homo sapiens; identical to SEQ ID NO: 78293
  chr16:1034635-1034665
  Hypo

SEQ ID NO: 111298 - DNA, 182 bp, Homo sapiens
  chr16:1035292-1035474
  Hypo
ctcacccctgctcaacggcctggccctgccgcccgcccacagccccaccagtcactgggaccagccggtgtacaccaccctgaccaggccctgagggcccagccgcggggagggactcgcaggcgtcagggggcagccttgtcccggcccagtgtgtgtgaccagggcgggaggggccccag

SEQ ID NO: 111299 - DNA, 30 bp, Homo sapiens; identical to SEQ ID NO: 78295
  chr16:1039445-1039475
  Hypo

SEQ ID NO: 111300 - DNA, 168 bp, Homo sapiens; identical to SEQ ID NO: 78296
  chr16:1040337-1040505
  Hypo

SEQ ID NO: 111301 - DNA, 30 bp, Homo sapiens; identical to SEQ ID NO: 78299
  chr16:1050321-1050351
  Hypo

SEQ ID NO: 111302 - DNA, 30 bp, Homo sapiens; identical to SEQ ID NO: 78300
  chr16:1052148-1052178
  Hypo

SEQ ID NO: 111303 - DNA, 372 bp, Homo sapiens; identical to SEQ ID NO: 78301
  chr16:1052442-1052814
  Hypo

SEQ ID NO: 111304 - DNA, 30 bp, Homo sapiens; identical to SEQ ID NO: 78302
  chr16:1053812-1053842
  Hypo

SEQ ID NO: 111305 - DNA, 94 bp, Homo sapiens; identical to SEQ ID NO: 78303
  chr16:1061426-1061520
  Hypo

SEQ ID NO: 111306 - DNA, 32 bp, Homo sapiens; identical to SEQ ID NO: 44449
  chr16:1062412-1062444
  Hypo

SEQ ID NO: 111307 - DNA, 30 bp, Homo sapiens; identical to SEQ ID NO: 78305
  chr16:1062655-1062685
  Hypo

SEQ ID NO: 111308 - DNA, 30 bp, Homo sapiens; identical to SEQ ID NO: 78306
  chr16:1067752-1067782
  Hypo

SEQ ID NO: 111309 - DNA, 112 bp, Homo sapiens; identical to SEQ ID NO: 78307
  chr16:1071854-1071966
  Hypo

SEQ ID NO: 111310 - DNA, 136 bp, Homo sapiens; identical to SEQ ID NO: 78309
  chr16:1072992-1073128
  Hypo

SEQ ID NO: 111311 - DNA, 42 bp, Homo sapiens; identical to SEQ ID NO: 44451
  chr16:1073516-1073558
  Hypo

SEQ ID NO: 111312 - DNA, 30 bp, Homo sapiens; identical to SEQ ID NO: 78311
  chr16:1075075-1075105
  Hypo

SEQ ID NO: 111313 - DNA, 51 bp, Homo sapiens; identical to SEQ ID NO: 44452
  chr16:1076434-1076485
  Hypo

SEQ ID NO: 111314 - DNA, 104 bp, Homo sapiens; identical to SEQ ID NO: 78313
  chr16:1077555-1077659
  Hypo

SEQ ID NO: 111315 - DNA, 63 bp, Homo sapiens; identical to SEQ ID NO: 78314
  chr16:1077886-1077949
  Hypo

SEQ ID NO: 111316 - DNA, 217 bp, Homo sapiens; identical to SEQ ID NO: 15968
  chr16:1081773-1081990
  Hypo

SEQ ID NO: 111317 - DNA, 42 bp, Homo sapiens; identical to SEQ ID NO: 78317
  chr16:1089124-1089166
  Hypo

SEQ ID NO: 111318 - DNA, 30 bp, Homo sapiens; identical to SEQ ID NO: 44455
  chr16:1089739-1089769
  Hypo

SEQ ID NO: 111319 - DNA, 30 bp, Homo sapiens; identical to SEQ ID NO: 78319
  chr16:1090322-1090352
  Hypo

SEQ ID NO: 111320 - DNA, 103 bp, Homo sapiens; identical to SEQ ID NO: 78320
  chr16:1090678-1090781
  Hypo

SEQ ID NO: 111321 - DNA, 30 bp, Homo sapiens; identical to SEQ ID NO: 44456
  chr16:1092742-1092772
  Hypo

SEQ ID NO: 111322 - DNA, 53 bp, Homo sapiens; identical to SEQ ID NO: 78322
  chr16:1096684-1096737
  Hypo

SEQ ID NO: 111323 - DNA, 89 bp, Homo sapiens; identical to SEQ ID NO: 78323
  chr16:1101018-1101107
  Hypo

SEQ ID NO: 111324 - DNA, 81 bp, Homo sapiens; identical to SEQ ID NO: 78324
  chr16:1103110-1103191
  Hypo

SEQ ID NO: 111325 - DNA, 30 bp, Homo sapiens; identical to SEQ ID NO: 78326
  chr16:1111359-1111389
  Hypo

SEQ ID NO: 111326 - DNA, 46 bp, Homo sapiens; identical to SEQ ID NO: 78328
  chr16:1111971-1112017
  Hypo

SEQ ID NO: 111327 - DNA, 72 bp, Homo sapiens; identical to SEQ ID NO: 78329
  chr16:1113889-1113961
  Hypo

SEQ ID NO: 111328 - DNA, 39 bp, Homo sapiens; identical to SEQ ID NO: 78332
  chr16:1116820-1116859
  Hypo

SEQ ID NO: 111329 - DNA, 30 bp, Homo sapiens; identical to SEQ ID NO: 78334
  chr16:1118971-1119001
  Hypo

SEQ ID NO: 111330 - DNA, 30 bp, Homo sapiens; identical to SEQ ID NO: 78337
  chr16:1125274-1125304
  Hypo

SEQ ID NO: 111331 - DNA, 420 bp, Homo sapiens; identical to SEQ ID NO: 78339
  chr16:1128947-1129367
  Hypo

SEQ ID NO: 111332 - DNA, 65 bp, Homo sapiens; identical to SEQ ID NO: 78342
  chr16:1142015-1142080
  Hypo

SEQ ID NO: 111333 - DNA, 30 bp, Homo sapiens; identical to SEQ ID NO: 78344
  chr16:1148193-1148223
  Hypo

SEQ ID NO: 111334 - DNA, 198 bp, Homo sapiens; identical to SEQ ID NO: 78346
  chr16:1155071-1155269
  Hypo

SEQ ID NO: 111335 - DNA, 232 bp, Homo sapiens; identical to SEQ ID NO: 78348
  chr16:1157293-1157525
  Hypo

SEQ ID NO: 111336 - DNA, 46 bp, Homo sapiens; identical to SEQ ID NO: 78349
  chr16:1164458-1164504
  Hypo

SEQ ID NO: 111337 - DNA, 225 bp, Homo sapiens; identical to SEQ ID NO: 78350
  chr16:1166553-1166778
  Hypo

SEQ ID NO: 111338 - DNA, 169 bp, Homo sapiens; identical to SEQ ID NO: 78352
  chr16:1171138-1171307
  Hypo

SEQ ID NO: 111339 - DNA, 155 bp, Homo sapiens; identical to SEQ ID NO: 78354
  chr16:1173250-1173405
  Hypo

SEQ ID NO: 111340 - DNA, 25 bp, Homo sapiens
  chr16:1186732-1186757
  Hypo
gggtgcggtggctcacgcctgtcat

SEQ ID NO: 111341 - DNA, 30 bp, Homo sapiens; identical to SEQ ID NO: 78360
  chr16:1187602-1187632
  Hypo

SEQ ID NO: 111342 - DNA, 36 bp, Homo sapiens; identical to SEQ ID NO: 78362
  chr16:1188922-1188958
  Hypo

SEQ ID NO: 111343 - DNA, 179 bp, Homo sapiens; identical to SEQ ID NO: 78363
  chr16:1195670-1195849
  Hypo

SEQ ID NO: 111344 - DNA, 34 bp, Homo sapiens; identical to SEQ ID NO: 78364
  chr16:1196701-1196735
  Hypo

SEQ ID NO: 111345 - DNA, 30 bp, Homo sapiens; identical to SEQ ID NO: 78365
  chr16:1198450-1198480
  Hypo

SEQ ID NO: 111346 - DNA, 30 bp, Homo sapiens; identical to SEQ ID NO: 78366
  chr16:1199021-1199051
  Hypo

SEQ ID NO: 111347 - DNA, 48 bp, Homo sapiens
  chr16:1202525-1202573
  Hyper
gcgccccatcacacacgcgcgcgcgggcacacccgggacacacacgcg

SEQ ID NO: 111348 - DNA, 1107 bp, Homo sapiens
  chr16:1203201-1204308
  Hyper
ccggcctcacccgtccgctcagcggcctccacgccgcgccgaggccgccgccgtcgcctccgccgggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgagacgcggcgaggacgcgcgcccgggaccctcttcaacttgcgcgaagcgggccggggagcccctcggggtgggggtggggccgctggagggagggagggggcgggcgggggcggggggcgcgtttgtctctaataagaaaagacaaagacatcccggcggccgcggctgttcccgcagctccgcgccgcgggaggcagggcgggggcgtcgccaccggccccgggtcaccccctgtcctctgcaggtgctgccggccgccaccatgaccgagggcgcacgggccgccgacgaggtccgggtgcccctgggcgcgccgccccctggccctgcggcgttggtgggggcgtccccggagagccccggggcgccgggacgcgaggcggagcgggggtccgagctcggcgtgtcaccctccgagagcccggcggccgagcgcggcgcggagctgggtgccgacgaggagcagcgcgtcccgtacccggccttggcggccacggtcttcttctgcctcggtcagaccacgcggccgcgcagctggtgcctccggctggtctgcaacccatatccttcccggccggcggggggcggggggcggggggcgtggggagggtgggggcccggggcgcgggactccctcggcatgcgcccccgcgcgcccctgttggtgggacctggcgtgggccgggcgcgcgggggtgcagggcaggggctggaggaccgcgctctaatttctgagagtggcgggcttggggggccaccgggcgcctccggactcccttccccagggccggctccggacggagaaggtggaagcgaagcggtgaggcccccgc

SEQ ID NO: 111349 - DNA, 30 bp, Homo sapiens; identical to SEQ ID NO: 78373
  chr16:1207059-1207089
  Hypo

SEQ ID NO: 111350 - DNA, 38 bp, Homo sapiens; identical to SEQ ID NO: 78374
  chr16:1207490-1207528
  Hypo

SEQ ID NO: 111351 - DNA, 55 bp, Homo sapiens; identical to SEQ ID NO: 78375
  chr16:1209218-1209273
  Hypo

SEQ ID NO: 111352 - DNA, 41 bp, Homo sapiens; identical to SEQ ID NO: 78378
  chr16:1213983-1214024
  Hypo

SEQ ID NO: 111353 - DNA, 30 bp, Homo sapiens; identical to SEQ ID NO: 78379
  chr16:1214993-1215023
  Hypo

SEQ ID NO: 111354 - DNA, 155 bp, Homo sapiens; identical to SEQ ID NO: 78380
  chr16:1216382-1216537
  Hypo

SEQ ID NO: 111355 - DNA, 30 bp, Homo sapiens; identical to SEQ ID NO: 78381
  chr16:1216945-1216975
  Hypo

SEQ ID NO: 111356 - DNA, 321 bp, Homo sapiens; identical to SEQ ID NO: 78382
  chr16:1217182-1217503
  Hypo

SEQ ID NO: 111357 - DNA, 307 bp, Homo sapiens; identical to SEQ ID NO: 78384
  chr16:1217833-1218140
  Hypo

SEQ ID NO: 111358 - DNA, 30 bp, Homo sapiens; identical to SEQ ID NO: 78385
  chr16:1218638-1218668
  Hypo

SEQ ID NO: 111359 - DNA, 215 bp, Homo sapiens; identical to SEQ ID NO: 78386
  chr16:1220501-1220716
  Hypo

SEQ ID NO: 111360 - DNA, 30 bp, Homo sapiens; identical to SEQ ID NO: 44469
  chr16:1222610-1222640
  Hypo

SEQ ID NO: 111361 - DNA, 30 bp, Homo sapiens; identical to SEQ ID NO: 78388
  chr16:1227328-1227358
  Hypo

SEQ ID NO: 111362 - DNA, 151 bp, Homo sapiens; identical to SEQ ID NO: 15975
  chr16:1228780-1228931
  Hypo

SEQ ID NO: 111363 - DNA, 342 bp, Homo sapiens; identical to SEQ ID NO: 78390
  chr16:1230012-1230354
  Hypo

SEQ ID NO: 111364 - DNA, 656 bp, Homo sapiens; identical to SEQ ID NO: 78391
  chr16:1236485-1237141
  Hypo

SEQ ID NO: 111365 - DNA, 39 bp, Homo sapiens; identical to SEQ ID NO: 78392
  chr16:1245806-1245845
  Hypo

SEQ ID NO: 111366 - DNA, 36 bp, Homo sapiens; identical to SEQ ID NO: 78393
  chr16:1247968-1248004
  Hypo

SEQ ID NO: 111367 - DNA, 570 bp, Homo sapiens; identical to SEQ ID NO: 78394
  chr16:1248352-1248922
  Hypo

SEQ ID NO: 111368 - DNA, 272 bp, Homo sapiens; identical to SEQ ID NO: 78395
  chr16:1250262-1250534
  Hypo

SEQ ID NO: 111369 - DNA, 142 bp, Homo sapiens; identical to SEQ ID NO: 78396
  chr16:1251693-1251835
  Hypo

SEQ ID NO: 111370 - DNA, 51 bp, Homo sapiens; identical to SEQ ID NO: 44477
  chr16:1253065-1253116
  Hypo

SEQ ID NO: 111371 - DNA, 119 bp, Homo sapiens; identical to SEQ ID NO: 78398
  chr16:1255901-1256020
  Hypo

SEQ ID NO: 111372 - DNA, 359 bp, Homo sapiens; identical to SEQ ID NO: 78399
  chr16:1259060-1259419
  Hypo

SEQ ID NO: 111373 - DNA, 102 bp, Homo sapiens; identical to SEQ ID NO: 78400
  chr16:1259773-1259875
  Hypo

SEQ ID NO: 111374 - DNA, 221 bp, Homo sapiens; identical to SEQ ID NO: 78401
  chr16:1260220-1260441
  Hypo

SEQ ID NO: 111375 - DNA, 67 bp, Homo sapiens; identical to SEQ ID NO: 78402
  chr16:1260766-1260833
  Hypo

SEQ ID NO: 111376 - DNA, 30 bp, Homo sapiens; identical to SEQ ID NO: 78403
  chr16:1261095-1261125
  Hypo

SEQ ID NO: 111377 - DNA, 582 bp, Homo sapiens; identical to SEQ ID NO: 78404
  chr16:1261601-1262183
  Hypo

SEQ ID NO: 111378 - DNA, 47 bp, Homo sapiens; identical to SEQ ID NO: 44481
  chr16:1262447-1262494
  Hypo

SEQ ID NO: 111379 - DNA, 38 bp, Homo sapiens; identical to SEQ ID NO: 78406
  chr16:1262762-1262800
  Hypo

SEQ ID NO: 111380 - DNA, 33 bp, Homo sapiens; identical to SEQ ID NO: 78407
  chr16:1263717-1263750
  Hypo

SEQ ID NO: 111381 - DNA, 30 bp, Homo sapiens; identical to SEQ ID NO: 78408
  chr16:1264397-1264427
  Hypo

SEQ ID NO: 111382 - DNA, 183 bp, Homo sapiens; identical to SEQ ID NO: 78409
  chr16:1265150-1265333
  Hypo

SEQ ID NO: 111383 - DNA, 97 bp, Homo sapiens; identical to SEQ ID NO: 78410
  chr16:1265614-1265711
  Hypo

SEQ ID NO: 111384 - DNA, 40 bp, Homo sapiens; identical to SEQ ID NO: 78411
  chr16:1266380-1266420
  Hypo

SEQ ID NO: 111385 - DNA, 30 bp, Homo sapiens; identical to SEQ ID NO: 44483
  chr16:1267184-1267214
  Hypo

SEQ ID NO: 111386 - DNA, 869 bp, Homo sapiens; identical to SEQ ID NO: 78413
  chr16:1267696-1268565
  Hypo

SEQ ID NO: 111387 - DNA, 252 bp, Homo sapiens; identical to SEQ ID NO: 78414
  chr16:1270197-1270449
  Hypo

SEQ ID NO: 111388 - DNA, 517 bp, Homo sapiens; identical to SEQ ID NO: 78415
  chr16:1271155-1271672
  Hypo

SEQ ID NO: 111389 - DNA, 38 bp, Homo sapiens; identical to SEQ ID NO: 44487
  chr16:1272194-1272232
  Hypo

SEQ ID NO: 111390 - DNA, 30 bp, Homo sapiens; identical to SEQ ID NO: 44488
  chr16:1288468-1288498
  Hypo

SEQ ID NO: 111391 - DNA, 30 bp, Homo sapiens; identical to SEQ ID NO: 78423
  chr16:1297961-1297991
  Hypo

SEQ ID NO: 111392 - DNA, 64 bp, Homo sapiens; identical to SEQ ID NO: 78427
  chr16:1307000-1307064
  Hypo

SEQ ID NO: 111393 - DNA, 30 bp, Homo sapiens; identical to SEQ ID NO: 78428
  chr16:1307785-1307815
  Hypo

SEQ ID NO: 111394 - DNA, 318 bp, Homo sapiens; identical to SEQ ID NO: 78429
  chr16:1312397-1312715
  Hypo

SEQ ID NO: 111395 - DNA, 133 bp, Homo sapiens; identical to SEQ ID NO: 44491
  chr16:1315371-1315504
  Hypo

SEQ ID NO: 111396 - DNA, 30 bp, Homo sapiens; identical to SEQ ID NO: 78431
  chr16:1316065-1316095
  Hypo

SEQ ID NO: 111397 - DNA, 33 bp, Homo sapiens; identical to SEQ ID NO: 78432
  chr16:1321465-1321498
  Hypo

SEQ ID NO: 111398 - DNA, 432 bp, Homo sapiens; identical to SEQ ID NO: 78433
  chr16:1323678-1324110
  Hypo

SEQ ID NO: 111399 - DNA, 51 bp, Homo sapiens; identical to SEQ ID NO: 78435
  chr16:1329677-1329728
  Hypo

SEQ ID NO: 111400 - DNA, 36 bp, Homo sapiens; identical to SEQ ID NO: 78436
  chr16:1330337-1330373
  Hypo

SEQ ID NO: 111401 - DNA, 280 bp, Homo sapiens; identical to SEQ ID NO: 78437
  chr16:1330636-1330916
  Hypo

SEQ ID NO: 111402 - DNA, 324 bp, Homo sapiens; identical to SEQ ID NO: 36012
  chr16:1382374-1382698
  Hyper

SEQ ID NO: 111403 - DNA, 324 bp, Homo sapiens; identical to SEQ ID NO: 36013
  chr16:1382818-1383142
  Hyper

SEQ ID NO: 111404 - DNA, 420 bp, Homo sapiens
  chr16:1383678-1384098
  Hyper
gtgcctcggcgtccccgagctggtgccgagcgcagcgccccaggagcccccccatccccgcgccggcccacggtaagtgccgcgggctgcggccagtgctgttgggccgccgtctgggctcggccccgcgccccaacccggacggaccgacggccgccgcccccttggtccgggtcccccaggaggcacgggggtggcctccgaggcggggggcggtgggaaggtctcgacgtcccctcggccctggggaaactgaggccgcgcatgcttggaggggcggggtctcgggggcatttcccctccgaacgcgcaggagagggtgcggcggtggggtccgcactgcggagcggacggggagggtatccgggcgctggcgacggcctcccccgcacttgagccgccaagcgaggcttcgacccc

SEQ ID NO: 111405 - DNA, 312 bp, Homo sapiens; identical to SEQ ID NO: 78444
  chr16:1384458-1384770
  Hyper

SEQ ID NO: 111406 - DNA, 30 bp, Homo sapiens; identical to SEQ ID NO: 78445
  chr16:1390516-1390546
  Hypo

SEQ ID NO: 111407 - DNA, 527 bp, Homo sapiens; identical to SEQ ID NO: 78446
  chr16:1391705-1392232
  Hypo

SEQ ID NO: 111408 - DNA, 30 bp, Homo sapiens; identical to SEQ ID NO: 78447
  chr16:1394474-1394504
  Hypo

SEQ ID NO: 111409 - DNA, 30 bp, Homo sapiens; identical to SEQ ID NO: 44496
  chr16:1397121-1397151
  Hypo

SEQ ID NO: 111410 - DNA, 437 bp, Homo sapiens; identical to SEQ ID NO: 78449
  chr16:1397422-1397859
  Hypo

SEQ ID NO: 111411 - DNA, 112 bp, Homo sapiens; identical to SEQ ID NO: 78451
  chr16:1400845-1400957
  Hypo

SEQ ID NO: 111412 - DNA, 30 bp, Homo sapiens; identical to SEQ ID NO: 78452
  chr16:1404083-1404113
  Hypo

SEQ ID NO: 111413 - DNA, 32 bp, Homo sapiens; identical to SEQ ID NO: 78453
  chr16:1407453-1407485
  Hypo

SEQ ID NO: 111414 - DNA, 151 bp, Homo sapiens; identical to SEQ ID NO: 78454
  chr16:1407785-1407936
  Hypo

SEQ ID NO: 111415 - DNA, 364 bp, Homo sapiens; identical to SEQ ID NO: 78455
  chr16:1417076-1417440
  Hypo

SEQ ID NO: 111416 - DNA, 431 bp, Homo sapiens; identical to SEQ ID NO: 78456
  chr16:1417675-1418106
  Hypo

SEQ ID NO: 111417 - DNA, 30 bp, Homo sapiens; identical to SEQ ID NO: 78457
  chr16:1424439-1424469
  Hypo

SEQ ID NO: 111418 - DNA, 284 bp, Homo sapiens; identical to SEQ ID NO: 78458
  chr16:1425400-1425684
  Hypo

SEQ ID NO: 111419 - DNA, 794 bp, Homo sapiens; identical to SEQ ID NO: 44503
  chr16:1428113-1428907
  Hypo

SEQ ID NO: 111420 - DNA, 266 bp, Homo sapiens; identical to SEQ ID NO: 78461
  chr16:1430200-1430466
  Hypo

SEQ ID NO: 111421 - DNA, 39 bp, Homo sapiens; identical to SEQ ID NO: 78465
  chr16:1469293-1469332
  Hypo

SEQ ID NO: 111422 - DNA, 98 bp, Homo sapiens; identical to SEQ ID NO: 78466
  chr16:1469572-1469670
  Hypo

SEQ ID NO: 111423 - DNA, 91 bp, Homo sapiens; identical to SEQ ID NO: 78472
  chr16:1477599-1477690
  Hypo

SEQ ID NO: 111424 - DNA, 367 bp, Homo sapiens; identical to SEQ ID NO: 78473
  chr16:1486290-1486657
  Hypo

SEQ ID NO: 111425 - DNA, 129 bp, Homo sapiens; identical to SEQ ID NO: 78474
  chr16:1487040-1487169
  Hypo

SEQ ID NO: 111426 - DNA, 49 bp, Homo sapiens; identical to SEQ ID NO: 78475
  chr16:1487580-1487629
  Hypo

SEQ ID NO: 111427 - DNA, 150 bp, Homo sapiens; identical to SEQ ID NO: 78476
  chr16:1487901-1488051
  Hypo

SEQ ID NO: 111428 - DNA, 30 bp, Homo sapiens; identical to SEQ ID NO: 44506
  chr16:1488680-1488710
  Hypo

SEQ ID NO: 111429 - DNA, 498 bp, Homo sapiens; identical to SEQ ID NO: 78478
  chr16:1491115-1491613
  Hypo

SEQ ID NO: 111430 - DNA, 117 bp, Homo sapiens; identical to SEQ ID NO: 78479
  chr16:1493574-1493691
  Hypo

SEQ ID NO: 111431 - DNA, 24 bp, Homo sapiens
  chr16:1524070-1524094
  Hypo
gtgaaactccgtctcaaaaaaaaa

SEQ ID NO: 111432 - DNA, 24 bp, Homo sapiens
  chr16:1523806-1523830
  Hypo
aggcgcagtggctcacgcctgtaa

SEQ ID NO: 111433 - DNA, 86 bp, Homo sapiens; identical to SEQ ID NO: 78485
  chr16:1541511-1541597
  Hypo

SEQ ID NO: 111434 - DNA, 30 bp, Homo sapiens; identical to SEQ ID NO: 78501
  chr16:1576652-1576682
  Hypo

SEQ ID NO: 111435 - DNA, 30 bp, Homo sapiens; identical to SEQ ID NO: 78503
  chr16:1580669-1580699
  Hypo

SEQ ID NO: 111436 - DNA, 119 bp, Homo sapiens; identical to SEQ ID NO: 78510
  chr16:1642740-1642859
  Hypo

SEQ ID NO: 111437 - DNA, 30 bp, Homo sapiens; identical to SEQ ID NO: 78512
  chr16:1682337-1682367
  Hypo

SEQ ID NO: 111438 - DNA, 30 bp, Homo sapiens; identical to SEQ ID NO: 78517
  chr16:1725008-1725038
  Hypo

SEQ ID NO: 111439 - DNA, 120 bp, Homo sapiens; identical to SEQ ID NO: 78519
  chr16:1729679-1729799
  Hypo

SEQ ID NO: 111440 - DNA, 455 bp, Homo sapiens; identical to SEQ ID NO: 44511
  chr16:1730306-1730761
  Hypo

SEQ ID NO: 111441 - DNA, 30 bp, Homo sapiens; identical to SEQ ID NO: 44512
  chr16:1734955-1734985
  Hypo

SEQ ID NO: 111442 - DNA, 30 bp, Homo sapiens; identical to SEQ ID NO: 78525
  chr16:1738302-1738332
  Hypo

SEQ ID NO: 111443 - DNA, 42 bp, Homo sapiens; identical to SEQ ID NO: 78526
  chr16:1738667-1738709
  Hypo

SEQ ID NO: 111444 - DNA, 54 bp, Homo sapiens; identical to SEQ ID NO: 78527
  chr16:1740152-1740206
  Hypo

SEQ ID NO: 111445 - DNA, 386 bp, Homo sapiens; identical to SEQ ID NO: 78528
  chr16:1741726-1742112
  Hypo

SEQ ID NO: 111446 - DNA, 30 bp, Homo sapiens; identical to SEQ ID NO: 78532
  chr16:1782670-1782700
  Hypo

SEQ ID NO: 111447 - DNA, 30 bp, Homo sapiens; identical to SEQ ID NO: 78535
  chr16:1793857-1793887
  Hypo

SEQ ID NO: 111448 - DNA, 119 bp, Homo sapiens; identical to SEQ ID NO: 78536
  chr16:1807880-1807999
  Hypo

SEQ ID NO: 111449 - DNA, 555 bp, Homo sapiens; identical to SEQ ID NO: 78537
  chr16:1813482-1814037
  Hypo

SEQ ID NO: 111450 - DNA, 116 bp, Homo sapiens; identical to SEQ ID NO: 78538
  chr16:1814253-1814369
  Hypo

SEQ ID NO: 111451 - DNA, 68 bp, Homo sapiens; identical to SEQ ID NO: 78539
  chr16:1831357-1831425
  Hypo

SEQ ID NO: 111452 - DNA, 77 bp, Homo sapiens; identical to SEQ ID NO: 78540
  chr16:1833990-1834067
  Hypo

SEQ ID NO: 111453 - DNA, 36 bp, Homo sapiens; identical to SEQ ID NO: 78541
  chr16:1839644-1839680
  Hypo

SEQ ID NO: 111454 - DNA, 30 bp, Homo sapiens; identical to SEQ ID NO: 78542
  chr16:1844136-1844166
  Hypo

SEQ ID NO: 111455 - DNA, 30 bp, Homo sapiens; identical to SEQ ID NO: 78543
  chr16:1854152-1854182
  Hypo

SEQ ID NO: 111456 - DNA, 30 bp, Homo sapiens; identical to SEQ ID NO: 78546
  chr16:1889598-1889628
  Hypo

SEQ ID NO: 111457 - DNA, 17 bp, Homo sapiens
  chr16:1900285-1900302
  Hypo
gtaaaaataacaggccg

SEQ ID NO: 111458 - DNA, 212 bp, Homo sapiens
  chr16:1922108-1922320
  Hyper
ctcgggccacagcctcgtgcaggtgcgacggccgcgcgaccgttagcgcgaggccccgccccgtcctcagcgactccgcccccaccgctcactgactccgcccccaccgctcactggctccgcccccaccgctcactggctccgcccccaacgcgctcagactcagccctcgggggaggggaggggagcccggttcccgtttcctccttctt

SEQ ID NO: 111459 - DNA, 30 bp, Homo sapiens; identical to SEQ ID NO: 78556
  chr16:1946488-1946518
  Hypo

SEQ ID NO: 111460 - DNA, 30 bp, Homo sapiens; identical to SEQ ID NO: 44519
  chr16:1946973-1947003
  Hypo

SEQ ID NO: 111461 - DNA, 30 bp, Homo sapiens; identical to SEQ ID NO: 78565
  chr16:1960214-1960244
  Hypo

SEQ ID NO: 111462 - DNA, 36 bp, Homo sapiens; identical to SEQ ID NO: 78566
  chr16:1962525-1962561
  Hypo

SEQ ID NO: 111463 - DNA, 90 bp, Homo sapiens; identical to SEQ ID NO: 78567
  chr16:1967819-1967909
  Hyper

SEQ ID NO: 111464 - DNA, 898 bp, Homo sapiens; identical to SEQ ID NO: 78568
  chr16:1968132-1969030
  Hyper

SEQ ID NO: 111465 - DNA, 30 bp, Homo sapiens; identical to SEQ ID NO: 78576
  chr16:2020979-2021009
  Hypo

SEQ ID NO: 111466 - DNA, 668 bp, Homo sapiens; identical to SEQ ID NO: 78577
  chr16:2028539-2029207
  Hypo

SEQ ID NO: 111467 - DNA, 32 bp, Homo sapiens; identical to SEQ ID NO: 78579
  chr16:2033521-2033553
  Hyper

SEQ ID NO: 111468 - DNA, 1656 bp, Homo sapiens
  chr16:2040847-2042503
  Hyper
aacctctgggccagccgcacctcggcgcctgtcttggaggagggcggtgcccacggtggggcaggggctttggcctcccctgcggagtggctctgaccagaccgggaggcaggacgctgcgttttggtccgagcgcacgtcccgacttgtggcccactcttggggacaagtgcatgtcccggcttcccccttggctccactctcggagctggagcgggaaaggagcgaagggatgaggttgaggctggaggtcgtttcttggaaacacagggctgccccgtgcagcgctggttaaaatgactgcggtccccctcatgcctgtctcccggaactggtgggcaggaggcattgaggtttgacggaacctcagaggtcaacggtgtcatcttttcagcccaaacacttacaggtgatattaataatcagtcacgtgggggctgtcatccctcgggtacccaccacgtgcaggaagctgggtggacatgtctgtcccagcactgcatgagctgtgcccgtcaccctatttgcatgctagaaaacaggccagacagttcccaaccgcgcaggaagcaacagctccgctgcctccataccctccctcccgccccgctctgcctgctgcactctcacctccccttcgccgttccggctccagcctgggaatcgcgggcccaggtgaaggctcctgttcccacactcttgagtgggctctgaggggactccacgggcccacgcggtgcagagtacctggcttgaatcaaccccggcttttgtcagccatgtgatcccggacaagtcacttcacctgttggggtcccaatgtcccccgcatttataaagagaataagaacaatggcgatcccacggggactttctgaggatttggtgaggggacgcatgtaaagtggctgtttaacacaatgtctgggcatagtagatgctcactaaacggcccgtgttgtcaataattactaaatacgcgagggttcgggaaagaaagaggtgacaccgccccccacccagatacgggcctgggaacgcagggacaggcccaggggcgtgggcgctcgaggcgggctcgcagaggtcgggtcgccgcagggccctgagcgccgcgccgcacgcaggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaatcagcagcgtccgcgaccgccggcgcgcggtgttgctggacctgggcttctcaggtgggcggggccggggcggtgagcgcggagagccttccgggtgggcggggagggggcggggcctgggcggggaacaccgctggagtttccagctgggcgtggccgtgacgaggggcggggactgaggcagggagtgtcaatgggcctcccgggtgggcggggagggggcggagcctggacggggagcgccgcgggactttctaggtaggcggggcccgggtctgggcggagcctgggcgcggaacgggtctggcgctcccgggtgggcggggtcagcgcaggagagggagg

SEQ ID NO: 111469 - DNA, 36 bp, Homo sapiens; identical to SEQ ID NO: 78587
  chr16:2048205-2048241
  Hypo

SEQ ID NO: 111470 - DNA, 92 bp, Homo sapiens; identical to SEQ ID NO: 78588
  chr16:2068929-2069021
  Hypo

SEQ ID NO: 111471 - DNA, 653 bp, Homo sapiens
  chr16:2069769-2070422
  Hyper
cctgcaggggacccacggctcgcctccagcctcctgcgctccggtacctgggcgtcccaactccactgcgcgcccaaacccagccgagccggttcgtggcccgccccgccgggcggccgtcgacgcgagcgccctggcgtggcgcccaggggagcggggggctcccgcgagccggccgcggctggcactgctgctgcttctgctcctgctgccgctgccctccggcgcgtggtacaagcacgtggcgagtccccgctaccacacggtgggccgcgccgctggcctgctcatggggctgcgtcgctcaccctatctgtggcgccgcgcgctgcgcgcggccgccgggcccctggccagggacaccctctcccccgaacccgcagcccgcgaggctcctctcctgctgccctcgtgggttcaggagctgtgggagacgcgacgcaggagctcccaggcagggatccccgtccgtgcgccccggagcccgcgcgccccagagcctgcgctggaaccggagtccctggacttcagcggagctggccaggtacgtgagaggggagaggcctggaccgccgcgggcaagggggtctcgggaggtctgagccggagcacggagccgcgcgttcagggggcaccctcgggcccttccattc

SEQ ID NO: 111472 - DNA, 51 bp, Homo sapiens; identical to SEQ ID NO: 78591
  chr16:2083370-2083421
  Hyper

SEQ ID NO: 111473 - DNA, 622 bp, Homo sapiens; identical to SEQ ID NO: 78593
  chr16:2104762-2105384
  Hypo

SEQ ID NO: 111474 - DNA, 41 bp, Homo sapiens; identical to SEQ ID NO: 78594
  chr16:2106600-2106641
  Hypo

SEQ ID NO: 111475 - DNA, 42 bp, Homo sapiens; identical to SEQ ID NO: 78595
  chr16:2107015-2107057
  Hypo

SEQ ID NO: 111476 - DNA, 30 bp, Homo sapiens; identical to SEQ ID NO: 78596
  chr16:2128577-2128607
  Hypo

SEQ ID NO: 111477 - DNA, 127 bp, Homo sapiens; identical to SEQ ID NO: 78598
  chr16:2129118-2129245
  Hypo

SEQ ID NO: 111478 - DNA, 98 bp, Homo sapiens; identical to SEQ ID NO: 78601
  chr16:2131668-2131766
  Hypo

SEQ ID NO: 111479 - DNA, 30 bp, Homo sapiens; identical to SEQ ID NO: 78603
  chr16:2141909-2141939
  Hypo

SEQ ID NO: 111480 - DNA, 82 bp, Homo sapiens; identical to SEQ ID NO: 78604
  chr16:2142546-2142628
  Hypo

SEQ ID NO: 111481 - DNA, 102 bp, Homo sapiens; identical to SEQ ID NO: 44525
  chr16:2145625-2145727
  Hypo

SEQ ID NO: 111482 - DNA, 99 bp, Homo sapiens; identical to SEQ ID NO: 78606
  chr16:2146363-2146462
  Hypo

SEQ ID NO: 111483 - DNA, 32 bp, Homo sapiens; identical to SEQ ID NO: 78608
  chr16:2151266-2151298
  Hypo

SEQ ID NO: 111484 - DNA, 135 bp, Homo sapiens; identical to SEQ ID NO: 78621
  chr16:2193270-2193405
  Hypo

SEQ ID NO: 111485 - DNA, 142 bp, Homo sapiens; identical to SEQ ID NO: 44529
  chr16:2212716-2212858
  Hypo

SEQ ID NO: 111486 - DNA, 72 bp, Homo sapiens; identical to SEQ ID NO: 78623
  chr16:2213240-2213312
  Hypo

SEQ ID NO: 111487 - DNA, 78 bp, Homo sapiens; identical to SEQ ID NO: 78624
  chr16:2213645-2213723
  Hypo

SEQ ID NO: 111488 - DNA, 533 bp, Homo sapiens; identical to SEQ ID NO: 78630
  chr16:2229690-2230223
  Hypo

SEQ ID NO: 111489 - DNA, 695 bp, Homo sapiens; identical to SEQ ID NO: 78631
  chr16:2230488-2231183
  Hypo

SEQ ID NO: 111490 - DNA, 81 bp, Homo sapiens; identical to SEQ ID NO: 44534
  chr16:2232745-2232826
  Hypo

SEQ ID NO: 111491 - DNA, 141 bp, Homo sapiens; identical to SEQ ID NO: 44535
  chr16:2233066-2233207
  Hypo

SEQ ID NO: 111492 - DNA, 57 bp, Homo sapiens; identical to SEQ ID NO: 78635
  chr16:2233791-2233848
  Hypo

SEQ ID NO: 111493 - DNA, 735 bp, Homo sapiens; identical to SEQ ID NO: 78636
  chr16:2234304-2235039
  Hypo

SEQ ID NO: 111494 - DNA, 267 bp, Homo sapiens; identical to SEQ ID NO: 78637
  chr16:2237256-2237523
  Hypo

SEQ ID NO: 111495 - DNA, 108 bp, Homo sapiens; identical to SEQ ID NO: 78638
  chr16:2246993-2247101
  Hyper

SEQ ID NO: 111496 - DNA, 183 bp, Homo sapiens; identical to SEQ ID NO: 78639
  chr16:2256439-2256622
  Hypo

SEQ ID NO: 111497 - DNA, 402 bp, Homo sapiens; identical to SEQ ID NO: 78640
  chr16:2278383-2278785
  Hypo

SEQ ID NO: 111498 - DNA, 199 bp, Homo sapiens; identical to SEQ ID NO: 78641
  chr16:2281203-2281402
  Hypo

SEQ ID NO: 111499 - DNA, 63 bp, Homo sapiens; identical to SEQ ID NO: 78642
  chr16:2281639-2281702
  Hypo

SEQ ID NO: 111500 - DNA, 30 bp, Homo sapiens; identical to SEQ ID NO: 78646
  chr16:2285581-2285611
  Hypo

SEQ ID NO: 111501 - DNA, 95 bp, Homo sapiens; identical to SEQ ID NO: 78647
  chr16:2286027-2286122
  Hypo

SEQ ID NO: 111502 - DNA, 442 bp, Homo sapiens
  chr16:2287079-2287521
  Hyper
agacccagacctcagcgccgtgtccgcgctcatggagcagatcaacaggtgtggtgggcagggcccctcgtcgcgaccccccgccgggatctcgccccggcgcggcgccccgaccctgagcgggcccctgtctccgcagcgtgtccgagcacgagtacagctttgtgagcagccagcccctgggccgggaccagtacaaggagatgtacctgttcgtgtacaggtgaggggcgggccgcagggaggggcgcgcggggccgcaggtcgggggctcagcgggtcctccccatctcctaggaaagacgcggtgtcggtcgtggacacctacctgtacccagaccccgaggacgtcttcagccgcgagcccttcgtggtcaagttctcggcccccggcaccggtgagcgggccccgcccctcccctcccgccgagctctgacgccc

SEQ ID NO: 111503 - DNA, 225 bp, Homo sapiens; identical to SEQ ID NO: 78650
  chr16:2294431-2294656
  Hypo

SEQ ID NO: 111504 - DNA, 41 bp, Homo sapiens; identical to SEQ ID NO: 78654
  chr16:2310480-2310521
  Hypo

SEQ ID NO: 111505 - DNA, 59 bp, Homo sapiens; identical to SEQ ID NO: 78656
  chr16:2324166-2324225
  Hypo

SEQ ID NO: 111506 - DNA, 66 bp, Homo sapiens; identical to SEQ ID NO: 78657
  chr16:2327703-2327769
  Hypo

SEQ ID NO: 111507 - DNA, 166 bp, Homo sapiens; identical to SEQ ID NO: 78661
  chr16:2334314-2334480
  Hypo

SEQ ID NO: 111508 - DNA, 30 bp, Homo sapiens; identical to SEQ ID NO: 44542
  chr16:2436229-2436259
  Hypo

SEQ ID NO: 111509 - DNA, 24 bp, Homo sapiens
  chr16:2466346-2466370
  Hypo
gcgagactccgcctcaaaaaaaaa

SEQ ID NO: 111510 - DNA, 62 bp, Homo sapiens; identical to SEQ ID NO: 78700
  chr16:2474253-2474315
  Hypo

SEQ ID NO: 111511 - DNA, 112 bp, Homo sapiens; identical to SEQ ID NO: 78702
  chr16:2493315-2493427
  Hypo

SEQ ID NO: 111512 - DNA, 30 bp, Homo sapiens; identical to SEQ ID NO: 78703
  chr16:2493886-2493916
  Hypo

SEQ ID NO: 111513 - DNA, 174 bp, Homo sapiens; identical to SEQ ID NO: 44545
  chr16:2497879-2498053
  Hypo

SEQ ID NO: 111514 - DNA, 16 bp, Homo sapiens
  chr16:2508540-2508556
  Hypo
gcgcctggcccccaaa

SEQ ID NO: 111515 - DNA, 115 bp, Homo sapiens; identical to SEQ ID NO: 78709
  chr16:2510869-2510984
  Hypo

SEQ ID NO: 111516 - DNA, 30 bp, Homo sapiens; identical to SEQ ID NO: 78711
  chr16:2516812-2516842
  Hypo

SEQ ID NO: 111517 - DNA, 130 bp, Homo sapiens; identical to SEQ ID NO: 78712
  chr16:2521727-2521857
  Hyper

SEQ ID NO: 111518 - DNA, 30 bp, Homo sapiens; identical to SEQ ID NO: 78714
  chr16:2531210-2531240
  Hypo

SEQ ID NO: 111519 - DNA, 149 bp, Homo sapiens; identical to SEQ ID NO: 78715
  chr16:2531804-2531953
  Hypo

SEQ ID NO: 111520 - DNA, 44 bp, Homo sapiens; identical to SEQ ID NO: 78716
  chr16:2539796-2539840
  Hypo

SEQ ID NO: 111521 - DNA, 105 bp, Homo sapiens; identical to SEQ ID NO: 78717
  chr16:2540828-2540933
  Hypo

SEQ ID NO: 111522 - DNA, 101 bp, Homo sapiens; identical to SEQ ID NO: 78718
  chr16:2546405-2546506
  Hypo

SEQ ID NO: 111523 - DNA, 30 bp, Homo sapiens; identical to SEQ ID NO: 78719
  chr16:2548427-2548457
  Hypo

SEQ ID NO: 111524 - DNA, 87 bp, Homo sapiens; identical to SEQ ID NO: 78727
  chr16:2589044-2589131
  Hypo

SEQ ID NO: 111525 - DNA, 30 bp, Homo sapiens; identical to SEQ ID NO: 78739
  chr16:2712995-2713025
  Hypo

SEQ ID NO: 111526 - DNA, 120 bp, Homo sapiens; identical to SEQ ID NO: 78742
  chr16:2731636-2731756
  Hypo

SEQ ID NO: 111527 - DNA, 94 bp, Homo sapiens; identical to SEQ ID NO: 78744
  chr16:2762746-2762840
  Hypo

SEQ ID NO: 111528 - DNA, 613 bp, Homo sapiens; identical to SEQ ID NO: 78745
  chr16:2764096-2764709
  Hypo

SEQ ID NO: 111529 - DNA, 86 bp, Homo sapiens; identical to SEQ ID NO: 78746
  chr16:2765717-2765803
  Hyper

SEQ ID NO: 111530 - DNA, 444 bp, Homo sapiens; identical to SEQ ID NO: 78748
  chr16:2770092-2770536
  Hypo

SEQ ID NO: 111531 - DNA, 210 bp, Homo sapiens; identical to SEQ ID NO: 78752
  chr16:2806195-2806405
  Hypo

SEQ ID NO: 111532 - DNA, 39 bp, Homo sapiens; identical to SEQ ID NO: 78758
  chr16:2818117-2818156
  Hypo

SEQ ID NO: 111533 - DNA, 39 bp, Homo sapiens; identical to SEQ ID NO: 78759
  chr16:2819758-2819797
  Hypo

SEQ ID NO: 111534 - DNA, 57 bp, Homo sapiens
  chr16:2835423-2835480
  Hyper
gcggcgggcgggcgccgggcacgggcaggcagacgggttggacgcgagcgctcaggg

SEQ ID NO: 111535 - DNA, 267 bp, Homo sapiens; identical to SEQ ID NO: 78761
  chr16:2849356-2849623
  Hypo

SEQ ID NO: 111536 - DNA, 30 bp, Homo sapiens; identical to SEQ ID NO: 78763
  chr16:2868686-2868716
  Hypo

SEQ ID NO: 111537 - DNA, 52 bp, Homo sapiens; identical to SEQ ID NO: 78764
  chr16:2877484-2877536
  Hypo

SEQ ID NO: 111538 - DNA, 30 bp, Homo sapiens; identical to SEQ ID NO: 78765
  chr16:2879766-2879796
  Hypo

SEQ ID NO: 111539 - DNA, 242 bp, Homo sapiens
  chr16:2892487-2892729
  Hyper
gaagttggcctgacccgagaagcccaggatcgctgaggaagctccccactgttgtcgcctctcagccccacgcccactcatccacaggcagccgggatgctcacgcagccacgtcacggacctcatctcggcctcgctacgactctgccaacagggggcgctgcaggaggctacgcggtcgcagggactcctttctgtccgtttccgacaaacttcccgcgctcttccggaggttgagggtg

SEQ ID NO: 111540 - DNA, 171 bp, Homo sapiens; identical to SEQ ID NO: 78797
  chr16:2975829-2976000
  Hypo

SEQ ID NO: 111541 - DNA, 861 bp, Homo sapiens
  chr16:3016793-3017654
  Hyper
aaggtgaggagtgggcggggaccaggggcctgggcgggcctcgaggtggggcctggccgggcaggggagccgccgtgtcctggtcctcaggatgctgactgccggccccgcccgcagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcggtgagcctcagctcggcgcgccctgcccgctgttcccaccccgctctccccaccccgcctcacgcccctctccgcagggctgcaggacgccgctgaggacccagaggcccccgagggctcggcccagacccccgcggcgcccctcgacggggccaacgtgagctgcagccccaggcctggggctccgccggccgcgattgggggtgaggcgggcgcgcgggacgggagtgagtcagggagccgccccctcgcgcccatcctcaccgcagccgtgtgcccgcagcccgggtcttctcgacggtgacggctgtctcggtgctgctgctgctgctcctggggctgctgcgtccgctgcgccgacggtgcggggcgctggggcagggcctgagggcggaccggtggtggggagct

SEQ ID NO: 111542 - DNA, 34 bp, Homo sapiens; identical to SEQ ID NO: 44559
  chr16:3021547-3021581
  Hypo

SEQ ID NO: 111543 - DNA, 45 bp, Homo sapiens; identical to SEQ ID NO: 78824
  chr16:3026818-3026863
  Hypo

SEQ ID NO: 111544 - DNA, 280 bp, Homo sapiens; identical to SEQ ID NO: 78834
  chr16:3068171-3068451
  Hyper

SEQ ID NO: 111545 - DNA, 30 bp, Homo sapiens; identical to SEQ ID NO: 78836
  chr16:3078354-3078384
  Hyper

SEQ ID NO: 111546 - DNA, 319 bp, Homo sapiens
  chr16:3096690-3097009
  Hyper
gcccacccgacccagcggcgcgaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcc

SEQ ID NO: 111547 - DNA, 282 bp, Homo sapiens; identical to SEQ ID NO: 78865
  chr16:3139085-3139367
  Hypo

SEQ ID NO: 111548 - DNA, 30 bp, Homo sapiens; identical to SEQ ID NO: 78866
  chr16:3142360-3142390
  Hypo

SEQ ID NO: 111549 - DNA, 30 bp, Homo sapiens; identical to SEQ ID NO: 44561
  chr16:3142599-3142629
  Hypo

SEQ ID NO: 111550 - DNA, 144 bp, Homo sapiens; identical to SEQ ID NO: 78876
  chr16:3151042-3151186
  Hypo

SEQ ID NO: 111551 - DNA, 22 bp, Homo sapiens
  chr16:3158301-3158323
  Hypo
ccgcgcccggcctatagtcagt

SEQ ID NO: 111552 - DNA, 60 bp, Homo sapiens; identical to SEQ ID NO: 78886
  chr16:3177923-3177983
  Hypo

SEQ ID NO: 111553 - DNA, 29 bp, Homo sapiens
  chr16:3183420-3183449
  Hypo
aaaatatgaaaattccgccaggcacggtg

SEQ ID NO: 111554 - DNA, 310 bp, Homo sapiens
  chr16:3209099-3209409
  Hyper
gcgccggggccgatccgacttcccgcttccgtccggcttgcggcccctcgccttgcccggctacaggaaggactcgcctgcgcctcctgactggagccttccacctgggagttctgagtgcgcctaaggcctggcgctgaggcagtggaccccagatccgggacccgaaaggagggcaaacacctccaccgccgcgtctgcctctgcggacgtggccctagatcccgggtggccatggaacttggtctgggcgtgtagttttcctttgagtgggtcggttctaagtttaaatttccgacgagcccagggt

SEQ ID NO: 111555 - DNA, 99 bp, Homo sapiens; identical to SEQ ID NO: 78891
  chr16:3211643-3211742
  Hypo

SEQ ID NO: 111556 - DNA, 180 bp, Homo sapiens; identical to SEQ ID NO: 78892
  chr16:3211802-3211982
  Hypo

SEQ ID NO: 111557 - DNA, 1868 bp, Homo sapiens
  chr16:3220371-3222239
  Hyper
ttcagttcagatccccgcgagggaaggggattaaagagagaaggaagttgagcctctgagcccattgcgccccggaatctgggaggcggcgtgaccaggtgcccgggttccatccgctggggctgggcagcccccctgcccccgcccagtacagaggctcctgccgggggaggcgtccatcgcgttcgcttacttctctagaccaacaagcgagggacgcggagactgagttggctgcggccaccgggtccccggacaccgtcttcattcactcccaccctcagtcaagcacctgtacccgcagtcctttcctaaaagaagaaaaacggccggtcgcgcgctgtccagagtactcagtcctggatccaggaggtggctggcggtgagctgatttccgggttcttaaacccgggcccggggcccaaggccccgcctggtggggtctcatcctgcagtttgagaaaccgaagaaggtaggagagggaggaagcgccggctttgcctgtgaaagattctttcattcgctccattcttgttcttgcgcgctggatttaccaggctaacaaacaacagctgatcacggcaggctgggctcctctgggactcgcaccggggcctctcgcacccaaagcgagaatcatacctctagaccaacaggcctcggtggcgggaagcaccatctttgctcctccactccctcacccccctcccgccccgcgccttatctttctggaacccaagacttcgtattctccgctctccataaacgtcgatgccagctctaggagcgtggccgggagcccacgatcgcggcagcgagaagcccaaccagaggggaggagggagtccccggagtgggacagcgctcaggtctggggtggggttgatctagggcaaaatagggcgggcggcctgtggcgatgggcaggaccctctcgcccaccacacgcggaactcgctggatcctctccacatccaggccgcgtccactggctttccaacctgctcaggtccttaaagaaggattcaaaaggtgttgcggtattggcccaacaggatttgaccctgaggcccactctcaccctaatcataaccgcaaaaccacagcgcctggagagagagtgagagagaaacagaaacggagcgagtgtgtgtcgctgtgatgccctttgccgtcgctgctcatccccagtgacctcctggaactttttcagctcttgctgacagaggaagacacgggggcagagctaacgtctgagtcagggcagaggcgctgggctccatccgagggaggctatgggggcgcctctgggatggagccaaccaccggcgcagtcggatgaaaggtgggctggccgctcagccatcctcctagggcaaggccttgggtatgagtcagcagccccaggtgtgagcgcagacccggtaaccccggcgcaggggaaaatacagcggggagccccaggctgcaggcctgaccctgagcatcccctaccaagcccagtgtggatgggctctgtctccaaggggctggttcaccagggtctccccgcagcgaccccagaattctgccaatcacttggggacggcgatgagctctatccacttcggaatcagccgatttgtgccggattggtggcaggtgtctgaaatgtcagcggaaatacacgcacgggaggctcgttggtctaggggtatgattctcgcttcgggtgcgagaggtcccgggttcaaatcccggacgagccctagaagtggttacttttcccttgtcattttagagaatatagagctagaaaatcggggaccgagcctgaagcctcaactaccagtcgcgttgctccgcttcaggtcggtccaggtctgtg

SEQ ID NO: 111558 - DNA, 254 bp, Homo sapiens; identical to SEQ ID NO: 78899
  chr16:3224942-3225196
  Hyper

SEQ ID NO: 111559 - DNA, 177 bp, Homo sapiens; identical to SEQ ID NO: 78900
  chr16:3225459-3225636
  Hyper

SEQ ID NO: 111560 - DNA, 1592 bp, Homo sapiens
  chr16:3232529-3234121
  Hyper
taacttcgaaggactcgggctgcgctgacctgtcagagctgtctggatctctgatcttcatctaaagtaggaaagggtagaaaccgatattttggaccaaaaaccgggctcgtccgggatttgaacccgggacctctcgcaccctaagcgagaatcatacccctagaccaacgagccacacgccccgtagcctccggcttgtctttgtggccttcgtggagtcctcgtggccagaggtggggacccagcagagcagagctaggaggagactccgatttcctgaagtctggaagagacaagttcaagcgcgggtggacgcggagggagccctgagcccccgcttctccctgcgccgcacaaaatggggagcatcccctgtgcccccacaatccggggccccccgggccctcgcccgcctccgcctctcagccctgggctggggatccgcgcgtcacgccgcgtcgcgtagtgaggagctccagctccggcgggacatgggaacctctcaagagctggcagcggctgcgcggagggtccgcgaaccgcgaccactggacgcccgccttggaaacgctgcagcccggcggcgtggtgcagatgggtggtcagtagaggcctcgccagtgcaccaggaaccagccaccaggccccctacctcgacgcgccccacgcttctcccgctccggtcctctcttctcccccagggaagccaaaacccagaaggtgagcttcccacgtggaacctcaattcaagaggctgacactgagcgtcgcttcgctccaccagacccgcggcgcccgccggagtcagcgatgtacccccttccctttcactgggggaactggcggaacctccggtcaccaggacgtggggaagcagaggccgcttggggcagcagaggccgcgtccaggtgtcggttccggggcaccttttactgtcactctgtccttctctgtgtccaaatttcacccggagcccgagaattcggcaggtctggactgaaaacgtctccccatcccctccggatccaagcctcgaatttcctggctcagtgggaaggcctcggggtctgggcgtggagacggggcccgagacccccaccccgccagggcccactaaagtgctgccagctgagccccggccttcgcccctccttcgtctctccctcattcccctccctctgacaccccgccacatacattactccccgcaataccatgcaattttaagctagggtagggctcacctgagactggagccgccataccgtcgaaccctacgaaaaatttatgcccgtaaataaacaagcccggcgcattcttccttattctaaataacttcttcctgctgcacggggtcgtctcctttaaccacggctaccgcagttggtagtgctggatcccatttcagggtgatgggatgctggatcccatttcagggtgataggaccgaccgcaaggcgaacgattcaggcccgtccgtctgcgtcccgggaccccgggaggtctccactgacgccctgccagcagcaggctccctccgccttcctagtctcctgtccttgctgaaaatgcgaaatgggaaaaaaga

SEQ ID NO: 111561 - DNA, 271 bp, Homo sapiens; identical to SEQ ID NO: 78904
  chr16:3234181-3234452
  Hyper

SEQ ID NO: 111562 - DNA, 335 bp, Homo sapiens; identical to SEQ ID NO: 78906
  chr16:3237708-3238043
  Hyper

SEQ ID NO: 111563 - DNA, 1775 bp, Homo sapiens; identical to SEQ ID NO: 78907
  chr16:3238163-3239938
  Hyper

SEQ ID NO: 111564 - DNA, 35 bp, Homo sapiens; identical to SEQ ID NO: 36049
  chr16:3241024-3241059
  Hyper

SEQ ID NO: 111565 - DNA, 519 bp, Homo sapiens; identical to SEQ ID NO: 78910
  chr16:3241472-3241991
  Hyper

SEQ ID NO: 111566 - DNA, 31 bp, Homo sapiens; identical to SEQ ID NO: 78914
  chr16:3269398-3269429
  Hypo

SEQ ID NO: 111567 - DNA, 46 bp, Homo sapiens; identical to SEQ ID NO: 78915
  chr16:3286277-3286323
  Hypo

SEQ ID NO: 111568 - DNA, 791 bp, Homo sapiens
  chr16:3355105-3355896
  Hyper
tcttcctcgaggaggcggcgacgagcccagcaacagctcgagcacggccggccgggccgcgggaagcccgagaacgcggcgcgcgcagctgggaggcgacccttacccggcgaggctcccgggaccaaacgccgcccgacagccacgcagaacagacgcggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggtaaccgagaagcggcttcccctatggcttcgaccctggagccgctggagcggcggcggccgcagggaggcagccattttccgtaggcggtggccgcggcgcttccgggccgcgcggctggagcctgaggcggggccaccgtcgggcacgagaaaccattctctccccgcttttcgcagctgtatcccagaggcgcggctgaagctcgctgggacactgcccgcttgcccagtgcccacgggcacgcctgtcg

SEQ ID NO: 111569 - DNA, 86 bp, Homo sapiens; identical to SEQ ID NO: 78930
  chr16:3492682-3492768
  Hypo

SEQ ID NO: 111570 - DNA, 202 bp, Homo sapiens; identical to SEQ ID NO: 78933
  chr16:3551302-3551504
  Hyper

SEQ ID NO: 111571 - DNA, 33 bp, Homo sapiens; identical to SEQ ID NO: 16015
  chr16:3598920-3598953
  Hypo

SEQ ID NO: 111572 - DNA, 30 bp, Homo sapiens; identical to SEQ ID NO: 78936
  chr16:3611471-3611501
  Hypo

SEQ ID NO: 111573 - DNA, 108 bp, Homo sapiens; identical to SEQ ID NO: 44568
  chr16:3696694-3696802
  Hypo

SEQ ID NO: 111574 - DNA, 61 bp, Homo sapiens; identical to SEQ ID NO: 78938
  chr16:3740595-3740656
  Hyper

SEQ ID NO: 111575 - DNA, 118 bp, Homo sapiens; identical to SEQ ID NO: 78939
  chr16:3773018-3773136
  Hypo

SEQ ID NO: 111576 - DNA, 47 bp, Homo sapiens; identical to SEQ ID NO: 78940
  chr16:3803027-3803074
  Hypo

SEQ ID NO: 111577 - DNA, 30 bp, Homo sapiens; identical to SEQ ID NO: 44569
  chr16:3925449-3925479
  Hypo

SEQ ID NO: 111578 - DNA, 78 bp, Homo sapiens; identical to SEQ ID NO: 78942
  chr16:3931903-3931981
  Hypo

SEQ ID NO: 111579 - DNA, 17 bp, Homo sapiens
  chr16:3951115-3951132
  Hypo
gttaaaaaaatttaccg

SEQ ID NO: 111580 - DNA, 37 bp, Homo sapiens; identical to SEQ ID NO: 16016
  chr16:3957870-3957907
  Hypo

SEQ ID NO: 111581 - DNA, 161 bp, Homo sapiens; identical to SEQ ID NO: 78945
  chr16:3998590-3998751
  Hypo

SEQ ID NO: 111582 - DNA, 30 bp, Homo sapiens; identical to SEQ ID NO: 78949
  chr16:4135781-4135811
  Hypo

SEQ ID NO: 111583 - DNA, 36 bp, Homo sapiens; identical to SEQ ID NO: 78950
  chr16:4165816-4165852
  Hyper

SEQ ID NO: 111584 - DNA, 79 bp, Homo sapiens; identical to SEQ ID NO: 78951
  chr16:4203488-4203567
  Hypo

SEQ ID NO: 111585 - DNA, 84 bp, Homo sapiens; identical to SEQ ID NO: 78952
  chr16:4203911-4203995
  Hypo

SEQ ID NO: 111586 - DNA, 165 bp, Homo sapiens; identical to SEQ ID NO: 78953
  chr16:4264529-4264694
  Hypo

SEQ ID NO: 111587 - DNA, 40 bp, Homo sapiens; identical to SEQ ID NO: 78955
  chr16:4308064-4308104
  Hypo

SEQ ID NO: 111588 - DNA, 160 bp, Homo sapiens; identical to SEQ ID NO: 36054
  chr16:4363920-4364080
  Hyper

SEQ ID NO: 111589 - DNA, 532 bp, Homo sapiens; identical to SEQ ID NO: 78957
  chr16:4377893-4378425
  Hyper

SEQ ID NO: 111590 - DNA, 112 bp, Homo sapiens; identical to SEQ ID NO: 78958
  chr16:4385316-4385428
  Hypo

SEQ ID NO: 111591 - DNA, 184 bp, Homo sapiens; identical to SEQ ID NO: 78959
  chr16:4395357-4395541
  Hypo

SEQ ID NO: 111592 - DNA, 28 bp, Homo sapiens
  chr16:4402011-4402039
  Hypo
tggattcacaggttccggacatttcata

SEQ ID NO: 111593 - DNA, 66 bp, Homo sapiens; identical to SEQ ID NO: 44575
  chr16:4410920-4410986
  Hypo

SEQ ID NO: 111594 - DNA, 131 bp, Homo sapiens; identical to SEQ ID NO: 78963
  chr16:4422122-4422253
  Hyper

SEQ ID NO: 111595 - DNA, 53 bp, Homo sapiens; identical to SEQ ID NO: 78964
  chr16:4431066-4431119
  Hypo

SEQ ID NO: 111596 - DNA, 30 bp, Homo sapiens; identical to SEQ ID NO: 78965
  chr16:4442476-4442506
  Hypo

SEQ ID NO: 111597 - DNA, 98 bp, Homo sapiens; identical to SEQ ID NO: 78966
  chr16:4443075-4443173
  Hypo

SEQ ID NO: 111598 - DNA, 30 bp, Homo sapiens; identical to SEQ ID NO: 44576
  chr16:4474675-4474705
  Hypo

SEQ ID NO: 111599 - DNA, 920 bp, Homo sapiens
  chr16:4587903-4588823
  Hyper
ccggggatgcgcggccgagcgccacatcccgactccacacgtcggcgagccgggcgcgggtgcaggacactgctgggctccgggacggccaaggtcacccgcggggctcggcaggggctggctcggccacggggctcctcctcgaccccctttccttgagaaaacaactcccacccctcccctccccgtctcgccctgcaagacggagatggcaatttccacaaccttccctgacggaaaaacgtgcgggcgagcaggctgccattccgggcgcacaaccccgcggcacacagcggggcgcccgcccgggccccgccaccgcagcggcttcgacatccccagggccgcgctaggtctcggcagcgccctgaggggaggacgggccccgccatgccgcgccccaaccgccggccccgctttacctccagaagcccggtgcccgaggccggccgaaagcggagaggggcccgggtccggacaggcgccggcagaacaagaccctcagccccgcgcggctttgcgcgcacaacgaaaccccccaacccaccgcccaccccaccgcccagaggcttctaggacttgtagtccgcccggtcaccccccccaccacaacccgctctgagaggctggggactacggtgcccggcatgcaccgcccaggcgccgcgggcgggggcggggagggggcgccacggtccgaggtcacgccccgacctgaggagagctggcgcccagacccttcccccggggaggagggctcccgcgcgaagccgtctccgaatgcgtccagtcgactcaccgtccccgcagccctggggcagcggccgcaacagcaggaccgaacgcctcggcagctggcagtcgcacttctgtcacaaggaggcgggtagactttggaccagggccgaggcccgggacgt

SEQ ID NO: 111600 - DNA, 33 bp, Homo sapiens; identical to SEQ ID NO: 78970
  chr16:4644769-4644802
  Hypo

SEQ ID NO: 111601 - DNA, 30 bp, Homo sapiens; identical to SEQ ID NO: 78971
  chr16:4645003-4645033
  Hypo

SEQ ID NO: 111602 - DNA, 30 bp, Homo sapiens; identical to SEQ ID NO: 44577
  chr16:4655417-4655447
  Hypo

SEQ ID NO: 111603 - DNA, 115 bp, Homo sapiens; identical to SEQ ID NO: 78973
  chr16:4665621-4665736
  Hypo

SEQ ID NO: 111604 - DNA, 137 bp, Homo sapiens; identical to SEQ ID NO: 78982
  chr16:4723596-4723733
  Hypo

SEQ ID NO: 111605 - DNA, 43 bp, Homo sapiens; identical to SEQ ID NO: 78983
  chr16:4840446-4840489
  Hypo

SEQ ID NO: 111606 - DNA, 84 bp, Homo sapiens; identical to SEQ ID NO: 44579
  chr16:4841600-4841684
  Hypo

SEQ ID NO: 111607 - DNA, 91 bp, Homo sapiens; identical to SEQ ID NO: 78985
  chr16:4844989-4845080
  Hypo

SEQ ID NO: 111608 - DNA, 284 bp, Homo sapiens; identical to SEQ ID NO: 78986
  chr16:4846136-4846420
  Hypo

SEQ ID NO: 111609 - DNA, 104 bp, Homo sapiens; identical to SEQ ID NO: 78987
  chr16:4846720-4846824
  Hypo

SEQ ID NO: 111610 - DNA, 30 bp, Homo sapiens; identical to SEQ ID NO: 78991
  chr16:4900604-4900634
  Hypo

SEQ ID NO: 111611 - DNA, 55 bp, Homo sapiens; identical to SEQ ID NO: 78992
  chr16:4920234-4920289
  Hypo

SEQ ID NO: 111612 - DNA, 37 bp, Homo sapiens; identical to SEQ ID NO: 78993
  chr16:4920489-4920526
  Hypo

SEQ ID NO: 111613 - DNA, 30 bp, Homo sapiens; identical to SEQ ID NO: 78999
  chr16:4931529-4931559
  Hypo

SEQ ID NO: 111614 - DNA, 30 bp, Homo sapiens; identical to SEQ ID NO: 79003
  chr16:4932123-4932153
  Hypo

SEQ ID NO: 111615 - DNA, 69 bp, Homo sapiens; identical to SEQ ID NO: 79021
  chr16:5007727-5007796
  Hyper

SEQ ID NO: 111616 - DNA, 667 bp, Homo sapiens; identical to SEQ ID NO: 79028
  chr16:5037514-5038181
  Hyper

SEQ ID NO: 111617 - DNA, 91 bp, Homo sapiens; identical to SEQ ID NO: 79036
  chr16:5090543-5090634
  Hypo

SEQ ID NO: 111618 - DNA, 30 bp, Homo sapiens; identical to SEQ ID NO: 79037
  chr16:5094354-5094384
  Hypo

SEQ ID NO: 111619 - DNA, 170 bp, Homo sapiens; identical to SEQ ID NO: 79039
  chr16:5105315-5105485
  Hypo

SEQ ID NO: 111620 - DNA, 30 bp, Homo sapiens; identical to SEQ ID NO: 79042
  chr16:5115288-5115318
  Hypo

SEQ ID NO: 111621 - DNA, 72 bp, Homo sapiens; identical to SEQ ID NO: 79043
  chr16:5115525-5115597
  Hypo

SEQ ID NO: 111622 - DNA, 22 bp, Homo sapiens
  chr16:5130483-5130505
  Hypo
ggtgtgggaagaggccgggtct

SEQ ID NO: 111623 - DNA, 22 bp, Homo sapiens
  chr16:5130565-5130587
  Hypo
tggaacccgcgccatatgctct

SEQ ID NO: 111624 - DNA, 95 bp, Homo sapiens; identical to SEQ ID NO: 79057
  chr16:5164973-5165068
  Hypo

SEQ ID NO: 111625 - DNA, 21 bp, Homo sapiens
  chr16:5215934-5215955
  Hypo
agcaagtatgaaaagcgttct

SEQ ID NO: 111626 - DNA, 42 bp, Homo sapiens; identical to SEQ ID NO: 79059
  chr16:5257258-5257300
  Hypo

SEQ ID NO: 111627 - DNA, 25 bp, Homo sapiens
  chr16:5412643-5412668
  Hypo
tgagccaccgcgccaggccacatca

SEQ ID NO: 111628 - DNA, 150 bp, Homo sapiens; identical to SEQ ID NO: 79075
  chr16:5439193-5439343
  Hypo

SEQ ID NO: 111629 - DNA, 82 bp, Homo sapiens; identical to SEQ ID NO: 79086
  chr16:5512088-5512170
  Hypo

SEQ ID NO: 111630 - DNA, 237 bp, Homo sapiens; identical to SEQ ID NO: 79098
  chr16:5541116-5541353
  Hypo

SEQ ID NO: 111631 - DNA, 170 bp, Homo sapiens; identical to SEQ ID NO: 79103
  chr16:5559726-5559896
  Hypo

SEQ ID NO: 111632 - DNA, 30 bp, Homo sapiens; identical to SEQ ID NO: 79134
  chr16:5703116-5703146
  Hypo

SEQ ID NO: 111633 - DNA, 37 bp, Homo sapiens; identical to SEQ ID NO: 79141
  chr16:5769148-5769185
  Hypo

SEQ ID NO: 111634 - DNA, 30 bp, Homo sapiens; identical to SEQ ID NO: 79167
  chr16:5950685-5950715
  Hypo

SEQ ID NO: 111635 - DNA, 78 bp, Homo sapiens
  chr16:6068899-6068977
  Hyper
aggagaccagggtaccgggtcgcgtgtccgccgccgccgcccgctggaatccagggctgcacgcgtgaccgcggcggc

SEQ ID NO: 111636 - DNA, 102 bp, Homo sapiens
  chr16:6069492-6069594
  Hyper
ccccccagcagcacccgcggtggggcgggggcgctctgccagccccgggaacagcagaggcggcggcactggctggacccacgcgcgcgcctccggggctga

SEQ ID NO: 111637 - DNA, 202 bp, Homo sapiens; identical to SEQ ID NO: 79173
  chr16:6070067-6070269
  Hyper

SEQ ID NO: 111638 - DNA, 30 bp, Homo sapiens
  chr16:6070517-6070547
  Hyper
tactggcactggaatcgatgccccgcggtg

SEQ ID NO: 111639 - DNA, 30 bp, Homo sapiens; identical to SEQ ID NO: 44589
  chr16:6186354-6186384
  Hypo

SEQ ID NO: 111640 - DNA, 30 bp, Homo sapiens; identical to SEQ ID NO: 44590
  chr16:6314961-6314991
  Hypo

SEQ ID NO: 111641 - DNA, 313 bp, Homo sapiens
  chr16:6533401-6533714
  Hyper
tttacattgctagcacgtgggtgccgtttgctgttgcctcggacttctcccgtgctgtgttttcccggtgaggaaacaggaggcactttgcagccgacaatgaaatcttggcagctaattgcagtcgtgggagatgcccttcaggtacggcgagcgaagaagactctaaaacactgtcagggaaggagagaaagagggagagagggagggagggaagggagagaccaggcagcttctgcagaggcttcctgaagcccactgactccgcgggagggggttgcagagggacgggggcgggcgacagggggaggag

SEQ ID NO: 111642 - DNA, 32 bp, Homo sapiens; identical to SEQ ID NO: 79251
  chr16:6825036-6825068
  Hypo

SEQ ID NO: 111643 - DNA, 148 bp, Homo sapiens; identical to SEQ ID NO: 79257
  chr16:6838778-6838926
  Hypo

SEQ ID NO: 111644 - DNA, 33 bp, Homo sapiens; identical to SEQ ID NO: 79284
  chr16:6990605-6990638
  Hypo

SEQ ID NO: 111645 - DNA, 30 bp, Homo sapiens; identical to SEQ ID NO: 79302
  chr16:7137064-7137094
  Hyper

SEQ ID NO: 111646 - DNA, 33 bp, Homo sapiens; identical to SEQ ID NO: 36062
  chr16:7354091-7354124
  Hyper

SEQ ID NO: 111647 - DNA, 287 bp, Homo sapiens
  chr16:7354388-7354675
  Hyper
tgcagcatcctctgacgggggccacctgcgtggcgctccccaacgtgggcatgtgtccccagctttcgtgtgccttgacttttatgtacttacagcaggtaaggcgcgcgtctgccctcggtggctgctttcctggggctgggccagatgggtccccgcgcgtactgggctgcgcttcggtgccttatgtaggttctgaggagggggctcccgcgttgcgatggaaagggtggatggaagcctcctgctctctgtggagcccgggcacctcgcgctgagatgtttct

SEQ ID NO: 111648 - DNA, 179 bp, Homo sapiens; identical to SEQ ID NO: 79343
  chr16:7489013-7489192
  Hypo

SEQ ID NO: 111649 - DNA, 69 bp, Homo sapiens; identical to SEQ ID NO: 79365
  chr16:7568309-7568378
  Hypo

SEQ ID NO: 111650 - DNA, 30 bp, Homo sapiens; identical to SEQ ID NO: 79385
  chr16:7827953-7827983
  Hypo

SEQ ID NO: 111651 - DNA, 16 bp, Homo sapiens
  chr16:8097095-8097111
  Hypo
agcattagggccaggc

SEQ ID NO: 111652 - DNA, 30 bp, Homo sapiens; identical to SEQ ID NO: 79422
  chr16:8158291-8158321
  Hypo

SEQ ID NO: 111653 - DNA, 189 bp, Homo sapiens; identical to SEQ ID NO: 79435
  chr16:8222706-8222895
  Hypo

SEQ ID NO: 111654 - DNA, 30 bp, Homo sapiens; identical to SEQ ID NO: 79439
  chr16:8234670-8234700
  Hypo

SEQ ID NO: 111655 - DNA, 221 bp, Homo sapiens; identical to SEQ ID NO: 79449
  chr16:8322627-8322848
  Hypo

SEQ ID NO: 111656 - DNA, 30 bp, Homo sapiens; identical to SEQ ID NO: 79493
  chr16:8519135-8519165
  Hypo

SEQ ID NO: 111657 - DNA, 51 bp, Homo sapiens; identical to SEQ ID NO: 79556
  chr16:8606896-8606947
  Hypo

SEQ ID NO: 111658 - DNA, 147 bp, Homo sapiens; identical to SEQ ID NO: 44593
  chr16:8781004-8781151
  Hypo

SEQ ID NO: 111659 - DNA, 53 bp, Homo sapiens; identical to SEQ ID NO: 79729
  chr16:8870353-8870406
  Hypo

SEQ ID NO: 111660 - DNA, 29 bp, Homo sapiens
  chr16:8963909-8963938
  Hypo
gggtgcggtggctcacgcctgtaattcca

SEQ ID NO: 111661 - DNA, 30 bp, Homo sapiens; identical to SEQ ID NO: 79901
  chr16:8971974-8972004
  Hypo

SEQ ID NO: 111662 - DNA, 334 bp, Homo sapiens; identical to SEQ ID NO: 79905
  chr16:8978000-8978334
  Hypo

SEQ ID NO: 111663 - DNA, 30 bp, Homo sapiens; identical to SEQ ID NO: 79908
  chr16:8987879-8987909
  Hypo

SEQ ID NO: 111664 - DNA, 463 bp, Homo sapiens; identical to SEQ ID NO: 79923
  chr16:9005341-9005804
  Hypo

SEQ ID NO: 111665 - DNA, 199 bp, Homo sapiens; identical to SEQ ID NO: 79926
  chr16:9009860-9010059
  Hypo

SEQ ID NO: 111666 - DNA, 41 bp, Homo sapiens; identical to SEQ ID NO: 79929
  chr16:9053767-9053808
  Hyper

SEQ ID NO: 111667 - DNA, 120 bp, Homo sapiens; identical to SEQ ID NO: 79930
  chr16:9062079-9062199
  Hypo

SEQ ID NO: 111668 - DNA, 30 bp, Homo sapiens; identical to SEQ ID NO: 79931
  chr16:9063642-9063672
  Hypo

SEQ ID NO: 111669 - DNA, 30 bp, Homo sapiens; identical to SEQ ID NO: 79932
  chr16:9106938-9106968
  Hyper

SEQ ID NO: 111670 - DNA, 51 bp, Homo sapiens; identical to SEQ ID NO: 79933
  chr16:9229760-9229811
  Hyper

SEQ ID NO: 111671 - DNA, 30 bp, Homo sapiens; identical to SEQ ID NO: 79938
  chr16:9381764-9381794
  Hypo

SEQ ID NO: 111672 - DNA, 184 bp, Homo sapiens; identical to SEQ ID NO: 79955
  chr16:9842646-9842830
  Hypo

SEQ ID NO: 111673 - DNA, 30 bp, Homo sapiens; identical to SEQ ID NO: 79956
  chr16:9862871-9862901
  Hypo

SEQ ID NO: 111674 - DNA, 208 bp, Homo sapiens; identical to SEQ ID NO: 44598
  chr16:9888740-9888948
  Hypo

SEQ ID NO: 111675 - DNA, 30 bp, Homo sapiens; identical to SEQ ID NO: 79958
  chr16:9943625-9943655
  Hypo

SEQ ID NO: 111676 - DNA, 248 bp, Homo sapiens
  chr16:10133318-10133566
  Hyper
tgtttgtttgaaaatcgagacgctaaactctaagtcttttgctgaagctcctctccctaggggcaggatgggagcaaggcttaccaaggctgccacctacagaacagagggcagcgaggactgcgcagcagcgggagggaccggtggcgttgggcgcggggagggtctgcgcggggagggtccgcacccgggagcgggggcggctgctcgctctactcctgggaggggcctttcgaaggaccaggtgc

SEQ ID NO: 111677 - DNA, 3146 bp, Homo sapiens
  chr16:10274265-10277411
  Hyper
catagtcgccactgacggtccctgcaaggtgaagagtgagaggcagggccgcggtgagcaaggcgaccagaagaaagggattaccaacttggcttcctgctctaggagccaggcatggaactcagcagcaggataggctgctgggatcacggactccattccgagtccccgacgccatccacatccctcgatccatctctaactctatccacaactccaattcgagctaattctccatcccccagccccttctcgcatccagcttcctcatcccctgtctccaggcacttccccatccccatctctgtccatatcccccaccgcattccccaagttcgccgcgggccacagaccctaagcgccgcgcgtgttctgtaccccaccaagctcctaggtgcacagaataaaccctccatccaacccctcccacctgggatagagaggaccaagttatcaaccccgccccctgctggcgcggagcgaactacagaccccgcagggcgtgcggaggcggcacccagaccccgcgtcccagcttgagagctcagctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttcacccctacacgcgcgcgtgcacacacacgtgcacacacacacgcacacacacatgttcacacacacacaccctctctcacgcgcgccgtgtgcaatgctgaattctggagagtaggcgcgtccccccgcgggccagcgcgtaggagctggcaaagaacgtgcgtagggggaaaggtaggctcccaagaagctcccagacggacgtggactgtacagcccctccctagcctttctactgcgggcgctgttgccaagtcctaggtgcacgtgggcagtgggccgcacacgctcataggcacgcgcgcttttctgcgcacttcctcagactgctgtagcggtgcccacggccagccggagtcctcacatgtcctcaggtggtgcacacgcatgaactgcggcaggtgcacagccctgcgtacctgcaaataccagcacggtcgtgcacgcgtgccctgacgcgcgcctctcgggacggacgctgctggagccgggggaagttgaggcgaactccaagaggcctcgacgttcctgggtaagcgccgcggagcgcggagccgcagcgccccctggtgcccctcctgcacttcgccgctgggctccctcccgctttccctctccctctctagcctgatccctctcccgctctccctccggtcgagtctccctcctccccggcccaaggagccctgatctccctctgggacgtacctgtagcccgagaaggtcgaggatgcagtggggcgcgctgcgcgcacgagcatctcggccgcctcagcagccaccgggtttagcgggttcccgcatgctgcggccccagcgcgctcccctggctgtcccgcgctgtccgcatcgcccccacggggggcggctatcccagccggaggctctgcagcagggctctaacggggcggaggagagaaggagaggcagggtcagcccaccaacgaggggagggagggttgaggggaaggctgcagtctgcagtgctcacaagcccccctatgcgcccaggggggctagacaagaggggggaagctgaagcccgatgcccacgacgcccccagtgcggatcctcagcccctgtggctgatagcgggagctccactccagggtgcacaggagaatgggagccccaggttggccacccacgagaagctaactgggcacctccacccgcaccccctaccacctccccagcgccggctgctgggagttgtgcgaccgggagctgctgagcgagggaggtagggagagaaagaggaggtaacgagggtgggggggcgctggctgagtttgtgacgagccagcagtaggagagggggagggaaggacgcgggctcccgcggtcccggttccccgagggaggtggatctttcccacgcagcgaccctcttgtgatcctgccgcttcctccctcttcaggcctcccacctccccccttcccaagggggcctcccaggcccggcgtcccgcgctagcactcaccgcagcctctctccacatagttctcagcagtggccgctcctggtcatctccagggctgatggctgcggccgcgattctcagcgctcacccggtcccatgatccggccaagccctaggagctcccctccaagatccctagctccgcttcctgccccactccggacggcaactgcccggtcctctgagcgcgccggagcaccctctccgcaacccagctccgggctggtgtgtttgagggcgagtgtgtgtgtgagtgtgggagcgcgctcgcgtgtggccggggatccccgcggtccccggccgagagaggcgcgggcggggaaaggcagctccctccgggcccttcgctgctgggccagctccgcgccgggcgttcggctccccacttcccagcgggagtccggtgagcgcctggacaccctggttcacagcactggcaaagccgggttcccggggcgtctttctgctgcggtcgcctccgaggaagaggagaaggaaggtagcggcgccctccacaccaacttagggacttgttctcagccggcgagacgcagtagcccccgctcaagcccaagaggcttcgagctccggcgggcgaaagcgtctcctgcccgcagcctctctcctaggtgggtcgagacagaccccgcagtccctcggcggcgacgcggagcgcggccacccgttccgagagcgcacggcggcaaataaggccaggataggtggctggctggcgacgggggcgcctgcggcggcgcgcgctgctgtccgtggtgttggaaccacgctctccgcccgctcccgggcgtctggtgcggctgaagaatcaattattcagatctctgctaccgcttcctcctcccccagtgcctcgcgctgggtacagttatccccctccacg

SEQ ID NO: 111678 - DNA, 635 bp, Homo sapiens
  chr16:10479701-10480336
  Hyper
gccccggtggctgaccggaagaagcgcccacggaggcgaaccccaggcgcccctcagcctacttccatttcccctcgcgacccttcgccccgcccactctagctggctgtgcctgactggctgggctgccgcatattcgcgctgccattggtccataatcagctgggggtgggcgtagggagacctacttcagcaggtcctggccggaccagcattgttaacggctgcggttcgaagtggctgtgggtattgctgcggctggtgcgtcgtcgctctaggtacgttggggccgggcgagtgtcctgcgagagcggcgattggcggggtggcggctctaggagcgtcggtcgcctctctgagggccggccccggaggcctcggagcgccgggcctaccggacgtttgcggcgaagctgccctgactgaaaagcgtccgcggggccgtctgacaggtccgggaagaggcccctgaggggcggacgggcgcgtctccaccgttttcgcagagggatactggtgaagcgggagtggtgtgcggcctcaggtccgggcggcactggggttagggactgcggagggaagtggtgcgtgttttttgtcctgaggggtaagtaaaagctcgctcttgtccggaa

SEQ ID NO: 111679 - DNA, 153 bp, Homo sapiens; identical to SEQ ID NO: 78308
  chr16:10721492-10721645
  Hypo

SEQ ID NO: 111680 - DNA, 85 bp, Homo sapiens; identical to SEQ ID NO: 78315
  chr16:10804580-10804665
  Hypo

SEQ ID NO: 111681 - DNA, 23 bp, Homo sapiens
  chr16:11102871-11102894
  Hypo
tacattcacgttgtataaccatc

SEQ ID NO: 111682 - DNA, 30 bp, Homo sapiens; identical to SEQ ID NO: 78327
  chr16:11118524-11118554
  Hypo

SEQ ID NO: 111683 - DNA, 30 bp, Homo sapiens; identical to SEQ ID NO: 78330
  chr16:11140587-11140617
  Hypo

SEQ ID NO: 111684 - DNA, 30 bp, Homo sapiens; identical to SEQ ID NO: 78331
  chr16:11167520-11167550
  Hypo

SEQ ID NO: 111685 - DNA, 30 bp, Homo sapiens; identical to SEQ ID NO: 78333
  chr16:11178655-11178685
  Hypo

SEQ ID NO: 111686 - DNA, 45 bp, Homo sapiens; identical to SEQ ID NO: 78335
  chr16:11232618-11232663
  Hypo

SEQ ID NO: 111687 - DNA, 30 bp, Homo sapiens; identical to SEQ ID NO: 78336
  chr16:11245768-11245798
  Hypo

SEQ ID NO: 111688 - DNA, 161 bp, Homo sapiens; identical to SEQ ID NO: 78338
  chr16:11283033-11283194
  Hypo

SEQ ID NO: 111689 - DNA, 30 bp, Homo sapiens; identical to SEQ ID NO: 78340
  chr16:11354746-11354776
  Hypo

SEQ ID NO: 111690 - DNA, 38 bp, Homo sapiens; identical to SEQ ID NO: 78341
  chr16:11407112-11407150
  Hypo

SEQ ID NO: 111691 - DNA, 30 bp, Homo sapiens; identical to SEQ ID NO: 78345
  chr16:11484000-11484030
  Hypo

SEQ ID NO: 111692 - DNA, 38 bp, Homo sapiens; identical to SEQ ID NO: 78347
  chr16:11568836-11568874
  Hypo

SEQ ID NO: 111693 - DNA, 30 bp, Homo sapiens; identical to SEQ ID NO: 78351
  chr16:11703494-11703524
  Hypo

SEQ ID NO: 111694 - DNA, 102 bp, Homo sapiens; identical to SEQ ID NO: 78353
  chr16:11712029-11712131
  Hypo

SEQ ID NO: 111695 - DNA, 30 bp, Homo sapiens; identical to SEQ ID NO: 78355
  chr16:11770160-11770190
  Hypo

SEQ ID NO: 111696 - DNA, 23 bp, Homo sapiens
  chr16:11843326-11843349
  Hypo
ggcgcggtggctcaacgtagtcc

SEQ ID NO: 111697 - DNA, 30 bp, Homo sapiens; identical to SEQ ID NO: 78357
  chr16:11853255-11853285
  Hypo

SEQ ID NO: 111698 - DNA, 42 bp, Homo sapiens; identical to SEQ ID NO: 44603
  chr16:11853669-11853711
  Hypo

SEQ ID NO: 111699 - DNA, 30 bp, Homo sapiens; identical to SEQ ID NO: 78361
  chr16:11879750-11879780
  Hypo

SEQ ID NO: 111700 - DNA, 42 bp, Homo sapiens; identical to SEQ ID NO: 78367
  chr16:12012089-12012131
  Hypo

SEQ ID NO: 111701 - DNA, 16 bp, Homo sapiens
  chr16:12130487-12130503
  Hypo
gcgggttttctgtttt

SEQ ID NO: 111702 - DNA, 51 bp, Homo sapiens; identical to SEQ ID NO: 78377
  chr16:12132399-12132450
  Hypo

SEQ ID NO: 111703 - DNA, 30 bp, Homo sapiens; identical to SEQ ID NO: 78383
  chr16:12177673-12177703
  Hypo

SEQ ID NO: 111704 - DNA, 361 bp, Homo sapiens
  chr16:12530041-12530402
  Hypo
ctctgctgcagcccccggaacagtattggcacaggtgagggccacgcctcctccctgggcccaggcatcaggcgctggctctccacaggaggccgcagcttaaggagctcacagacgtttctattcggagagaggggaaggaacgaagacaggaacacagcaccgtttttagtaccaggagacagcgacagcttggcgtcagtgcgatgcgtgacatttccgtgtgtaaggtgtgctgctgcctggtggagtggcgcgcgagcacctggctgctttcctccctgccagatgccatttcaggaaatcgcctttgttgctcaggcattcatacccctgactgctcaggcgcagcctggcttgg

SEQ ID NO: 111705 - DNA, 114 bp, Homo sapiens; identical to SEQ ID NO: 78417
  chr16:12758831-12758945
  Hypo

SEQ ID NO: 111706 - DNA, 30 bp, Homo sapiens; identical to SEQ ID NO: 78418
  chr16:12798468-12798498
  Hypo

SEQ ID NO: 111707 - DNA, 108 bp, Homo sapiens; identical to SEQ ID NO: 78420
  chr16:12897794-12897902
  Hyper

SEQ ID NO: 111708 - DNA, 30 bp, Homo sapiens; identical to SEQ ID NO: 78421
  chr16:12956299-12956329
  Hypo

SEQ ID NO: 111709 - DNA, 71 bp, Homo sapiens; identical to SEQ ID NO: 78422
  chr16:12971895-12971966
  Hypo

SEQ ID NO: 111710 - DNA, 3284 bp, Homo sapiens
  chr16:12994419-12997703
  Hyper
cggggagctggaattcgctaggagagagagggcagatttggaaacacagaggagacgggaggctggaagctgaggaagcaaggcagagctctgcagcccccggtgaggatttccggggggatccgtggggacaggggccagccagctccagagaccgatgcgcgggctccaggtccgggagggtggctgaggctgggtgcccaggccttgcgctgcgccagatccgggagcgcagaggcggcgccgcggtgttccctcctgtggagcgcagaaaacgctgcgggggcgaagagggacagaaagcggcaggttcgagaggctgggggacttccaaggaaagaccttccaggacacgccatagcctcggccttgttcggctgtcccctcttacccccgaccttctttgattcgttcatcccgagcccctctcccccggagggtgcttatccctggctcaggggcttgccacctgtccttcccagctccgcctgggtccttgcttgggcccagagagttgagccatgcgggttgcgctcagggctggagggcgcagccgggaagggcaaggaggccccgcacgcctgggaggggcgatcctgaccagactgcacccagtctgtcttggagtgaaagccatttagtctgtccccatcctctccgagtcatccttcccctgatgcacagatttcggccgccgctcctgcacacgcaccggtgaaaaagctacgagctgagccgcctctgcgctctggacagggctgagccgcgcctcctacccagagagggcgcgggaggtcctgccgcggttttccacctgcctggaaatccgagcggctcctctagcctcggctgctgccgagctcgctcctccccgtccgctcgcctggctcagctctgcacgccccccagctagctcccgctctagtcacctcttccccgcgcccccgcccctctagagctcgcgcccgcccccccccacccgcgcctcctctgcccgccctcctccccctcccccttccctcctgccctcccttcattccacaagtgtcgcttcgctctcttcagcgcacttggcgagctggtgaggtgagagggatactgcgagagggctaggggcggccagtccggggctgccggccaaggctaggcgctgccagcccgattctcctctgctctccacccccgcctcacccagtggccggccggacctgcaccccgcgcttgaccccgctcatcctccccccgcccggccgggcgcgctcctccccggccggcccctcggcgcgcggcgcgctggaggcgaacgcgggctgaggcgaacgcgggctgagccgagcgcagtggccgccgaccaccgagcgccccgcgccgctccctgcatgtgcggcccgcggcggctcgcagctcccggcagcagcctcggcagcttcggccgcgcctcgagaggcggccgcagaggctccagcggcggccgagcggccgagcccgggctgggagacaccatgcgccgcgtccttcggctgctcctcggttgcttcctcaccgagctgtgcgcccgcgtgtgccgggcgcaggagcgagcgggacacgggcagctggcgcaactgggcggcgtgttgctgctggcggggggcaaccgctccggggccgcctccggagaggccagcgagggcgctgaggcatcggacgcgcccccgacccgggcgcccacgccggacttctgccggggctacttcgatgtcatgggccagtgggacccgccgttcaactgcagctcgggcgacttcatcttctgctgcgggacttgtggcttccggttctgctgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccaggtgggctgcctccccttcgccctcccctcggggcttcgctctccctgctctctcctccccaccttcccccaggcaatggcgctccccacggtccccgctccccgcatcccagcctctccgctgggggatgtcaccgggaagccaacttcggcttggaacacggagaaggggcgctgggctcagcacaggtgtgggtctgagcgtgttcgtgtgtgtgtgagcgtgtgtgtgtgtgtgtgtgactctgctccctcaccctctggccgcctcctcccgctggtgactgaggcggacttgagacacgtagcctgggagcccgtggccccgaaatcttcgggtttggggagagggtccatggcacccctcggattccaggtgctagctttttggtaaacaggggcaggcgagcccgaaaggggaggggggcgtgtgtgagcccgagcgcgcgtgtgtgaaggagggagggtcagagtgagtgccgcctgcaactcgtacgactcgcgaaaaggagacgagggaggtggagtgaggggagggcgagaacaaaagccttgcttggagcggccgcctcgctttcccagagcttcgccgtccctggatttgggacctcagctgcccccgcccctttacccacctcatccctttctctggccaccacttctccctgcccggggccgtggccatcgctgcagattgagccccttgccctggctggcgtggactccgggggcccgagccccctcctcgcgcgccctcacttccaagcaccctgatttcgtcaactttcgggtttgccttgttcattatgcaagccccagcaccagctagttccagcagatgggagaaggctttgggggattaatggagctatttgccttttgctttttttaaattttttttattttaagtgtctaaatcgattcgcaaactccgtaactttggaggcggaggacgcagccactaggagcactaagcccccggccgcgggagaggctgggggttggcgtgaggtccgggcgggcggggtggaaggagtgactagcggcctgcgaacagctggatggttggggcataagctttaactgtcccctttcagagtctgggcaacgaagtcgctgtatttttctctaccctctccccaccccttcttccgcgccccctctgccgggggcctgtgtgtgtgcgcgcgtgtgtgcacgcgctccgtgtgatgcctaaa

SEQ ID NO: 111711 - DNA, 27 bp, Homo sapiens
  chr16:13064659-13064686
  Hypo
tgtgagccaccgcgcctggccggggca

SEQ ID NO: 111712 - DNA, 30 bp, Homo sapiens; identical to SEQ ID NO: 78434
  chr16:13266811-13266841
  Hypo

SEQ ID NO: 111713 - DNA, 156 bp, Homo sapiens; identical to SEQ ID NO: 78438
  chr16:13676585-13676741
  Hypo

SEQ ID NO: 111714 - DNA, 93 bp, Homo sapiens; identical to SEQ ID NO: 78439
  chr16:13687295-13687388
  Hypo

SEQ ID NO: 111715 - DNA, 30 bp, Homo sapiens; identical to SEQ ID NO: 78450
  chr16:13977355-13977385
  Hypo

SEQ ID NO: 111716 - DNA, 30 bp, Homo sapiens; identical to SEQ ID NO: 78462
  chr16:14359651-14359681
  Hypo

SEQ ID NO: 111717 - DNA, 32 bp, Homo sapiens; identical to SEQ ID NO: 44607
  chr16:14464204-14464236
  Hypo

SEQ ID NO: 111718 - DNA, 44 bp, Homo sapiens; identical to SEQ ID NO: 78464
  chr16:14615356-14615400
  Hypo

SEQ ID NO: 111719 - DNA, 88 bp, Homo sapiens; identical to SEQ ID NO: 78467
  chr16:14724470-14724558
  Hypo

SEQ ID NO: 111720 - DNA, 102 bp, Homo sapiens; identical to SEQ ID NO: 78468
  chr16:14725771-14725873
  Hypo

SEQ ID NO: 111721 - DNA, 102 bp, Homo sapiens; identical to SEQ ID NO: 78469
  chr16:14726113-14726215
  Hypo

SEQ ID NO: 111722 - DNA, 30 bp, Homo sapiens; identical to SEQ ID NO: 44610
  chr16:14728494-14728524
  Hypo

SEQ ID NO: 111723 - DNA, 48 bp, Homo sapiens; identical to SEQ ID NO: 44611
  chr16:14761842-14761890
  Hypo

SEQ ID NO: 111724 - DNA, 48 bp, Homo sapiens; identical to SEQ ID NO: 78480
  chr16:15052961-15053009
  Hypo

SEQ ID NO: 111725 - DNA, 35 bp, Homo sapiens; identical to SEQ ID NO: 78481
  chr16:15191537-15191572
  Hypo

SEQ ID NO: 111726 - DNA, 174 bp, Homo sapiens; identical to SEQ ID NO: 78484
  chr16:15241215-15241389
  Hypo

SEQ ID NO: 111727 - DNA, 259 bp, Homo sapiens; identical to SEQ ID NO: 78486
  chr16:15489930-15490189
  Hyper

SEQ ID NO: 111728 - DNA, 36 bp, Homo sapiens; identical to SEQ ID NO: 78487
  chr16:15522286-15522322
  Hypo

SEQ ID NO: 111729 - DNA, 808 bp, Homo sapiens; identical to SEQ ID NO: 78488
  chr16:15528335-15529143
  Hyper

SEQ ID NO: 111730 - DNA, 20 bp, Homo sapiens
  chr16:15552675-15552695
  Hypo
aaacaaagccaggtgcggtg

SEQ ID NO: 111731 - DNA, 30 bp, Homo sapiens; identical to SEQ ID NO: 44614
  chr16:15555102-15555132
  Hypo

SEQ ID NO: 111732 - DNA, 15 bp, Homo sapiens
  chr16:15594787-15594802
  Hypo
cgtgagccaccgtgc

SEQ ID NO: 111733 - DNA, 161 bp, Homo sapiens; identical to SEQ ID NO: 78492
  chr16:15595873-15596034
  Hypo

SEQ ID NO: 111734 - DNA, 17 bp, Homo sapiens
  chr16:15600039-15600056
  Hypo
cttttatttttgagacg

SEQ ID NO: 111735 - DNA, 113 bp, Homo sapiens; identical to SEQ ID NO: 78494
  chr16:15604260-15604373
  Hypo

SEQ ID NO: 111736 - DNA, 58 bp, Homo sapiens; identical to SEQ ID NO: 78495
  chr16:15626753-15626811
  Hypo

SEQ ID NO: 111737 - DNA, 30 bp, Homo sapiens; identical to SEQ ID NO: 78496
  chr16:15628035-15628065
  Hypo

SEQ ID NO: 111738 - DNA, 129 bp, Homo sapiens; identical to SEQ ID NO: 78497
  chr16:15692042-15692171
  Hypo

SEQ ID NO: 111739 - DNA, 37 bp, Homo sapiens; identical to SEQ ID NO: 78498
  chr16:15743162-15743199
  Hypo

SEQ ID NO: 111740 - DNA, 28 bp, Homo sapiens
  chr16:15746797-15746825
  Hypo
gagagagccaccgcgcctggcctaagct

SEQ ID NO: 111741 - DNA, 170 bp, Homo sapiens; identical to SEQ ID NO: 78500
  chr16:15762561-15762731
  Hypo

SEQ ID NO: 111742 - DNA, 30 bp, Homo sapiens; identical to SEQ ID NO: 78502
  chr16:15767710-15767740
  Hypo

SEQ ID NO: 111743 - DNA, 92 bp, Homo sapiens; identical to SEQ ID NO: 44620
  chr16:15820825-15820917
  Hypo

SEQ ID NO: 111744 - DNA, 30 bp, Homo sapiens; identical to SEQ ID NO: 78505
  chr16:15841780-15841810
  Hypo

SEQ ID NO: 111745 - DNA, 498 bp, Homo sapiens; identical to SEQ ID NO: 78506
  chr16:15950839-15951337
  Hyper

SEQ ID NO: 111746 - DNA, 643 bp, Homo sapiens; identical to SEQ ID NO: 78507
  chr16:15951793-15952436
  Hyper

SEQ ID NO: 111747 - DNA, 30 bp, Homo sapiens; identical to SEQ ID NO: 78508
  chr16:16045826-16045856
  Hypo

SEQ ID NO: 111748 - DNA, 30 bp, Homo sapiens; identical to SEQ ID NO: 78509
  chr16:16122579-16122609
  Hypo

SEQ ID NO: 111749 - DNA, 37 bp, Homo sapiens; identical to SEQ ID NO: 78511
  chr16:16663469-16663506
  Hypo

SEQ ID NO: 111750 - DNA, 30 bp, Homo sapiens; identical to SEQ ID NO: 78513
  chr16:17046472-17046502
  Hypo

SEQ ID NO: 111751 - DNA, 22 bp, Homo sapiens
  chr16:17049589-17049611
  Hypo
accacgccggccacaacagatt

SEQ ID NO: 111752 - DNA, 30 bp, Homo sapiens; identical to SEQ ID NO: 78515
  chr16:17077914-17077944
  Hypo

SEQ ID NO: 111753 - DNA, 30 bp, Homo sapiens; identical to SEQ ID NO: 78516
  chr16:17202525-17202555
  Hypo

SEQ ID NO: 111754 - DNA, 30 bp, Homo sapiens; identical to SEQ ID NO: 78518
  chr16:17294271-17294301
  Hypo

SEQ ID NO: 111755 - DNA, 66 bp, Homo sapiens; identical to SEQ ID NO: 78521
  chr16:17335057-17335123
  Hypo

SEQ ID NO: 111756 - DNA, 30 bp, Homo sapiens; identical to SEQ ID NO: 44622
  chr16:17341523-17341553
  Hypo

SEQ ID NO: 111757 - DNA, 18 bp, Homo sapiens
  chr16:17368739-17368757
  Hypo
ctctcagagcagggccgg

SEQ ID NO: 111758 - DNA, 16 bp, Homo sapiens
  chr16:17566188-17566204
  Hypo
tgagataggcctgggc

SEQ ID NO: 111759 - DNA, 30 bp, Homo sapiens; identical to SEQ ID NO: 78530
  chr16:17659142-17659172
  Hypo

SEQ ID NO: 111760 - DNA, 29 bp, Homo sapiens
  chr16:17821439-17821468
  Hypo
tgagatcaggccaggcgcggtggctcaca

SEQ ID NO: 111761 - DNA, 88 bp, Homo sapiens; identical to SEQ ID NO: 78533
  chr16:17866374-17866462
  Hypo

SEQ ID NO: 111762 - DNA, 152 bp, Homo sapiens; identical to SEQ ID NO: 78534
  chr16:17913465-17913617
  Hypo

SEQ ID NO: 111763 - DNA, 146 bp, Homo sapiens; identical to SEQ ID NO: 44624
  chr16:18802485-18802631
  Hypo

SEQ ID NO: 111764 - DNA, 128 bp, Homo sapiens; identical to SEQ ID NO: 78545
  chr16:18804414-18804542
  Hypo

SEQ ID NO: 111765 - DNA, 33 bp, Homo sapiens; identical to SEQ ID NO: 78547
  chr16:18950653-18950686
  Hypo

SEQ ID NO: 111766 - DNA, 32 bp, Homo sapiens; identical to SEQ ID NO: 78548
  chr16:18950986-18951018
  Hypo

SEQ ID NO: 111767 - DNA, 40 bp, Homo sapiens; identical to SEQ ID NO: 78549
  chr16:18995550-18995590
  Hyper

SEQ ID NO: 111768 - DNA, 142 bp, Homo sapiens; identical to SEQ ID NO: 78553
  chr16:19422024-19422166
  Hyper

SEQ ID NO: 111769 - DNA, 166 bp, Homo sapiens; identical to SEQ ID NO: 78554
  chr16:19422383-19422549
  Hyper

SEQ ID NO: 111770 - DNA, 30 bp, Homo sapiens; identical to SEQ ID NO: 78555
  chr16:19442928-19442958
  Hypo

SEQ ID NO: 111771 - DNA, 30 bp, Homo sapiens; identical to SEQ ID NO: 78558
  chr16:19485502-19485532
  Hypo

SEQ ID NO: 111772 - DNA, 30 bp, Homo sapiens; identical to SEQ ID NO: 78559
  chr16:19498338-19498368
  Hypo

SEQ ID NO: 111773 - DNA, 30 bp, Homo sapiens; identical to SEQ ID NO: 78560
  chr16:19529179-19529209
  Hypo

SEQ ID NO: 111774 - DNA, 23 bp, Homo sapiens
  chr16:19534847-19534870
  Hypo
atcacgcccggtgggttcagcaa

SEQ ID NO: 111775 - DNA, 27 bp, Homo sapiens
  chr16:19554463-19554490
  Hypo
ggaagtcagggaccccgaatggaggga

SEQ ID NO: 111776 - DNA, 486 bp, Homo sapiens; identical to SEQ ID NO: 78563
  chr16:19567041-19567527
  Hyper

SEQ ID NO: 111777 - DNA, 42 bp, Homo sapiens; identical to SEQ ID NO: 78564
  chr16:19568977-19569019
  Hypo

SEQ ID NO: 111778 - DNA, 57 bp, Homo sapiens; identical to SEQ ID NO: 78569
  chr16:19708504-19708561
  Hypo

SEQ ID NO: 111779 - DNA, 30 bp, Homo sapiens
  chr16:19891072-19891102
  Hypo
caccccatggggttgcggtgacggttaaaa

SEQ ID NO: 111780 - DNA, 420 bp, Homo sapiens
  chr16:19894846-19895266
  Hyper
ccttggctgaagtgccggggtttttgtgccagatccctcccccacttctcttgtctttgcggggtcccccagggctttctgggctctgttcaggtgccccccggcctggtgcagttgggcggccaatgtggcgcgtgggctggggccccaggcggggacgccgctgcccgccacactccaggggcctttgtccgcgctccaaggagccgcccccttagcgaacgggggacggaaagggaggactggctaggcctgggtgtgacagagcaaggacggaggagtgaacccgctgcacgggggagatttctggggcaaggtcgttggccccttcccaggctgttcaaccggctgcccggggccaaggcgggtgcgggctcctcccgcgcgctcccttttcggcctaagcgctagggaccccgg

SEQ ID NO: 111781 - DNA, 18 bp, Homo sapiens
  chr16:19929829-19929847
  Hypo
tcccggtcggaaatttat

SEQ ID NO: 111782 - DNA, 97 bp, Homo sapiens; identical to SEQ ID NO: 78571
  chr16:20084459-20084556
  Hyper

SEQ ID NO: 111783 - DNA, 816 bp, Homo sapiens
  chr16:20084616-20085432
  Hyper
cacacacacacggtccccagctagggcacagcaacttcctttccccccgtgtggaaatatccatagttgcccttaaagcttaaactttttccgagggggcgccagggaacgcacgggggaggacgggggattctgggtagggttgcccggcacttggggttcctggcttccctccctctcccccacgcccctcacctggtaaaccgaggcacagcaagaggctgtagtagaccacgggcacgaaacccaagccgcaggccgagccgggggaccaccaagacagcgagctgttggctgcgaggtgggcgtgcgtgtgctccatgagcgcgcccctcgctccccttgccgcttcgcgcccggcctgccagcccgactctggtcgccggctcggtggtggcggcggcggaggcagcggcagctggagcagcagcgcctctctccccgcaggactggctcctacccttggccgtgatcccctctgctcgctccgcacctgcccgcctggagtcttggctcagccctcccgcagggcgcggggcgcagggtgcggggcgcgctgcgcggggcctcgggaggggctcccggagcccgtctgtgcgcctcccacctcggacccgctccactcccgcctcaaagccggggggctgggacgccgctccccgcagccaatcagcggctgcctggaagcggagtgtgtgtggggtgggagggatgcggaagaggagggggtcccagccgcctcgcttggctccactttcaggggagaagatgcagttagacctgggagccccgaaggaagaccggagtggaaaacag

SEQ ID NO: 111784 - DNA, 205 bp, Homo sapiens; identical to SEQ ID NO: 78574
  chr16:20085652-20085857
  Hyper

SEQ ID NO: 111785 - DNA, 30 bp, Homo sapiens; identical to SEQ ID NO: 78575
  chr16:20133385-20133415
  Hypo

SEQ ID NO: 111786 - DNA, 201 bp, Homo sapiens; identical to SEQ ID NO: 78578
  chr16:20327304-20327505
  Hypo

SEQ ID NO: 111787 - DNA, 201 bp, Homo sapiens; identical to SEQ ID NO: 78580
  chr16:20359734-20359935
  Hyper

SEQ ID NO: 111788 - DNA, 108 bp, Homo sapiens; identical to SEQ ID NO: 78597
  chr16:21289404-21289512
  Hyper

SEQ ID NO: 111789 - DNA, 464 bp, Homo sapiens
  chr16:21294910-21295374
  Hyper
ggccaggacaagcaacggatgaagtatctcggaagccggagaagggtggtctggggctcttgggagcatgcgcggggtggggcggtggggggactgaggtggcgctcccggctcctccgcgcgcccccggcaccttccgcgcgtccccggctccccacactccgtccccggctccccacactcccaccccggtctgccccgggcgcccccggttccccacctcctggtgtgcctctggcgggtccgcgcaggatcaggctacagactcgcccgcgggcggctgcgcggcgggccgttggggagggtgttgggatgaggagccccaaccagatggacgcgcaccccgcagcggcggaggcggcggcgaggcttgagcagtgagtgctcgggagccccggccagcccttcctccttctgcctgcgtcctctgcgctggccgctgctccagacgccagggggcccac

SEQ ID NO: 111790 - DNA, 59 bp, Homo sapiens; identical to SEQ ID NO: 78602
  chr16:21363314-21363373
  Hypo

SEQ ID NO: 111791 - DNA, 90 bp, Homo sapiens; identical to SEQ ID NO: 78609
  chr16:21526523-21526613
  Hypo

SEQ ID NO: 111792 - DNA, 48 bp, Homo sapiens; identical to SEQ ID NO: 78610
  chr16:21539162-21539210
  Hypo

SEQ ID NO: 111793 - DNA, 38 bp, Homo sapiens; identical to SEQ ID NO: 78611
  chr16:21541457-21541495
  Hypo

SEQ ID NO: 111794 - DNA, 157 bp, Homo sapiens; identical to SEQ ID NO: 78612
  chr16:21566618-21566775
  Hypo

SEQ ID NO: 111795 - DNA, 51 bp, Homo sapiens; identical to SEQ ID NO: 78613
  chr16:21569348-21569399
  Hypo

SEQ ID NO: 111796 - DNA, 256 bp, Homo sapiens; identical to SEQ ID NO: 78617
  chr16:21675205-21675461
  Hyper

SEQ ID NO: 111797 - DNA, 33 bp, Homo sapiens; identical to SEQ ID NO: 44635
  chr16:21719131-21719164
  Hypo

SEQ ID NO: 111798 - DNA, 411 bp, Homo sapiens; identical to SEQ ID NO: 78619
  chr16:21831546-21831957
  Hyper

SEQ ID NO: 111799 - DNA, 20 bp, Homo sapiens
  chr16:21839328-21839348
  Hypo
acagacagaaaagcacggtc

SEQ ID NO: 111800 - DNA, 328 bp, Homo sapiens; identical to SEQ ID NO: 78625
  chr16:22173605-22173933
  Hyper

SEQ ID NO: 111801 - DNA, 30 bp, Homo sapiens; identical to SEQ ID NO: 78626
  chr16:22189581-22189611
  Hypo

SEQ ID NO: 111802 - DNA, 377 bp, Homo sapiens; identical to SEQ ID NO: 12422
  chr16:22203596-22203973
  Hyper

SEQ ID NO: 111803 - DNA, 19 bp, Homo sapiens
  chr16:22216598-22216617
  Hypo
gtttttgtttttttgcgac

SEQ ID NO: 111804 - DNA, 30 bp, Homo sapiens; identical to SEQ ID NO: 78629
  chr16:22289966-22289996
  Hypo

SEQ ID NO: 111805 - DNA, 1906 bp, Homo sapiens
  chr16:22824473-22826379
  Hyper
tctggacatggtcaccgagaactgtcctgtaggcattcacttaggaatcattcgaagtggaattgctcctggatacgttctccttgtactctgtttcctcctcctagtgtctctgtgtgaagaagccctcctcactcagccctcggcgaccctctggtaccctggacagctccccggggagcagtctaccgctaggcggcggctgctaagagaggaaccctcctgacgcggagtctgccgctccggggctcgctctccggcaggcccggggagaggtggggtgacaatgggttggggtgcgcgcgtgcctcataggtgcgagacagagcgagccgccggggtgtgagtcagcgcgctgggggctaagaagctgggtgaatagtcacggaatctcactcacgctcggctcctccacccatcccgtctacagcgcgtgtcccagtccagggcgtgcgtgcgctcggtgtccgattccgggctgtgtgtgtccatttggcgagatgtcgagagcggggggagtgtccttgtcggtgtatctgggcccaggttaggggacttctcctccccacccccgcgtgggtgtgggggtgtgtccgggctagggcgcgtgtgcttctgtgcctgtgcgtgcgtgtgcgggtcagggtggtgggaccgcgcatcagggcagggtgcctgcgtctgcgtctgggtctgtctggtctgcatgtcggcgcgatctcgacctggattcgtgtccctggatgtcgagaggccagcgtggtgggggtgtccagcctcccggaggagtactatgccttgacaccttcgtttcaccgccccaaagctggcctggggctccgtagggagtggcctgcatggggagggcccgcgtgctgtgtttctgggaggggtaagagagtgggggcgcagggggcgggccaggtccctgggcgcggcgcgggctcgggggacccgcgcggctgacgtcaggccactccttaaatagagccggcagcgcgctccgctcggcatttcccgaagagccagatcgcggccggcgccagcgccaccgtccggtccacccgccagcccgcacagccgcgccgccgccgagcgtttcgtgagcggcgctccgaggatcaggaatggggcttcgggcgctgggcgcgctccgaacccggcgcacgtaagagcctgggagcgcccgagccgcccggctgcccggagccccatcgcctaggaccgggagatgctggaaatgcaaccgcctgttccccgaggagccgctgcccccgggaccccctggcactgtgcgcaccctggtcagcagcccccggagaagacggcgcccccaacgcccgacccgcgtggccgtggcagcgccacgcgagccctctaggcgaccgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttct

SEQ ID NO: 111806 - DNA, 30 bp, Homo sapiens; identical to SEQ ID NO: 44636
  chr16:23093885-23093915
  Hypo

SEQ ID NO: 111807 - DNA, 37 bp, Homo sapiens; identical to SEQ ID NO: 78655
  chr16:23194399-23194436
  Hyper

SEQ ID NO: 111808 - DNA, 213 bp, Homo sapiens; identical to SEQ ID NO: 78658
  chr16:23303285-23303498
  Hypo

SEQ ID NO: 111809 - DNA, 621 bp, Homo sapiens
  chr16:23313389-23314010
  Hyper
ggcgcatgtgggtatcgctggtgtcccgaggtggggagggagaatgcggagcgcgtgcgtgcggggggcgtccagtgtccctgaacctggcgtgtgggggctggagcttattgggaggcgagggaggtggccaggggagccgggaccgtgcgtgtggccaggccggtagcgcccagtaagctccacccgcgggcgctccccgtgcttccccgcccctgaacctgctccctcccagtcggtctcgccgcgctcgccgggtgtcccagtgtcaccaacactcggccgccgccgccagcttggcgcgcaccgccgcctccgccaccgccgacagcgcgcatcctccgtgtccccgctccgccgcccgagcaggtatgacggcgaaccctggctcgcacccggtctcccgcgcgctgcccggagtccctgcgcgcgcgccttctcctgcccaaccccggcccgcgagctcctgtcccggcctcagtttcccacgggagggcgcttgggtgcctgtctgaggcgcctgggacccggcctggggactgaacgggttgggggcggaggggagagctggaggctgggaaaagcccccagggtgcagaaggcagacggggccagggtccc

SEQ ID NO: 111810 - DNA, 151 bp, Homo sapiens; identical to SEQ ID NO: 78663
  chr16:23444796-23444947
  Hypo

SEQ ID NO: 111811 - DNA, 47 bp, Homo sapiens; identical to SEQ ID NO: 78664
  chr16:23511691-23511738
  Hypo

SEQ ID NO: 111812 - DNA, 29 bp, Homo sapiens
  chr16:23551968-23551997
  Hypo
aaggtttgggctgagcgcagtggctcatg

SEQ ID NO: 111813 - DNA, 30 bp, Homo sapiens; identical to SEQ ID NO: 78666
  chr16:23595732-23595762
  Hypo

SEQ ID NO: 111814 - DNA, 38 bp, Homo sapiens; identical to SEQ ID NO: 78667
  chr16:23606618-23606656
  Hypo

SEQ ID NO: 111815 - DNA, 19 bp, Homo sapiens
  chr16:23651266-23651285
  Hypo
atctcggcagctccctgca

SEQ ID NO: 111816 - DNA, 389 bp, Homo sapiens
  chr16:23706226-23706615
  Hyper
cctggcttcaggtcccggtgcactgtgggagaggggcagaaagaaagctggttgctgagggcggaaggcaggggctaaggacagggagcgggaggcaggggaagtgcgggtacctatgtgtaaagagtgcaggtgggccaggccagacatcagctgctgcagcacgacctcgggctccagacccccgcgatccaggtccgggttttctacgtactgagcagcagcaagggccaaagcatcactctccagcccggaccttcccactcaccctccctgaaccgcaatgcaactcacctcctgcaaggaggcccggcagagctccagggcaatgtagtggaactggggtccccgctcggtgcagaagtagcggagcacgttggggtgcctgt

SEQ ID NO: 111817 - DNA, 96 bp, Homo sapiens; identical to SEQ ID NO: 78671
  chr16:23716327-23716423
  Hypo

SEQ ID NO: 111818 - DNA, 104 bp, Homo sapiens; identical to SEQ ID NO: 36097
  chr16:23765896-23766000
  Hyper

SEQ ID NO: 111819 - DNA, 337 bp, Homo sapiens; identical to SEQ ID NO: 78673
  chr16:23766233-23766570
  Hyper

SEQ ID NO: 111820 - DNA, 102 bp, Homo sapiens; identical to SEQ ID NO: 78674
  chr16:23782435-23782537
  Hypo

SEQ ID NO: 111821 - DNA, 30 bp, Homo sapiens; identical to SEQ ID NO: 78675
  chr16:23829399-23829429
  Hypo

SEQ ID NO: 111822 - DNA, 1773 bp, Homo sapiens
  chr16:23846792-23848565
  Hyper
cctacctctgcagaacgtgtgtgtgtatgtgtgtgtaagtgtgtgcggccacaagcctttccgaatgagtgacagcgggagcccatccctccaggagacgcgtgcagaatgaccaatgggatggatgggggtggatgggtaccagtctccgcagaggccggggtggaattcgctgcgccccaccccttccacccgctccccttcgccccgtaggtctttccactctcgctcctcccctgggcacatctcctgaacgcagccccgggggccgaggacggggtggggtggggggcgaggctcgggtccgacgaccccgggctgcggtcccggcgctgcagagctgcggctgtgcacgcttagccgcgaggcccgcggtagcccgggcgccgatatgtaaagcagctggcagcgctgggcggggcctgggcgcgatgcaaatgaggagggcggggctggcccggggctccgcctccctcccccgcagctggggccagcggtgccaagcgcagctggacgagcggcagcagctgggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggtgagcgcgcgcgcgcagggcaccttcccgggcccccgagggcagcgccgcgccagggaccccctctccgcgccctctgcgccctccgcgccctccgcaccctgggaccccgcgtctccggactcccggctccggaccctgctgcccgggactcccggatggacagtcctgccgttgccctgtccccaccctggtcccagacgggccgccgcggggcgcctcctgccctctcctgctctcaggcgcctctagagcgcccaggggcggcgtcgcgggagcctttgctccacctgactaggagcgcgcggggtctgtgcctgccctggagggcagcgcctcgggtgctctccgacccggggttccctatctctccgcctgcttccgggcgcgaggagccctcgccccccaccccttgtttccggggggggcggcgccctgggtgtccttctctatctccctgcgggcatgggacatcctttctcactcctctgtgcctccgggcagcgccctgtgttatctcccattgcccctccccgagggcctgggttcccctttccactcctcggtcacatcactgcgggcccctttcttccccagtccctccagtagtggggcatcctttcctccttcccagtccccctcccagaggacaccaccgccgcggggtcactctcgccctccctctgaatgcgtctttatctcttctcttttcccgagggtgctcggggcatctatgggtacatctgtcgcctgccttcagcccctaccccgacggaaacgctccccactatcccgccacctggtggtcgcagcctcctctcttctgcaggagtgaaggcagatgggggttacagccgagctcccacctacccccacaaaggcggaagactcttggg

SEQ ID NO: 111823 - DNA, 30 bp, Homo sapiens; identical to SEQ ID NO: 78683
  chr16:23939787-23939817
  Hypo

SEQ ID NO: 111824 - DNA, 30 bp, Homo sapiens; identical to SEQ ID NO: 78684
  chr16:23966825-23966855
  Hypo

SEQ ID NO: 111825 - DNA, 105 bp, Homo sapiens; identical to SEQ ID NO: 78685
  chr16:23967391-23967496
  Hypo

SEQ ID NO: 111826 - DNA, 231 bp, Homo sapiens; identical to SEQ ID NO: 78686
  chr16:23990945-23991176
  Hypo

SEQ ID NO: 111827 - DNA, 33 bp, Homo sapiens; identical to SEQ ID NO: 44642
  chr16:24013932-24013965
  Hypo

SEQ ID NO: 111828 - DNA, 30 bp, Homo sapiens; identical to SEQ ID NO: 78688
  chr16:24118868-24118898
  Hypo

SEQ ID NO: 111829 - DNA, 690 bp, Homo sapiens
  chr16:24266904-24267594
  Hyper
cgtctccagagctgccggtgcctttaagaagactcggtctttcgggtcttctttttccccaatgggctccagtggtgcccgcagcaaaaggcaaacttgcctggctcatggggtgaaagggaggattgaagaatgccgcgttgggtgggtgctgagggagcgccagagtgcgctacgggcttcgctccccttcccctttccttaacccttcctagagcggaggaaccgggtcgtgctgcagcgcccaggagccagggcgctgactgtcctcggctccagaaactttgcgcggagagtgggcttgactgggcagagccgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccagtttgagcgggggtgtcgggagcaggcggagagctttcctgcgaggctgtggaagcagtgaacactcttctcagcggctcgcctcccagcagtgctattttttgccatcc

SEQ ID NO: 111830 - DNA, 150 bp, Homo sapiens
  chr16:24267654-24267804
  Hyper
cacactcacacagagacctctctgggtttctttgccttgagtctcccggggctgtgagaagccaggcgcatctcaaaccgagctggcagctccaggctccggagccatgccctgcacggaccctcgtctttaccacgctcctgaggaatg

SEQ ID NO: 111831 - DNA, 30 bp, Homo sapiens; identical to SEQ ID NO: 78694
  chr16:24366205-24366235
  Hypo

SEQ ID NO: 111832 - DNA, 100 bp, Homo sapiens; identical to SEQ ID NO: 78695
  chr16:24373008-24373108
  Hypo

SEQ ID NO: 111833 - DNA, 37 bp, Homo sapiens; identical to SEQ ID NO: 78696
  chr16:24383172-24383209
  Hypo

SEQ ID NO: 111834 - DNA, 30 bp, Homo sapiens; identical to SEQ ID NO: 78697
  chr16:24549351-24549381
  Hypo

SEQ ID NO: 111835 - DNA, 212 bp, Homo sapiens; identical to SEQ ID NO: 78698
  chr16:24621853-24622065
  Hyper

SEQ ID NO: 111836 - DNA, 23 bp, Homo sapiens
  chr16:24880199-24880222
  Hypo
tttttttttttgagacggagtct

SEQ ID NO: 111837 - DNA, 23 bp, Homo sapiens
  chr16:25071412-25071435
  Hypo
aaacttgttaatcaccgggcgcg

SEQ ID NO: 111838 - DNA, 31 bp, Homo sapiens; identical to SEQ ID NO: 78706
  chr16:25077193-25077224
  Hypo

SEQ ID NO: 111839 - DNA, 30 bp, Homo sapiens; identical to SEQ ID NO: 78707
  chr16:25078633-25078663
  Hyper

SEQ ID NO: 111840 - DNA, 78 bp, Homo sapiens; identical to SEQ ID NO: 78710
  chr16:25111119-25111197
  Hypo

SEQ ID NO: 111841 - DNA, 36 bp, Homo sapiens; identical to SEQ ID NO: 78713
  chr16:25266537-25266573
  Hypo

SEQ ID NO: 111842 - DNA, 30 bp, Homo sapiens; identical to SEQ ID NO: 78720
  chr16:25535143-25535173
  Hypo

SEQ ID NO: 111843 - DNA, 19 bp, Homo sapiens
  chr16:25551069-25551088
  Hypo
ggtgctggccaggcacggt

SEQ ID NO: 111844 - DNA, 28 bp, Homo sapiens
  chr16:25692519-25692547
  Hypo
ttaagatatgtaggccgggtgcggtggc

SEQ ID NO: 111845 - DNA, 1849 bp, Homo sapiens
  chr16:25702795-25704644
  Hyper
agagaagatggggggcggggggcggtggctggaaagatggaagttgggatgggaaagcggttgtagaaaaggattcactcctggaccgaaggcaggaggatatcccgggcgagagaagggagggtcggggatgggctgagttggagtcccagaggaaaagcggaagcgagagcttcgtcacccgctgtcttccagctcccggtgcgcggcaccggaggcaggcgttgggctttacctctctaaaagtactggggcaaaggaatggagaacacggcgtcccgagctcccaagggaggggagtaaacgaggtggggtggggaacaccccaagtgcgtgcgtgctgggggctggggggcacgatctccgttctcccgggtgccccagccctagcgcacgcctccgctcccccgcccccttcgcaggcgcgcgcgaggcgcaccccccttccctcggcggcgccgggcgcgcgcccggccccctcctcctcccctccgcgcctctcctctctcccggcagaaagttagcagcggggaaggaactccgggctgcaacagcgcgcggcggcggcggcagaggctgaagcagaagccgcggcggagccggggaagcgggggcgctgcagacggagcaggtgccgccggcgggtccgcgcgcccccctcggtccccttgcctgaggctgaggggggggcggtggtgggggggccacccggactcggcgggcagcgtggggcggggggccatgcggccgggctcccccctggcgcagcgggacagcggccagggccgggggcgcagcggcgtcgcttcatgcagccggggcggctgggcagcggcggcggcggcggcggcggcggcggcggcgggggcggcggctgaaaccatgtccgggcagcgccgggggctgccgccgccgccgccgccgccgcgagccgggagccgcgatggcccggtggcccgcacctcctccgcctccgcctccgcctccacctctggccgcgccgccgccgcccggcgcctctgctaaggggccgccggcgcgcaagctgctttttatgtgcaccttgtccctgtctgtcacctacctgtgctacagcctcctgggcggctcgggctccctgcaattccctctggcgctgcaggagtcgccgggcgccgccgccgagcccccgccgagcccgccgccaccctctctgctgcctacccccgtgcgcctcggcgccccctcgcagccgcccgcgccgccgccgctggacaacgcgagccacggggagccgcccgagcccccagagcagccagccgcccccgggaccgacggctgggggctgccgagcggcggcggaggcgcccaggacgcctggctccggaccccgctggcccccagcgagatgatcacggctcagagcgcgctgccggagagggaagcgcaggagtccagcaccaccgacgaggatctcgcaggccggagagcggccaacgggagcagcgagaggggcggcgccgtcagcacccccgactatggggagaagaagctgccacaggcgctcatcatcggggtcaagaaaggagggacccgcgcgctgctggaggcgatccgcgtgcacccggacgtgcgggcggtgggcgtagagccgcacttcttcgacaggaactacgaaaaggggttggagtggtacaggtaggaccctgggctccgcgggctggtggagacgcgtgggggagacgcggaggggaagccgcggctttccacgcccttcgagcatccaggcaccgtcccgagaggcccaagcccccgcgagggctctgcaaaccctggcggcgttgctcagggggatcggctgagagggctg

SEQ ID NO: 111846 - DNA, 151 bp, Homo sapiens; identical to SEQ ID NO: 78725
  chr16:25808282-25808433
  Hypo

SEQ ID NO: 111847 - DNA, 30 bp, Homo sapiens; identical to SEQ ID NO: 78726
  chr16:25859755-25859785
  Hypo

SEQ ID NO: 111848 - DNA, 18 bp, Homo sapiens
  chr16:26044215-26044233
  Hypo
tctcgcctcttcttcaca

SEQ ID NO: 111849 - DNA, 32 bp, Homo sapiens; identical to SEQ ID NO: 78729
  chr16:26383401-26383433
  Hypo

SEQ ID NO: 111850 - DNA, 88 bp, Homo sapiens; identical to SEQ ID NO: 78730
  chr16:26388441-26388529
  Hypo

SEQ ID NO: 111851 - DNA, 214 bp, Homo sapiens; identical to SEQ ID NO: 78731
  chr16:26501488-26501702
  Hypo

SEQ ID NO: 111852 - DNA, 134 bp, Homo sapiens; identical to SEQ ID NO: 78732
  chr16:26616439-26616573
  Hypo

SEQ ID NO: 111853 - DNA, 42 bp, Homo sapiens; identical to SEQ ID NO: 44646
  chr16:26664733-26664775
  Hypo

SEQ ID NO: 111854 - DNA, 30 bp, Homo sapiens; identical to SEQ ID NO: 44647
  chr16:26732577-26732607
  Hypo

SEQ ID NO: 111855 - DNA, 30 bp, Homo sapiens; identical to SEQ ID NO: 78735
  chr16:26830222-26830252
  Hypo

SEQ ID NO: 111856 - DNA, 30 bp, Homo sapiens; identical to SEQ ID NO: 78736
  chr16:27006797-27006827
  Hypo

SEQ ID NO: 111857 - DNA, 32 bp, Homo sapiens; identical to SEQ ID NO: 44648
  chr16:27038943-27038975
  Hypo

SEQ ID NO: 111858 - DNA, 70 bp, Homo sapiens; identical to SEQ ID NO: 78738
  chr16:27052238-27052308
  Hypo

SEQ ID NO: 111859 - DNA, 57 bp, Homo sapiens; identical to SEQ ID NO: 78740
  chr16:27166676-27166733
  Hyper

SEQ ID NO: 111860 - DNA, 36 bp, Homo sapiens; identical to SEQ ID NO: 44649
  chr16:27279055-27279091
  Hypo

SEQ ID NO: 111861 - DNA, 30 bp, Homo sapiens; identical to SEQ ID NO: 78743
  chr16:27460076-27460106
  Hypo

SEQ ID NO: 111862 - DNA, 30 bp, Homo sapiens; identical to SEQ ID NO: 78747
  chr16:27661959-27661989
  Hypo

SEQ ID NO: 111863 - DNA, 110 bp, Homo sapiens; identical to SEQ ID NO: 78749
  chr16:27853439-27853549
  Hypo

SEQ ID NO: 111864 - DNA, 56 bp, Homo sapiens; identical to SEQ ID NO: 78751
  chr16:28057979-28058035
  Hypo

SEQ ID NO: 111865 - DNA, 1388 bp, Homo sapiens
  chr16:28073999-28075387
  Hyper
gggcatctagtgccccgcgaaaggaagaggaggagggggcgagcgtggagatgagttcaggagcggaaagcagcgcgcgcccctccgaccggcagcgggggtgggcgccttcccggggcgcgggagcgtccccaaagccgcggggcgtccgcagcgggtaggagctctgccttgcacctctccacggcggggcgtcccgcacgtccccccatgctggtccccggccccggaacggcgcgcgccccctgccccggaacgtcgcccctagccaggcggagcgctgggagctgggcccaggcggcgggaggagggcgaacgggtccggggctcgggcctcgatggccgcgccgccccgggggagccggagccgagctggccgccgcccgcgcgcactcaccaagcccgctgagctcctcctcgcacgagtaccagatgccggtgtggaaattcctgaagaggaagcggtcgtcgccggtctcccagctgtagagcgcgccgccaggggggccgttccccgaggcggtggcggcggcggcggcggcggcgggggcggcggtgccgttggccgtggcgttggcgcccgagttggggcagttggcgcgcccgccctggccgcagcccggcttggggacccgctgcgtgccctggcaccagtgcgtggtgaggaaagcggtggtggcgaacagcagcgccagcaggttcagggccacggccaggagcgctcggccgcggcggctagtcttcatgccgcccgcgccgccgggacgggactgcaccgccggggagctccgcgcgcgaagttggcagctggcgccccgcgtcagcggccgctgcccgccgcgccccggggctcgggtgcctgagatcggcggcggcggacgcggcgcgggcccatgccccccccaaccccggggtgggggcgcggcgcggggggcgtgcggggcgggctggcggggcgggcggcggtggaggagcggctacggcgcgcccggagcccggagcgcgagtgcacctcggctaggagccgctggcgcctggcagcggccacggcgcagggacgcgcgcccctccgtggggagacacctgcaggcggccggcgacactgttccggagcccgcccgcacggggagagggggccgccacgccgggcgcgggcgggggcctgggagtggagggacgcccccgaaagaaatccgagccagggtgagggtctgagacgcaaggagaatcccaggcaaggcgctcctgagaaaagatccccacggcggacgtggggcaacaaaacccgccgggagcgggcatctcatgagacccagagaggccctgccccaggagacaagggcagagcctgctggggctccccaagagggacacggaccagcaggacc

SEQ ID NO: 111866 - DNA, 221 bp, Homo sapiens; identical to SEQ ID NO: 78757
  chr16:28104147-28104368
  Hypo

SEQ ID NO: 111867 - DNA, 220 bp, Homo sapiens; identical to SEQ ID NO: 78760
  chr16:28304439-28304659
  Hyper

SEQ ID NO: 111868 - DNA, 104 bp, Homo sapiens; identical to SEQ ID NO: 78762
  chr16:28560175-28560279
  Hypo

SEQ ID NO: 111869 - DNA, 165 bp, Homo sapiens; identical to SEQ ID NO: 78766
  chr16:28878680-28878845
  Hypo

SEQ ID NO: 111870 - DNA, 149 bp, Homo sapiens; identical to SEQ ID NO: 78767
  chr16:28887653-28887802
  Hypo

SEQ ID NO: 111871 - DNA, 523 bp, Homo sapiens; identical to SEQ ID NO: 78768
  chr16:28891515-28892038
  Hyper

SEQ ID NO: 111872 - DNA, 26 bp, Homo sapiens
  chr16:28947344-28947370
  Hypo
cccgtccgcctcgcaatttgaactcc

SEQ ID NO: 111873 - DNA, 70 bp, Homo sapiens; identical to SEQ ID NO: 78772
  chr16:28947831-28947901
  Hyper

SEQ ID NO: 111874 - DNA, 38 bp, Homo sapiens; identical to SEQ ID NO: 78773
  chr16:28986682-28986720
  Hyper

SEQ ID NO: 111875 - DNA, 90 bp, Homo sapiens; identical to SEQ ID NO: 78774
  chr16:29009366-29009456
  Hypo

SEQ ID NO: 111876 - DNA, 30 bp, Homo sapiens; identical to SEQ ID NO: 78775
  chr16:29083064-29083094
  Hypo

SEQ ID NO: 111877 - DNA, 30 bp, Homo sapiens; identical to SEQ ID NO: 78776
  chr16:29119028-29119058
  Hypo

SEQ ID NO: 111878 - DNA, 85 bp, Homo sapiens; identical to SEQ ID NO: 78777
  chr16:29139086-29139171
  Hypo

SEQ ID NO: 111879 - DNA, 97 bp, Homo sapiens; identical to SEQ ID NO: 78778
  chr16:29153157-29153254
  Hypo

SEQ ID NO: 111880 - DNA, 217 bp, Homo sapiens; identical to SEQ ID NO: 78779
  chr16:29153374-29153591
  Hypo

SEQ ID NO: 111881 - DNA, 159 bp, Homo sapiens; identical to SEQ ID NO: 78780
  chr16:29169937-29170096
  Hypo

SEQ ID NO: 111882 - DNA, 30 bp, Homo sapiens; identical to SEQ ID NO: 78781
  chr16:29179232-29179262
  Hypo

SEQ ID NO: 111883 - DNA, 181 bp, Homo sapiens; identical to SEQ ID NO: 78782
  chr16:29187850-29188031
  Hypo

SEQ ID NO: 111884 - DNA, 55 bp, Homo sapiens; identical to SEQ ID NO: 78783
  chr16:29191424-29191479
  Hypo

SEQ ID NO: 111885 - DNA, 146 bp, Homo sapiens; identical to SEQ ID NO: 78784
  chr16:29230150-29230296
  Hypo

SEQ ID NO: 111886 - DNA, 344 bp, Homo sapiens; identical to SEQ ID NO: 78785
  chr16:29244717-29245061
  Hypo

SEQ ID NO: 111887 - DNA, 125 bp, Homo sapiens; identical to SEQ ID NO: 78786
  chr16:29248426-29248551
  Hypo

SEQ ID NO: 111888 - DNA, 30 bp, Homo sapiens; identical to SEQ ID NO: 44659
  chr16:29262965-29262995
  Hypo

SEQ ID NO: 111889 - DNA, 80 bp, Homo sapiens; identical to SEQ ID NO: 78788
  chr16:29266368-29266448
  Hypo

SEQ ID NO: 111890 - DNA, 30 bp, Homo sapiens; identical to SEQ ID NO: 78789
  chr16:29324346-29324376
  Hypo

SEQ ID NO: 111891 - DNA, 34 bp, Homo sapiens; identical to SEQ ID NO: 44661
  chr16:29324812-29324846
  Hypo

SEQ ID NO: 111892 - DNA, 63 bp, Homo sapiens; identical to SEQ ID NO: 78791
  chr16:29353324-29353387
  Hypo

SEQ ID NO: 111893 - DNA, 27 bp, Homo sapiens
  chr16:29660744-29660771
  Hypo
ggcgtgagcgatcgcacccagcctctt

SEQ ID NO: 111894 - DNA, 37 bp, Homo sapiens; identical to SEQ ID NO: 78793
  chr16:29682566-29682603
  Hypo

SEQ ID NO: 111895 - DNA, 73 bp, Homo sapiens; identical to SEQ ID NO: 44662
  chr16:29691644-29691717
  Hypo

SEQ ID NO: 111896 - DNA, 30 bp, Homo sapiens; identical to SEQ ID NO: 78795
  chr16:29703508-29703538
  Hypo

SEQ ID NO: 111897 - DNA, 30 bp, Homo sapiens; identical to SEQ ID NO: 78796
  chr16:29711222-29711252
  Hypo

SEQ ID NO: 111898 - DNA, 252 bp, Homo sapiens; identical to SEQ ID NO: 78798
  chr16:29830871-29831123
  Hypo

SEQ ID NO: 111899 - DNA, 35 bp, Homo sapiens; identical to SEQ ID NO: 78799
  chr16:29884723-29884758
  Hypo

SEQ ID NO: 111900 - DNA, 145 bp, Homo sapiens
  chr16:29888121-29888266
  Hyper
ggcaagtgagaatgtcggagcctagcagctcgtagccaggctcgcactggtaggtgagcaccgtgccccggatcaggtccccgtgggatgccgttctccagccccactccggaggtggcagctcggggcacgtgtcgttcctcgg

SEQ ID NO: 111901 - DNA, 148 bp, Homo sapiens; identical to SEQ ID NO: 78800
  chr16:29888624-29888772
  Hyper

SEQ ID NO: 111902 - DNA, 30 bp, Homo sapiens; identical to SEQ ID NO: 78801
  chr16:29913174-29913204
  Hypo

SEQ ID NO: 111903 - DNA, 141 bp, Homo sapiens; identical to SEQ ID NO: 78802
  chr16:29936349-29936490
  Hypo

SEQ ID NO: 111904 - DNA, 35 bp, Homo sapiens; identical to SEQ ID NO: 78803
  chr16:29972439-29972474
  Hypo

SEQ ID NO: 111905 - DNA, 112 bp, Homo sapiens; identical to SEQ ID NO: 78805
  chr16:30015457-30015569
  Hypo

SEQ ID NO: 111906 - DNA, 630 bp, Homo sapiens; identical to SEQ ID NO: 78806
  chr16:30017228-30017858
  Hypo

SEQ ID NO: 111907 - DNA, 44 bp, Homo sapiens; identical to SEQ ID NO: 78807
  chr16:30018478-30018522
  Hypo

SEQ ID NO: 111908 - DNA, 38 bp, Homo sapiens; identical to SEQ ID NO: 78808
  chr16:30020315-30020353
  Hypo

SEQ ID NO: 111909 - DNA, 114 bp, Homo sapiens; identical to SEQ ID NO: 78810
  chr16:30022990-30023104
  Hyper

SEQ ID NO: 111910 - DNA, 38 bp, Homo sapiens; identical to SEQ ID NO: 78811
  chr16:30032589-30032627
  Hyper

SEQ ID NO: 111911 - DNA, 129 bp, Homo sapiens; identical to SEQ ID NO: 78812
  chr16:30042292-30042421
  Hyper

SEQ ID NO: 111912 - DNA, 26 bp, Homo sapiens
  chr16:30065618-30065644
  Hypo
cagtgatactccgtctcaataagaat

SEQ ID NO: 111913 - DNA, 30 bp, Homo sapiens; identical to SEQ ID NO: 78814
  chr16:30085375-30085405
  Hypo

SEQ ID NO: 111914 - DNA, 107 bp, Homo sapiens; identical to SEQ ID NO: 78815
  chr16:30100357-30100464
  Hypo

SEQ ID NO: 111915 - DNA, 30 bp, Homo sapiens; identical to SEQ ID NO: 78816
  chr16:30103941-30103971
  Hyper

SEQ ID NO: 111916 - DNA, 196 bp, Homo sapiens; identical to SEQ ID NO: 78817
  chr16:30116119-30116315
  Hypo

SEQ ID NO: 111917 - DNA, 34 bp, Homo sapiens; identical to SEQ ID NO: 78818
  chr16:30124080-30124114
  Hypo

SEQ ID NO: 111918 - DNA, 364 bp, Homo sapiens; identical to SEQ ID NO: 78819
  chr16:30124497-30124861
  Hypo

SEQ ID NO: 111919 - DNA, 23 bp, Homo sapiens
  chr16:30135083-30135106
  Hypo
agggtctctctctgtcgtccagg

SEQ ID NO: 111920 - DNA, 30 bp, Homo sapiens; identical to SEQ ID NO: 44667
  chr16:30354712-30354742
  Hypo

SEQ ID NO: 111921 - DNA, 181 bp, Homo sapiens; identical to SEQ ID NO: 78826
  chr16:30365186-30365367
  Hypo

SEQ ID NO: 111922 - DNA, 20 bp, Homo sapiens
  chr16:30401737-30401757
  Hypo
ttattttttttgagtcggag

SEQ ID NO: 111923 - DNA, 153 bp, Homo sapiens; identical to SEQ ID NO: 78828
  chr16:30430020-30430173
  Hypo

SEQ ID NO: 111924 - DNA, 19 bp, Homo sapiens
  chr16:30541444-30541463
  Hypo
cggccgagaatagctacat

SEQ ID NO: 111925 - DNA, 63 bp, Homo sapiens; identical to SEQ ID NO: 78830
  chr16:30567446-30567509
  Hypo

SEQ ID NO: 111926 - DNA, 34 bp, Homo sapiens; identical to SEQ ID NO: 78831
  chr16:30573625-30573659
  Hypo

SEQ ID NO: 111927 - DNA, 31 bp, Homo sapiens; identical to SEQ ID NO: 78832
  chr16:30584531-30584562
  Hypo

SEQ ID NO: 111928 - DNA, 47 bp, Homo sapiens; identical to SEQ ID NO: 78833
  chr16:30644928-30644975
  Hypo

SEQ ID NO: 111929 - DNA, 69 bp, Homo sapiens; identical to SEQ ID NO: 78835
  chr16:30761038-30761107
  Hypo

SEQ ID NO: 111930 - DNA, 48 bp, Homo sapiens; identical to SEQ ID NO: 78837
  chr16:30790427-30790475
  Hypo

SEQ ID NO: 111931 - DNA, 104 bp, Homo sapiens; identical to SEQ ID NO: 78838
  chr16:30803850-30803954
  Hypo

SEQ ID NO: 111932 - DNA, 26 bp, Homo sapiens
  chr16:30804455-30804481
  Hypo
tgcggacttcccgattaaaaagcact

SEQ ID NO: 111933 - DNA, 34 bp, Homo sapiens; identical to SEQ ID NO: 78840
  chr16:30817004-30817038
  Hyper

SEQ ID NO: 111934 - DNA, 145 bp, Homo sapiens; identical to SEQ ID NO: 78841
  chr16:30826330-30826475
  Hypo

SEQ ID NO: 111935 - DNA, 30 bp, Homo sapiens; identical to SEQ ID NO: 78842
  chr16:30832615-30832645
  Hypo

SEQ ID NO: 111936 - DNA, 30 bp, Homo sapiens; identical to SEQ ID NO: 78843
  chr16:30832846-30832876
  Hypo

SEQ ID NO: 111937 - DNA, 30 bp, Homo sapiens; identical to SEQ ID NO: 78844
  chr16:30833324-30833354
  Hypo

SEQ ID NO: 111938 - DNA, 76 bp, Homo sapiens; identical to SEQ ID NO: 44672
  chr16:30906986-30907062
  Hypo

SEQ ID NO: 111939 - DNA, 196 bp, Homo sapiens; identical to SEQ ID NO: 44673
  chr16:30907122-30907318
  Hypo

SEQ ID NO: 111940 - DNA, 30 bp, Homo sapiens; identical to SEQ ID NO: 78849
  chr16:30979173-30979203
  Hypo

SEQ ID NO: 111941 - DNA, 30 bp, Homo sapiens; identical to SEQ ID NO: 78850
  chr16:31001301-31001331
  Hypo

SEQ ID NO: 111942 - DNA, 30 bp, Homo sapiens; identical to SEQ ID NO: 44674
  chr16:31018076-31018106
  Hypo

SEQ ID NO: 111943 - DNA, 30 bp, Homo sapiens; identical to SEQ ID NO: 36119
  chr16:31022167-31022197
  Hyper

SEQ ID NO: 111944 - DNA, 198 bp, Homo sapiens; identical to SEQ ID NO: 78853
  chr16:31138607-31138805
  Hypo

SEQ ID NO: 111945 - DNA, 39 bp, Homo sapiens; identical to SEQ ID NO: 44676
  chr16:31149942-31149981
  Hypo

SEQ ID NO: 111946 - DNA, 81 bp, Homo sapiens; identical to SEQ ID NO: 78855
  chr16:31173147-31173228
  Hypo

SEQ ID NO: 111947 - DNA, 196 bp, Homo sapiens; identical to SEQ ID NO: 78856
  chr16:31213944-31214140
  Hyper

SEQ ID NO: 111948 - DNA, 138 bp, Homo sapiens; identical to SEQ ID NO: 36120
  chr16:31226609-31226747
  Hyper

SEQ ID NO: 111949 - DNA, 68 bp, Homo sapiens; identical to SEQ ID NO: 78858
  chr16:31227017-31227085
  Hyper

SEQ ID NO: 111950 - DNA, 43 bp, Homo sapiens; identical to SEQ ID NO: 78859
  chr16:31227355-31227398
  Hyper

SEQ ID NO: 111951 - DNA, 543 bp, Homo sapiens
  chr16:31227770-31228313
  Hyper
aaaaaaacccaacctcgcccaaccttgcccgtctttatctgcgaagaaagcacagaacccatgaaacggaacagggcccaggcagcccaggagcctggaagggggcagtggggcgagatgcagcccaccagggttcgcggcagcccagcccttcgcccccgggaggggctggccggaggtctgagggaggaccccaggagggaccctgaaggaggggaacaggaaggctctgggcgggacctgacgcgtgggtccttggcgaggaagcggggttgggtcccgagatcacgtaccagctcagagtggccctcacgcagcccgctgcagccgtgcggcctcctccaacatgcgcatgtcgcgcagcacggccacgacgagctcggctgcgtagtcctcgtagtaggaggcgaccagcttgtcggtgaggtccacgatatctagctgcccgagcgcgccccgcgggatgcgctcaaagccctcgcgcagcggcaccgtccccagcttcatcttgaacttcttgagctcctccggtgtcaggttctc

SEQ ID NO: 111952 - DNA, 152 bp, Homo sapiens; identical to SEQ ID NO: 78862
  chr16:31373926-31374078
  Hypo

SEQ ID NO: 111953 - DNA, 40 bp, Homo sapiens; identical to SEQ ID NO: 78863
  chr16:31384803-31384843
  Hypo

SEQ ID NO: 111954 - DNA, 65 bp, Homo sapiens; identical to SEQ ID NO: 78864
  chr16:31388356-31388421
  Hypo

SEQ ID NO: 111955 - DNA, 445 bp, Homo sapiens; identical to SEQ ID NO: 78868
  chr16:31446903-31447348
  Hypo

SEQ ID NO: 111956 - DNA, 141 bp, Homo sapiens; identical to SEQ ID NO: 78869
  chr16:31483518-31483659
  Hyper

SEQ ID NO: 111957 - DNA, 30 bp, Homo sapiens; identical to SEQ ID NO: 78870
  chr16:31496344-31496374
  Hypo

SEQ ID NO: 111958 - DNA, 42 bp, Homo sapiens; identical to SEQ ID NO: 78871
  chr16:31498048-31498090
  Hypo

SEQ ID NO: 111959 - DNA, 261 bp, Homo sapiens; identical to SEQ ID NO: 78872
  chr16:31498557-31498818
  Hyper

SEQ ID NO: 111960 - DNA, 182 bp, Homo sapiens; identical to SEQ ID NO: 78873
  chr16:31499022-31499204
  Hyper

SEQ ID NO: 111961 - DNA, 413 bp, Homo sapiens; identical to SEQ ID NO: 78874
  chr16:31499494-31499907
  Hyper

SEQ ID NO: 111962 - DNA, 151 bp, Homo sapiens; identical to SEQ ID NO: 78875
  chr16:31500522-31500673
  Hypo

SEQ ID NO: 111963 - DNA, 41 bp, Homo sapiens; identical to SEQ ID NO: 78877
  chr16:31524056-31524097
  Hypo

SEQ ID NO: 111964 - DNA, 40 bp, Homo sapiens; identical to SEQ ID NO: 78878
  chr16:31526376-31526416
  Hypo

SEQ ID NO: 111965 - DNA, 249 bp, Homo sapiens; identical to SEQ ID NO: 36126
  chr16:31540812-31541061
  Hyper

SEQ ID NO: 111966 - DNA, 30 bp, Homo sapiens
  chr16:31549080-31549110
  Hyper
ccgctcctccattgccgcccagcggggatc

SEQ ID NO: 111967 - DNA, 30 bp, Homo sapiens; identical to SEQ ID NO: 78881
  chr16:31558059-31558089
  Hypo

SEQ ID NO: 111968 - DNA, 30 bp, Homo sapiens; identical to SEQ ID NO: 78882
  chr16:31560507-31560537
  Hypo

SEQ ID NO: 111969 - DNA, 556 bp, Homo sapiens
  chr16:31580480-31581036
  Hyper
tctttggtgtcatttcgatttataaatccatatccatttctgacgttgaaccatttgacagtgccaaggactttggtggcgagaacttttttctccgcgtcttcgctgtcggcggcggtggctaaagaggcggcggccgcggtgcccgtggctgcgggggccccgtccccacccgggtttcctgcgacgagggcggcgggcgccggggccgcggcttggggtgcaccgctgcccacccggctcttggtcgcggggtcctggggagccgcggcggccgccaccgcaggagcctgctggagggtggtggtgatgatggtggcctcgcccgcctcgctcatgcctcctcctcctctgctctcgctcatgcgcctcggtggcggttggtcggcggttagtgcggctggtggtcgccgcggccggggctcgctctcggggaggccggggctgatctcgcggcgcaggcggcggcggcagaggtggggtcgcgcagcggaggcagctcgagcttcgggatgcgcgctcgcttcttgggctcctcgctcgatcttactgcccc

SEQ ID NO: 111970 - DNA, 21 bp, Homo sapiens
  chr16:31658246-31658267
  Hypo
aatggaaggactgggcgcggt

SEQ ID NO: 111971 - DNA, 150 bp, Homo sapiens; identical to SEQ ID NO: 78893
  chr16:32127040-32127190
  Hyper

SEQ ID NO: 111972 - DNA, 179 bp, Homo sapiens; identical to SEQ ID NO: 78912
  chr16:32485443-32485622
  Hypo

SEQ ID NO: 111973 - DNA, 20 bp, Homo sapiens
  chr16:33396766-33396786
  Hypo
tatgagatggattttcgccc

SEQ ID NO: 111974 - DNA, 30 bp, Homo sapiens; identical to SEQ ID NO: 78922
  chr16:33619032-33619062
  Hypo

SEQ ID NO: 111975 - DNA, 30 bp, Homo sapiens; identical to SEQ ID NO: 78924
  chr16:33784579-33784609
  Hypo

SEQ ID NO: 111976 - DNA, 120 bp, Homo sapiens; identical to SEQ ID NO: 78925
  chr16:33893476-33893596
  Hypo

SEQ ID NO: 111977 - DNA, 97 bp, Homo sapiens; identical to SEQ ID NO: 78926
  chr16:33897828-33897925
  Hypo

SEQ ID NO: 111978 - DNA, 162 bp, Homo sapiens; identical to SEQ ID NO: 78927
  chr16:34264932-34265094
  Hypo

SEQ ID NO: 111979 - DNA, 83 bp, Homo sapiens; identical to SEQ ID NO: 78928
  chr16:34407744-34407827
  Hypo

SEQ ID NO: 111980 - DNA, 30 bp, Homo sapiens; identical to SEQ ID NO: 78929
  chr16:34788530-34788560
  Hypo

SEQ ID NO: 111981 - DNA, 213 bp, Homo sapiens; identical to SEQ ID NO: 78931
  chr16:34983934-34984147
  Hypo

SEQ ID NO: 111982 - DNA, 116 bp, Homo sapiens; identical to SEQ ID NO: 78974
  chr16:46721647-46721763
  Hypo

SEQ ID NO: 111983 - DNA, 30 bp, Homo sapiens; identical to SEQ ID NO: 78975
  chr16:46763064-46763094
  Hypo

SEQ ID NO: 111984 - DNA, 30 bp, Homo sapiens; identical to SEQ ID NO: 78976
  chr16:46785401-46785431
  Hypo

SEQ ID NO: 111985 - DNA, 44 bp, Homo sapiens; identical to SEQ ID NO: 78977
  chr16:46803052-46803096
  Hypo

SEQ ID NO: 111986 - DNA, 85 bp, Homo sapiens; identical to SEQ ID NO: 78979
  chr16:47053768-47053853
  Hypo

SEQ ID NO: 111987 - DNA, 987 bp, Homo sapiens; identical to SEQ ID NO: 78980
  chr16:47176772-47177759
  Hyper

SEQ ID NO: 111988 - DNA, 626 bp, Homo sapiens; identical to SEQ ID NO: 78981
  chr16:47177819-47178445
  Hyper

SEQ ID NO: 111989 - DNA, 120 bp, Homo sapiens; identical to SEQ ID NO: 78988
  chr16:48642018-48642138
  Hypo

SEQ ID NO: 111990 - DNA, 96 bp, Homo sapiens; identical to SEQ ID NO: 78989
  chr16:48644969-48645065
  Hypo

SEQ ID NO: 111991 - DNA, 656 bp, Homo sapiens
  chr16:48844517-48845173
  Hyper
ggggggtgggggctgcgctgcctcctctcctctgcgctcacctgggcggcggacagggtcgagtgccctaaagtccccctggcacgcccgggtgcgcgtccctcctcgacgccctgcgcccacccaggcccgggggcacgaggcggcctccagcttccccgcgggtccggggcgggcacagcgggtcgggggcggcctggctgggctggcagagcacgtctcggcggcaaaagaggcgccgggcatgctctcggatgaacttggcagatttagacactcagccctaattgcggcgagctcgggccgctgcacccgcgcggggcagatgtgcctcggcgctgcccggcccaattgctcccatttatcccggcctcgcccgcccagttgggagcgcgcggccggctcgggccgccaggaaaagcctctgccatcaatcagaggcggcggggcggccgcgatcgatggcggcccccgcactgaggcccccgcctcccgatcaatcggccgcctgccgtgttccaccgcggcctgcggacgccgcgctgggagagacgggtcgatgcgtctcggggcgccggggcacgcggggacggcggccttcgcggggctctgccctcaccctggcatcgtcctgccgggcccgggtgatgctggcc

SEQ ID NO: 111992 - DNA, 487 bp, Homo sapiens; identical to SEQ ID NO: 78994
  chr16:49309010-49309497
  Hyper

SEQ ID NO: 111993 - DNA, 1514 bp, Homo sapiens
  chr16:49311063-49312577
  Hyper
cagggagcgccaaagcgtacaggggcagcttccttgagcggtggctctccaaccttcgcggccctacagcctcaagcttacacgcaccctactgactatagggtctccacaagcccggagggctggccctgcaacggcagagctgctgggtggagctagtttcgctgccaaaggctccaactgtctccgacctctccttcccaaccaggagacttcggagaaagcgcgtctctttattaaaagcagtttttctttaaatccctttaaggccccttatttcttctcattcacacttccctggggcctaacagagtagaagggaaactgttgggcagaaacagaaaagtactcgggtccactcctcactcgcgaagtccctatctatctctgtgggtcccggaggcacagggctgcaagggcgcccgctagagctgctccacggcttaccggattgcatgcggagaagaaacgggcccgggtttcaacagaggccccgtgctccgtgaatttctaactcgaaccagccgctgggataaatccgagaaacgttgtttattgtgctattattaactttcccttctccccacgcccctagaggaaataaaattcattcctgaatattgggccaggaaaacgtttctctgaaaggaaccacaactgcaggggaccacccggctgcagctcccagctcccggcccttcgccctaggctgcccactcgctccggctcccgacctccccgctgccgaagcaactgggtcagcctttcagacttaaaacgaagtcgtttatttcatttttgctttcacattatgttccgatacaatcaaaactcctggacgaacctcttgaataaagtcctgtgaatgagcggaatcataggtcctgggcgcccgagtatgcggcgggtggactccggattcagaggcggtgtataaaacatacgctgcttcgggaactgcgagggggacgcggtgggagacatccggggacagaaggcctgaggagtctgccgctccaggcagggtcgtttgggtcctcaaactgggactattcctgatgcatttggaatgcaaagaaaaaaatcaaacttcgctcctgggccggcggccgcgcctggcctagcaagatttcggccacatttcttacgtttccgccaaagctgtgaacacaggcgaatgcagtgctggtccccggcctggcgcaggaaggagcgcaaggccggctttgcaaggaagccctcgcgcccaggcctttctatggttgcgttcccccaagtctcctgcctttcggaacctcgccctttggcaccccagacccccaacctcgcagctggggaagatgcggattttagaaagctgtttcagaaaaataaaagtcccacttcgactttattagattaaagcaaaattaaaccttgactattcacacgtatgttacagaggaagaggaggcgtccggaagaagctccttggcgtttcgtggagtcacagagcacgacggcattgacaagca

SEQ ID NO: 111994 - DNA, 3557 bp, Homo sapiens
  chr16:49313154-49316711
  Hyper
ttgtcccacagctggcgcgcacctttttacccagatacagttagagaacatgtaggaagtttcaagtcgtgctgctttctcgccctcttaatttcagcctctttctcactccccttcctgccttcgccctctccctgcctcccttccggctacgagccagtcagagaggaaacaccaggaatccggagaaggtcgagtacttccagccccccatcaagtttccccgctccagcttgaggtatgctcggtcgcctttctccatttggattaggactccgttgctggcggcctcccgggtcacgtcctggtcaccagcgaaggctgaaatcaccggccacccgtttagcatgaggctcacctgagaaagagaaaggcccgcttcagaggcgcaacctaggcaggcaccgaagccgcggtggagcgaacctcctccttgcttggctaacagcctgtaaggcctggaagcacggagaggtggggggtggggggggcgaatggaggaaaaggggctttgcagcttactgctgaggctccagtggggcgaaagaccacacatctgggtgacaggaagggcctgtccccaaaacgggagttgctcttattccagtttctcaaatgagcgcgccaagcgaatctcgactgtgctctgtgatccaatttaataaacccatgaggtggctctagcgccctgagacctttgacctctctcccgtttcccctcagcctcaaaaaacaaacaacaaacaaaaaaaacccagcaactcaggctccttctggcgctaccggaaaaacaaaaacgaacaaacaaaaagcccctgatccctcctggacccagctgccaggacacagtggagaagccactgtgatttgtgattagaagtctcgcaccgagcggcacaatgtatttcctccccaaaccacgggctcaattccctcccccatccagccgcgcccgccaccgcctggttttgcccctgtggtggcaccgtcagccaagggcctcgcgccctctccccagctgtgcgtcccacctctctcggcgcccaagggaaacctggacatctttggggacccggagagccggcgagtgattgctgggacacggctggagccgggagagagtagcactacgccccctccctccctcctctctctacccctcaccctccggggctaaatgctgctagctcaaaaacccacagtccgcacggggtggggattggggacaagtgggagaaaacgggggccccgtccgtggtgctgaagacaagcacgcaagccgcatcgcaggcttctgagccggggcaaggggtagggtgtactgtcgcggtgcttcctggggagtccgggaaggcttcccaagcggcagctgtctggggcgctaacaacagccgttacaaggaagtccctgaaatccagggaacccttcggagaggcccggaaggcagaagcagaaaattctgtctctcgggggatggggctggatcccaagagccagagacagggaaagcagaggacagttgaagccacagaactgagaggccccgctatctgtccctccaagcagcccgaagtacatgcagccgccacttctgcctaccacctccggacagcccgagcacccctgaggccagtaacccccctacggggccagggcccggcacgaggcgtcggctgacctgtatggtttgtctgttgtagacttttaccacgtggaagttaaaactgtagatccctttgcgcggggcgatgaaagtgctgcgttctgaatcaaagttgttcccaatgttcactagtacctataacgagacgggaacgaaggggagtgggcaggaatcggtcccggactgtcgtccccgcgcctccgcagagcccttggagaggaccgggcatcggtcttccatccatccctccttcaccagcccaatctgcacgccgcgggaggaaggaacactcacctggtcgaagtagatgatcatggtgcgattactcatctcggacggctcgtggttggtgctcctgatggcagagaaagccaccttggcgctgccagagcgcacagagatgcccagggcagtgcccgtggggtcggacgtggggttggagtcgcacaccaccaggcacttgccctccagcacgatgggctccgtctcattctgcccgcgggccgggcccgccagccacgcagcccccagcagcagcagctccaggacgcccagcatcgcgccgccggcgcccaccccgccccccacccccagggctgctcgcgccagccgccccccccgtcccagtcccgctccgaagccccctcctcagctccgtgcgcagctccgccgccgccgctctggacactacacctcttcctcgcactccgggactagcgtcccctccgcgactagcgtcccctccgcgctgtgttcccggagcccctcccgggcctcaggggtgccgcggctgcccagccgcacttggatgcatagccgctgctgctcggtcccgctgctgccgccgcctcctgcccgcacccgccgctgccgccgccgccgccgctctgaattattgatgcagccggcgctgcagccggagcgggcggagagcgcgcgccgggcacaaaggcgcggacctcggcctggccccgcccccgccgcctcccggcccgcctccctccgaggccctgcccccgccccggccgaggccacgccccccagccaatcctgacgcgccgcgctccccaccgagccaatggcggcgctgtccgcgctcggccacctgaccccgggcgccgttgttattaggcgcggcgaggcgggtggcgcgcggcagcagggttgggctctcgccgtgagtcgacgaagggagcgcgggcgcgcgcccgcgtccgcgcactgagagtcgcctcggccgctcgctttctcgactcccgcctcgcgcctcgatcctgttccgcctccctcggccctcctgcccgcccccactcgtcggccctcaggtaggaggcggcgcgccccggggtcgggagtggaatcgctggaggctgcgagtcgcctgcccgcctgtgggcgcgcccgttgggaggggagcgccccccagcgggcgcgggcgcgagggcagccggcgcgctgggcgagcctggctcagggtcccggcggccggggtgcagggcgcgtgcgcgcgcggcggggcggggcctgcgcggctctggcgggcgcacgtggtgcccgggagctgctgggcgggcactcaccgcggggactcggtgcggagccggggcgccgagtgtctccgtgtccctctgccccagccggcggccgcgatggtggagcttggcctctcgctctctcccgcctctccagcgactgctctgccggccgcggaggtcggatcgagcggtcattcattcatttgttaattcgttcacttattcaggggagatcattgaacccctacggagtaccgggtactgggccgggcgctgaggacgcggggctgagcaaaagcagccgaggcccaccttcgtgccccttaaaacccagcgtgcggggcggcaacgagtactg

SEQ ID NO: 111995 - DNA, 182 bp, Homo sapiens; identical to SEQ ID NO: 79001
  chr16:49317053-49317235
  Hyper

SEQ ID NO: 111996 - DNA, 48 bp, Homo sapiens; identical to SEQ ID NO: 79002
  chr16:49317700-49317748
  Hyper

SEQ ID NO: 111997 - DNA, 30 bp, Homo sapiens; identical to SEQ ID NO: 79004
  chr16:49434635-49434665
  Hypo

SEQ ID NO: 111998 - DNA, 30 bp, Homo sapiens; identical to SEQ ID NO: 79005
  chr16:49464835-49464865
  Hypo

SEQ ID NO: 111999 - DNA, 30 bp, Homo sapiens; identical to SEQ ID NO: 44691
  chr16:49500178-49500208
  Hypo

SEQ ID NO: 112000 - DNA, 30 bp, Homo sapiens; identical to SEQ ID NO: 79007
  chr16:49508868-49508898
  Hypo

SEQ ID NO: 112001 - DNA, 184 bp, Homo sapiens; identical to SEQ ID NO: 79008
  chr16:49532989-49533173
  Hypo

SEQ ID NO: 112002 - DNA, 161 bp, Homo sapiens; identical to SEQ ID NO: 44693
  chr16:49545215-49545376
  Hypo

SEQ ID NO: 112003 - DNA, 52 bp, Homo sapiens; identical to SEQ ID NO: 79010
  chr16:49577715-49577767
  Hypo

SEQ ID NO: 112004 - DNA, 30 bp, Homo sapiens; identical to SEQ ID NO: 79011
  chr16:49593939-49593969
  Hypo

SEQ ID NO: 112005 - DNA, 90 bp, Homo sapiens; identical to SEQ ID NO: 44694
  chr16:49623675-49623765
  Hypo

SEQ ID NO: 112006 - DNA, 43 bp, Homo sapiens; identical to SEQ ID NO: 79013
  chr16:49634728-49634771
  Hypo

SEQ ID NO: 112007 - DNA, 44 bp, Homo sapiens; identical to SEQ ID NO: 79014
  chr16:49638054-49638098
  Hypo

SEQ ID NO: 112008 - DNA, 30 bp, Homo sapiens; identical to SEQ ID NO: 79015
  chr16:49671197-49671227
  Hypo

SEQ ID NO: 112009 - DNA, 97 bp, Homo sapiens; identical to SEQ ID NO: 79016
  chr16:49671872-49671969
  Hypo

SEQ ID NO: 112010 - DNA, 20 bp, Homo sapiens
  chr16:49736772-49736792
  Hypo
tgtgtgctggaggagcgagt

SEQ ID NO: 112011 - DNA, 140 bp, Homo sapiens; identical to SEQ ID NO: 79018
  chr16:49736852-49736992
  Hypo

SEQ ID NO: 112012 - DNA, 30 bp, Homo sapiens; identical to SEQ ID NO: 79019
  chr16:49893240-49893270
  Hyper

SEQ ID NO: 112013 - DNA, 27 bp, Homo sapiens
  chr16:50070326-50070353
  Hypo
ggcataagccaccgtgcctggcctctt

SEQ ID NO: 112014 - DNA, 17 bp, Homo sapiens
  chr16:50292023-50292040
  Hypo
aacctccaagctactcg

SEQ ID NO: 112015 - DNA, 37 bp, Homo sapiens; identical to SEQ ID NO: 79024
  chr16:50292820-50292857
  Hypo

SEQ ID NO: 112016 - DNA, 51 bp, Homo sapiens; identical to SEQ ID NO: 79025
  chr16:50335767-50335818
  Hypo

SEQ ID NO: 112017 - DNA, 30 bp, Homo sapiens; identical to SEQ ID NO: 44700
  chr16:50336356-50336386
  Hypo

SEQ ID NO: 112018 - DNA, 152 bp, Homo sapiens; identical to SEQ ID NO: 44701
  chr16:50336625-50336777
  Hypo

SEQ ID NO: 112019 - DNA, 237 bp, Homo sapiens; identical to SEQ ID NO: 79029
  chr16:50501876-50502113
  Hyper

SEQ ID NO: 112020 - DNA, 66 bp, Homo sapiens; identical to SEQ ID NO: 79031
  chr16:50581600-50581666
  Hyper

SEQ ID NO: 112021 - DNA, 53 bp, Homo sapiens; identical to SEQ ID NO: 79032
  chr16:50667548-50667601
  Hypo

SEQ ID NO: 112022 - DNA, 184 bp, Homo sapiens; identical to SEQ ID NO: 79033
  chr16:50699260-50699444
  Hyper

SEQ ID NO: 112023 - DNA, 188 bp, Homo sapiens; identical to SEQ ID NO: 79034
  chr16:50753089-50753277
  Hypo

SEQ ID NO: 112024 - DNA, 195 bp, Homo sapiens; identical to SEQ ID NO: 79035
  chr16:50753681-50753876
  Hypo

SEQ ID NO: 112025 - DNA, 197 bp, Homo sapiens; identical to SEQ ID NO: 79038
  chr16:50958551-50958748
  Hypo

SEQ ID NO: 112026 - DNA, 123 bp, Homo sapiens; identical to SEQ ID NO: 79044
  chr16:51167687-51167810
  Hyper

SEQ ID NO: 112027 - DNA, 856 bp, Homo sapiens
  chr16:51183605-51184461
  Hyper
aggattcccctttcccgacatcaggggtaaagggagcgggggtcccttcgcttcactgtgccccagctctaccgagaggcaggcctctgggaaacgagccggggacctgggggcccgggcggccgcagcttagtgggctgaggtgccgatcagggtcacgcttcggagctctgtcggggcccagctccctccttcacaccccaaaatgccgcctagggcgtgggcatcccgagtggcatccggagccgctgagaccccgccgagattgctccttgtgcgtcctcccacagccgagaggccagcatcgtgccgggacgacccggggacccgagtccgggcgccgctacaccgcctcgggcgctaggcctgggagctttgaggccggtaccgtgaaacacctttaggagcaaggagggattccaggtgtcctccctttgtaccccaactccctgcccggatctcttccactctctgccatagcccccacacacaaactttgttctggacttgttcagccccttcgggacccacagttgtcgcctccatcggagaaaacaagtgcccctgtttcaggggggattccactctggctggccacccgcaaacctggaaaactattctatgacttcttccctgacccccctggaagtagggagcaccacgatccgcagagggcgcataccgaccagaaagattttggggggcagagggtgcaagtgttgtgggaagagatgcggagataaattttgcgagccagaccccgacactttccccgtccgtttgcaccgtctccggaacaactggcggccagcagcactctccaccccggccgcaaccccagcgggtcaggcgctgg

SEQ ID NO: 112028 - DNA, 2873 bp, Homo sapiens
  chr16:51184677-51187550
  Hyper
gagcgctaggggccccgtgcggtcaggccggggcgacctccacccgcacccacgcctcatggggctcccgggtcttggccgcggctgggatccccggaaaagcagggacggagaagccaggccggcatgcccgccctccttcccccgggaggacccaacaactccggaaagatcctgccgggagatgtgctcgctttccccggggcagcgggggaaagcccagcaaaggcacattgaaaattaaaaagaaaaaaaaaattacgccgagtggaagaagcaatcggggccgcggcggcggtgaggtagggggcgcgggggccagccgcgtgtgagtgggtccgagtgtgcgtgagtgtgagtgcgtgtgtgtgtgtccacggcgcgggccggagcactcaccatctcgccgggggagcgaggccacttcggggtcggattggaaatgttgaggcttcgcttgcttcctccgcgacatgctggctcaaacatcagctggggcagaataaaaaattactaaaaaaaaatcttctcaaaattacggaaatcgagcggcggcggcggcggcggctccccccgcccgccggcccgcccgccccctccccggctccccggccccgggcgcagcgcgcatgtgtcctgctataattatgattatcaataatgcattgcgattaatcatagaggggctctttgaaaggcgattggcaccgggccagcgctattcaaacccgctcgccttaatcaattagttcgtgatttgctgcagacccctgtctctccgcgcgctggcccaataagccggccgcggggctggctctgcgcgccgcgccgcccgacactgggttaaccctctttgcgaccgcccgggactccgcggcccggccgccgggggccggcctcctctccactgcgggcccggcgccccggcaggcgccccccgctctctccctctcccctccctcttccctccctccttcgcccccccccacaatcccgggctgggccgacccaaattagcatgccctccccggaattgagccgccccgggtggggggtggggccgggcggcgagggctggggacccgggctgccggcgcgctgcgaacttcccaactcgggggcgaggcgcgccggcccgcggggggagggagtcccgcggcgggatcaggggggagggcgtcccgtttcgtgagtgtttcttcgtttctttaagagctaccagaaagcagcccacccccacccccattaaaaaaaaaaataagcgagtggggaagagccagccccacgccggtccgcctcccgcccacggctcggcctccctcccgcctggctcggcgctcctccgccccgagttctccatcccctggatcccgggctcgcgggggcgcggagaagaggatccaggaaaggtttgggaacctgatgggtttgtggctggggggaggggcagttctcccgccaccccatcccctccccgccaggggcactgatcctccagcttcttgcttgctccctcgctccctttctctacctcggacattcccaggacaattagggctgaagttttcgggagaagcagccccgagcccgtgggataagggggcggcccggctccgcccaggacccctcccggacctcccccccggctgccccggttggctgcagggcgcgtcactccgcggggaggcggcggcagcggtggcgccgcagagccccgggcgggcggagagcggggaccggcctgggctccgagttcagctccggccggggggaggggaggggctgcggctcacactgagcgcagcagcgagcaccggcctagggagacacagcccgggcggacccggcactggactgggccagtccctgggacccctgggcaccccgccctggggagggggccgcgccccagccttccgggacgaggtggcggcgcagagccggaaagcggggtggggggagggcggtggggaggtgttctgtccgaggctgcctggcggcgccgaagctcgcctccactttttgggcacttgccgagcgcggcgcccgaacttttcgctctatcaccatctccctcaagctgagatgcaacctccctaccctcgccccagagcccagagccaggagcccgatccctctgccgggctcaggcgcccgcgaacctgagactcggtacgcggctcagcctagctctttcccctcgcgcctcggggtctcctcgctccaaggttctcgaagtcttgcgcccgaaggactaaactaaactaaacttcggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccgacttcgtgtactccggacctgtactgcgctccggtagaggacccttccctttctcttagcttcttaaatcttttcttttaaggtgtaaatgtgtgtgtgtgccgatgaatgtttctgtttttcatctgctgactttatttttttttattggtataacttctcccttctctctccctgctcgtccgttttccaccttttctcttacttatcttctgccctcgctcactccctaacacacacattcacaccctctccgcctcgctctcccgttctcgccaggtcctgatgggtacagtagattttgataaaaagacaaacgaagctatcagtggggctgatgttgaagaatgaagataataatgtttccataggtggtgcttcaaatgccattatttctcactgaatatttaaagagatccctcggcaaagatggatc

SEQ ID NO: 112029 - DNA, 191 bp, Homo sapiens
  chr16:51189183-51189374
  Hyper
cccagctcaaggccccgctggcccccggccgaggctagaagggcagtagtggaggtttcgttttcttaagcaaggcaaaaagcggcgaaaaggcggcagcggcgccccgggggcgggggacgaggcacatcgatggtatcaacattattgatggggaaaagttcggggcaggagcccggagatcaggttcc

SEQ ID NO: 112030 - DNA, 329 bp, Homo sapiens
  chr16:51189922-51190251
  Hyper
ttttgggggaactcccgccgcccgccaccaagggctatctccagacgggcgccgggtgcagcgccgtgaccgggcgccctggcgccggctcgggcgcgaaattcagcggtggcaagcggagggtgggcttggtaaccacccgcgcgcgcccgagccaagagtcgcgtactgtctgcccgcggcaaagttcgtctttctccgcttggagggctgttcctacaccggtattaagaaaccgacttcgctagcgactgcaagtgcttgcgattttgactttccgtccacagttgagcgtcttgcacttaaattcactgcgccccgcatgcaac

SEQ ID NO: 112031 - DNA, 309 bp, Homo sapiens; identical to SEQ ID NO: 79060
  chr16:52580711-52581020
  Hyper

SEQ ID NO: 112032 - DNA, 174 bp, Homo sapiens
  chr16:52581360-52581534
  Hyper
cggacgccagccctgcgtcccgtgtgtcccaccctcctcctgcgcgaccacagcttccccgggccccagcatccccaagccgtctgctcccttcctgtcgctttcctccccatgacccccttccttcttcatgggtgcctgtccccgggcccctctcctcgaccccgccttgcc

SEQ ID NO: 112033 - DNA, 80 bp, Homo sapiens; identical to SEQ ID NO: 79062
  chr16:53448471-53448551
  Hypo

SEQ ID NO: 112034 - DNA, 200 bp, Homo sapiens; identical to SEQ ID NO: 44704
  chr16:53563454-53563654
  Hypo

SEQ ID NO: 112035 - DNA, 94 bp, Homo sapiens; identical to SEQ ID NO: 79065
  chr16:54317132-54317226
  Hyper

SEQ ID NO: 112036 - DNA, 30 bp, Homo sapiens; identical to SEQ ID NO: 79066
  chr16:54317821-54317851
  Hyper

SEQ ID NO: 112037 - DNA, 245 bp, Homo sapiens
  chr16:54318505-54318750
  Hyper
gcccagcagggagagcgggtgcaggcgggggccgggcggtgggcctggaaacggccggttggtccaagccgggaacttgcccagcggcgctgagaccagtctgtgagcggcggcggcggcggcggccggagagagctgcagggcggaaggcgcgaccgctgcccccggtggagacccccccgcgccgggaggcgagcggcgcgggttgtccgggcttgtggcagtctccgcgagggaccagatct

SEQ ID NO: 112038 - DNA, 98 bp, Homo sapiens; identical to SEQ ID NO: 79069
  chr16:54318955-54319053
  Hyper

SEQ ID NO: 112039 - DNA, 295 bp, Homo sapiens; identical to SEQ ID NO: 79070
  chr16:54319354-54319649
  Hyper

SEQ ID NO: 112040 - DNA, 341 bp, Homo sapiens; identical to SEQ ID NO: 79071
  chr16:54320739-54321080
  Hyper

SEQ ID NO: 112041 - DNA, 548 bp, Homo sapiens
  chr16:54321286-54321834
  Hyper
ccttactaaaaatggcgggctggctccgggggctgaagggtggcagcccgggggcactggaagggtagggagccgccacaaatcggtgaagcaggcccgcgccccaggcggctgggaatgggggaggagcagggcgccgggggacggaggccctaggaacttttggagagctcttcgagaagtttctgtattggcgtttttgtctgtggagaaccttccttgcgcgacccctaccccttctcccggtcccggcgctaacctcttttctctctgcaaggatcctcccaccgcctccggtggggatggaaagcaagagttttggtttaatgatgggatatttcctaaatcaaacttgaaatctcaggatcgggcgcccaccttcacggattagggcgtgcagtcgatagcggcattgaaattcccagcattgccgcggctgggggctcagagctttaggccgcggcggcgacccacaagccggccaggcctgcagtgggcacgccccggagacaaaacgggggtggtgactctgccgtggagtggccagc

SEQ ID NO: 112042 - DNA, 53 bp, Homo sapiens; identical to SEQ ID NO: 79073
  chr16:54322754-54322807
  Hyper

SEQ ID NO: 112043 - DNA, 33 bp, Homo sapiens; identical to SEQ ID NO: 36160
  chr16:54325062-54325095
  Hyper

SEQ ID NO: 112044 - DNA, 342 bp, Homo sapiens; identical to SEQ ID NO: 79076
  chr16:54628674-54629016
  Hyper

SEQ ID NO: 112045 - DNA, 285 bp, Homo sapiens; identical to SEQ ID NO: 79077
  chr16:54962651-54962936
  Hyper

SEQ ID NO: 112046 - DNA, 446 bp, Homo sapiens; identical to SEQ ID NO: 79078
  chr16:54963430-54963876
  Hyper

SEQ ID NO: 112047 - DNA, 44 bp, Homo sapiens; identical to SEQ ID NO: 36164
  chr16:54964141-54964185
  Hyper

SEQ ID NO: 112048 - DNA, 163 bp, Homo sapiens; identical to SEQ ID NO: 79080
  chr16:54964972-54965135
  Hyper

SEQ ID NO: 112049 - DNA, 159 bp, Homo sapiens
  chr16:54966076-54966235
  Hyper
atctgcatggagggccgggccgccgtggccagatctgcgcacggggtacggacgtgcccgggcagatgggggcctacggggtgacaccgaggccgggacagcttcaggggccccagaaggacctgacccagaaattgaggtccccgctgccttctgagg

SEQ ID NO: 112050 - DNA, 81 bp, Homo sapiens
  chr16:54966450-54966531
  Hyper
ggggtaccatccttacgcggcgcccctgggatcgtacccttacggggacccagcgtaccggaagaacgccacaagggacgc

SEQ ID NO: 112051 - DNA, 526 bp, Homo sapiens
  chr16:54966765-54967291
  Hyper
cgagccccagaagcccgaggacaagggcgaccccgagggccccgaagcaggttggtggacatgggaaagggcgtgttgggcgggagtaaaaaggaaaagagaggcctggagggggcgcgcacggggcctggaggttgggggcaggggtccctgcctttgcgggcgggaaccgggtcccgccgcgcggcctctgcgcccctgacagcctgggtttcgcccgcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgc

SEQ ID NO: 112052 - DNA, 53 bp, Homo sapiens
  chr16:54971043-54971096
  Hyper
gaggcagtgcaaaaccggaaacctgctctgtgcggggccgaatcagttcatgg

SEQ ID NO: 112053 - DNA, 272 bp, Homo sapiens
  chr16:54971342-54971614
  Hyper
agctagctgccaactcggacggaagcgcggaacagcgcaatgcaaaccgcccaaagtgaaaggaatgtaattgcgctcccatgacagagccagacgcggatgcagtttaggaagggcgccgcctaccggcccctgggagccatgcgattcgaagggagggggacctagaggagacccccgctatccccccacccaccgtggggccttagctttgaactccggcccggacaaacttaaactgcttcgccaccccaacgcgccacagccctgga

SEQ ID NO: 112054 - DNA, 46 bp, Homo sapiens; identical to SEQ ID NO: 36169
  chr16:54972930-54972976
  Hyper

SEQ ID NO: 112055 - DNA, 402 bp, Homo sapiens; identical to SEQ ID NO: 79085
  chr16:55090666-55091068
  Hyper

SEQ ID NO: 112056 - DNA, 244 bp, Homo sapiens; identical to SEQ ID NO: 79087
  chr16:55203739-55203983
  Hypo

SEQ ID NO: 112057 - DNA, 1681 bp, Homo sapiens
  chr16:55357444-55359125
  Hyper
ctcccccacccctgccgccgcccacccatcagtgcccctttgaagacccctgggatggagtgagggggtggtcagaccgctgggcccagccgggcgtccaggaggagcgcagggaatgggccgccctcccggagcgctccactgcggctctccagcgccacccccagcggagcgcaggggctgcagcccggaccgggagccttcttcaggctccctggctgccccgcggccactgcgggaggcgcgcgcgcgaggcagccaagccttgccttcggaggagatgcccagggatcttagcaagcagcctgcggctgccagggatcggacctggcgagtttcccgacggaatctgagggatcccgaacctcggcctcgagggggcgctatccggcctactcgaggaccaggcagctgcagagaagctccaaggtcaaggccctgggccaggccagggcttggagagccggaatctagcccgagtcctggggaggctgaggcggggaaccagatccccgaggacaaagatgggcgggccagtgggatccaccgacgctgcccggagctgctccaacgagagccgggcctgtggcgtgaacaaactttacttcagcgcaggggcggaggaaccgggctggaggcttctcccccgggcctctgctctcctccacctgccagtgctcagcctccgcccagccttcgcccaccccagctccctccccctcccccacgcgcctctgttcactcagactcctgtctcccctctcccctcctccttctccctcttgcctttctcccccacttttctcctgtctcttcttttgtattctctcctccctcgccgccccggttgcctctcgcctcctccgggccgcaggggaggaggtgagcgcgctgcgcccggggcctgcgcggctcagagggaggcgtttctcctacttctcccgggtaatttggagaggttgtgtgtgtgtgcgcgcgcgcgtgagctccaggcgaaaaggggtaggattcagcgccgagcagagagggtcagggtttttgacgttcctcgccagctgcacaaacctcccggagcaagtgtgagtgtgggtgagagtgcgcgcgcgcgcacgggctggctgcgcttggcacgcttggtggcccagggtcccggggcccggggtcccgtctggcggcccgggattaccgtgacgtcacattgagcctctggccaccttggactgggacacctccggagcctcacagccccgcgccgcgccgcgcctcacctcgccaccacgcgcctttgggaacccgcatcttcttccttcccctgcccatccatgggcccttctgtcttccggaccccacgggccggaggggcgccttccggagcgcagggctcggcagccgggctgccctcggctctgcctccactggggccaaccaggcgaaggaaccggcgctgggcatccgcagcggtgtaaggaactgagacacctcactgctgggggcgcggaacagctgggctgagacgggaactcgacagggaagagagagacgggccagggacagccaccatgtccttcccacactttggacacccgtaccgcggcgcttcccaggtaagaggcgcctctatgggggataggggacagactgggtggagggagtgcctagtgcacggcgcctgcctctgatc

SEQ ID NO: 112058 - DNA, 336 bp, Homo sapiens
  chr16:55362920-55363256
  Hyper
catgcttggagaaaccgcgcatctggtctctggcgcacaccgcgacagccagcgctgttgaaggtgcacccccagcccggcctaggccacgaagtcctgagtgccgtatgattcctggacagcctcctgcctctgcccggcgactctcagtccccagagactccgcgtgcgacgagtcttcctgcatacccaaagcctttggaaaccccaagtttgccctgcagggactaccgctgaactgtgcgccgtgcccgcggaggagcgagcctgtagtgcagtgccagtacccgtctggagcagaaggtagtgggcccccagcggcgctgggagtatcta

SEQ ID NO: 112059 - DNA, 776 bp, Homo sapiens
  chr16:55364692-55365468
  Hyper
aggtgcttgagaggtcggtgtgcaggcaaagatgcattgcggccagggattcttgcgacagcgcggcgtgggctgcatacctcagttcctttagtagctgggaaagaaactgacaaggtaacagacaaggccgtggcgcctgcagctcagcggactaaccgctgcgtaaccaatccgtggagccaagctgaccacctcgcgggtcctgcgcatgggaagtggtgggacttgtcaggatgtttatctggaaactgcatctgtttccgggttcgtatttgggttgtaagtttactgggggaggggtgacgaggaccgcgctcctccgatcgaactgaacctaatggggaggtcaggcagctttcagggtcggtgtgaggcgagagggggcattcttcccgttttatcaaaagtgtcagcaaacacttccggtacaggccaaccaatgggaactgacgggcagggaaggggtctttgtcccccttgctaggagtgtcgagcgaccgggttgggggtaagagatttaaagacgcccgcgcaatggtgggtgggggaggctgcctgcgttcgtgtcccgcgtctagtggctttggctttagccagggagtgagcgcaccgctgctcgcagggaagcagggacccggggcagtgccctagaggggagctccgaagagcaaatgaggcgggaaggcaggacgaaaggcagctggggtgtgcgcccaaggcctggattcctggggagctgcgtttccaacgccgggtcccggccaggccaggcc

SEQ ID NO: 112060 - DNA, 329 bp, Homo sapiens
  chr16:55404915-55405244
  Hyper
cttttgcatcttatacggatagccggctcatggcaatgtgactcaagctggcaggggtctttgagcatcaaacgtgtcctccttccctctacctacttcggctccggtttctctcccgaagcctaaataaagaaggtaacagacaacacctctattggcagaggcttctgccttttccgtcaggctggctgcagcacatccgtaatccttatgtcagcctgcactctagcgttgccggcccggtccagcatctgacagccgcgaatccaaagctgccggcctctcgtttctaagcagcagctcacagcgccagccgccctcccgcagaa

SEQ ID NO: 112061 - DNA, 895 bp, Homo sapiens
  chr16:55512644-55513539
  Hyper
cctatccctaaatatcgaaaatttctgtctctgaccatctatcattgtggctgatcatctgtttctgaccattccttcccgttcctgaccccagggagtgcagggtgtcctagccaagccggcgtccctcctagtagtaccgctgctctctaacctcaggacgtcaagggcctagagcgacagatgtttcccagcagggggttctgaggctgtgcgcccagatcgcgagagaggcaagtggggtgacgaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttgg

SEQ ID NO: 112062 - DNA, 437 bp, Homo sapiens; identical to SEQ ID NO: 79102
  chr16:55514076-55514513
  Hyper

SEQ ID NO: 112063 - DNA, 76 bp, Homo sapiens; identical to SEQ ID NO: 79104
  chr16:55689542-55689618
  Hyper

SEQ ID NO: 112064 - DNA, 933 bp, Homo sapiens
  chr16:55689876-55690809
  Hyper
taccagcccggcccccgccaggcacggccagaaccagtcagcccgcgccctgccggccgccccgcgcctccagctcttccccggccccgcccgaacgccacacggcggagcccagccccagcccgcgccctagagcctgccaaggcgccgccggtcgggggccggcagggcgcaaggcaccagggatcccctcgccgccggacacgtgagtgcgccctgagcgcgggacagggctaggtctgcctgggaggcccgggccgagacgcgccagcagagggctagcgagtttgtagtgcagtgacgttaagtgtccgagaaggctcctgtggctgttgaagtgtcgcggacctgagctggggagggggtcggcacgctgccctcagcctcggtgagttcaatcccagccatttggggcaggcgagagtgggtgaacgaggaaaagtgctgcagggtcttcagccgcccccagagggctgtcagaagtctccaactcttgagttccggcgtgccccaacctctgtttccaaatttttccagcggacgcgcgcccttttctgggaaccctgcgtccgctcagcgcgcgctcatcccagtgtctaaggcgctcccgggtggtcttgggagttgcaagtagggaggaacggccgggtaaccacctcttttccctttatccaagcagagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtc

SEQ ID NO: 112065 - DNA, 1299 bp, Homo sapiens
  chr16:56224364-56225663
  Hyper
aaaattcattttgtgcgtttcgaagggggaggacaggagaatttagtgcaaagacggcctccaccaaacgaaaccgtccaacatttgcaaaagcttttaaaataaactgctcagggatcaggggtttgctggaaactcccggtcgcttgaagccctgtccctccactccgggcaccctggcctccccagggtgggcacccctcctgcacggagagcggcggctgggatctcggagcagggtcggctatggccctggaggcagcggctcacagagaaaaagctctggcttttctccgcccgctgcgttcctcttcttacagcctcgggtgtcacatattaggtgctcaataaatgtggacataggaaacgaaaagtccgaatctgtccttacgcccccaaggcgaattctggggcgcgcgggtttattccgacccactaccacatcgcgtttcctgaggtaacccggcctcggctctgcggccccagcggctggagagccacggagaaggcgggctacgggcgacaagatggagagccggcccgagagggacagaggccgcgctggcagcgagctggggggcccacctgaccgtcctgcgggcagcccggccccgcgctcccattgacaaggaggtccgcgccgccggcgcgtggggcgggggcggaggcggggtggggcgccccggcgcgcgcccggccccactccccgcccccgccagtcccgcaagcacccaccccgggggagccgcgggccgggagggcgctggggggaggggcaggccgctccgcgagcgcgtgtgcgcgccgccgccggctgacgcgaactccggcgcgcgcctcccccgccccgcgccctccccgtcccgggggcccggcgcgcggccctgctgacgtcagctggcggcccgcggagccgggtgcgcagagccgctggcgcactcgcgcgctgcgctggcctcctccccgccccgggcccaggcgcgcgcgcgcttgttcgctctcccattttttttttcccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgc

SEQ ID NO: 112066 - DNA, 158 bp, Homo sapiens; identical to SEQ ID NO: 79113
  chr16:56225723-56225881
  Hyper

SEQ ID NO: 112067 - DNA, 215 bp, Homo sapiens; identical to SEQ ID NO: 79114
  chr16:56226149-56226364
  Hyper

SEQ ID NO: 112068 - DNA, 222 bp, Homo sapiens
  chr16:56228369-56228591
  Hyper
ggatgaggtttcaggcgttgcaagtggtggacagcgcccagccgaggccggaaaagtcgatggggctcagttcggcgacgctcggctaggttcggtgcggtctgggcgcggggctcggagggagtcggcggtgttcggagccgagtcggtgctccggcggagagagccgagccgcttcggagggggtcgaaagcattcggaaatactcgggggaggggagtg

SEQ ID NO: 112069 - DNA, 43 bp, Homo sapiens; identical to SEQ ID NO: 79117
  chr16:56460223-56460266
  Hypo

SEQ ID NO: 112070 - DNA, 816 bp, Homo sapiens; identical to SEQ ID NO: 79118
  chr16:56623053-56623869
  Hyper

SEQ ID NO: 112071 - DNA, 366 bp, Homo sapiens
  chr16:56650999-56651365
  Hyper
aggcctacccagggacgaagctggggttgcacaccggctccgggaatggcgaaataccgcagatggggtggtgggggtgggaatatcgcgaccaccagaggctgggttcccggaacgctcggggacggagatggccagcaaccacaaggaaatggggaatatggggaagttgcgcgggcaggacggcacggacgccgcggacgaccgggcgcacaggcctgagcgagcgagcgagtgagcgggtgccaagcaagagacccgcggtgcacaccttgcgcccggccggcctgctgctcacagtccctccacgtacccacaggaggcccagactcagcggggcgggtgcaagcgcggggcggggcctct

SEQ ID NO: 112072 - DNA, 715 bp, Homo sapiens; identical to SEQ ID NO: 79121
  chr16:56659106-56659821
  Hyper

SEQ ID NO: 112073 - DNA, 649 bp, Homo sapiens; identical to SEQ ID NO: 79122
  chr16:56665943-56666592
  Hyper

SEQ ID NO: 112074 - DNA, 571 bp, Homo sapiens
  chr16:56672114-56672685
  Hyper
cgctctgcactacgccgatccggggacaggagcaggaggctgtggctgcactcagacttcgggacaggccgagctgaaaaccgtgagaggggtggggtggaggcgaccgaaacgccaaggctgggttcccggaacgcgcggggactagggtggaaggcaacttcggggaaactgggaaaggcgaccgggacctcggggacgccccgtaccccgggcgtaaactcactcccgcgttagcggccccaaagcggggagggggtggtcccgtggtccgcacccaggggagctcagtggactgtgcgccttgcctttctgctgcgcaaagcccagtccaggtcatcacctcgggcggggcggactcggctgggcggactcagcggggcgggcgcaggcgcagggcgggtcctttgcgtccggccctctttcccctgaccataaaagcagccgctggctgctgggccctaccaagccttccacgtgcgccttatagcctctcaacttcttgcttgggatctccaacctcaccgcggctcgaaatggaccccaactgctcctgcgccactggtaaggg

SEQ ID NO: 112075 - DNA, 451 bp, Homo sapiens; identical to SEQ ID NO: 79126
  chr16:56677117-56677568
  Hyper

SEQ ID NO: 112076 - DNA, 74 bp, Homo sapiens; identical to SEQ ID NO: 79127
  chr16:56692017-56692091
  Hyper

SEQ ID NO: 112077 - DNA, 265 bp, Homo sapiens; identical to SEQ ID NO: 79128
  chr16:56701956-56702221
  Hyper

SEQ ID NO: 112078 - DNA, 30 bp, Homo sapiens
  chr16:56703372-56703402
  Hyper
ggggtgggcaggccccggggtgtggggcgc

SEQ ID NO: 112079 - DNA, 235 bp, Homo sapiens
  chr16:56709814-56710049
  Hyper
cagcatagcccctcccgcacgagcgggccccaaaagggcggtccccgggagcccaccaggctgcactcaggggatggtgcgcctgacccgcctgctgcgcacagctcaacccaagaccgcaggcgccgcggattccgcgtgggggtgggtgagaagggtactctgcacccggccccctcttctaactataaattgagcttccggttcctagaatccaccacgcctcccacctgcc

SEQ ID NO: 112080 - DNA, 27 bp, Homo sapiens
  chr16:56774935-56774962
  Hypo
ggagagggagagcgctaaatttctttt

SEQ ID NO: 112081 - DNA, 30 bp, Homo sapiens; identical to SEQ ID NO: 79133
  chr16:57017302-57017332
  Hypo

SEQ ID NO: 112082 - DNA, 216 bp, Homo sapiens; identical to SEQ ID NO: 79135
  chr16:57222193-57222409
  Hypo

SEQ ID NO: 112083 - DNA, 35 bp, Homo sapiens; identical to SEQ ID NO: 79136
  chr16:57222709-57222744
  Hypo

SEQ ID NO: 112084 - DNA, 35 bp, Homo sapiens; identical to SEQ ID NO: 79137
  chr16:57299645-57299680
  Hypo

SEQ ID NO: 112085 - DNA, 82 bp, Homo sapiens; identical to SEQ ID NO: 79138
  chr16:57321270-57321352
  Hypo

SEQ ID NO: 112086 - DNA, 23 bp, Homo sapiens
  chr16:57457827-57457850
  Hypo
tacaaatccactggtcgggcgtg

SEQ ID NO: 112087 - DNA, 30 bp, Homo sapiens; identical to SEQ ID NO: 79140
  chr16:57656267-57656297
  Hypo

SEQ ID NO: 112088 - DNA, 30 bp, Homo sapiens; identical to SEQ ID NO: 16055
  chr16:57759922-57759952
  Hypo

SEQ ID NO: 112089 - DNA, 30 bp, Homo sapiens; identical to SEQ ID NO: 79143
  chr16:57935550-57935580
  Hypo

SEQ ID NO: 112090 - DNA, 199 bp, Homo sapiens; identical to SEQ ID NO: 79144
  chr16:57937598-57937797
  Hypo

SEQ ID NO: 112091 - DNA, 933 bp, Homo sapiens; identical to SEQ ID NO: 79145
  chr16:58018551-58019484
  Hyper

SEQ ID NO: 112092 - DNA, 103 bp, Homo sapiens; identical to SEQ ID NO: 79146
  chr16:58061004-58061107
  Hyper

SEQ ID NO: 112093 - DNA, 122 bp, Homo sapiens; identical to SEQ ID NO: 44712
  chr16:58120963-58121085
  Hypo

SEQ ID NO: 112094 - DNA, 50 bp, Homo sapiens; identical to SEQ ID NO: 79148
  chr16:58192290-58192340
  Hypo

SEQ ID NO: 112095 - DNA, 214 bp, Homo sapiens; identical to SEQ ID NO: 79149
  chr16:58427268-58427482
  Hypo

SEQ ID NO: 112096 - DNA, 23 bp, Homo sapiens
  chr16:58462000-58462023
  Hypo
taatacatcgtggacatccttcc

SEQ ID NO: 112097 - DNA, 1510 bp, Homo sapiens
  chr16:58497214-58498724
  Hyper
tctaaacaaagactacggcagcgccgtcccctcccccgggaacccgacgccgcgcggccacagggggcctggaggggcgggcagggcctcgcagcgcacccagcacagtccgcgcggcggagcgggtgagaagtcggcgggggcgcggatcgaccggggtgtcccccaggctccgcgtcgcggtccccgctcgccctcccgcccgcccaccgggcaccccagccgcgcagaaggcggaagccacgcgcgagggaccgcggtccgtccgggactagccccaggcccggcaccgccccgcgggccgagcgcccacacccgccaaacccacgcgggcacgcccccgcggcgcaccgcccccagcccggcctccgcccctgcagccgcgggcacgcggaggggctcctggctgcccgcacctgcacccgcgcgtcggcggcgccgaagccccgctccccgcctgcgcgtctgtctcgtccgcatctccgcggtgagtcggcggcgccctcgcccctgagcccagggccagcttctctcgccgccgcggctgctgcgcgcgtccccgcccagcccagcccagccccgagcacgaccccagccccacgcacgaccctagccccgcgagtcccgcaccgactcgctcccgccccatttcgcctccgcgggggcggcgccccctcctccccgcggctcccgctctccttcctcgccttcccggccgcgctggggacccccagccgccgtccgcgaccccccaccgcgacgcccggaggcggcggggtctctttgttcgggcggcgggcacgggggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgttgggggcgggagagcgctcctggctgtgagctgctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggtaccgcccgcctgccccgcagccggccgccactttccgagttggagcggactccgggcgcggcggccggggactggggcggctcgggtctgagcaggaaggggtgcggaccccaactaagtcctagttttgtgctacctgtttgtgtgcggagcccagccccgggagaggacttgaggttgtggcgagtccctggcgctggcgtccgggctgcgggagcaccggtcagggggtggccccatggggtctctgaccagcggagctcggattaggaccctgaaagctagctcagggctcctgccctccaatcagtgtcgcttgtcccctaagaaaggacccgtgggcttctggca

SEQ ID NO: 112098 - DNA, 119 bp, Homo sapiens; identical to SEQ ID NO: 79154
  chr16:58499185-58499304
  Hyper

SEQ ID NO: 112099 - DNA, 29 bp, Homo sapiens
  chr16:58521708-58521737
  Hyper
ccctgaggagaagccgctgctccggggcc

SEQ ID NO: 112100 - DNA, 44 bp, Homo sapiens; identical to SEQ ID NO: 79155
  chr16:58540563-58540607
  Hypo

SEQ ID NO: 112101 - DNA, 97 bp, Homo sapiens; identical to SEQ ID NO: 79156
  chr16:58548289-58548386
  Hypo

SEQ ID NO: 112102 - DNA, 87 bp, Homo sapiens; identical to SEQ ID NO: 79157
  chr16:58549151-58549238
  Hyper

SEQ ID NO: 112103 - DNA, 50 bp, Homo sapiens; identical to SEQ ID NO: 79158
  chr16:58550442-58550492
  Hypo

SEQ ID NO: 112104 - DNA, 145 bp, Homo sapiens; identical to SEQ ID NO: 79159
  chr16:58831937-58832082
  Hypo

SEQ ID NO: 112105 - DNA, 35 bp, Homo sapiens; identical to SEQ ID NO: 79160
  chr16:58850468-58850503
  Hypo

SEQ ID NO: 112106 - DNA, 20 bp, Homo sapiens
  chr16:58886050-58886070
  Hypo
aatgctggtcaggcacggtg

SEQ ID NO: 112107 - DNA, 33 bp, Homo sapiens; identical to SEQ ID NO: 79162
  chr16:58886324-58886357
  Hypo

SEQ ID NO: 112108 - DNA, 27 bp, Homo sapiens
  chr16:58932088-58932115
  Hypo
tttgcctaggctgagcgcagtggtgtg

SEQ ID NO: 112109 - DNA, 61 bp, Homo sapiens; identical to SEQ ID NO: 79164
  chr16:58969757-58969818
  Hypo

SEQ ID NO: 112110 - DNA, 38 bp, Homo sapiens; identical to SEQ ID NO: 16056
  chr16:59046529-59046567
  Hypo

SEQ ID NO: 112111 - DNA, 30 bp, Homo sapiens; identical to SEQ ID NO: 79166
  chr16:59182473-59182503
  Hypo

SEQ ID NO: 112112 - DNA, 28 bp, Homo sapiens
  chr16:60166000-60166028
  Hypo
gcgtgagccaccgcgtcaggccgaaagc

SEQ ID NO: 112113 - DNA, 30 bp, Homo sapiens; identical to SEQ ID NO: 79184
  chr16:61479596-61479626
  Hypo

SEQ ID NO: 112114 - DNA, 85 bp, Homo sapiens; identical to SEQ ID NO: 36213
  chr16:62068463-62068548
  Hyper

SEQ ID NO: 112115 - DNA, 426 bp, Homo sapiens
  chr16:62069009-62069435
  Hyper
agcacgtttttttaccgtttcccagccttggctggatcctgggagaaccggagtaggtcccttatgaacctcttacgtactggcagaacctaggcaagagcctttttccctccgatcctgcgaggggcgcgaccagcccctcaaaggttcccggatgagaagcggccagaccacagaaagcgcaggtctgggctcagctgtccctaggagagcggctacggagtccccggcttaagggggcctccgtgcacgcaatctcgagttgcggggagacactgcctgggggtcctgcaggggtgctgggcagcgtcttggcgagggcagagccgcagggcgactccggagcccggcaagtttgtagcgggcaccgcacctcccagagctggagctgccacttgtgggaaagcctcgcgctggggctttcgc

SEQ ID NO: 112116 - DNA, 30 bp, Homo sapiens
  chr16:62070111-62070141
  Hyper
tccgttcatgcctctcggagctacagggct

SEQ ID NO: 112117 - DNA, 43 bp, Homo sapiens; identical to SEQ ID NO: 36217
  chr16:62070743-62070786
  Hyper

SEQ ID NO: 112118 - DNA, 28 bp, Homo sapiens
  chr16:62670669-62670697
  Hypo
ccagtggcgctatcccggctcactgcaa

SEQ ID NO: 112119 - DNA, 30 bp, Homo sapiens; identical to SEQ ID NO: 79196
  chr16:64407177-64407207
  Hypo

SEQ ID NO: 112120 - DNA, 767 bp, Homo sapiens; identical to SEQ ID NO: 79197
  chr16:65154509-65155276
  Hyper

SEQ ID NO: 112121 - DNA, 1640 bp, Homo sapiens
  chr16:65155677-65157317
  Hyper
ctcaccaccccgccccgccaagacattctcttcctgagaaaatcctgccccccattccaagaagccccaaccaggcgagaggaagggactggcggcgcacctcacctggggcccttgagggtggacgcaacctccgagccgccagtccctggcgcagggcaagcgctgcggtgtcagtcccggccccagtcccggtcccattcacaagtcagcggcggctgcgagcggcccccgcggcatctgctcctcggcccgcgacgctcccctcagctggcggcggccgcggaatgagccgccgagcgcgctagtggcaggaatgagaaaccggggggaggtggcgggcgggcaggcgggtgcggggcggggggggcgggaggagggaggctgccgctgtgagggaaggaaagggcgggggctgagagaagccgaggctgcgagaggcagcgagatgggcctcgcagaggctgcgggggccgaccccgtccgcgcccctccccccaggggcccagagatgctaacccctggattcgtggccgcccctcccgccccgtggcgcggcgctccgactccctcagggctcagatggagtctggagcgactgaagttgggctccagggacgcacagccaatcagggagggcggcggagggaagctggagaggggttgggagcccccattttcctccttcccccaaatccgctccagctggccaggctgggctctcgcctggcgggccgggatggtggttgggggaaggtatcgtccaagtgagggaagcaattgggaattcgggagcgcgttctattctttctcactccaccaccccaccttccaaaaatccctcaacgttggcggctcctgcccagcccccacccctctcaatctcccatcccttgcaaactcttctggtggctctggtggtgaagtcgggcggggagggagacttaggacttgggaagagcccagtctccgttctctctcagctctcctctcgtctagtgccccccacgcaacgcctcggagaggggtgcgcggggagcgcttcgccggggtcggcctcgctccagcttttgggagggtgccttggcccctaccccagccaggtatcagtggcccccgccggtagtgtcacttgttgccactccctcgctacagacccgccagggcccggtggagtgtgcgtttctacgggagaaagggcctaatggggcgcagcgccggagtcctagctccttcctccgctgttcccctcactgacgactcgctaccgtgagggttccccgggcctgcttcctgccctccctccccgagtcgccgggagaaagggctggcagggccggggcttaggaatcacgccaaggactgggcggggcgctcgcggtaccgggaacggcgtggggatccgcacacccagcagggaacaaccatgcctgtgtggggacccctggcttgaacaagtttgcagggtgggaggtggaggcaagagaggaggcggaggaaggtggagacgccagtgggtgaaggctaaaaaggaaccgcctagggggacggggatgaggctgggaaaggagaagagatggacccgcgaaaaagacggggaaggaggctgcggagggaaagctgggcgccacagccaagca

SEQ ID NO: 112122 - DNA, 544 bp, Homo sapiens
  chr16:65157522-65158066
  Hyper
gcttggggagacgcccgcgggggcgggtgccggcgaggctgccccgggacctaccctcttcggcctgcgcgcccgcgtttttcttgacgactccaggatccgggtggcgctgcgtgcctgcccccagtccgcgtcctgcgcggagaggatgcctctgtcaccctctgtgtggacgtggcctttgaactcctcattcctccactgcgggggaagagctgtaagtttccagctgcccggttatcttactcctcagccttccccccaccataggtgtccaaggtgatagccccctgggtctccagtaaccccccaacctcgcaccacactctgcgcaagggacgcgcgaggacattgactcccggtgctttcctgtagagcgccagagagcagatcgtggtgcctgccactcctgcctccccctgtgggtccctggccctgaaccttttcagagctctaccctgcttcctctgtctgcctttttggcctctgctgtaacccctaaaactttgggtacttcccaagccaccgccgaaagtccccactc

SEQ ID NO: 112123 - DNA, 581 bp, Homo sapiens
  chr16:66461408-66461989
  Hyper
ggtggtaccggcgaacgacacacccgggggcgcgccgcgcggagcctcggtgcgcggggcgggcggatgcgcggtccggaacggaaccgcagcgcgctcggaacggagcgggatcccgggtctcccgcggaccctcgaccccgggctggccactgggatctgcgcgagccgaggctgaccctgatcgcgccctcgggcctcggggaaggggaggtatccaggttttctgcctgactcgagtccccgacgagcatcaaccgcatttggggaacccaagacagcctccccagcagcttgccctcggtttcggggacccctgaacaacccaaccaagaagggaaaactagggcgcactctcggtcggggtgggagaggaaaggggctggggcttcacggagtttggagtttgaacccacccgcacccctttgagctaggaagtttgacccttcgacgagcaggtcgcctggggtatgcccctgtctccgtgcctctgtctcagcaccgagcgtcggagagagagcgcgccctccgcaccttctcccactttgggacagactttcccttgcgctgtcagagggac

SEQ ID NO: 112124 - DNA, 30 bp, Homo sapiens; identical to SEQ ID NO: 79204
  chr16:66512694-66512724
  Hyper

SEQ ID NO: 112125 - DNA, 530 bp, Homo sapiens
  chr16:66612734-66613264
  Hyper
ccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaacacctgcttcctctcgttgccttgtgtgaaagtcgcgttgtattttcctgcgcttggcgctgcgcccgcggagctcagggccgtgacccggtgctcgcagccccccgaccccgcagcggagcggcggcttacagacctggggccacctggagacgccgggatgggaccgcgagggcagctccgcgcggaggtgggaccggcgggttgggaacggagttggggcccg

SEQ ID NO: 112126 - DNA, 377 bp, Homo sapiens
  chr16:66638075-66638452
  Hyper
gcgcttgcaggtctgagagtcctctgagaatgggttgggggaggcgggtgcaggaccgaggcctggaacagccaacaaagaggccctggaggagggtggggctggccggggacaggaggggtggccaagaaagtcgcaagaaaactccggcccccaagaaaaagagagggcatgggttgcggagccgacatcacggccggggtctttgctgtttagacgcctgggttcccggatcccagacacgcgcacgggcaggaagttagaccggagacagcgagtatagacagcccttctggataggggcagacgggtgggagctccgaaggggtgccggggcggtgatcgggaggtctccagcggcccgaaccagggtgaag

SEQ ID NO: 112127 - DNA, 810 bp, Homo sapiens; identical to SEQ ID NO: 79209
  chr16:66878235-66879045
  Hyper

SEQ ID NO: 112128 - DNA, 273 bp, Homo sapiens; identical to SEQ ID NO: 79210
  chr16:66958730-66959003
  Hyper

SEQ ID NO: 112129 - DNA, 167 bp, Homo sapiens; identical to SEQ ID NO: 79211
  chr16:66959249-66959416
  Hyper

SEQ ID NO: 112130 - DNA, 226 bp, Homo sapiens; identical to SEQ ID NO: 79212
  chr16:66987397-66987623
  Hypo

SEQ ID NO: 112131 - DNA, 30 bp, Homo sapiens; identical to SEQ ID NO: 79213
  chr16:67049292-67049322
  Hypo

SEQ ID NO: 112132 - DNA, 269 bp, Homo sapiens; identical to SEQ ID NO: 79215
  chr16:67184148-67184417
  Hyper

SEQ ID NO: 112133 - DNA, 91 bp, Homo sapiens; identical to SEQ ID NO: 79216
  chr16:67189168-67189259
  Hyper

SEQ ID NO: 112134 - DNA, 689 bp, Homo sapiens; identical to SEQ ID NO: 79217
  chr16:67197593-67198282
  Hyper

SEQ ID NO: 112135 - DNA, 980 bp, Homo sapiens; identical to SEQ ID NO: 79218
  chr16:67198552-67199532
  Hyper

SEQ ID NO: 112136 - DNA, 30 bp, Homo sapiens; identical to SEQ ID NO: 79219
  chr16:67241204-67241234
  Hypo

SEQ ID NO: 112137 - DNA, 277 bp, Homo sapiens; identical to SEQ ID NO: 79220
  chr16:67241603-67241880
  Hypo

SEQ ID NO: 112138 - DNA, 30 bp, Homo sapiens; identical to SEQ ID NO: 79221
  chr16:67242338-67242368
  Hypo

SEQ ID NO: 112139 - DNA, 101 bp, Homo sapiens; identical to SEQ ID NO: 79222
  chr16:67244020-67244121
  Hypo

SEQ ID NO: 112140 - DNA, 48 bp, Homo sapiens; identical to SEQ ID NO: 79223
  chr16:67289799-67289847
  Hypo

SEQ ID NO: 112141 - DNA, 102 bp, Homo sapiens; identical to SEQ ID NO: 79224
  chr16:67299098-67299200
  Hypo

SEQ ID NO: 112142 - DNA, 106 bp, Homo sapiens; identical to SEQ ID NO: 79225
  chr16:67313852-67313958
  Hypo

SEQ ID NO: 112143 - DNA, 83 bp, Homo sapiens; identical to SEQ ID NO: 79226
  chr16:67320453-67320536
  Hypo

SEQ ID NO: 112144 - DNA, 348 bp, Homo sapiens; identical to SEQ ID NO: 79227
  chr16:67360535-67360883
  Hyper

SEQ ID NO: 112145 - DNA, 162 bp, Homo sapiens; identical to SEQ ID NO: 79228
  chr16:67427310-67427472
  Hyper

SEQ ID NO: 112146 - DNA, 30 bp, Homo sapiens; identical to SEQ ID NO: 79229
  chr16:67427854-67427884
  Hyper

SEQ ID NO: 112147 - DNA, 137 bp, Homo sapiens; identical to SEQ ID NO: 79230
  chr16:67433335-67433472
  Hyper

SEQ ID NO: 112148 - DNA, 30 bp, Homo sapiens; identical to SEQ ID NO: 79231
  chr16:67478638-67478668
  Hypo

SEQ ID NO: 112149 - DNA, 30 bp, Homo sapiens; identical to SEQ ID NO: 79232
  chr16:67496823-67496853
  Hypo

SEQ ID NO: 112150 - DNA, 38 bp, Homo sapiens; identical to SEQ ID NO: 79233
  chr16:67571498-67571536
  Hyper

SEQ ID NO: 112151 - DNA, 74 bp, Homo sapiens; identical to SEQ ID NO: 79234
  chr16:67572364-67572438
  Hyper

SEQ ID NO: 112152 - DNA, 81 bp, Homo sapiens; identical to SEQ ID NO: 79235
  chr16:67578633-67578714
  Hypo

SEQ ID NO: 112153 - DNA, 77 bp, Homo sapiens; identical to SEQ ID NO: 79236
  chr16:67678709-67678786
  Hyper

SEQ ID NO: 112154 - DNA, 117 bp, Homo sapiens; identical to SEQ ID NO: 79237
  chr16:67679041-67679158
  Hyper

SEQ ID NO: 112155 - DNA, 41 bp, Homo sapiens; identical to SEQ ID NO: 79238
  chr16:67683741-67683782
  Hypo

SEQ ID NO: 112156 - DNA, 259 bp, Homo sapiens; identical to SEQ ID NO: 79239
  chr16:67700832-67701091
  Hyper

SEQ ID NO: 112157 - DNA, 18 bp, Homo sapiens
  chr16:67730391-67730409
  Hypo
tttttgagacagtctcgc

SEQ ID NO: 112158 - DNA, 100 bp, Homo sapiens; identical to SEQ ID NO: 79243
  chr16:67854142-67854242
  Hypo

SEQ ID NO: 112159 - DNA, 129 bp, Homo sapiens; identical to SEQ ID NO: 79244
  chr16:67877005-67877134
  Hyper

SEQ ID NO: 112160 - DNA, 270 bp, Homo sapiens; identical to SEQ ID NO: 79245
  chr16:67982004-67982274
  Hypo

SEQ ID NO: 112161 - DNA, 157 bp, Homo sapiens; identical to SEQ ID NO: 79246
  chr16:68002842-68002999
  Hyper

SEQ ID NO: 112162 - DNA, 30 bp, Homo sapiens; identical to SEQ ID NO: 79247
  chr16:68012551-68012581
  Hypo

SEQ ID NO: 112163 - DNA, 691 bp, Homo sapiens
  chr16:68118224-68118915
  Hyper
tccctgtccaccttgcgcctcagcggagccttaggtaaacaagccaggctcccagtccccaaggacggccttcaccccagaccccaggaggaggcgtcttgggccatctcgggaaggctagcttgctcgggaggggcagatcacgaaaacggttctttaggcagtgtcacttcctctccactgccagccacccaatttaggcggctccatccctcccgctttcatggatatgcagcaggatgcagagagcacagagctgtgattggcacgagctcacaacgggctttcccgctcaatctactcaacttccagcaagggacaggccctgcccattggggttcgctgaggcctcaaacgcgcatgctgtcaagggagcagctgcgggggcccgctagtggggacaaaggcgcagccaccggggcgaaagctccgccccgcagagggtgggcctgcggcgaccgcgagctcagagtccggacttgtcgcgcaatctgtctccttcggttccaccccaacctagctggactctcggtccggtccctgccctctggagactcagccattaaagttgaggtggggggatgaggatgtgggcggcgtccaggtaactctgaggggccctgatgccttccctagagccagccatcaggagtaacacgatgcgcccccacatcaccgaacccagaacctc

SEQ ID NO: 112164 - DNA, 30 bp, Homo sapiens; identical to SEQ ID NO: 79252
  chr16:68270127-68270157
  Hyper

SEQ ID NO: 112165 - DNA, 84 bp, Homo sapiens; identical to SEQ ID NO: 79253
  chr16:68273891-68273975
  Hyper

SEQ ID NO: 112166 - DNA, 30 bp, Homo sapiens; identical to SEQ ID NO: 79254
  chr16:68362039-68362069
  Hypo

SEQ ID NO: 112167 - DNA, 183 bp, Homo sapiens; identical to SEQ ID NO: 79255
  chr16:68385408-68385591
  Hypo

SEQ ID NO: 112168 - DNA, 35 bp, Homo sapiens; identical to SEQ ID NO: 79256
  chr16:68386152-68386187
  Hypo

SEQ ID NO: 112169 - DNA, 41 bp, Homo sapiens; identical to SEQ ID NO: 79258
  chr16:68480923-68480964
  Hyper

SEQ ID NO: 112170 - DNA, 265 bp, Homo sapiens; identical to SEQ ID NO: 79259
  chr16:68504027-68504292
  Hyper

SEQ ID NO: 112171 - DNA, 236 bp, Homo sapiens; identical to SEQ ID NO: 79260
  chr16:68544142-68544378
  Hyper

SEQ ID NO: 112172 - DNA, 60 bp, Homo sapiens; identical to SEQ ID NO: 79261
  chr16:68572648-68572708
  Hypo

SEQ ID NO: 112173 - DNA, 679 bp, Homo sapiens
  chr16:68676360-68677039
  Hyper
aagtggttggcacatcgccggctgtcagcaaatgtttttgaaatgaatgaatgagtgaatgaccgacaaggggagctaaggggaaggcagcggtgcggtccgcgtcgcaggcagaagagctgactctccaatctccgctcctctctccgcccccgtccggaatgctgagtgcccgagaaggaggcggaaatgagcgcgctcaacagcccaccagccgggtgtttacttaattagggcctgcatcccgaggctcgtttgtgtttaaccgtccgcctaatggcttcgtctggctccgggcgggcgcgggggaacctgcgaggcgagcgtaggcctggccaccctgtcccgccgggggcccactccattgcgccgcgcgggtgcgcgtagacctgacctcccctcgggcataaaaagcgccctgcgggagatccaggccgggagggcgcggagctcagcgagcagccccaggctttcccaaccgcgtggtccacccccagcctcagtcccagccccagctgctgggctcacccgccggctaagggaatgctcccgagataccagatgccagttgctcgttgtaccctcagccatgaaattggaggattacaacgcttctcattctcttaattcaggggatgtggggatgctagaaagagagacggctcgccagacatctgag

SEQ ID NO: 112174 - DNA, 174 bp, Homo sapiens; identical to SEQ ID NO: 79264
  chr16:68678982-68679156
  Hyper

SEQ ID NO: 112175 - DNA, 108 bp, Homo sapiens; identical to SEQ ID NO: 79265
  chr16:68679959-68680067
  Hyper

SEQ ID NO: 112176 - DNA, 80 bp, Homo sapiens; identical to SEQ ID NO: 79266
  chr16:68759191-68759271
  Hypo

SEQ ID NO: 112177 - DNA, 120 bp, Homo sapiens; identical to SEQ ID NO: 79267
  chr16:68770606-68770726
  Hypo

SEQ ID NO: 112178 - DNA, 149 bp, Homo sapiens; identical to SEQ ID NO: 79268
  chr16:68770846-68770995
  Hypo

SEQ ID NO: 112179 - DNA, 76 bp, Homo sapiens; identical to SEQ ID NO: 79269
  chr16:68771248-68771324
  Hyper

SEQ ID NO: 112180 - DNA, 45 bp, Homo sapiens; identical to SEQ ID NO: 44724
  chr16:68787504-68787549
  Hypo

SEQ ID NO: 112181 - DNA, 42 bp, Homo sapiens; identical to SEQ ID NO: 79271
  chr16:68876805-68876847
  Hypo

SEQ ID NO: 112182 - DNA, 30 bp, Homo sapiens; identical to SEQ ID NO: 79272
  chr16:69106048-69106078
  Hypo

SEQ ID NO: 112183 - DNA, 25 bp, Homo sapiens
  chr16:69107559-69107584
  Hypo
gttagaaagggcactcgaagccagg

SEQ ID NO: 112184 - DNA, 48 bp, Homo sapiens; identical to SEQ ID NO: 79274
  chr16:69133585-69133633
  Hypo

SEQ ID NO: 112185 - DNA, 30 bp, Homo sapiens; identical to SEQ ID NO: 79275
  chr16:69139552-69139582
  Hyper

SEQ ID NO: 112186 - DNA, 136 bp, Homo sapiens; identical to SEQ ID NO: 79276
  chr16:69352213-69352349
  Hypo

SEQ ID NO: 112187 - DNA, 30 bp, Homo sapiens; identical to SEQ ID NO: 44727
  chr16:69352566-69352596
  Hypo

SEQ ID NO: 112188 - DNA, 21 bp, Homo sapiens
  chr16:69359280-69359301
  Hypo
tcgagagttgctgggcgcggt

SEQ ID NO: 112189 - DNA, 30 bp, Homo sapiens; identical to SEQ ID NO: 79279
  chr16:69372480-69372510
  Hypo

SEQ ID NO: 112190 - DNA, 36 bp, Homo sapiens; identical to SEQ ID NO: 79280
  chr16:69563669-69563705
  Hypo

SEQ ID NO: 112191 - DNA, 19 bp, Homo sapiens
  chr16:69564030-69564049
  Hypo
agtcttggccgggcgcgat

SEQ ID NO: 112192 - DNA, 30 bp, Homo sapiens; identical to SEQ ID NO: 79282
  chr16:69776566-69776596
  Hypo

SEQ ID NO: 112193 - DNA, 187 bp, Homo sapiens; identical to SEQ ID NO: 79283
  chr16:69791463-69791650
  Hypo

SEQ ID NO: 112194 - DNA, 140 bp, Homo sapiens; identical to SEQ ID NO: 79287
  chr16:70379985-70380125
  Hypo

SEQ ID NO: 112195 - DNA, 136 bp, Homo sapiens; identical to SEQ ID NO: 79288
  chr16:70416085-70416221
  Hypo

SEQ ID NO: 112196 - DNA, 126 bp, Homo sapiens; identical to SEQ ID NO: 44730
  chr16:70427606-70427732
  Hypo

SEQ ID NO: 112197 - DNA, 19 bp, Homo sapiens
  chr16:70439156-70439175
  Hypo
aggcacagcctggtgcggt

SEQ ID NO: 112198 - DNA, 30 bp, Homo sapiens; identical to SEQ ID NO: 79291
  chr16:70514821-70514851
  Hypo

SEQ ID NO: 112199 - DNA, 28 bp, Homo sapiens
  chr16:70522735-70522763
  Hypo
gagccaccacacccggcccagctactgt

SEQ ID NO: 112200 - DNA, 77 bp, Homo sapiens; identical to SEQ ID NO: 44731
  chr16:70595623-70595700
  Hypo

SEQ ID NO: 112201 - DNA, 140 bp, Homo sapiens; identical to SEQ ID NO: 79294
  chr16:70610992-70611132
  Hypo

SEQ ID NO: 112202 - DNA, 50 bp, Homo sapiens; identical to SEQ ID NO: 44732
  chr16:70680482-70680532
  Hypo

SEQ ID NO: 112203 - DNA, 32 bp, Homo sapiens; identical to SEQ ID NO: 79296
  chr16:70719509-70719541
  Hyper

SEQ ID NO: 112204 - DNA, 30 bp, Homo sapiens; identical to SEQ ID NO: 79297
  chr16:70769908-70769938
  Hypo

SEQ ID NO: 112205 - DNA, 69 bp, Homo sapiens; identical to SEQ ID NO: 79298
  chr16:70795276-70795345
  Hypo

SEQ ID NO: 112206 - DNA, 96 bp, Homo sapiens
  chr16:71264576-71264672
  Hyper
cccgcactctccatgcgccgcccgagctgttgccgtccgttgccacggtaaccacggagccgcacagcctagcaagccgcgcgatgattggaggag

SEQ ID NO: 112207 - DNA, 23 bp, Homo sapiens
  chr16:71266650-71266673
  Hypo
gggtgcagtggctcacgcctgta

SEQ ID NO: 112208 - DNA, 30 bp, Homo sapiens; identical to SEQ ID NO: 79303
  chr16:71418717-71418747
  Hypo

SEQ ID NO: 112209 - DNA, 22 bp, Homo sapiens
  chr16:71433525-71433547
  Hypo
cgcgccccgcagctgtggttaa

SEQ ID NO: 112210 - DNA, 663 bp, Homo sapiens
  chr16:71459854-71460517
  Hyper
tgcatttggcagccacgagagcccatctcccgcccaatcaagaggccgtcgccctggagacggaggaccccagctggggtcaccccttgcagcctcctctcccgtgcttgccggttcttgccaccctccgccgcttgcaccggacccaggcgctcatcccccgcttcccccgcgccccagcccggtcacgcctcggagcttgtccccacctggccgtgctcagagtctgcctgcccggcgtcccacacgcaccgcagggccccaccgcctcttggtgagccgcggtggctcgggtcccgggtccccaataggctgcgctcccggcaggcagctttcttcccggcgcggggctcgttccctgaggccaggccgctcagtggccgcaagagcgaccttcccacatgtccccaggtgtgcgcacaagcccggggtgagaccagaagctgctgcctgcagagcccgaccttgcgtagatgactccgcgagtgcaaggggctgcaggcattttcttacaggaggtagcaagcttgtctaagcagaggccctcttagcgcagtgggcagcgcgtcagtctcataatctgaaggtcctgagttcgagcctcagagagggcagctgttttgttgtgctacgaatgcagcaaatgttcggatgtaacccagc

SEQ ID NO: 112211 - DNA, 167 bp, Homo sapiens; identical to SEQ ID NO: 79307
  chr16:71715744-71715911
  Hypo

SEQ ID NO: 112212 - DNA, 45 bp, Homo sapiens; identical to SEQ ID NO: 79308
  chr16:71841040-71841085
  Hypo

SEQ ID NO: 112213 - DNA, 104 bp, Homo sapiens; identical to SEQ ID NO: 79309
  chr16:71841325-71841429
  Hypo

SEQ ID NO: 112214 - DNA, 23 bp, Homo sapiens
  chr16:71919058-71919081
  Hypo
tggttggacgcacttctagtcaa

SEQ ID NO: 112215 - DNA, 140 bp, Homo sapiens; identical to SEQ ID NO: 79311
  chr16:72038633-72038773
  Hypo

SEQ ID NO: 112216 - DNA, 44 bp, Homo sapiens
  chr16:72459645-72459689
  Hypo
taaaatcaattaacccgagtgttaattaacgtcaagtcgacggg

SEQ ID NO: 112217 - DNA, 30 bp, Homo sapiens; identical to SEQ ID NO: 79313
  chr16:72461127-72461157
  Hypo

SEQ ID NO: 112218 - DNA, 114 bp, Homo sapiens; identical to SEQ ID NO: 79314
  chr16:72461587-72461701
  Hypo

SEQ ID NO: 112219 - DNA, 30 bp, Homo sapiens; identical to SEQ ID NO: 79317
  chr16:72697029-72697059
  Hypo

SEQ ID NO: 112220 - DNA, 121 bp, Homo sapiens; identical to SEQ ID NO: 79318
  chr16:72835621-72835742
  Hypo

SEQ ID NO: 112221 - DNA, 70 bp, Homo sapiens; identical to SEQ ID NO: 79319
  chr16:72957744-72957814
  Hypo

SEQ ID NO: 112222 - DNA, 30 bp, Homo sapiens; identical to SEQ ID NO: 79320
  chr16:72963559-72963589
  Hypo

SEQ ID NO: 112223 - DNA, 30 bp, Homo sapiens; identical to SEQ ID NO: 79321
  chr16:72995364-72995394
  Hypo

SEQ ID NO: 112224 - DNA, 30 bp, Homo sapiens; identical to SEQ ID NO: 44739
  chr16:73033457-73033487
  Hypo

SEQ ID NO: 112225 - DNA, 82 bp, Homo sapiens; identical to SEQ ID NO: 79323
  chr16:73062471-73062553
  Hypo

SEQ ID NO: 112226 - DNA, 52 bp, Homo sapiens
  chr16:73096999-73097051
  Hyper
cgggatccaaggtgccgcgcggaggaggcgggctgctcgcagtgccggggtc

SEQ ID NO: 112227 - DNA, 704 bp, Homo sapiens
  chr16:73099886-73100590
  Hyper
cagggcgtggccccacggccggcaggagtccggcgcacactgggcctggagcgcactgactggggctctggctagccgggctacccgtggggtggcctagggcccagcctgtgtcaaggctgcgggcagggcactggtcccctgtggactcggggcgcgccctctcagccgcctccctgtttaattccagagctcagcgggctgcagggacattcgacgccagtttcctcaggcccgggcgtgagacgcgcccttctcgtgtctgctcttccgtccctctgcgctggatgttgtatagcgcaggccccttccctccccgcctctcgttcccaaaaccttatcattgagaattcgacagttgccccgagatgctgatcccagttcacggagccagcgtgcgcgtccctaatgcccggcacacccatctccatttcgggacccttttttttcctgcgggctctggactcccgggaggaagcctcgggccctccggctccccggagacaccggctgaggcgcttaggccagtgcagagtcgccgcactgggacccaggcgcccctcacaggtgcacgtagggcatggcccaacggcccctcggatgggcggggaaacaggcccgggcggagcaattcgatcaccccattatgcccctgcggatgcccagaaaagccacgaggcccgggggaccgccccagcagtggt

SEQ ID NO: 112228 - DNA, 43 bp, Homo sapiens; identical to SEQ ID NO: 79328
  chr16:73397226-73397269
  Hypo

SEQ ID NO: 112229 - DNA, 33 bp, Homo sapiens; identical to SEQ ID NO: 79329
  chr16:73422838-73422871
  Hypo

SEQ ID NO: 112230 - DNA, 25 bp, Homo sapiens
  chr16:73450459-73450484
  Hypo
actcaatttagcagacgaaagttga

SEQ ID NO: 112231 - DNA, 30 bp, Homo sapiens; identical to SEQ ID NO: 79334
  chr16:73558881-73558911
  Hypo

SEQ ID NO: 112232 - DNA, 205 bp, Homo sapiens; identical to SEQ ID NO: 79335
  chr16:73693831-73694036
  Hypo

SEQ ID NO: 112233 - DNA, 17 bp, Homo sapiens
  chr16:73984305-73984322
  Hypo
gagtcgcaggcaggccg

SEQ ID NO: 112234 - DNA, 30 bp, Homo sapiens; identical to SEQ ID NO: 44742
  chr16:74331835-74331865
  Hypo

SEQ ID NO: 112235 - DNA, 30 bp, Homo sapiens; identical to SEQ ID NO: 79340
  chr16:74401355-74401385
  Hyper

SEQ ID NO: 112236 - DNA, 20 bp, Homo sapiens
  chr16:74490343-74490363
  Hypo
caccgcgcccggccctgacc

SEQ ID NO: 112237 - DNA, 30 bp, Homo sapiens; identical to SEQ ID NO: 79342
  chr16:74702004-74702034
  Hypo

SEQ ID NO: 112238 - DNA, 152 bp, Homo sapiens; identical to SEQ ID NO: 79344
  chr16:74901411-74901563
  Hypo

SEQ ID NO: 112239 - DNA, 240 bp, Homo sapiens; identical to SEQ ID NO: 79345
  chr16:75019623-75019863
  Hypo

SEQ ID NO: 112240 - DNA, 30 bp, Homo sapiens; identical to SEQ ID NO: 79347
  chr16:75112923-75112953
  Hypo

SEQ ID NO: 112241 - DNA, 598 bp, Homo sapiens; identical to SEQ ID NO: 79348
  chr16:75148553-75149151
  Hypo

SEQ ID NO: 112242 - DNA, 37 bp, Homo sapiens; identical to SEQ ID NO: 44746
  chr16:75171636-75171673
  Hypo

SEQ ID NO: 112243 - DNA, 38 bp, Homo sapiens; identical to SEQ ID NO: 79350
  chr16:75178915-75178953
  Hypo

SEQ ID NO: 112244 - DNA, 120 bp, Homo sapiens; identical to SEQ ID NO: 79351
  chr16:75183609-75183729
  Hypo

SEQ ID NO: 112245 - DNA, 30 bp, Homo sapiens; identical to SEQ ID NO: 79352
  chr16:75227098-75227128
  Hypo

SEQ ID NO: 112246 - DNA, 87 bp, Homo sapiens; identical to SEQ ID NO: 79353
  chr16:75403259-75403346
  Hypo

SEQ ID NO: 112247 - DNA, 35 bp, Homo sapiens; identical to SEQ ID NO: 79354
  chr16:75465061-75465096
  Hypo

SEQ ID NO: 112248 - DNA, 34 bp, Homo sapiens; identical to SEQ ID NO: 79355
  chr16:75465516-75465550
  Hypo

SEQ ID NO: 112249 - DNA, 39 bp, Homo sapiens; identical to SEQ ID NO: 79356
  chr16:75469080-75469119
  Hypo

SEQ ID NO: 112250 - DNA, 702 bp, Homo sapiens
  chr16:75528671-75529373
  Hyper
gcgatgccctttccacgttgctgatggaaaagccactcccagctcttcccgccaccccaggtccccggtgcaggacagaggagcgtccccagctgtgccaccagcccggcccccagccgacccgagtgtggggacatcccccgcggagaatgaagaaccaacgtaccccaaagcttggcggctctgcccgagctgcagcggcacggtgggggacgcctctctccctggactcagcaaaggctcccaaacgtcgtctcttccaaattccaccgcacagccagctctttctcttcactgggagggtccgcaggggctgacttgctccttaaggtcccaagactattaagcgacacccggtgaggccgggaaaggggctctaagaggcatggacgagagttggcggtgaccaagccactggaagctcctggagactcgaggtagaacgaatgtgggaacagggcaggagtcccagaatgggatgttgaggctgggggtgtcctggggctaccacagggaaggacccggcgcagagctccctctggaacccggcactgcggcccgcgccctctactccccgcgcgccggccggcaaccctcggcgctgcccggtgcagcccgcccgagcgcacacaatgaggcgctttcagacgtggctgcggtcccgaggtggccagcgggagctagcgccgtgggggaaggaag

SEQ ID NO: 112251 - DNA, 32 bp, Homo sapiens; identical to SEQ ID NO: 79359
  chr16:75549843-75549875
  Hypo

SEQ ID NO: 112252 - DNA, 99 bp, Homo sapiens; identical to SEQ ID NO: 79362
  chr16:75658303-75658402
  Hypo

SEQ ID NO: 112253 - DNA, 120 bp, Homo sapiens; identical to SEQ ID NO: 79363
  chr16:75666903-75667023
  Hypo

SEQ ID NO: 112254 - DNA, 99 bp, Homo sapiens; identical to SEQ ID NO: 79364
  chr16:75680068-75680167
  Hypo

SEQ ID NO: 112255 - DNA, 30 bp, Homo sapiens; identical to SEQ ID NO: 44750
  chr16:75733411-75733441
  Hypo

SEQ ID NO: 112256 - DNA, 32 bp, Homo sapiens; identical to SEQ ID NO: 79367
  chr16:75787877-75787909
  Hypo

SEQ ID NO: 112257 - DNA, 41 bp, Homo sapiens; identical to SEQ ID NO: 36256
  chr16:76311161-76311202
  Hyper

SEQ ID NO: 112258 - DNA, 30 bp, Homo sapiens; identical to SEQ ID NO: 79370
  chr16:76685067-76685097
  Hypo

SEQ ID NO: 112259 - DNA, 955 bp, Homo sapiens; identical to SEQ ID NO: 79372
  chr16:77245975-77246930
  Hyper

SEQ ID NO: 112260 - DNA, 129 bp, Homo sapiens; identical to SEQ ID NO: 79373
  chr16:77247382-77247511
  Hypo

SEQ ID NO: 112261 - DNA, 67 bp, Homo sapiens; identical to SEQ ID NO: 79374
  chr16:77247715-77247782
  Hypo

SEQ ID NO: 112262 - DNA, 25 bp, Homo sapiens
  chr16:77372556-77372581
  Hypo
agtaagtggcttggccgggcgcggt

SEQ ID NO: 112263 - DNA, 859 bp, Homo sapiens
  chr16:77468261-77469120
  Hyper
agggtcaaagtgctgcgaaaggcccttcttggggatggggggcaaatacgaaccatcatttaatccgctggcgccgctgctgctgtcactggctaaggccgcggcgaccgacgcacagcagaggcagcacagctggagcgcctgcaagagaaaaggtgacatcgcgcgtgaggggcgcggcggggctggcgtcgggcgccccctgccacccgctctcggagctccgctcggcggcacctgccttggccacgcgccccagtcccgccaggcccctcggcgggcccgaacccgcagccgggaaggcacacgcgagcaggagggcgcactccatggtcaggtgcggacgcggcggctgcgggtggccagacgcggcaggcggagcgcacgggcggcgcgcattctttccgcggccccggagctcggcgccccaggtgcggctccaggtgagagccgccgccgttcacatcgcagcgggggcgcgctgggacctcccctcctccggccgcctgcgcgccctcccttctcccggcgcgggcctgccgagctgcagtttgcggcaccccagagggtacggggggctccctgggccgggactggagcgcaaacggttgggagactgtcggtgtctgcccgcccgtctgtgcgtctgtctgtgtcggtgtgagcgtctgaggcgatggggaagacagcgccagctggctcccccagcgcgccggagccgagcgcccgcctctccaccgcgcggtgattggcgaccagcggctcccgggctcgtccgagcccccgggctggtgcaagggcgtgggattcccggctccagctctgagggagggggcgaagggggcggggaggctgggtg

SEQ ID NO: 112264 - DNA, 30 bp, Homo sapiens; identical to SEQ ID NO: 79379
  chr16:77753074-77753104
  Hypo

SEQ ID NO: 112265 - DNA, 200 bp, Homo sapiens; identical to SEQ ID NO: 79380
  chr16:77753871-77754071
  Hypo

SEQ ID NO: 112266 - DNA, 1203 bp, Homo sapiens
  chr16:77822117-77823320
  Hyper
agagggcaaccttgtcgcggtaaggcatcctccaggcccagacattagtctcggtccatttcaaggcacccgagcctgtgccgtatataaccaagtactgggcccacaggaagggggatgacagggtggtctctctaggctcgttttagtcacagatcttcggcaaatttgggtttagggccgcgatcccgaccctaacttgggactatttcaggaactggagttgaggcttcgttgggacaggaaagaagggtggggcgggggtgaagcgcttagggcacggctcttgtgaggattacggcggaggctgtggaccgcggcggcgctcgcagaggctgcagccattgcacagccgagcatcccacattcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctggtccagtatccgcgcctttctcgctttctctctttttgcgcgctgggcgctggggagggggtgggaaagctgcggctgggatgctgcccgggtagaaccgccgcgcgcaccccctccgcgccctcacccgggtctcagagcctccccgggccaaagctggggaggatgcagaggggcggcctccccaagccagatctaggggtgacgggaggagaatgtgagctcctgggcgcggggagaatgctggcgcccaggcaccccgggtctggaagattgcgctacgggagttctccgtctgagaggacaactcagctttcgcacgggagggttgatgcttaacagaattaaaaatatatgtattaagaaccgcaagcccactgtgtgccagccgccgttggtagttttacacgtgcgatcttatttaatacttcctgggacctaatgagtcaggtgccatcatgatccgtttacaggtaagaaagccgccgctcagcgagaatgagtgatt

SEQ ID NO: 112267 - DNA, 30 bp, Homo sapiens; identical to SEQ ID NO: 79383
  chr16:78057993-78058023
  Hypo

SEQ ID NO: 112268 - DNA, 408 bp, Homo sapiens; identical to SEQ ID NO: 79384
  chr16:78079769-78080177
  Hyper

SEQ ID NO: 112269 - DNA, 30 bp, Homo sapiens; identical to SEQ ID NO: 79386
  chr16:79253226-79253256
  Hypo

SEQ ID NO: 112270 - DNA, 48 bp, Homo sapiens; identical to SEQ ID NO: 79387
  chr16:79253546-79253594
  Hypo

SEQ ID NO: 112271 - DNA, 174 bp, Homo sapiens
  chr16:79263326-79263500
  Hypo
atagagctgcctttccgttgtccgtggaattcactgcacatttcgagggaccgcctgtcctggcagagagcaagggactcataaaagtgtcagaacattatgaacagcccgaagatgggctgtgagcggggataagtgaagcgcggcgtggaggccgttcggtaactccatcca

SEQ ID NO: 112272 - DNA, 52 bp, Homo sapiens; identical to SEQ ID NO: 79388
  chr16:79623822-79623874
  Hyper

SEQ ID NO: 112273 - DNA, 976 bp, Homo sapiens
  chr16:79632604-79633580
  Hyper
tagcaagcccacacccgagccggacccccgcggagcacttatcagggtggctagctggaatcgcgtgtcagactcacatgaaaaactcgggagaggacgggttgtcgctgctcgagccgttttctcggaagccgctgctcaccaacttctcgtatttctccttgtacgcgtccctctcgcgcaccagcctggagatctcctgcttgaggtggtcgacttgctgcagcagctggttcttctccgactccaggacgtgtctctgctgcaccctcttgaagcggcaggactgggcatagccgcggtttttcagggtccgcctcttctgcttcagccggatcacctcctccttgctgaccccgcgcagctgccggttcagctcgcgcacagacatggtcaccagctgctcgtcggagaagcggtcgtcgaagtgcaggccgccggcggcgtggtgcgggtgcagggcgccccccgcccccgccgcgcccccgccgcctccgccgccgccgccgccgccgccgcccccagcgctggccgggccaccgccgcccgcgcccccagcgccaccggccgaggcggccgcgctgcccgcggcgccgggcgcgccggccgtcgggtggtggtggtggccggcggcgtggtggtggtggtggtggtagtgcgggcccgcgccgctctgcgcggcggccgcggcgatcacggcggacaccacggcggcggcggggcccatctcctcgccgctgccgcccaaggaggcgccggcaccggccccggccgccgcggccagctgctgcgccccgcgcgcgtagccatcgaagccgccctggagctggtggctgttgctgatgagcgcctcgaccgcgtcctcggggctgaagcccagcgcctcggggttcagctgctgcgggtagccggtcatccagtagtagtcttccaggtgcgccttctgctcgctgcccgagcccgggctgggcgccga

SEQ ID NO: 112274 - DNA, 51 bp, Homo sapiens; identical to SEQ ID NO: 36268
  chr16:79633792-79633843
  Hyper

SEQ ID NO: 112275 - DNA, 30 bp, Homo sapiens; identical to SEQ ID NO: 79392
  chr16:79634334-79634364
  Hyper

SEQ ID NO: 112276 - DNA, 936 bp, Homo sapiens; identical to SEQ ID NO: 79393
  chr16:79634758-79635694
  Hyper

SEQ ID NO: 112277 - DNA, 30 bp, Homo sapiens; identical to SEQ ID NO: 79394
  chr16:79635937-79635967
  Hyper

SEQ ID NO: 112278 - DNA, 36 bp, Homo sapiens; identical to SEQ ID NO: 79395
  chr16:79674118-79674154
  Hypo

SEQ ID NO: 112279 - DNA, 215 bp, Homo sapiens; identical to SEQ ID NO: 79396
  chr16:79804242-79804457
  Hyper

SEQ ID NO: 112280 - DNA, 194 bp, Homo sapiens; identical to SEQ ID NO: 79398
  chr16:79880975-79881169
  Hypo

SEQ ID NO: 112281 - DNA, 30 bp, Homo sapiens; identical to SEQ ID NO: 79399
  chr16:80015013-80015043
  Hypo

SEQ ID NO: 112282 - DNA, 444 bp, Homo sapiens; identical to SEQ ID NO: 79400
  chr16:80574608-80575052
  Hyper

SEQ ID NO: 112283 - DNA, 225 bp, Homo sapiens; identical to SEQ ID NO: 79401
  chr16:80641678-80641903
  Hypo

SEQ ID NO: 112284 - DNA, 135 bp, Homo sapiens; identical to SEQ ID NO: 79402
  chr16:80644760-80644895
  Hypo

SEQ ID NO: 112285 - DNA, 116 bp, Homo sapiens; identical to SEQ ID NO: 79403
  chr16:80654735-80654851
  Hypo

SEQ ID NO: 112286 - DNA, 30 bp, Homo sapiens; identical to SEQ ID NO: 79404
  chr16:80671402-80671432
  Hypo

SEQ ID NO: 112287 - DNA, 181 bp, Homo sapiens; identical to SEQ ID NO: 79405
  chr16:80704532-80704713
  Hypo

SEQ ID NO: 112288 - DNA, 115 bp, Homo sapiens; identical to SEQ ID NO: 79406
  chr16:80718633-80718748
  Hypo

SEQ ID NO: 112289 - DNA, 61 bp, Homo sapiens
  chr16:80837363-80837424
  Hyper
caagggccacccccacgcccgagcccggagggcgtccgagctggtgcgggggcagcaggtg

SEQ ID NO: 112290 - DNA, 44 bp, Homo sapiens; identical to SEQ ID NO: 79408
  chr16:80838149-80838193
  Hyper

SEQ ID NO: 112291 - DNA, 189 bp, Homo sapiens; identical to SEQ ID NO: 79409
  chr16:80871876-80872065
  Hypo

SEQ ID NO: 112292 - DNA, 30 bp, Homo sapiens; identical to SEQ ID NO: 79411
  chr16:80965838-80965868
  Hyper

SEQ ID NO: 112293 - DNA, 32 bp, Homo sapiens; identical to SEQ ID NO: 36273
  chr16:80966399-80966431
  Hyper

SEQ ID NO: 112294 - DNA, 90 bp, Homo sapiens; identical to SEQ ID NO: 79414
  chr16:81042175-81042265
  Hypo

SEQ ID NO: 112295 - DNA, 22 bp, Homo sapiens
  chr16:81111435-81111457
  Hypo
aggcgcggtggctcacgcctgt

SEQ ID NO: 112296 - DNA, 100 bp, Homo sapiens; identical to SEQ ID NO: 79416
  chr16:81230844-81230944
  Hypo

SEQ ID NO: 112297 - DNA, 30 bp, Homo sapiens; identical to SEQ ID NO: 16070
  chr16:81533258-81533288
  Hypo

SEQ ID NO: 112298 - DNA, 52 bp, Homo sapiens; identical to SEQ ID NO: 79418
  chr16:81557303-81557355
  Hypo

SEQ ID NO: 112299 - DNA, 150 bp, Homo sapiens; identical to SEQ ID NO: 79419
  chr16:81564391-81564541
  Hypo

SEQ ID NO: 112300 - DNA, 151 bp, Homo sapiens; identical to SEQ ID NO: 44759
  chr16:81569552-81569703
  Hypo

SEQ ID NO: 112301 - DNA, 30 bp, Homo sapiens; identical to SEQ ID NO: 79424
  chr16:81615132-81615162
  Hypo

SEQ ID NO: 112302 - DNA, 30 bp, Homo sapiens; identical to SEQ ID NO: 79425
  chr16:81619949-81619979
  Hypo

SEQ ID NO: 112303 - DNA, 120 bp, Homo sapiens; identical to SEQ ID NO: 79426
  chr16:81627222-81627342
  Hypo

SEQ ID NO: 112304 - DNA, 200 bp, Homo sapiens; identical to SEQ ID NO: 79427
  chr16:81632912-81633112
  Hypo

SEQ ID NO: 112305 - DNA, 30 bp, Homo sapiens; identical to SEQ ID NO: 79428
  chr16:81694683-81694713
  Hypo

SEQ ID NO: 112306 - DNA, 30 bp, Homo sapiens; identical to SEQ ID NO: 79429
  chr16:81700035-81700065
  Hypo

SEQ ID NO: 112307 - DNA, 30 bp, Homo sapiens; identical to SEQ ID NO: 79430
  chr16:81739542-81739572
  Hypo

SEQ ID NO: 112308 - DNA, 165 bp, Homo sapiens; identical to SEQ ID NO: 79431
  chr16:81779848-81780013
  Hyper

SEQ ID NO: 112309 - DNA, 197 bp, Homo sapiens; identical to SEQ ID NO: 79432
  chr16:81813400-81813597
  Hyper

SEQ ID NO: 112310 - DNA, 30 bp, Homo sapiens; identical to SEQ ID NO: 79433
  chr16:81901263-81901293
  Hypo

SEQ ID NO: 112311 - DNA, 218 bp, Homo sapiens
  chr16:81929174-81929392
  Hypo
aaaatgaaaaaaaaagcagcattgaaactagcttgtcttggacagctgcacttgcattatgtaagcgcacagggaaccctgcggatacagggaaagccatgtcctcgtgttggcagccgaatggagggagtgtgggtgtccttgtctagtaactgaactggtgtgtgggccgggggctgacctcggggctgtcagtgaacacacgtggtattgaggct

SEQ ID NO: 112312 - DNA, 30 bp, Homo sapiens; identical to SEQ ID NO: 79438
  chr16:82336003-82336033
  Hypo

SEQ ID NO: 112313 - DNA, 194 bp, Homo sapiens; identical to SEQ ID NO: 79442
  chr16:82540089-82540283
  Hypo

SEQ ID NO: 112314 - DNA, 603 bp, Homo sapiens
  chr16:82660301-82660904
  Hyper
taggctggaagtggccgccagtcccccgtgcaattccattctctggaaaagtggaatcagctggcattgcccagcgtgatttgtgaggctgagccccaacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtagggaagaggggctgccgggcgcgctctgcgccccgtttctgcattcggatcgcccggcacgggcagggtgagggggctttcggggggtcggggcctccggtcgcggcggcgaagacagatcggggctcggtagggaggtcattccgagcccagagatcc

SEQ ID NO: 112315 - DNA, 616 bp, Homo sapiens
  chr16:82661179-82661795
  Hyper
ctcgggtccggattgcgggatgcggggctggagaggccgagcaggcaccaccgacttcccagggcgcccgggccccctggtacagcccggctgcccgctggaaggcgcctcggggcagcagagagcctcagcccggctgctgctgtcgctcaaaggcgccggcgccggccgcacccgcatcggggtccttttgctcccagaccccgggcccgaaagggccggagcgtgtcccccgccagggcgcaggccccagccccccgcacccctattgtccagccagctggagctccggccagatcccgggctgccgcctctgctgccttccctgagcgggagcggagcgcagagaaaagttcaagccttgcccacccgggctgcagctgcttgttaaccctcagagcgccacggcgcgagggaagggcacgccaaccaggagagggggcgagggagatgcggtccgcctgcagtcacctctgcacctcagagatttcgggaagtttgagtgcaggaaagcagcgctccgaggccaggcctggggtgctggccgctgcggggggcacgccctgcgctgctcaggggcctgtggtttcggagagcaccccgatccagtccccca

SEQ ID NO: 112316 - DNA, 181 bp, Homo sapiens; identical to SEQ ID NO: 79447
  chr16:83151734-83151915
  Hypo

SEQ ID NO: 112317 - DNA, 169 bp, Homo sapiens; identical to SEQ ID NO: 79448
  chr16:83197025-83197194
  Hypo

SEQ ID NO: 112318 - DNA, 30 bp, Homo sapiens; identical to SEQ ID NO: 79450
  chr16:83566510-83566540
  Hypo

SEQ ID NO: 112319 - DNA, 28 bp, Homo sapiens
  chr16:83670814-83670842
  Hypo
ttaaaatatcaaaaacgtctaatagaaa

SEQ ID NO: 112320 - DNA, 32 bp, Homo sapiens; identical to SEQ ID NO: 79453
  chr16:83842937-83842969
  Hypo

SEQ ID NO: 112321 - DNA, 343 bp, Homo sapiens; identical to SEQ ID NO: 79454
  chr16:83968763-83969106
  Hypo

SEQ ID NO: 112322 - DNA, 162 bp, Homo sapiens; identical to SEQ ID NO: 79455
  chr16:83974810-83974972
  Hypo

SEQ ID NO: 112323 - DNA, 125 bp, Homo sapiens; identical to SEQ ID NO: 79456
  chr16:84001778-84001903
  Hyper

SEQ ID NO: 112324 - DNA, 66 bp, Homo sapiens; identical to SEQ ID NO: 79457
  chr16:84002378-84002444
  Hyper

SEQ ID NO: 112325 - DNA, 30 bp, Homo sapiens; identical to SEQ ID NO: 79458
  chr16:84067071-84067101
  Hypo

SEQ ID NO: 112326 - DNA, 30 bp, Homo sapiens; identical to SEQ ID NO: 79459
  chr16:84074841-84074871
  Hypo

SEQ ID NO: 112327 - DNA, 41 bp, Homo sapiens; identical to SEQ ID NO: 16073
  chr16:84075186-84075227
  Hypo

SEQ ID NO: 112328 - DNA, 30 bp, Homo sapiens; identical to SEQ ID NO: 44764
  chr16:84129364-84129394
  Hypo

SEQ ID NO: 112329 - DNA, 30 bp, Homo sapiens; identical to SEQ ID NO: 79462
  chr16:84131007-84131037
  Hypo

SEQ ID NO: 112330 - DNA, 39 bp, Homo sapiens; identical to SEQ ID NO: 79463
  chr16:84148968-84149007
  Hypo

SEQ ID NO: 112331 - DNA, 30 bp, Homo sapiens; identical to SEQ ID NO: 44765
  chr16:84152910-84152940
  Hypo

SEQ ID NO: 112332 - DNA, 58 bp, Homo sapiens; identical to SEQ ID NO: 79465
  chr16:84153336-84153394
  Hypo

SEQ ID NO: 112333 - DNA, 102 bp, Homo sapiens; identical to SEQ ID NO: 79466
  chr16:84328322-84328424
  Hyper

SEQ ID NO: 112334 - DNA, 398 bp, Homo sapiens; identical to SEQ ID NO: 79467
  chr16:84402023-84402421
  Hyper

SEQ ID NO: 112335 - DNA, 30 bp, Homo sapiens; identical to SEQ ID NO: 79468
  chr16:84483442-84483472
  Hypo

SEQ ID NO: 112336 - DNA, 168 bp, Homo sapiens; identical to SEQ ID NO: 79469
  chr16:84573769-84573937
  Hypo

SEQ ID NO: 112337 - DNA, 30 bp, Homo sapiens; identical to SEQ ID NO: 44767
  chr16:84593218-84593248
  Hypo

SEQ ID NO: 112338 - DNA, 122 bp, Homo sapiens; identical to SEQ ID NO: 79472
  chr16:84593455-84593577
  Hypo

SEQ ID NO: 112339 - DNA, 194 bp, Homo sapiens; identical to SEQ ID NO: 79473
  chr16:84633325-84633519
  Hyper

SEQ ID NO: 112340 - DNA, 142 bp, Homo sapiens; identical to SEQ ID NO: 79475
  chr16:84765227-84765369
  Hypo

SEQ ID NO: 112341 - DNA, 48 bp, Homo sapiens; identical to SEQ ID NO: 79476
  chr16:84780623-84780671
  Hypo

SEQ ID NO: 112342 - DNA, 18 bp, Homo sapiens
  chr16:84852343-84852361
  Hypo
gcccggccagtctgcatt

SEQ ID NO: 112343 - DNA, 297 bp, Homo sapiens; identical to SEQ ID NO: 36283
  chr16:84853364-84853661
  Hyper

SEQ ID NO: 112344 - DNA, 30 bp, Homo sapiens; identical to SEQ ID NO: 79479
  chr16:84933190-84933220
  Hypo

SEQ ID NO: 112345 - DNA, 30 bp, Homo sapiens; identical to SEQ ID NO: 79480
  chr16:84998014-84998044
  Hypo

SEQ ID NO: 112346 - DNA, 60 bp, Homo sapiens; identical to SEQ ID NO: 79481
  chr16:85001619-85001679
  Hypo

SEQ ID NO: 112347 - DNA, 426 bp, Homo sapiens; identical to SEQ ID NO: 79482
  chr16:85007493-85007919
  Hypo

SEQ ID NO: 112348 - DNA, 30 bp, Homo sapiens; identical to SEQ ID NO: 44770
  chr16:85010139-85010169
  Hypo

SEQ ID NO: 112349 - DNA, 173 bp, Homo sapiens; identical to SEQ ID NO: 16076
  chr16:85028164-85028337
  Hypo

SEQ ID NO: 112350 - DNA, 30 bp, Homo sapiens; identical to SEQ ID NO: 44772
  chr16:85028787-85028817
  Hypo

SEQ ID NO: 112351 - DNA, 75 bp, Homo sapiens; identical to SEQ ID NO: 79486
  chr16:85033827-85033902
  Hypo

SEQ ID NO: 112352 - DNA, 212 bp, Homo sapiens; identical to SEQ ID NO: 79487
  chr16:85043907-85044119
  Hypo

SEQ ID NO: 112353 - DNA, 66 bp, Homo sapiens; identical to SEQ ID NO: 79488
  chr16:85075504-85075570
  Hypo

SEQ ID NO: 112354 - DNA, 243 bp, Homo sapiens; identical to SEQ ID NO: 79489
  chr16:85083548-85083791
  Hypo

SEQ ID NO: 112355 - DNA, 72 bp, Homo sapiens; identical to SEQ ID NO: 79490
  chr16:85136820-85136892
  Hypo

SEQ ID NO: 112356 - DNA, 47 bp, Homo sapiens; identical to SEQ ID NO: 79491
  chr16:85141797-85141844
  Hypo

SEQ ID NO: 112357 - DNA, 135 bp, Homo sapiens; identical to SEQ ID NO: 79492
  chr16:85147716-85147851
  Hypo

SEQ ID NO: 112358 - DNA, 207 bp, Homo sapiens; identical to SEQ ID NO: 79494
  chr16:85203399-85203606
  Hyper

SEQ ID NO: 112359 - DNA, 39 bp, Homo sapiens; identical to SEQ ID NO: 79495
  chr16:85255435-85255474
  Hypo

SEQ ID NO: 112360 - DNA, 42 bp, Homo sapiens; identical to SEQ ID NO: 79496
  chr16:85264292-85264334
  Hypo

SEQ ID NO: 112361 - DNA, 137 bp, Homo sapiens; identical to SEQ ID NO: 79497
  chr16:85317660-85317797
  Hypo

SEQ ID NO: 112362 - DNA, 48 bp, Homo sapiens; identical to SEQ ID NO: 79498
  chr16:85318173-85318221
  Hypo

SEQ ID NO: 112363 - DNA, 32 bp, Homo sapiens; identical to SEQ ID NO: 79499
  chr16:85328962-85328994
  Hypo

SEQ ID NO: 112364 - DNA, 239 bp, Homo sapiens; identical to SEQ ID NO: 44779
  chr16:85336342-85336581
  Hypo

SEQ ID NO: 112365 - DNA, 30 bp, Homo sapiens; identical to SEQ ID NO: 79501
  chr16:85337464-85337494
  Hypo

SEQ ID NO: 112366 - DNA, 30 bp, Homo sapiens; identical to SEQ ID NO: 79502
  chr16:85369520-85369550
  Hypo

SEQ ID NO: 112367 - DNA, 30 bp, Homo sapiens; identical to SEQ ID NO: 79503
  chr16:85399740-85399770
  Hypo

SEQ ID NO: 112368 - DNA, 30 bp, Homo sapiens; identical to SEQ ID NO: 79504
  chr16:85401274-85401304
  Hypo

SEQ ID NO: 112369 - DNA, 221 bp, Homo sapiens; identical to SEQ ID NO: 79505
  chr16:85427749-85427970
  Hypo

SEQ ID NO: 112370 - DNA, 100 bp, Homo sapiens; identical to SEQ ID NO: 79506
  chr16:85455150-85455250
  Hypo

SEQ ID NO: 112371 - DNA, 30 bp, Homo sapiens; identical to SEQ ID NO: 79507
  chr16:85455735-85455765
  Hypo

SEQ ID NO: 112372 - DNA, 30 bp, Homo sapiens; identical to SEQ ID NO: 79508
  chr16:85462609-85462639
  Hypo

SEQ ID NO: 112373 - DNA, 82 bp, Homo sapiens; identical to SEQ ID NO: 79509
  chr16:85464220-85464302
  Hypo

SEQ ID NO: 112374 - DNA, 30 bp, Homo sapiens; identical to SEQ ID NO: 79510
  chr16:85464926-85464956
  Hypo

SEQ ID NO: 112375 - DNA, 30 bp, Homo sapiens; identical to SEQ ID NO: 79511
  chr16:85478405-85478435
  Hypo

SEQ ID NO: 112376 - DNA, 30 bp, Homo sapiens; identical to SEQ ID NO: 79512
  chr16:85479322-85479352
  Hypo

SEQ ID NO: 112377 - DNA, 108 bp, Homo sapiens; identical to SEQ ID NO: 79513
  chr16:85485747-85485855
  Hypo

SEQ ID NO: 112378 - DNA, 54 bp, Homo sapiens; identical to SEQ ID NO: 79514
  chr16:85496643-85496697
  Hyper

SEQ ID NO: 112379 - DNA, 30 bp, Homo sapiens; identical to SEQ ID NO: 79515
  chr16:85498216-85498246
  Hypo

SEQ ID NO: 112380 - DNA, 42 bp, Homo sapiens; identical to SEQ ID NO: 79516
  chr16:85515663-85515705
  Hypo

SEQ ID NO: 112381 - DNA, 45 bp, Homo sapiens; identical to SEQ ID NO: 44783
  chr16:85516822-85516867
  Hypo

SEQ ID NO: 112382 - DNA, 402 bp, Homo sapiens; identical to SEQ ID NO: 79518
  chr16:85517218-85517620
  Hypo

SEQ ID NO: 112383 - DNA, 141 bp, Homo sapiens; identical to SEQ ID NO: 79519
  chr16:85537491-85537632
  Hypo

SEQ ID NO: 112384 - DNA, 26 bp, Homo sapiens
  chr16:85586238-85586264
  Hypo
caggtggacctcgatggctgtctcca

SEQ ID NO: 112385 - DNA, 30 bp, Homo sapiens; identical to SEQ ID NO: 79521
  chr16:85612527-85612557
  Hypo

SEQ ID NO: 112386 - DNA, 70 bp, Homo sapiens; identical to SEQ ID NO: 44786
  chr16:85617748-85617818
  Hypo

SEQ ID NO: 112387 - DNA, 61 bp, Homo sapiens; identical to SEQ ID NO: 79523
  chr16:85618591-85618652
  Hypo

SEQ ID NO: 112388 - DNA, 59 bp, Homo sapiens; identical to SEQ ID NO: 79524
  chr16:85627887-85627946
  Hypo

SEQ ID NO: 112389 - DNA, 30 bp, Homo sapiens; identical to SEQ ID NO: 79525
  chr16:85628473-85628503
  Hypo

SEQ ID NO: 112390 - DNA, 88 bp, Homo sapiens; identical to SEQ ID NO: 79526
  chr16:85668900-85668988
  Hypo

SEQ ID NO: 112391 - DNA, 30 bp, Homo sapiens; identical to SEQ ID NO: 79527
  chr16:85669859-85669889
  Hypo

SEQ ID NO: 112392 - DNA, 347 bp, Homo sapiens; identical to SEQ ID NO: 79528
  chr16:85670998-85671345
  Hypo

SEQ ID NO: 112393 - DNA, 30 bp, Homo sapiens; identical to SEQ ID NO: 79529
  chr16:85671745-85671775
  Hypo

SEQ ID NO: 112394 - DNA, 44 bp, Homo sapiens; identical to SEQ ID NO: 79530
  chr16:85672034-85672078
  Hypo

SEQ ID NO: 112395 - DNA, 55 bp, Homo sapiens; identical to SEQ ID NO: 44789
  chr16:85673184-85673239
  Hypo

SEQ ID NO: 112396 - DNA, 48 bp, Homo sapiens; identical to SEQ ID NO: 44790
  chr16:85673838-85673886
  Hypo

SEQ ID NO: 112397 - DNA, 211 bp, Homo sapiens; identical to SEQ ID NO: 79533
  chr16:85674123-85674334
  Hypo

SEQ ID NO: 112398 - DNA, 644 bp, Homo sapiens; identical to SEQ ID NO: 79534
  chr16:85678117-85678761
  Hypo

SEQ ID NO: 112399 - DNA, 309 bp, Homo sapiens; identical to SEQ ID NO: 79535
  chr16:85679146-85679455
  Hypo

SEQ ID NO: 112400 - DNA, 43 bp, Homo sapiens; identical to SEQ ID NO: 79536
  chr16:85679829-85679872
  Hypo

SEQ ID NO: 112401 - DNA, 624 bp, Homo sapiens; identical to SEQ ID NO: 79537
  chr16:85683970-85684594
  Hypo

SEQ ID NO: 112402 - DNA, 79 bp, Homo sapiens; identical to SEQ ID NO: 79538
  chr16:85693778-85693857
  Hypo

SEQ ID NO: 112403 - DNA, 30 bp, Homo sapiens; identical to SEQ ID NO: 79539
  chr16:85698705-85698735
  Hypo

SEQ ID NO: 112404 - DNA, 200 bp, Homo sapiens; identical to SEQ ID NO: 79540
  chr16:85699645-85699845
  Hypo

SEQ ID NO: 112405 - DNA, 208 bp, Homo sapiens; identical to SEQ ID NO: 79541
  chr16:85721429-85721637
  Hypo

SEQ ID NO: 112406 - DNA, 163 bp, Homo sapiens; identical to SEQ ID NO: 44796
  chr16:85731450-85731613
  Hypo

SEQ ID NO: 112407 - DNA, 234 bp, Homo sapiens; identical to SEQ ID NO: 79543
  chr16:85741334-85741568
  Hypo

SEQ ID NO: 112408 - DNA, 35 bp, Homo sapiens; identical to SEQ ID NO: 79544
  chr16:85752258-85752293
  Hypo

SEQ ID NO: 112409 - DNA, 30 bp, Homo sapiens; identical to SEQ ID NO: 44799
  chr16:85758266-85758296
  Hypo

SEQ ID NO: 112410 - DNA, 32 bp, Homo sapiens; identical to SEQ ID NO: 79546
  chr16:85799033-85799065
  Hypo

SEQ ID NO: 112411 - DNA, 35 bp, Homo sapiens; identical to SEQ ID NO: 79548
  chr16:85869217-85869252
  Hypo

SEQ ID NO: 112412 - DNA, 174 bp, Homo sapiens; identical to SEQ ID NO: 79549
  chr16:85873671-85873845
  Hypo

SEQ ID NO: 112413 - DNA, 30 bp, Homo sapiens; identical to SEQ ID NO: 79550
  chr16:85919965-85919995
  Hypo

SEQ ID NO: 112414 - DNA, 747 bp, Homo sapiens
  chr16:85932298-85933045
  Hyper
ccaatatccagcgctcgtgaaggcggagaccggcggggcagctagtttctggctgtggattctgattaatgggccgcaggcgcacggtctgcaccgtccggctcgttgctagtggctcgctcgggagccgccgcactcccggggctgtccgcccgagccggcctggaaggcggaggacgcctccaggtcgctccgcggggcctccggaattcctgggaaagcccccctgcagcgccgcccctggaccccaggtgtgaggagcggggctcggccagcggctccagaagaggcccggaccccactgccgtggctgccgggggcgggaaagtgatttctcggaaagcagagcacttcgaagaaggcgggccgcgcgagccaagctgacgctattggtcggtgtggccgtcgctctgcgcaccgcccgtcccccccacgaccctttttaaggccgcgcgaccgctggcgcatcgcctggagcgcggcagcaagcgtgggaacgcgggcggcgagacggcggcaggacggcggcaggtaggcacagtgggcgggtagggcgcccgtgtcccgcgcggtccggtcccgcggggtccccgacgccaggcggggcgtgggggtggaactacctaccgtaatgtccccgggcgcagctcagtggccacccgtgtccctctctgctttttgcctattttccagccacctaagtccaatctgaatgcccaagtcgttgattgtcgtttgcctgtttcc

SEQ ID NO: 112415 - DNA, 101 bp, Homo sapiens; identical to SEQ ID NO: 79554
  chr16:85952205-85952306
  Hypo

SEQ ID NO: 112416 - DNA, 30 bp, Homo sapiens; identical to SEQ ID NO: 79555
  chr16:86068336-86068366
  Hypo

SEQ ID NO: 112417 - DNA, 54 bp, Homo sapiens; identical to SEQ ID NO: 79557
  chr16:86081901-86081955
  Hyper

SEQ ID NO: 112418 - DNA, 198 bp, Homo sapiens; identical to SEQ ID NO: 79558
  chr16:86092017-86092215
  Hypo

SEQ ID NO: 112419 - DNA, 30 bp, Homo sapiens; identical to SEQ ID NO: 79559
  chr16:86101131-86101161
  Hypo

SEQ ID NO: 112420 - DNA, 55 bp, Homo sapiens; identical to SEQ ID NO: 79560
  chr16:86102059-86102114
  Hypo

SEQ ID NO: 112421 - DNA, 38 bp, Homo sapiens; identical to SEQ ID NO: 79561
  chr16:86115722-86115760
  Hypo

SEQ ID NO: 112422 - DNA, 55 bp, Homo sapiens; identical to SEQ ID NO: 44800
  chr16:86119064-86119119
  Hypo

SEQ ID NO: 112423 - DNA, 30 bp, Homo sapiens; identical to SEQ ID NO: 79563
  chr16:86133147-86133177
  Hypo

SEQ ID NO: 112424 - DNA, 35 bp, Homo sapiens; identical to SEQ ID NO: 79564
  chr16:86141209-86141244
  Hypo

SEQ ID NO: 112425 - DNA, 30 bp, Homo sapiens; identical to SEQ ID NO: 79565
  chr16:86149152-86149182
  Hypo

SEQ ID NO: 112426 - DNA, 96 bp, Homo sapiens; identical to SEQ ID NO: 79566
  chr16:86215311-86215407
  Hypo

SEQ ID NO: 112427 - DNA, 30 bp, Homo sapiens; identical to SEQ ID NO: 79567
  chr16:86216291-86216321
  Hypo

SEQ ID NO: 112428 - DNA, 803 bp, Homo sapiens
  chr16:86320265-86321068
  Hyper
aaggggagcccagtgcgcagggctccagaaaccccgaccctcgcaggggagagccagccgaaccagacgtgtgggggcagcagccgccgcggcggtctgggacgcgggtgtcgccttccacgggacttgggtccagggacccaagacggggatctgggaggagggggatgcccttggggcctgagacccgggcggtttccgaagcgaagtagttacccagaaccgctccctaccttctccccgcctccctgtctttctgcccctctgtcccctgcagctgctcggccctccctcctctgaaacccaccgcccgcccaaggctcactccttcctgctgttcccgcccgcgaagctgttgcagggacggtgcgcccttgggctgcactcaccaccgcccctcgcccgcgacgtcctggccccctaaccccagctttcccgccgccgctcactcccgcgctccgctgcagctcagcccggtctgcaactctccctctgttttctgccccgctcctcagttctgcgctctcctcttctccaggcttccctctcctcctccttctgcctctcccctgtccccgttccattctcctgcgcccctcgccagcgcgctcgcagcccatcggctcctgccggggcccctctggtgccagccgccttcaggctgtgggtccgtccgctggtggaggggaaggtcggggctggccccgggccccgcgctgctgggccccatggtcagtggagacgcctcctggtctcccttcagagctcctcgtcgtcgtcggagtcatcggaggaccaggaag

SEQ ID NO: 112429 - DNA, 37 bp, Homo sapiens; identical to SEQ ID NO: 79570
  chr16:86334870-86334907
  Hyper

SEQ ID NO: 112430 - DNA, 789 bp, Homo sapiens
  chr16:86530884-86531673
  Hyper
cacggccacctacttcgtcgggaaagacagtccagcgcccaccggcccgtgctcgcccgcctgccgagccccgagtcccggcaacgcgccccgggtgctccggtccactcggcacacgccgcgcgcggggctcggccgaggtggcttcgggtggctctgaagcctcggtcttcccggctcccaggacgccccccccgcccccgcccctccattcagcctgtcatctcggccctccgccgcctccggagccccgacggaggtgctgagttgtcaacgcaaattcctagttaagccacttgttgataaaccctctaggcaaattggttccgtctttacctgcccgccccgcccccgcccccggccccagccggcgcgcccctaattgctggaggagctcgacgccggcggcggcctctgcagcgagctaattgagttggaacccgagcggtcttcgttaagccggacgcaaggcggggacgggggaagggggcgggaggtgagacgcagcctgggacctccggcctggggttggaggcccacgcttgctggggtgggcttttggtggaggaagagcaatcatgcggagggctctgccgccgggttaagtggacgcagcgactatctggcggttctcgggggtctgcgttccctggttcacaaccaccccacccccacgcgcctgtgcacatgtccctcccgccgcgcagggtctccgcgggcgcgccccgccccaaatagagcttactacagtaacccgggagtctcacatctgcgcgtcccccacccgcc

SEQ ID NO: 112431 - DNA, 71 bp, Homo sapiens
  chr16:86531946-86532017
  Hyper
cgccccaaccaatctcgcactgtaagtgcatttcttgggttttccggggaaaagcacggttccagcacccc

SEQ ID NO: 112432 - DNA, 157 bp, Homo sapiens; identical to SEQ ID NO: 79577
  chr16:86537937-86538094
  Hyper

SEQ ID NO: 112433 - DNA, 526 bp, Homo sapiens
  chr16:86539103-86539629
  Hyper
cacaaatatccctcccgcgctcctccggcagccgtgaagtttcgtttcccccggccgggtcctccttccctcccttccgaagccccgaggacaggccgcttccctcccgcccagctcccgcgtcgggtcctggctggccgccctaccttgaggcgtcgtttgaacctcgcctcgcggggggttggagggagcgggggcgggcgaggagggcgcgggcccggcgttaatgcggagcgggggcggcggcggccggcggggcggctgccctcgcggtgggtggtcggcggccccctgccccgcccgcgcggccggcctgggctccctcggagcgggatctggttccccgctcgggttacggcgcgctctcggcccgggcggcttcgcttaagcaattagctagtaaaaataccttgggcctggggagtgggagacgttgcagtcgtgtccgtttttacacacccacccccgccctgctcggccagtttcaggattcctggggccagagatggggcgcagatttgttttg

SEQ ID NO: 112434 - DNA, 226 bp, Homo sapiens; identical to SEQ ID NO: 36297
  chr16:86541633-86541859
  Hyper

SEQ ID NO: 112435 - DNA, 466 bp, Homo sapiens
  chr16:86542207-86542673
  Hyper
cctggagggagaggccgcgcccggccagcagtcgctgcgagagcagcactcacctgggtctgtgcgcgccgcgatgcgccggggctcctgcgctgtcctgcgctccgctctcggcaccacctttcgtggctccaccgcccccagcccgcacccgagcgctgaggtggcaagggcaggtctgcgtgcgagccccctgcgggctggcagccaggtgcgcgagggccgcccttgccggcgctcccagcccgcgctgtctgctctcaggaacctggcctggcgcgcagtgtcagaggccccgcggcggcggcaggccgagcccacaggggcattaggccaactcccccctcccgccctgcgcacgcggaattctctattattattattaaagaatcccccagaacttgtttacgttaaaccctgtaaacttcctgccagggcctttgccatctctcgggaaatcggaacc

SEQ ID NO: 112436 - DNA, 33 bp, Homo sapiens; identical to SEQ ID NO: 79583
  chr16:86543017-86543050
  Hyper

SEQ ID NO: 112437 - DNA, 30 bp, Homo sapiens; identical to SEQ ID NO: 79584
  chr16:86543320-86543350
  Hyper

SEQ ID NO: 112438 - DNA, 199 bp, Homo sapiens; identical to SEQ ID NO: 79585
  chr16:86543623-86543822
  Hyper

SEQ ID NO: 112439 - DNA, 984 bp, Homo sapiens
  chr16:86544174-86545158
  Hyper
gatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccagcgagttcatgttcgaggagggctcctttcggcggcggccgcgcggcttccgaaggaaatgccaggcgctcaagcccatgtacagcatgatgaacgggctcggcttcaaccacctcccggacacctacggcttccagggctcggccggcggcctctcgtgcccgcccaacagcctggcgctggagggcggcctgggcatgatgaacggccacttgccgggcaacgtggacggcatggccctgcccagccactcggtgccccacctgccttccaacggcggccactcgtacatgggcggctgcggcggcgcggcggccggcgagtacccgcaccacgacagctcggtgcccgcctccccgctgctgcccaccggcgccggtggggtcatggagccgcacgccgtctactcgggctcggcggcggcctggccgccctcggcgtccgcggcgctcaacagcggcgcctcttatatcaagcagcagcccctgtccccctgtaaccccgcggccaaccccctgtccggcagcctctccacgcactccctggagcagccgtatctgcaccagaacagccacaacgccccagccgagctgcaaggtga

SEQ ID NO: 112440 - DNA, 30 bp, Homo sapiens
  chr16:86549567-86549597
  Hyper
tcatctccttgccttcgcttcagcgggatc

SEQ ID NO: 112441 - DNA, 30 bp, Homo sapiens; identical to SEQ ID NO: 79588
  chr16:86556449-86556479
  Hypo

SEQ ID NO: 112442 - DNA, 30 bp, Homo sapiens; identical to SEQ ID NO: 79589
  chr16:86564966-86564996
  Hypo

SEQ ID NO: 112443 - DNA, 30 bp, Homo sapiens; identical to SEQ ID NO: 79590
  chr16:86589626-86589656
  Hypo

SEQ ID NO: 112444 - DNA, 844 bp, Homo sapiens
  chr16:86599203-86600047
  Hyper
ccgtttgcaatcaaccgctcacccagtcttcccacggagcgcgctccctaactcaccctacccacccaacaaaacaaaaaaaaggctgaaatatagaaaagcaacttggaggctcccagggggacgttgccaggagcaggaggcagggacagcgccctagggtcggtgttagcggccggcgccggcctgggccacgggaaacgtccacgcttggtgcccgcggtgcgcggcgctcattgcgcgcgccttcgagccaagcccccgcggaaaacaggctcgggtttctcctcgcagggcccaggaactcggctctgcctggcccgggtgggtcgctgcattgtcccggtcttctgggagtgcggggtcagcttgttagagggaatttctacctgggaaaagggagacgagtttcgaagctgaagttggtaggctgcgagtgtccacgcgggagacgaaagggggaaatagcagagtcacttcacccttttccccaaaccccacaaaactgctcgcagcgacgcggatgatctaccgaattccccgcgaattcggaggattaagttgtcagtcagcacgttgctaccttcccctctatgcactccgctgcctggctcctcggcggggagcgagggaaactcagtttgtagggtttacctctaaaacctcgataggttatccttgacgaccccgagcctggaaactccctgttgatgattaattatttgattaaataagtataacatccaggagaggccctgccattccaatccagcgcgtttgctttgaatccattacacctgggcccccataattaggaaatctaattattcgcttcatcactcat

SEQ ID NO: 112445 - DNA, 2264 bp, Homo sapiens
  chr16:86600250-86602514
  Hyper
gttttcaagtgaagacggagtcgccgcggaggccggggcggcggggtcttagagccgacggattcctgcgctcctcgccccgattggcgccgactcctctcagctgccgggtgattggctcaaagttccgggagggggcgtggcccgaggaaagtaaaaactcgctttcagcaagaagacttttgaaacttttcccaatccctaaaagggacttggcctctttttctgggctcagcggggcagccgctcggaccccggcgcgctgaccctcggggctgccgattcgctgggggcttggagagcctcctgcgcccctcctcgcgcgggccgagggtccacctgggtccccaggccgcggcgtctccgctgggtccgcggccgcccgcctgcccgcgctgccgccgccgggtcctggagccagcgaggagcggggccggcgctgcgcttgcccggggcgcgccctccaggatgccgatccgcccggtccgctgaaagcgcgcgcccctgctcggcccgagcgccgccgcccgcgcaccctcgccccggaggctgccaggagcccggggccgcccctcccgctcccctcctctccccctctggctctctcgcgctctctcgctctcagggcccccctcgctcccccggccgcagtccgtgcgcgagggcgccggcgagccgtctcggaagcagcatgcaggcgcgctactccgtgtccgaccccaacgccctgggagtggtgccctacctgagcgagcagaattactaccgggctgcgggcagctacggcggcatggccagccccatgggcgtctattccggccacccggagcagtacagcgcggggatgggccgctcctacgcgccctaccaccaccaccagcccgcggcgcctaaggacctggtgaagccgccctacagctacatcgcgctcatcaccatggccatccagaacgcgcccgagaagaagatcaccttgaacggcatctaccagttcatcatggaccgcttccccttctaccgggagaacaagcagggctggcagaacagcatccgccacaacctctcgctcaacgagtgcttcgtcaaggtgccccgcgacgacaagaagcccggcaagggcagttactggaccctggacccggactcctacaacatgttcgagaacggcagcttcctgcggcgccggcggcgcttcaaaaagaaggacgtgtccaaggagaaggaggagcgggcccacctcaaggagccgcccccggcggcgtccaagggcgccccggccaccccccacctagcggacgcccccaaggaggccgagaagaaggtggtgatcaagagcgaggcggcgtccccggcgctgccggtcatcaccaaggtggagacgctgagccccgagagcgcgctgcagggcagcccgcgcagcgcggcctccacgcccgccggctcccccgacggctcgctgccggagcaccacgccgcggcgcccaacgggctgcctggcttcagcgtggagaacatcatgaccctgcgaacgtcgccgccgggcggagagctgagcccgggggccggacgcgcgggcctggtggtgccgccgctggcgctgccctacgccgccgcgccgcccgccgcctacggccagccgtgcgctcagggcctggaggccggggccgccgggggctaccagtgcagcatgcgagcgatgagcctgtacaccggggccgagcggccggcgcacatgtgcgtcccgcccgccctggacgaggccctctcggaccacccgagcggccccacgtcgcccctgagcgctctcaacctcgccgccggccaggagggcgcgctcgccgccacgggccaccaccaccagcaccacggccaccaccacccgcaggcgccgccgcccccgccggctccccagccccagccgacgccgcagcccggggccgccgcggcgcaggcggcctcctggtatctcaaccacagcggggacctgaaccacctccccggccacacgttcgcggcccagcagcaaactttccccaacgtgcgggagatgttcaactcccaccggctggggattgagaactcgaccctcggggagtcccaggtgagtggcaatgccagctgccagctgccctacagatccacgccgcctctctatcgccacgcagccccctactcctacgactgcacgaaatactgacgtgtcccgggacctcccctccccggcccgctccggcttcgcttcccagccccgacccaaccagaca

SEQ ID NO: 112446 - DNA, 36 bp, Homo sapiens
  chr16:86612879-86612915
  Hyper
cccgcctgcaggcagcgcccgcgggcccctcgcccc

SEQ ID NO: 112447 - DNA, 30 bp, Homo sapiens; identical to SEQ ID NO: 79595
  chr16:86740720-86740750
  Hypo

SEQ ID NO: 112448 - DNA, 36 bp, Homo sapiens; identical to SEQ ID NO: 79596
  chr16:86741248-86741284
  Hypo

SEQ ID NO: 112449 - DNA, 91 bp, Homo sapiens; identical to SEQ ID NO: 79597
  chr16:86775015-86775106
  Hyper

SEQ ID NO: 112450 - DNA, 42 bp, Homo sapiens; identical to SEQ ID NO: 79598
  chr16:86824590-86824632
  Hypo

SEQ ID NO: 112451 - DNA, 30 bp, Homo sapiens; identical to SEQ ID NO: 79599
  chr16:86828224-86828254
  Hypo

SEQ ID NO: 112452 - DNA, 279 bp, Homo sapiens; identical to SEQ ID NO: 79600
  chr16:86878223-86878502
  Hypo

SEQ ID NO: 112453 - DNA, 38 bp, Homo sapiens; identical to SEQ ID NO: 44803
  chr16:86903475-86903513
  Hypo

SEQ ID NO: 112454 - DNA, 85 bp, Homo sapiens; identical to SEQ ID NO: 79602
  chr16:86950939-86951024
  Hypo

SEQ ID NO: 112455 - DNA, 30 bp, Homo sapiens; identical to SEQ ID NO: 79603
  chr16:86951460-86951490
  Hypo

SEQ ID NO: 112456 - DNA, 72 bp, Homo sapiens; identical to SEQ ID NO: 79604
  chr16:86981285-86981357
  Hypo

SEQ ID NO: 112457 - DNA, 30 bp, Homo sapiens; identical to SEQ ID NO: 79605
  chr16:87020868-87020898
  Hypo

SEQ ID NO: 112458 - DNA, 88 bp, Homo sapiens; identical to SEQ ID NO: 79606
  chr16:87022637-87022725
  Hypo

SEQ ID NO: 112459 - DNA, 164 bp, Homo sapiens; identical to SEQ ID NO: 79607
  chr16:87052288-87052452
  Hypo

SEQ ID NO: 112460 - DNA, 30 bp, Homo sapiens; identical to SEQ ID NO: 79608
  chr16:87091202-87091232
  Hypo

SEQ ID NO: 112461 - DNA, 245 bp, Homo sapiens; identical to SEQ ID NO: 79609
  chr16:87092376-87092621
  Hypo

SEQ ID NO: 112462 - DNA, 30 bp, Homo sapiens; identical to SEQ ID NO: 79611
  chr16:87100260-87100290
  Hypo

SEQ ID NO: 112463 - DNA, 30 bp, Homo sapiens; identical to SEQ ID NO: 79612
  chr16:87106180-87106210
  Hypo

SEQ ID NO: 112464 - DNA, 54 bp, Homo sapiens; identical to SEQ ID NO: 79613
  chr16:87158485-87158539
  Hypo

SEQ ID NO: 112465 - DNA, 77 bp, Homo sapiens; identical to SEQ ID NO: 79614
  chr16:87178999-87179076
  Hypo

SEQ ID NO: 112466 - DNA, 131 bp, Homo sapiens; identical to SEQ ID NO: 79615
  chr16:87186183-87186314
  Hypo

SEQ ID NO: 112467 - DNA, 247 bp, Homo sapiens; identical to SEQ ID NO: 79616
  chr16:87187799-87188046
  Hypo

SEQ ID NO: 112468 - DNA, 194 bp, Homo sapiens; identical to SEQ ID NO: 79617
  chr16:87215623-87215817
  Hypo

SEQ ID NO: 112469 - DNA, 30 bp, Homo sapiens; identical to SEQ ID NO: 79618
  chr16:87221538-87221568
  Hypo

SEQ ID NO: 112470 - DNA, 30 bp, Homo sapiens; identical to SEQ ID NO: 79619
  chr16:87249934-87249964
  Hypo

SEQ ID NO: 112471 - DNA, 33 bp, Homo sapiens; identical to SEQ ID NO: 79620
  chr16:87253357-87253390
  Hypo

SEQ ID NO: 112472 - DNA, 104 bp, Homo sapiens; identical to SEQ ID NO: 79621
  chr16:87262420-87262524
  Hypo

SEQ ID NO: 112473 - DNA, 30 bp, Homo sapiens; identical to SEQ ID NO: 79622
  chr16:87273793-87273823
  Hypo

SEQ ID NO: 112474 - DNA, 30 bp, Homo sapiens; identical to SEQ ID NO: 79623
  chr16:87284714-87284744
  Hypo

SEQ ID NO: 112475 - DNA, 147 bp, Homo sapiens; identical to SEQ ID NO: 16090
  chr16:87296936-87297083
  Hypo

SEQ ID NO: 112476 - DNA, 40 bp, Homo sapiens; identical to SEQ ID NO: 79625
  chr16:87300104-87300144
  Hypo

SEQ ID NO: 112477 - DNA, 30 bp, Homo sapiens; identical to SEQ ID NO: 79626
  chr16:87311858-87311888
  Hypo

SEQ ID NO: 112478 - DNA, 36 bp, Homo sapiens; identical to SEQ ID NO: 79627
  chr16:87312099-87312135
  Hypo

SEQ ID NO: 112479 - DNA, 135 bp, Homo sapiens; identical to SEQ ID NO: 44808
  chr16:87354991-87355126
  Hypo

SEQ ID NO: 112480 - DNA, 202 bp, Homo sapiens; identical to SEQ ID NO: 79629
  chr16:87356769-87356971
  Hypo

SEQ ID NO: 112481 - DNA, 32 bp, Homo sapiens; identical to SEQ ID NO: 79630
  chr16:87418168-87418200
  Hyper

SEQ ID NO: 112482 - DNA, 85 bp, Homo sapiens; identical to SEQ ID NO: 44810
  chr16:87421370-87421455
  Hypo

SEQ ID NO: 112483 - DNA, 207 bp, Homo sapiens; identical to SEQ ID NO: 79632
  chr16:87583661-87583868
  Hypo

SEQ ID NO: 112484 - DNA, 78 bp, Homo sapiens; identical to SEQ ID NO: 79633
  chr16:87584344-87584422
  Hypo

SEQ ID NO: 112485 - DNA, 146 bp, Homo sapiens; identical to SEQ ID NO: 79634
  chr16:87594957-87595103
  Hypo

SEQ ID NO: 112486 - DNA, 40 bp, Homo sapiens; identical to SEQ ID NO: 79635
  chr16:87622634-87622674
  Hyper

SEQ ID NO: 112487 - DNA, 391 bp, Homo sapiens; identical to SEQ ID NO: 79636
  chr16:87635070-87635461
  Hyper

SEQ ID NO: 112488 - DNA, 87 bp, Homo sapiens; identical to SEQ ID NO: 79637
  chr16:87635740-87635827
  Hyper

SEQ ID NO: 112489 - DNA, 1123 bp, Homo sapiens
  chr16:87636197-87637320
  Hyper
gccgccgccgccccgcgcccggcccgcggcccccaatatggtgcagccgccagcgccgccgcccgtgccgccgccgccgcccgcgggccccgccgccgccctcgggcgcccgcagcgcggcagccgcaggtggggggccgcggcccgggcctgagctgccccccgcccggcctcggcgcggcgccctccccgcggggctgccggcgaggggccctctcgccgctgaggtggagccgcgggccccgccgccgccgctcctgccccctccctccctcctcccctccccctcccctccggtcctgtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaagccacggcggctcctggctacaggttgccccgctgcctggtgggg

SEQ ID NO: 112490 - DNA, 193 bp, Homo sapiens; identical to SEQ ID NO: 79641
  chr16:87637541-87637734
  Hyper

SEQ ID NO: 112491 - DNA, 138 bp, Homo sapiens; identical to SEQ ID NO: 79642
  chr16:87648265-87648403
  Hypo

SEQ ID NO: 112492 - DNA, 30 bp, Homo sapiens; identical to SEQ ID NO: 79643
  chr16:87657914-87657944
  Hypo

SEQ ID NO: 112493 - DNA, 36 bp, Homo sapiens; identical to SEQ ID NO: 79644
  chr16:87678053-87678089
  Hypo

SEQ ID NO: 112494 - DNA, 30 bp, Homo sapiens; identical to SEQ ID NO: 79645
  chr16:87681285-87681315
  Hypo

SEQ ID NO: 112495 - DNA, 281 bp, Homo sapiens; identical to SEQ ID NO: 79646
  chr16:87688422-87688703
  Hypo

SEQ ID NO: 112496 - DNA, 30 bp, Homo sapiens; identical to SEQ ID NO: 44814
  chr16:87701846-87701876
  Hypo

SEQ ID NO: 112497 - DNA, 232 bp, Homo sapiens; identical to SEQ ID NO: 79648
  chr16:87714174-87714406
  Hypo

SEQ ID NO: 112498 - DNA, 32 bp, Homo sapiens; identical to SEQ ID NO: 79649
  chr16:87718103-87718135
  Hypo

SEQ ID NO: 112499 - DNA, 30 bp, Homo sapiens; identical to SEQ ID NO: 79650
  chr16:87718416-87718446
  Hypo

SEQ ID NO: 112500 - DNA, 103 bp, Homo sapiens; identical to SEQ ID NO: 79651
  chr16:87721480-87721583
  Hypo

SEQ ID NO: 112501 - DNA, 30 bp, Homo sapiens; identical to SEQ ID NO: 79652
  chr16:87722716-87722746
  Hypo

SEQ ID NO: 112502 - DNA, 1244 bp, Homo sapiens; identical to SEQ ID NO: 79653
  chr16:87723113-87724357
  Hypo

SEQ ID NO: 112503 - DNA, 20 bp, Homo sapiens
  chr16:87726991-87727011
  Hypo
tttcttggccaggcacggtg

SEQ ID NO: 112504 - DNA, 30 bp, Homo sapiens; identical to SEQ ID NO: 79655
  chr16:87728594-87728624
  Hypo

SEQ ID NO: 112505 - DNA, 30 bp, Homo sapiens; identical to SEQ ID NO: 79656
  chr16:87740397-87740427
  Hypo

SEQ ID NO: 112506 - DNA, 30 bp, Homo sapiens; identical to SEQ ID NO: 79657
  chr16:87740741-87740771
  Hypo

SEQ ID NO: 112507 - DNA, 78 bp, Homo sapiens; identical to SEQ ID NO: 79660
  chr16:87864575-87864653
  Hypo

SEQ ID NO: 112508 - DNA, 81 bp, Homo sapiens; identical to SEQ ID NO: 79662
  chr16:87905808-87905889
  Hypo

SEQ ID NO: 112509 - DNA, 59 bp, Homo sapiens; identical to SEQ ID NO: 79663
  chr16:87911217-87911276
  Hypo

SEQ ID NO: 112510 - DNA, 60 bp, Homo sapiens; identical to SEQ ID NO: 79664
  chr16:87916269-87916329
  Hypo

SEQ ID NO: 112511 - DNA, 30 bp, Homo sapiens; identical to SEQ ID NO: 79665
  chr16:87941554-87941584
  Hypo

SEQ ID NO: 112512 - DNA, 30 bp, Homo sapiens; identical to SEQ ID NO: 79666
  chr16:87960551-87960581
  Hypo

SEQ ID NO: 112513 - DNA, 30 bp, Homo sapiens; identical to SEQ ID NO: 79667
  chr16:87979832-87979862
  Hypo

SEQ ID NO: 112514 - DNA, 30 bp, Homo sapiens; identical to SEQ ID NO: 79668
  chr16:88056313-88056343
  Hypo

SEQ ID NO: 112515 - DNA, 81 bp, Homo sapiens; identical to SEQ ID NO: 79669
  chr16:88092513-88092594
  Hypo

SEQ ID NO: 112516 - DNA, 30 bp, Homo sapiens; identical to SEQ ID NO: 79670
  chr16:88098353-88098383
  Hypo

SEQ ID NO: 112517 - DNA, 48 bp, Homo sapiens; identical to SEQ ID NO: 44817
  chr16:88101496-88101544
  Hypo

SEQ ID NO: 112518 - DNA, 158 bp, Homo sapiens; identical to SEQ ID NO: 79672
  chr16:88101811-88101969
  Hypo

SEQ ID NO: 112519 - DNA, 66 bp, Homo sapiens; identical to SEQ ID NO: 79673
  chr16:88107013-88107079
  Hypo

SEQ ID NO: 112520 - DNA, 30 bp, Homo sapiens; identical to SEQ ID NO: 79674
  chr16:88133222-88133252
  Hypo

SEQ ID NO: 112521 - DNA, 99 bp, Homo sapiens; identical to SEQ ID NO: 79675
  chr16:88137279-88137378
  Hypo

SEQ ID NO: 112522 - DNA, 47 bp, Homo sapiens; identical to SEQ ID NO: 79676
  chr16:88138197-88138244
  Hypo

SEQ ID NO: 112523 - DNA, 237 bp, Homo sapiens; identical to SEQ ID NO: 79677
  chr16:88164335-88164572
  Hypo

SEQ ID NO: 112524 - DNA, 215 bp, Homo sapiens; identical to SEQ ID NO: 79678
  chr16:88165545-88165760
  Hypo

SEQ ID NO: 112525 - DNA, 30 bp, Homo sapiens; identical to SEQ ID NO: 79679
  chr16:88179063-88179093
  Hypo

SEQ ID NO: 112526 - DNA, 30 bp, Homo sapiens; identical to SEQ ID NO: 79680
  chr16:88216917-88216947
  Hypo

SEQ ID NO: 112527 - DNA, 40 bp, Homo sapiens; identical to SEQ ID NO: 79683
  chr16:88261467-88261507
  Hypo

SEQ ID NO: 112528 - DNA, 30 bp, Homo sapiens; identical to SEQ ID NO: 79684
  chr16:88317274-88317304
  Hypo

SEQ ID NO: 112529 - DNA, 150 bp, Homo sapiens; identical to SEQ ID NO: 79686
  chr16:88355986-88356136
  Hypo

SEQ ID NO: 112530 - DNA, 138 bp, Homo sapiens; identical to SEQ ID NO: 79687
  chr16:88358687-88358825
  Hypo

SEQ ID NO: 112531 - DNA, 30 bp, Homo sapiens; identical to SEQ ID NO: 79689
  chr16:88369078-88369108
  Hypo

SEQ ID NO: 112532 - DNA, 45 bp, Homo sapiens; identical to SEQ ID NO: 79690
  chr16:88374282-88374327
  Hypo

SEQ ID NO: 112533 - DNA, 85 bp, Homo sapiens; identical to SEQ ID NO: 44820
  chr16:88375259-88375344
  Hypo

SEQ ID NO: 112534 - DNA, 180 bp, Homo sapiens; identical to SEQ ID NO: 79692
  chr16:88387108-88387288
  Hypo

SEQ ID NO: 112535 - DNA, 87 bp, Homo sapiens; identical to SEQ ID NO: 79693
  chr16:88442772-88442859
  Hypo

SEQ ID NO: 112536 - DNA, 1179 bp, Homo sapiens; identical to SEQ ID NO: 79694
  chr16:88449274-88450453
  Hyper

SEQ ID NO: 112537 - DNA, 42 bp, Homo sapiens; identical to SEQ ID NO: 79695
  chr16:88460646-88460688
  Hypo

SEQ ID NO: 112538 - DNA, 39 bp, Homo sapiens; identical to SEQ ID NO: 79696
  chr16:88464766-88464805
  Hypo

SEQ ID NO: 112539 - DNA, 32 bp, Homo sapiens; identical to SEQ ID NO: 79697
  chr16:88473761-88473793
  Hypo

SEQ ID NO: 112540 - DNA, 210 bp, Homo sapiens; identical to SEQ ID NO: 79698
  chr16:88476104-88476314
  Hypo

SEQ ID NO: 112541 - DNA, 41 bp, Homo sapiens; identical to SEQ ID NO: 79699
  chr16:88480893-88480934
  Hypo

SEQ ID NO: 112542 - DNA, 30 bp, Homo sapiens; identical to SEQ ID NO: 79700
  chr16:88484563-88484593
  Hypo

SEQ ID NO: 112543 - DNA, 170 bp, Homo sapiens; identical to SEQ ID NO: 44822
  chr16:88495551-88495721
  Hypo

SEQ ID NO: 112544 - DNA, 112 bp, Homo sapiens
  chr16:88496986-88497098
  Hyper
aggaagaggaaggctcggggcggcgcctggggcaaggagctcattctgaagatcgtgcagcagaagaacaggcgccaccggcggctggggcggcgggcgggcaggtgcggct

SEQ ID NO: 112545 - DNA, 52 bp, Homo sapiens
  chr16:88497335-88497387
  Hyper
cgaaccccgaggagccgggcgggtctcgcccgggccccggcaggagccctca

SEQ ID NO: 112546 - DNA, 743 bp, Homo sapiens; identical to SEQ ID NO: 79703
  chr16:88498119-88498862
  Hypo

SEQ ID NO: 112547 - DNA, 30 bp, Homo sapiens; identical to SEQ ID NO: 79704
  chr16:88501699-88501729
  Hypo

SEQ ID NO: 112548 - DNA, 207 bp, Homo sapiens; identical to SEQ ID NO: 79705
  chr16:88502150-88502357
  Hypo

SEQ ID NO: 112549 - DNA, 30 bp, Homo sapiens; identical to SEQ ID NO: 44826
  chr16:88502901-88502931
  Hypo

SEQ ID NO: 112550 - DNA, 520 bp, Homo sapiens; identical to SEQ ID NO: 79707
  chr16:88503229-88503749
  Hypo

SEQ ID NO: 112551 - DNA, 763 bp, Homo sapiens; identical to SEQ ID NO: 79708
  chr16:88504017-88504780
  Hypo

SEQ ID NO: 112552 - DNA, 195 bp, Homo sapiens; identical to SEQ ID NO: 79709
  chr16:88506346-88506541
  Hypo

SEQ ID NO: 112553 - DNA, 462 bp, Homo sapiens; identical to SEQ ID NO: 79710
  chr16:88506828-88507290
  Hypo

SEQ ID NO: 112554 - DNA, 160 bp, Homo sapiens; identical to SEQ ID NO: 79711
  chr16:88507982-88508142
  Hypo

SEQ ID NO: 112555 - DNA, 274 bp, Homo sapiens; identical to SEQ ID NO: 79712
  chr16:88512417-88512691
  Hypo

SEQ ID NO: 112556 - DNA, 64 bp, Homo sapiens; identical to SEQ ID NO: 79713
  chr16:88534612-88534676
  Hypo

SEQ ID NO: 112557 - DNA, 30 bp, Homo sapiens; identical to SEQ ID NO: 79714
  chr16:88548193-88548223
  Hypo

SEQ ID NO: 112558 - DNA, 30 bp, Homo sapiens; identical to SEQ ID NO: 79715
  chr16:88550771-88550801
  Hypo

SEQ ID NO: 112559 - DNA, 168 bp, Homo sapiens; identical to SEQ ID NO: 79716
  chr16:88551406-88551574
  Hypo

SEQ ID NO: 112560 - DNA, 30 bp, Homo sapiens; identical to SEQ ID NO: 79717
  chr16:88594593-88594623
  Hypo

SEQ ID NO: 112561 - DNA, 170 bp, Homo sapiens; identical to SEQ ID NO: 79718
  chr16:88601509-88601679
  Hypo

SEQ ID NO: 112562 - DNA, 51 bp, Homo sapiens; identical to SEQ ID NO: 44837
  chr16:88602946-88602997
  Hypo

SEQ ID NO: 112563 - DNA, 80 bp, Homo sapiens; identical to SEQ ID NO: 79720
  chr16:88603696-88603776
  Hypo

SEQ ID NO: 112564 - DNA, 30 bp, Homo sapiens; identical to SEQ ID NO: 79721
  chr16:88622299-88622329
  Hypo

SEQ ID NO: 112565 - DNA, 205 bp, Homo sapiens; identical to SEQ ID NO: 79722
  chr16:88623960-88624165
  Hypo

SEQ ID NO: 112566 - DNA, 19 bp, Homo sapiens
  chr16:88624548-88624567
  Hypo
aaaatacataaaaggcgga

SEQ ID NO: 112567 - DNA, 559 bp, Homo sapiens; identical to SEQ ID NO: 79724
  chr16:88624747-88625306
  Hypo

SEQ ID NO: 112568 - DNA, 30 bp, Homo sapiens; identical to SEQ ID NO: 79725
  chr16:88627634-88627664
  Hypo

SEQ ID NO: 112569 - DNA, 40 bp, Homo sapiens; identical to SEQ ID NO: 79726
  chr16:88629600-88629640
  Hypo

SEQ ID NO: 112570 - DNA, 95 bp, Homo sapiens; identical to SEQ ID NO: 79727
  chr16:88633091-88633186
  Hypo

SEQ ID NO: 112571 - DNA, 397 bp, Homo sapiens; identical to SEQ ID NO: 79728
  chr16:88683701-88684098
  Hypo

SEQ ID NO: 112572 - DNA, 54 bp, Homo sapiens; identical to SEQ ID NO: 79730
  chr16:88709735-88709789
  Hypo

SEQ ID NO: 112573 - DNA, 491 bp, Homo sapiens; identical to SEQ ID NO: 79731
  chr16:88722326-88722817
  Hypo

SEQ ID NO: 112574 - DNA, 30 bp, Homo sapiens; identical to SEQ ID NO: 79732
  chr16:88725656-88725686
  Hypo

SEQ ID NO: 112575 - DNA, 159 bp, Homo sapiens; identical to SEQ ID NO: 79733
  chr16:88757527-88757686
  Hypo

SEQ ID NO: 112576 - DNA, 30 bp, Homo sapiens; identical to SEQ ID NO: 79734
  chr16:88760519-88760549
  Hypo

SEQ ID NO: 112577 - DNA, 30 bp, Homo sapiens; identical to SEQ ID NO: 79735
  chr16:88780737-88780767
  Hypo

SEQ ID NO: 112578 - DNA, 294 bp, Homo sapiens; identical to SEQ ID NO: 79736
  chr16:88791525-88791819
  Hypo

SEQ ID NO: 112579 - DNA, 398 bp, Homo sapiens; identical to SEQ ID NO: 79737
  chr16:88793275-88793673
  Hypo

SEQ ID NO: 112580 - DNA, 148 bp, Homo sapiens; identical to SEQ ID NO: 79738
  chr16:88794012-88794160
  Hypo

SEQ ID NO: 112581 - DNA, 195 bp, Homo sapiens; identical to SEQ ID NO: 79739
  chr16:88794566-88794761
  Hypo

SEQ ID NO: 112582 - DNA, 30 bp, Homo sapiens; identical to SEQ ID NO: 79740
  chr16:88797788-88797818
  Hypo

SEQ ID NO: 112583 - DNA, 271 bp, Homo sapiens; identical to SEQ ID NO: 79741
  chr16:88798735-88799006
  Hypo

SEQ ID NO: 112584 - DNA, 90 bp, Homo sapiens; identical to SEQ ID NO: 79742
  chr16:88800047-88800137
  Hypo

SEQ ID NO: 112585 - DNA, 52 bp, Homo sapiens; identical to SEQ ID NO: 79743
  chr16:88801866-88801918
  Hypo

SEQ ID NO: 112586 - DNA, 52 bp, Homo sapiens; identical to SEQ ID NO: 79744
  chr16:88802185-88802237
  Hypo

SEQ ID NO: 112587 - DNA, 54 bp, Homo sapiens; identical to SEQ ID NO: 79745
  chr16:88802631-88802685
  Hypo

SEQ ID NO: 112588 - DNA, 197 bp, Homo sapiens; identical to SEQ ID NO: 79746
  chr16:88803266-88803463
  Hypo

SEQ ID NO: 112589 - DNA, 41 bp, Homo sapiens; identical to SEQ ID NO: 79747
  chr16:88804816-88804857
  Hypo

SEQ ID NO: 112590 - DNA, 90 bp, Homo sapiens; identical to SEQ ID NO: 79748
  chr16:88805842-88805932
  Hypo

SEQ ID NO: 112591 - DNA, 30 bp, Homo sapiens; identical to SEQ ID NO: 79749
  chr16:88822251-88822281
  Hypo

SEQ ID NO: 112592 - DNA, 50 bp, Homo sapiens; identical to SEQ ID NO: 79750
  chr16:88827020-88827070
  Hypo

SEQ ID NO: 112593 - DNA, 193 bp, Homo sapiens; identical to SEQ ID NO: 79751
  chr16:88827321-88827514
  Hypo

SEQ ID NO: 112594 - DNA, 67 bp, Homo sapiens; identical to SEQ ID NO: 79752
  chr16:88831230-88831297
  Hypo

SEQ ID NO: 112595 - DNA, 176 bp, Homo sapiens; identical to SEQ ID NO: 79753
  chr16:88832651-88832827
  Hypo

SEQ ID NO: 112596 - DNA, 41 bp, Homo sapiens; identical to SEQ ID NO: 79754
  chr16:88871924-88871965
  Hypo

SEQ ID NO: 112597 - DNA, 30 bp, Homo sapiens; identical to SEQ ID NO: 79755
  chr16:88875855-88875885
  Hypo

SEQ ID NO: 112598 - DNA, 148 bp, Homo sapiens; identical to SEQ ID NO: 79756
  chr16:88879949-88880097
  Hypo

SEQ ID NO: 112599 - DNA, 39 bp, Homo sapiens; identical to SEQ ID NO: 79757
  chr16:88880594-88880633
  Hypo

SEQ ID NO: 112600 - DNA, 33 bp, Homo sapiens; identical to SEQ ID NO: 79758
  chr16:88881413-88881446
  Hypo

SEQ ID NO: 112601 - DNA, 896 bp, Homo sapiens; identical to SEQ ID NO: 79759
  chr16:88882683-88883579
  Hypo

SEQ ID NO: 112602 - DNA, 126 bp, Homo sapiens; identical to SEQ ID NO: 79761
  chr16:88884153-88884279
  Hypo

SEQ ID NO: 112603 - DNA, 34 bp, Homo sapiens; identical to SEQ ID NO: 79762
  chr16:88898821-88898855
  Hypo

SEQ ID NO: 112604 - DNA, 91 bp, Homo sapiens; identical to SEQ ID NO: 44857
  chr16:88931237-88931328
  Hypo

SEQ ID NO: 112605 - DNA, 47 bp, Homo sapiens; identical to SEQ ID NO: 79764
  chr16:88933367-88933414
  Hypo

SEQ ID NO: 112606 - DNA, 30 bp, Homo sapiens; identical to SEQ ID NO: 79765
  chr16:88934321-88934351
  Hypo

SEQ ID NO: 112607 - DNA, 204 bp, Homo sapiens; identical to SEQ ID NO: 79766
  chr16:88935284-88935488
  Hypo

SEQ ID NO: 112608 - DNA, 220 bp, Homo sapiens; identical to SEQ ID NO: 79767
  chr16:88941005-88941225
  Hypo

SEQ ID NO: 112609 - DNA, 126 bp, Homo sapiens; identical to SEQ ID NO: 79768
  chr16:88941444-88941570
  Hypo

SEQ ID NO: 112610 - DNA, 203 bp, Homo sapiens; identical to SEQ ID NO: 79769
  chr16:88941957-88942160
  Hypo

SEQ ID NO: 112611 - DNA, 178 bp, Homo sapiens; identical to SEQ ID NO: 79770
  chr16:88943054-88943232
  Hypo

SEQ ID NO: 112612 - DNA, 615 bp, Homo sapiens; identical to SEQ ID NO: 79771
  chr16:88943442-88944057
  Hypo

SEQ ID NO: 112613 - DNA, 30 bp, Homo sapiens; identical to SEQ ID NO: 79772
  chr16:88944446-88944476
  Hypo

SEQ ID NO: 112614 - DNA, 94 bp, Homo sapiens; identical to SEQ ID NO: 79773
  chr16:88944924-88945018
  Hypo

SEQ ID NO: 112615 - DNA, 711 bp, Homo sapiens; identical to SEQ ID NO: 79774
  chr16:88945368-88946079
  Hypo

SEQ ID NO: 112616 - DNA, 445 bp, Homo sapiens; identical to SEQ ID NO: 79775
  chr16:88948324-88948769
  Hypo

SEQ ID NO: 112617 - DNA, 30 bp, Homo sapiens; identical to SEQ ID NO: 79776
  chr16:88951851-88951881
  Hypo

SEQ ID NO: 112618 - DNA, 624 bp, Homo sapiens; identical to SEQ ID NO: 79777
  chr16:88952174-88952798
  Hypo

SEQ ID NO: 112619 - DNA, 179 bp, Homo sapiens; identical to SEQ ID NO: 44867
  chr16:88955189-88955368
  Hypo

SEQ ID NO: 112620 - DNA, 619 bp, Homo sapiens; identical to SEQ ID NO: 79779
  chr16:88956093-88956712
  Hypo

SEQ ID NO: 112621 - DNA, 622 bp, Homo sapiens; identical to SEQ ID NO: 44870
  chr16:88957373-88957995
  Hypo

SEQ ID NO: 112622 - DNA, 184 bp, Homo sapiens; identical to SEQ ID NO: 79781
  chr16:88958295-88958479
  Hypo

SEQ ID NO: 112623 - DNA, 81 bp, Homo sapiens; identical to SEQ ID NO: 79782
  chr16:88958818-88958899
  Hypo

SEQ ID NO: 112624 - DNA, 111 bp, Homo sapiens; identical to SEQ ID NO: 79783
  chr16:88960414-88960525
  Hypo

SEQ ID NO: 112625 - DNA, 30 bp, Homo sapiens; identical to SEQ ID NO: 79784
  chr16:88961870-88961900
  Hypo

SEQ ID NO: 112626 - DNA, 347 bp, Homo sapiens; identical to SEQ ID NO: 79785
  chr16:88962615-88962962
  Hypo

SEQ ID NO: 112627 - DNA, 586 bp, Homo sapiens; identical to SEQ ID NO: 79786
  chr16:88963177-88963763
  Hypo

SEQ ID NO: 112628 - DNA, 105 bp, Homo sapiens; identical to SEQ ID NO: 79787
  chr16:88964508-88964613
  Hypo

SEQ ID NO: 112629 - DNA, 51 bp, Homo sapiens; identical to SEQ ID NO: 79788
  chr16:88965028-88965079
  Hypo

SEQ ID NO: 112630 - DNA, 45 bp, Homo sapiens; identical to SEQ ID NO: 79789
  chr16:88965602-88965647
  Hypo

SEQ ID NO: 112631 - DNA, 728 bp, Homo sapiens; identical to SEQ ID NO: 79790
  chr16:88966234-88966962
  Hypo

SEQ ID NO: 112632 - DNA, 1111 bp, Homo sapiens; identical to SEQ ID NO: 79791
  chr16:88967701-88968812
  Hypo

SEQ ID NO: 112633 - DNA, 93 bp, Homo sapiens; identical to SEQ ID NO: 79792
  chr16:88970441-88970534
  Hypo

SEQ ID NO: 112634 - DNA, 131 bp, Homo sapiens; identical to SEQ ID NO: 79793
  chr16:88976603-88976734
  Hypo

SEQ ID NO: 112635 - DNA, 204 bp, Homo sapiens; identical to SEQ ID NO: 79794
  chr16:88977918-88978122
  Hypo

SEQ ID NO: 112636 - DNA, 50 bp, Homo sapiens; identical to SEQ ID NO: 79795
  chr16:88978924-88978974
  Hypo

SEQ ID NO: 112637 - DNA, 30 bp, Homo sapiens; identical to SEQ ID NO: 44881
  chr16:88980132-88980162
  Hypo

SEQ ID NO: 112638 - DNA, 44 bp, Homo sapiens; identical to SEQ ID NO: 79797
  chr16:88990078-88990122
  Hypo

SEQ ID NO: 112639 - DNA, 30 bp, Homo sapiens; identical to SEQ ID NO: 79798
  chr16:88990804-88990834
  Hypo

SEQ ID NO: 112640 - DNA, 30 bp, Homo sapiens; identical to SEQ ID NO: 79799
  chr16:88992350-88992380
  Hypo

SEQ ID NO: 112641 - DNA, 152 bp, Homo sapiens; identical to SEQ ID NO: 79800
  chr16:88993078-88993230
  Hypo

SEQ ID NO: 112642 - DNA, 380 bp, Homo sapiens; identical to SEQ ID NO: 79801
  chr16:88994340-88994720
  Hypo

SEQ ID NO: 112643 - DNA, 71 bp, Homo sapiens; identical to SEQ ID NO: 79802
  chr16:88997925-88997996
  Hypo

SEQ ID NO: 112644 - DNA, 84 bp, Homo sapiens; identical to SEQ ID NO: 79803
  chr16:88999377-88999461
  Hypo

SEQ ID NO: 112645 - DNA, 29 bp, Homo sapiens
  chr16:88999664-88999693
  Hypo
cctcacagtgccacacgtctgcacgcctc

SEQ ID NO: 112646 - DNA, 136 bp, Homo sapiens; identical to SEQ ID NO: 79805
  chr16:89000126-89000262
  Hypo

SEQ ID NO: 112647 - DNA, 199 bp, Homo sapiens; identical to SEQ ID NO: 79806
  chr16:89000985-89001184
  Hypo

SEQ ID NO: 112648 - DNA, 249 bp, Homo sapiens; identical to SEQ ID NO: 79807
  chr16:89006347-89006596
  Hyper

SEQ ID NO: 112649 - DNA, 90 bp, Homo sapiens; identical to SEQ ID NO: 79808
  chr16:89006819-89006909
  Hyper

SEQ ID NO: 112650 - DNA, 481 bp, Homo sapiens; identical to SEQ ID NO: 79809
  chr16:89007308-89007789
  Hyper

SEQ ID NO: 112651 - DNA, 224 bp, Homo sapiens; identical to SEQ ID NO: 79810
  chr16:89008368-89008592
  Hyper

SEQ ID NO: 112652 - DNA, 196 bp, Homo sapiens; identical to SEQ ID NO: 79811
  chr16:89010286-89010482
  Hypo

SEQ ID NO: 112653 - DNA, 41 bp, Homo sapiens; identical to SEQ ID NO: 79812
  chr16:89015672-89015713
  Hypo

SEQ ID NO: 112654 - DNA, 30 bp, Homo sapiens; identical to SEQ ID NO: 79813
  chr16:89016452-89016482
  Hypo

SEQ ID NO: 112655 - DNA, 30 bp, Homo sapiens; identical to SEQ ID NO: 79814
  chr16:89022691-89022721
  Hypo

SEQ ID NO: 112656 - DNA, 412 bp, Homo sapiens; identical to SEQ ID NO: 79815
  chr16:89025720-89026132
  Hypo

SEQ ID NO: 112657 - DNA, 114 bp, Homo sapiens; identical to SEQ ID NO: 79816
  chr16:89028699-89028813
  Hypo

SEQ ID NO: 112658 - DNA, 81 bp, Homo sapiens; identical to SEQ ID NO: 79817
  chr16:89029708-89029789
  Hypo

SEQ ID NO: 112659 - DNA, 201 bp, Homo sapiens; identical to SEQ ID NO: 79818
  chr16:89029849-89030050
  Hypo

SEQ ID NO: 112660 - DNA, 163 bp, Homo sapiens; identical to SEQ ID NO: 79819
  chr16:89047584-89047747
  Hypo

SEQ ID NO: 112661 - DNA, 601 bp, Homo sapiens; identical to SEQ ID NO: 79820
  chr16:89055344-89055945
  Hypo

SEQ ID NO: 112662 - DNA, 364 bp, Homo sapiens; identical to SEQ ID NO: 79821
  chr16:89072463-89072827
  Hypo

SEQ ID NO: 112663 - DNA, 192 bp, Homo sapiens; identical to SEQ ID NO: 79822
  chr16:89084022-89084214
  Hypo

SEQ ID NO: 112664 - DNA, 116 bp, Homo sapiens; identical to SEQ ID NO: 79823
  chr16:89086081-89086197
  Hypo

SEQ ID NO: 112665 - DNA, 37 bp, Homo sapiens; identical to SEQ ID NO: 79824
  chr16:89088526-89088563
  Hypo

SEQ ID NO: 112666 - DNA, 30 bp, Homo sapiens; identical to SEQ ID NO: 79825
  chr16:89090173-89090203
  Hypo

SEQ ID NO: 112667 - DNA, 81 bp, Homo sapiens; identical to SEQ ID NO: 79826
  chr16:89103448-89103529
  Hypo

SEQ ID NO: 112668 - DNA, 30 bp, Homo sapiens; identical to SEQ ID NO: 79827
  chr16:89103807-89103837
  Hypo

SEQ ID NO: 112669 - DNA, 59 bp, Homo sapiens; identical to SEQ ID NO: 79828
  chr16:89104048-89104107
  Hyper

SEQ ID NO: 112670 - DNA, 183 bp, Homo sapiens; identical to SEQ ID NO: 79829
  chr16:89105500-89105683
  Hypo

SEQ ID NO: 112671 - DNA, 184 bp, Homo sapiens; identical to SEQ ID NO: 79830
  chr16:89107642-89107826
  Hypo

SEQ ID NO: 112672 - DNA, 39 bp, Homo sapiens; identical to SEQ ID NO: 79831
  chr16:89108941-89108980
  Hypo

SEQ ID NO: 112673 - DNA, 211 bp, Homo sapiens; identical to SEQ ID NO: 79832
  chr16:89109448-89109659
  Hypo

SEQ ID NO: 112674 - DNA, 30 bp, Homo sapiens; identical to SEQ ID NO: 44896
  chr16:89110091-89110121
  Hypo

SEQ ID NO: 112675 - DNA, 116 bp, Homo sapiens; identical to SEQ ID NO: 79834
  chr16:89115281-89115397
  Hypo

SEQ ID NO: 112676 - DNA, 30 bp, Homo sapiens; identical to SEQ ID NO: 79835
  chr16:89116859-89116889
  Hypo

SEQ ID NO: 112677 - DNA, 943 bp, Homo sapiens; identical to SEQ ID NO: 79836
  chr16:89119921-89120864
  Hypo

SEQ ID NO: 112678 - DNA, 30 bp, Homo sapiens; identical to SEQ ID NO: 79837
  chr16:89121266-89121296
  Hypo

SEQ ID NO: 112679 - DNA, 50 bp, Homo sapiens; identical to SEQ ID NO: 79838
  chr16:89122497-89122547
  Hypo

SEQ ID NO: 112680 - DNA, 30 bp, Homo sapiens; identical to SEQ ID NO: 79839
  chr16:89131236-89131266
  Hypo

SEQ ID NO: 112681 - DNA, 192 bp, Homo sapiens; identical to SEQ ID NO: 79840
  chr16:89134608-89134800
  Hypo

SEQ ID NO: 112682 - DNA, 152 bp, Homo sapiens; identical to SEQ ID NO: 79841
  chr16:89138016-89138168
  Hypo

SEQ ID NO: 112683 - DNA, 43 bp, Homo sapiens; identical to SEQ ID NO: 79842
  chr16:89139238-89139281
  Hypo

SEQ ID NO: 112684 - DNA, 25 bp, Homo sapiens
  chr16:89139536-89139561
  Hypo
cacttacctggagtgcggtggcccc

SEQ ID NO: 112685 - DNA, 104 bp, Homo sapiens; identical to SEQ ID NO: 79844
  chr16:89139951-89140055
  Hypo

SEQ ID NO: 112686 - DNA, 67 bp, Homo sapiens; identical to SEQ ID NO: 79845
  chr16:89140367-89140434
  Hypo

SEQ ID NO: 112687 - DNA, 30 bp, Homo sapiens; identical to SEQ ID NO: 44903
  chr16:89141923-89141953
  Hypo

SEQ ID NO: 112688 - DNA, 88 bp, Homo sapiens; identical to SEQ ID NO: 79847
  chr16:89146026-89146114
  Hypo

SEQ ID NO: 112689 - DNA, 30 bp, Homo sapiens; identical to SEQ ID NO: 79848
  chr16:89146902-89146932
  Hypo

SEQ ID NO: 112690 - DNA, 30 bp, Homo sapiens; identical to SEQ ID NO: 79849
  chr16:89156566-89156596
  Hypo

SEQ ID NO: 112691 - DNA, 30 bp, Homo sapiens; identical to SEQ ID NO: 79851
  chr16:89165849-89165879
  Hypo

SEQ ID NO: 112692 - DNA, 402 bp, Homo sapiens; identical to SEQ ID NO: 44904
  chr16:89172134-89172536
  Hypo

SEQ ID NO: 112693 - DNA, 37 bp, Homo sapiens; identical to SEQ ID NO: 79853
  chr16:89184300-89184337
  Hypo

SEQ ID NO: 112694 - DNA, 81 bp, Homo sapiens; identical to SEQ ID NO: 79854
  chr16:89188334-89188415
  Hypo

SEQ ID NO: 112695 - DNA, 224 bp, Homo sapiens; identical to SEQ ID NO: 79855
  chr16:89189759-89189983
  Hypo

SEQ ID NO: 112696 - DNA, 19 bp, Homo sapiens
  chr16:89202477-89202496
  Hypo
tggccggttcttgtatttt

SEQ ID NO: 112697 - DNA, 192 bp, Homo sapiens
  chr16:89203023-89203215
  Hypo
acagctgaggatggccgaggccggcctgcagctccccaacggcctcctccgggtcaggatgagaggagaggttgccagctttgatgccagccgctcctgcctcccccacctgcctctgtgcctacagcccgcttctgcctcaagatcacacagcgggcttgtgaggccaggggtctccgctgctgctcaagg

SEQ ID NO: 112698 - DNA, 30 bp, Homo sapiens; identical to SEQ ID NO: 79858
  chr16:89216656-89216686
  Hypo

SEQ ID NO: 112699 - DNA, 54 bp, Homo sapiens; identical to SEQ ID NO: 44906
  chr16:89219318-89219372
  Hypo

SEQ ID NO: 112700 - DNA, 94 bp, Homo sapiens; identical to SEQ ID NO: 79860
  chr16:89219597-89219691
  Hypo

SEQ ID NO: 112701 - DNA, 707 bp, Homo sapiens; identical to SEQ ID NO: 44907
  chr16:89220327-89221034
  Hypo

SEQ ID NO: 112702 - DNA, 179 bp, Homo sapiens; identical to SEQ ID NO: 79862
  chr16:89225868-89226047
  Hypo

SEQ ID NO: 112703 - DNA, 458 bp, Homo sapiens; identical to SEQ ID NO: 79863
  chr16:89226262-89226720
  Hypo

SEQ ID NO: 112704 - DNA, 279 bp, Homo sapiens; identical to SEQ ID NO: 79864
  chr16:89242783-89243062
  Hypo

SEQ ID NO: 112705 - DNA, 151 bp, Homo sapiens; identical to SEQ ID NO: 44911
  chr16:89245291-89245442
  Hypo

SEQ ID NO: 112706 - DNA, 143 bp, Homo sapiens; identical to SEQ ID NO: 79866
  chr16:89245643-89245786
  Hypo

SEQ ID NO: 112707 - DNA, 156 bp, Homo sapiens; identical to SEQ ID NO: 79867
  chr16:89254608-89254764
  Hypo

SEQ ID NO: 112708 - DNA, 713 bp, Homo sapiens
  chr16:89267222-89267935
  Hyper
ctagcccagcctctgcgcacctcactgatgggaagcccaccttccccagtctgtgctgaccacgtcagtccctccaagcagagactctgccttggaaagccagcccaaagccacggtctgctgaagacgctggtggtcctgaagcaaattccaggccctgctcccccaccggcgccttcggctccaatcctccagcgccccaggccgccccgcgcctggcagctcccaggcccagattcagcccccgcccggcccctctccgcgggtccggcccgtgcgcgcccgtctgcggcaccgtcgggccggcggccgccccggagcaggaagcccaggaggacggccggggggcccgggtcagaggcgccaggtaggatggagaaaggacacccagggcctcggcgggctgggggcggggagggctgcggggcagcagggacgggggcgcacctgggtgaccgggctttgcaggaggccggcgccgggcagcgcgtagagccagccgcgtgtgcagggccgggtgccgttgcgtgcgggcgcggggcgcgggcccggggcgggtgcagggcgcgggatcggggtagcgcaggagcaggcaggggctcgcggctcgcgtgggccccaggcgcgggatggcggcgtccagcagcgcgggtccgcgcagggcgcgcagcgctgggggcaacagcgtggggtccggtcggcagtggggcgcg

SEQ ID NO: 112709 - DNA, 182 bp, Homo sapiens; identical to SEQ ID NO: 79869
  chr16:89268351-89268533
  Hyper

SEQ ID NO: 112710 - DNA, 178 bp, Homo sapiens; identical to SEQ ID NO: 79870
  chr16:89268813-89268991
  Hyper

SEQ ID NO: 112711 - DNA, 30 bp, Homo sapiens; identical to SEQ ID NO: 44914
  chr16:89311109-89311139
  Hypo

SEQ ID NO: 112712 - DNA, 90 bp, Homo sapiens; identical to SEQ ID NO: 79872
  chr16:89313564-89313654
  Hyper

SEQ ID NO: 112713 - DNA, 39 bp, Homo sapiens; identical to SEQ ID NO: 79873
  chr16:89321968-89322007
  Hypo

SEQ ID NO: 112714 - DNA, 274 bp, Homo sapiens; identical to SEQ ID NO: 79874
  chr16:89323313-89323587
  Hyper

SEQ ID NO: 112715 - DNA, 35 bp, Homo sapiens; identical to SEQ ID NO: 79875
  chr16:89360320-89360355
  Hypo

SEQ ID NO: 112716 - DNA, 121 bp, Homo sapiens; identical to SEQ ID NO: 79876
  chr16:89410313-89410434
  Hypo

SEQ ID NO: 112717 - DNA, 64 bp, Homo sapiens; identical to SEQ ID NO: 79879
  chr16:89531790-89531854
  Hypo

SEQ ID NO: 112718 - DNA, 134 bp, Homo sapiens; identical to SEQ ID NO: 44916
  chr16:89558631-89558765
  Hypo

SEQ ID NO: 112719 - DNA, 42 bp, Homo sapiens; identical to SEQ ID NO: 79881
  chr16:89575654-89575696
  Hypo

SEQ ID NO: 112720 - DNA, 162 bp, Homo sapiens; identical to SEQ ID NO: 79882
  chr16:89575936-89576098
  Hypo

SEQ ID NO: 112721 - DNA, 30 bp, Homo sapiens; identical to SEQ ID NO: 79883
  chr16:89622358-89622388
  Hypo

SEQ ID NO: 112722 - DNA, 27 bp, Homo sapiens
  chr16:89637111-89637138
  Hypo
acaggaggaggtgagcggggattggag

SEQ ID NO: 112723 - DNA, 287 bp, Homo sapiens; identical to SEQ ID NO: 79886
  chr16:89641417-89641704
  Hyper

SEQ ID NO: 112724 - DNA, 88 bp, Homo sapiens
  chr16:89642511-89642599
  Hyper
ccgggccggggctggcgccgagctggggatgcggagaccagagcgggcgcgctgaggccagtggggcgcaaggcggggccccccggag

SEQ ID NO: 112725 - DNA, 45 bp, Homo sapiens; identical to SEQ ID NO: 79889
  chr16:89650665-89650710
  Hypo

SEQ ID NO: 112726 - DNA, 51 bp, Homo sapiens; identical to SEQ ID NO: 79890
  chr16:89651630-89651681
  Hypo

SEQ ID NO: 112727 - DNA, 119 bp, Homo sapiens; identical to SEQ ID NO: 79891
  chr16:89655014-89655133
  Hypo

SEQ ID NO: 112728 - DNA, 30 bp, Homo sapiens; identical to SEQ ID NO: 79892
  chr16:89657693-89657723
  Hypo

SEQ ID NO: 112729 - DNA, 71 bp, Homo sapiens; identical to SEQ ID NO: 79893
  chr16:89663895-89663966
  Hypo

SEQ ID NO: 112730 - DNA, 30 bp, Homo sapiens; identical to SEQ ID NO: 44922
  chr16:89667452-89667482
  Hypo

SEQ ID NO: 112731 - DNA, 96 bp, Homo sapiens; identical to SEQ ID NO: 79895
  chr16:89668332-89668428
  Hypo

SEQ ID NO: 112732 - DNA, 56 bp, Homo sapiens; identical to SEQ ID NO: 79896
  chr16:89674507-89674563
  Hypo

SEQ ID NO: 112733 - DNA, 170 bp, Homo sapiens; identical to SEQ ID NO: 79897
  chr16:89688129-89688299
  Hypo

SEQ ID NO: 112734 - DNA, 402 bp, Homo sapiens; identical to SEQ ID NO: 79898
  chr16:89702599-89703001
  Hypo

SEQ ID NO: 112735 - DNA, 212 bp, Homo sapiens; identical to SEQ ID NO: 79899
  chr16:89704484-89704696
  Hypo

SEQ ID NO: 112736 - DNA, 87 bp, Homo sapiens; identical to SEQ ID NO: 79900
  chr16:89713549-89713636
  Hypo

SEQ ID NO: 112737 - DNA, 17 bp, Homo sapiens
  chr16:89725803-89725820
  Hypo
gggcgcagtggctcacg

SEQ ID NO: 112738 - DNA, 37 bp, Homo sapiens; identical to SEQ ID NO: 44928
  chr16:89763835-89763872
  Hypo

SEQ ID NO: 112739 - DNA, 79 bp, Homo sapiens; identical to SEQ ID NO: 79904
  chr16:89778723-89778802
  Hyper

SEQ ID NO: 112740 - DNA, 92 bp, Homo sapiens; identical to SEQ ID NO: 79906
  chr16:89846148-89846240
  Hypo

SEQ ID NO: 112741 - DNA, 42 bp, Homo sapiens; identical to SEQ ID NO: 79907
  chr16:89855370-89855412
  Hypo

SEQ ID NO: 112742 - DNA, 420 bp, Homo sapiens; identical to SEQ ID NO: 79909
  chr16:89883924-89884344
  Hypo

SEQ ID NO: 112743 - DNA, 93 bp, Homo sapiens; identical to SEQ ID NO: 44930
  chr16:89884896-89884989
  Hypo

SEQ ID NO: 112744 - DNA, 33 bp, Homo sapiens; identical to SEQ ID NO: 44931
  chr16:89885109-89885142
  Hypo

SEQ ID NO: 112745 - DNA, 30 bp, Homo sapiens; identical to SEQ ID NO: 44932
  chr16:89896219-89896249
  Hypo

SEQ ID NO: 112746 - DNA, 852 bp, Homo sapiens; identical to SEQ ID NO: 79913
  chr16:89899963-89900815
  Hypo

SEQ ID NO: 112747 - DNA, 38 bp, Homo sapiens; identical to SEQ ID NO: 79914
  chr16:89901552-89901590
  Hypo

SEQ ID NO: 112748 - DNA, 111 bp, Homo sapiens; identical to SEQ ID NO: 79916
  chr16:89972124-89972235
  Hypo

SEQ ID NO: 112749 - DNA, 126 bp, Homo sapiens
  chr16:89972675-89972801
  Hypo
tcgctgccctgcccccggtaagggagaaaggctgaaatgggagctctgtgtaagccggtcacatgcacgtcccttctgctccgggcggtccacatgcaggcgtgcgtggtgcgggctccctcagca

SEQ ID NO: 112750 - DNA, 32 bp, Homo sapiens; identical to SEQ ID NO: 79918
  chr16:89985113-89985145
  Hyper

SEQ ID NO: 112751 - DNA, 161 bp, Homo sapiens; identical to SEQ ID NO: 79919
  chr16:89992858-89993019
  Hyper

SEQ ID NO: 112752 - DNA, 49 bp, Homo sapiens; identical to SEQ ID NO: 79920
  chr16:90002280-90002329
  Hypo

SEQ ID NO: 112753 - DNA, 40 bp, Homo sapiens; identical to SEQ ID NO: 44936
  chr16:90037700-90037740
  Hypo

SEQ ID NO: 112754 - DNA, 30 bp, Homo sapiens; identical to SEQ ID NO: 79922
  chr16:90048779-90048809
  Hypo

SEQ ID NO: 112755 - DNA, 363 bp, Homo sapiens; identical to SEQ ID NO: 79924
  chr16:90066618-90066981
  Hypo

SEQ ID NO: 112756 - DNA, 157 bp, Homo sapiens; identical to SEQ ID NO: 79925
  chr16:90069167-90069324
  Hypo

SEQ ID NO: 112757 - DNA, 144 bp, Homo sapiens; identical to SEQ ID NO: 80431
  chr17:401156-401300
  Hypo

SEQ ID NO: 112758 - DNA, 35 bp, Homo sapiens; identical to SEQ ID NO: 80729
  chr17:536397-536432
  Hypo

SEQ ID NO: 112759 - DNA, 37 bp, Homo sapiens; identical to SEQ ID NO: 44939
  chr17:616989-617026
  Hypo

SEQ ID NO: 112760 - DNA, 30 bp, Homo sapiens; identical to SEQ ID NO: 80908
  chr17:692622-692652
  Hypo

SEQ ID NO: 112761 - DNA, 57 bp, Homo sapiens; identical to SEQ ID NO: 44940
  chr17:706526-706583
  Hypo

SEQ ID NO: 112762 - DNA, 77 bp, Homo sapiens; identical to SEQ ID NO: 80931
  chr17:708414-708491
  Hypo

SEQ ID NO: 112763 - DNA, 190 bp, Homo sapiens; identical to SEQ ID NO: 81095
  chr17:745634-745824
  Hypo

SEQ ID NO: 112764 - DNA, 30 bp, Homo sapiens; identical to SEQ ID NO: 81518
  chr17:835911-835941
  Hypo

SEQ ID NO: 112765 - DNA, 30 bp, Homo sapiens; identical to SEQ ID NO: 81526
  chr17:851863-851893
  Hypo

SEQ ID NO: 112766 - DNA, 80 bp, Homo sapiens; identical to SEQ ID NO: 81534
  chr17:876820-876900
  Hypo

SEQ ID NO: 112767 - DNA, 63 bp, Homo sapiens; identical to SEQ ID NO: 81548
  chr17:896321-896384
  Hypo

SEQ ID NO: 112768 - DNA, 426 bp, Homo sapiens; identical to SEQ ID NO: 81553
  chr17:915591-916017
  Hypo

SEQ ID NO: 112769 - DNA, 192 bp, Homo sapiens; identical to SEQ ID NO: 81554
  chr17:938024-938216
  Hypo

SEQ ID NO: 112770 - DNA, 47 bp, Homo sapiens; identical to SEQ ID NO: 79969
  chr17:1082429-1082476
  Hyper

SEQ ID NO: 112771 - DNA, 30 bp, Homo sapiens; identical to SEQ ID NO: 79970
  chr17:1082997-1083027
  Hyper

SEQ ID NO: 112772 - DNA, 224 bp, Homo sapiens; identical to SEQ ID NO: 79971
  chr17:1083533-1083757
  Hyper

SEQ ID NO: 112773 - DNA, 30 bp, Homo sapiens; identical to SEQ ID NO: 79974
  chr17:1129316-1129346
  Hypo

SEQ ID NO: 112774 - DNA, 18 bp, Homo sapiens
  chr17:1134324-1134342
  Hypo
attgatctaagaggccgg

SEQ ID NO: 112775 - DNA, 87 bp, Homo sapiens; identical to SEQ ID NO: 79976
  chr17:1136675-1136762
  Hypo

SEQ ID NO: 112776 - DNA, 30 bp, Homo sapiens; identical to SEQ ID NO: 79981
  chr17:1163513-1163543
  Hyper

SEQ ID NO: 112777 - DNA, 702 bp, Homo sapiens
  chr17:1173853-1174555
  Hyper
ggccatgctgcggggcgcgccaggactaggcctcacggcgcggaagggggccgaggactctgcggaggacttggggggcccctgccccgagcccgggggcgattcgggggtgctgggggcgaacggcgcttcctgcagccggggcgaggcggaggagccggcgggcaggaggcgcgcgcggccggtgcggtccaaggcgcggcgcatggccgccaacgtgcgggagcgcaagcgcatcctagactacaacgaggccttcaacgcgctgcgccgggcgctgcggcacgacctgggcggcaagaggctctccaagatcgccacgctgcgcagggccatccaccgcatcgccgcgctctccctggtcctgcgcgccagccccgcgccccgcgggccctgcggacacctggagtgccacggcccggccgcgcgcggggacaccggggacacaggcgccagccccccgccgcctgcagggcccagcctcgcgcgcccagacgccgcccgcccctcggtgccgtccgcgccccgctgcgcctcgtgccccccgcacgcgcccctggcacggcccagtgcggtggccgaggggccgggcctagcacaggcctccgggggaagctggcgccgctgtccgggggcttcctctgccgggccgcctccctggccgcggggctacctgcgatccgcccccgggatgggccatcc

SEQ ID NO: 112778 - DNA, 30 bp, Homo sapiens; identical to SEQ ID NO: 79986
  chr17:1180688-1180718
  Hypo

SEQ ID NO: 112779 - DNA, 30 bp, Homo sapiens; identical to SEQ ID NO: 44946
  chr17:1193094-1193124
  Hypo

SEQ ID NO: 112780 - DNA, 196 bp, Homo sapiens; identical to SEQ ID NO: 80003
  chr17:1387714-1387910
  Hypo

SEQ ID NO: 112781 - DNA, 73 bp, Homo sapiens; identical to SEQ ID NO: 80004
  chr17:1412390-1412463
  Hypo

SEQ ID NO: 112782 - DNA, 18 bp, Homo sapiens
  chr17:1471448-1471466
  Hypo
acccggccactctttcat

SEQ ID NO: 112783 - DNA, 30 bp, Homo sapiens; identical to SEQ ID NO: 80014
  chr17:1472708-1472738
  Hypo

SEQ ID NO: 112784 - DNA, 18 bp, Homo sapiens
  chr17:1479669-1479687
  Hypo
gcccggcccaggaactct

SEQ ID NO: 112785 - DNA, 38 bp, Homo sapiens; identical to SEQ ID NO: 80018
  chr17:1501153-1501191
  Hypo

SEQ ID NO: 112786 - DNA, 25 bp, Homo sapiens
  chr17:1520973-1520998
  Hypo
cacacccagccgatatgcacctttc

SEQ ID NO: 112787 - DNA, 23 bp, Homo sapiens
  chr17:1536225-1536248
  Hypo
atatccaggatatgtcgttaagt

SEQ ID NO: 112788 - DNA, 40 bp, Homo sapiens; identical to SEQ ID NO: 80027
  chr17:1543656-1543696
  Hypo

SEQ ID NO: 112789 - DNA, 49 bp, Homo sapiens; identical to SEQ ID NO: 44952
  chr17:1543917-1543966
  Hypo

SEQ ID NO: 112790 - DNA, 386 bp, Homo sapiens; identical to SEQ ID NO: 80029
  chr17:1544223-1544609
  Hypo

SEQ ID NO: 112791 - DNA, 21 bp, Homo sapiens
  chr17:1545300-1545321
  Hypo
ccaccgcgcccagccagggat

SEQ ID NO: 112792 - DNA, 139 bp, Homo sapiens; identical to SEQ ID NO: 44955
  chr17:1546311-1546450
  Hypo

SEQ ID NO: 112793 - DNA, 38 bp, Homo sapiens; identical to SEQ ID NO: 80038
  chr17:1589533-1589571
  Hypo

SEQ ID NO: 112794 - DNA, 24 bp, Homo sapiens
  chr17:1608003-1608027
  Hypo
tttttttttttgagacggagtctc

SEQ ID NO: 112795 - DNA, 80 bp, Homo sapiens; identical to SEQ ID NO: 80040
  chr17:1623392-1623472
  Hypo

SEQ ID NO: 112796 - DNA, 32 bp, Homo sapiens; identical to SEQ ID NO: 44956
  chr17:1623703-1623735
  Hypo

SEQ ID NO: 112797 - DNA, 142 bp, Homo sapiens; identical to SEQ ID NO: 80044
  chr17:1627248-1627390
  Hypo

SEQ ID NO: 112798 - DNA, 30 bp, Homo sapiens; identical to SEQ ID NO: 80055
  chr17:1675342-1675372
  Hypo

SEQ ID NO: 112799 - DNA, 16 bp, Homo sapiens
  chr17:1696340-1696356
  Hypo
agctgagaccacaagc

SEQ ID NO: 112800 - DNA, 48 bp, Homo sapiens; identical to SEQ ID NO: 80081
  chr17:1811643-1811691
  Hyper

SEQ ID NO: 112801 - DNA, 222 bp, Homo sapiens; identical to SEQ ID NO: 80085
  chr17:1819556-1819778
  Hypo

SEQ ID NO: 112802 - DNA, 30 bp, Homo sapiens; identical to SEQ ID NO: 80086
  chr17:1824581-1824611
  Hypo

SEQ ID NO: 112803 - DNA, 86 bp, Homo sapiens; identical to SEQ ID NO: 80089
  chr17:1832993-1833079
  Hypo

SEQ ID NO: 112804 - DNA, 43 bp, Homo sapiens; identical to SEQ ID NO: 80090
  chr17:1835919-1835962
  Hypo

SEQ ID NO: 112805 - DNA, 30 bp, Homo sapiens; identical to SEQ ID NO: 80094
  chr17:1887214-1887244
  Hypo

SEQ ID NO: 112806 - DNA, 477 bp, Homo sapiens
  chr17:1901493-1901970
  Hyper
cctttgggggaggggcggggagggctgtcgcattgatccggagctgcagggcgagggcggtgcccagacccggcgccccaaggcctcccgcaggccgacccgagccgagcgcgccctttgggcaccggccccgcccgggagggtcttctcgctctagagccgggggcccgcgctgagagatcggggttaccgcgcggggagccgcggccgcgctgggatccgttccctctcgcgggagccgccggccggggatctgcgcaccccacgcgccccgctcgggtcgggcctcccctccccgcggctgcccccgggccggccaccgctgcccagcgcgcaggtccctgccggatccccggcggctttcctgcccccactttacagacgtgaacgctgaggcggagggtgggggacgtggggccggctcgcctcctcctgggctcgccgggatgtggcctccgaggtcgccgcggcgctttc

SEQ ID NO: 112807 - DNA, 300 bp, Homo sapiens; identical to SEQ ID NO: 80100
  chr17:1927406-1927706
  Hyper

SEQ ID NO: 112808 - DNA, 290 bp, Homo sapiens; identical to SEQ ID NO: 80101
  chr17:1927990-1928280
  Hyper

SEQ ID NO: 112809 - DNA, 262 bp, Homo sapiens; identical to SEQ ID NO: 80105
  chr17:1956915-1957177
  Hyper

SEQ ID NO: 112810 - DNA, 115 bp, Homo sapiens; identical to SEQ ID NO: 80106
  chr17:1957480-1957595
  Hyper

SEQ ID NO: 112811 - DNA, 692 bp, Homo sapiens
  chr17:1958942-1959634
  Hyper
gggccaggaggggaacggggtcgggcgggcgagcagcgggcaggggagctcagggctcggctccgggctctgccgccggatttgggggccgcgaggaagagctgcgagccgagggcctggggccggcgcactcctcccgccctgtctgcagttggaaaacttttccccaagtttggggcggcggagttccgggggagaaggggccgggggagccgcggagggaggcgccgggcccgcgcgtgtagggcccaggccgaggccgggacgcgggtggggcgcaggcccgggtcagggccgcagccggctgtgcgccgtgcccgcccggggcgctgccccctccctcccctgggagctgcgtggctcccccctcccccccacctgcttcctgcctcagcctcctgccccgatataacgccctccccgcgccgggcccggccttcgcgctctgcccgccacggcagccgctgcctccgctccccgcgcggccgccgcccgggccccgaccgagggttgacagcccccggccagggcggcgccagggcgggcaccgcgctcccctcctccgtatcacttcccccaactggggcaacttctcccgaggcgggaggcgctggttcctcggctccctttctccctacttgggtaaagttctccgccctgaatgacttttcctgaagcggacattttactta

SEQ ID NO: 112812 - DNA, 30 bp, Homo sapiens; identical to SEQ ID NO: 80124
  chr17:2015149-2015179
  Hypo

SEQ ID NO: 112813 - DNA, 120 bp, Homo sapiens; identical to SEQ ID NO: 80142
  chr17:2207847-2207967
  Hypo

SEQ ID NO: 112814 - DNA, 36 bp, Homo sapiens; identical to SEQ ID NO: 80143
  chr17:2208027-2208063
  Hypo

SEQ ID NO: 112815 - DNA, 86 bp, Homo sapiens; identical to SEQ ID NO: 80144
  chr17:2220973-2221059
  Hypo

SEQ ID NO: 112816 - DNA, 39 bp, Homo sapiens; identical to SEQ ID NO: 80145
  chr17:2237982-2238021
  Hypo

SEQ ID NO: 112817 - DNA, 30 bp, Homo sapiens; identical to SEQ ID NO: 80146
  chr17:2250051-2250081
  Hypo

SEQ ID NO: 112818 - DNA, 66 bp, Homo sapiens; identical to SEQ ID NO: 80147
  chr17:2264699-2264765
  Hypo

SEQ ID NO: 112819 - DNA, 36 bp, Homo sapiens; identical to SEQ ID NO: 80148
  chr17:2270585-2270621
  Hypo

SEQ ID NO: 112820 - DNA, 148 bp, Homo sapiens; identical to SEQ ID NO: 80149
  chr17:2298883-2299031
  Hypo

SEQ ID NO: 112821 - DNA, 44 bp, Homo sapiens; identical to SEQ ID NO: 80150
  chr17:2495626-2495670
  Hypo

SEQ ID NO: 112822 - DNA, 44 bp, Homo sapiens; identical to SEQ ID NO: 80151
  chr17:2529816-2529860
  Hypo

SEQ ID NO: 112823 - DNA, 148 bp, Homo sapiens; identical to SEQ ID NO: 80153
  chr17:2538042-2538190
  Hypo

SEQ ID NO: 112824 - DNA, 929 bp, Homo sapiens
  chr17:2627439-2628368
  Hyper
gacggcgagtcctctcggtagagaaggtgcccccgctcggccccgcggaggaactctcgcgcgaggagagggctcgaagctttggaaacgtcgggaagtacaaaaggctggcggttcggggatttggggggagccggggccgcctcgccccgcttcctggaggaggggcggctgccctccgacccgggacctgcctgcggggaccgagctgcgtccctggccggccctccccgtccgtcccgcgtcaccccggccagcctggcgcctactccgggtccccgggcgcgctgggctggctgggcgcgggctgcgggccggctcggtccgggggctcctggggaggcggctggcgcgggctgcgggcgctgggccgcagcggcctgcgtgcatagaggaagagcgcggggtcgggcatggggtcggcgtcgtcgagggcgccggccccgcggtcccaggcggcccagtcccggccggggcccttggcggcggcctcgtgggcagcaggcgggcggcgggctcgcagtgcgcggcggcgtggcctgggctcggcggtggcgccggggcccgggcgcggggcctgcagtctctggcgcgccgcgtgcagctggcaggagaggtaggcggccgcctcggtgtgcttctgcagctcggtgcccagcacggtggcgcggtggctgcggcggcgcagctcctccaggaagcggcgctcctcggtgcgcaggctgcagcgcagcgcggacaccagcgcctcgcgctgcgccacctcccgccgcagctccgcgttggccgcagcacgcgcctccagctgcgactccagcgcgcggcacttgctctccagctcccgggacgccgcctctggaacggggcagaggccagaggtgacggtctccccctggcttggaacagaacctgcacggctcagagctccg

SEQ ID NO: 112825 - DNA, 40 bp, Homo sapiens; identical to SEQ ID NO: 80176
  chr17:2628710-2628750
  Hypo

SEQ ID NO: 112826 - DNA, 177 bp, Homo sapiens; identical to SEQ ID NO: 80177
  chr17:2634225-2634402
  Hypo

SEQ ID NO: 112827 - DNA, 215 bp, Homo sapiens; identical to SEQ ID NO: 80180
  chr17:2652439-2652654
  Hyper

SEQ ID NO: 112828 - DNA, 38 bp, Homo sapiens; identical to SEQ ID NO: 80184
  chr17:2658821-2658859
  Hyper

SEQ ID NO: 112829 - DNA, 540 bp, Homo sapiens; identical to SEQ ID NO: 80185
  chr17:2659210-2659750
  Hyper

SEQ ID NO: 112830 - DNA, 30 bp, Homo sapiens; identical to SEQ ID NO: 80187
  chr17:2666440-2666470
  Hypo

SEQ ID NO: 112831 - DNA, 315 bp, Homo sapiens; identical to SEQ ID NO: 80188
  chr17:2680183-2680498
  Hyper

SEQ ID NO: 112832 - DNA, 338 bp, Homo sapiens
  chr17:2756263-2756601
  Hyper
cgcagcggccaggcccgggtgggcgcggggagggcggagtggggggcgcccggcccgccaggaggaagcggggtcgccgtgaagttggttattgaacccatgtggagtcaaactcccagggccgggagagccagtgttcgcggggagccgaccccagcccactctgcatcccagctcggcgatccttgcgccgactctgcggggaggcgggggcagaattccgcctcgttcctcccatccgcaagctcccacccggggacccgggcccgggagctgcgagccggggcgggcgccgggctcaggtgccccctgtaagcgctgggcggccgggaggggac

SEQ ID NO: 112833 - DNA, 120 bp, Homo sapiens; identical to SEQ ID NO: 80214
  chr17:2757584-2757704
  Hyper

SEQ ID NO: 112834 - DNA, 99 bp, Homo sapiens; identical to SEQ ID NO: 80224
  chr17:2801121-2801220
  Hypo

SEQ ID NO: 112835 - DNA, 30 bp, Homo sapiens; identical to SEQ ID NO: 80230
  chr17:2831027-2831057
  Hypo

SEQ ID NO: 112836 - DNA, 30 bp, Homo sapiens; identical to SEQ ID NO: 80231
  chr17:2844357-2844387
  Hypo

SEQ ID NO: 112837 - DNA, 272 bp, Homo sapiens; identical to SEQ ID NO: 80234
  chr17:2859276-2859548
  Hypo

SEQ ID NO: 112838 - DNA, 157 bp, Homo sapiens; identical to SEQ ID NO: 80252
  chr17:2952123-2952280
  Hyper

SEQ ID NO: 112839 - DNA, 17 bp, Homo sapiens
  chr17:3036557-3036574
  Hypo
ctcgccagttcccaggc

SEQ ID NO: 112840 - DNA, 28 bp, Homo sapiens
  chr17:3338320-3338348
  Hypo
gagccaccgtgcccggccacacactgtg

SEQ ID NO: 112841 - DNA, 204 bp, Homo sapiens
  chr17:3438826-3439030
  Hyper
cctcctcccagactccgcaccgggcgggggcggcacccaccgaagtagaagccttcgtgttggtacttggggttgaagaaggcccccttggcgtgcgcgttgacgtcggcgccggcggcgatgagcagggctgcgatgtccccctgccgccgctcgatggcgatgttcagcgccgtctgccctgcggagcgggcggggacgcgc

SEQ ID NO: 112842 - DNA, 42 bp, Homo sapiens; identical to SEQ ID NO: 80341
  chr17:3541067-3541109
  Hypo

SEQ ID NO: 112843 - DNA, 81 bp, Homo sapiens; identical to SEQ ID NO: 80342
  chr17:3585002-3585083
  Hypo

SEQ ID NO: 112844 - DNA, 105 bp, Homo sapiens; identical to SEQ ID NO: 80344
  chr17:3599635-3599740
  Hyper

SEQ ID NO: 112845 - DNA, 144 bp, Homo sapiens; identical to SEQ ID NO: 80353
  chr17:3658786-3658930
  Hypo

SEQ ID NO: 112846 - DNA, 143 bp, Homo sapiens; identical to SEQ ID NO: 80354
  chr17:3658990-3659133
  Hypo

SEQ ID NO: 112847 - DNA, 90 bp, Homo sapiens; identical to SEQ ID NO: 80358
  chr17:3686092-3686182
  Hypo

SEQ ID NO: 112848 - DNA, 204 bp, Homo sapiens; identical to SEQ ID NO: 80383
  chr17:3741592-3741796
  Hypo

SEQ ID NO: 112849 - DNA, 30 bp, Homo sapiens; identical to SEQ ID NO: 80384
  chr17:3755004-3755034
  Hypo

SEQ ID NO: 112850 - DNA, 62 bp, Homo sapiens; identical to SEQ ID NO: 80386
  chr17:3769760-3769822
  Hypo

SEQ ID NO: 112851 - DNA, 73 bp, Homo sapiens; identical to SEQ ID NO: 80408
  chr17:3792191-3792264
  Hypo

SEQ ID NO: 112852 - DNA, 227 bp, Homo sapiens; identical to SEQ ID NO: 80421
  chr17:3866983-3867210
  Hyper

SEQ ID NO: 112853 - DNA, 30 bp, Homo sapiens; identical to SEQ ID NO: 80422
  chr17:3907085-3907115
  Hypo

SEQ ID NO: 112854 - DNA, 79 bp, Homo sapiens; identical to SEQ ID NO: 80486
  chr17:4236625-4236704
  Hypo

SEQ ID NO: 112855 - DNA, 32 bp, Homo sapiens; identical to SEQ ID NO: 80527
  chr17:4436418-4436450
  Hypo

SEQ ID NO: 112856 - DNA, 68 bp, Homo sapiens; identical to SEQ ID NO: 80528
  chr17:4446308-4446376
  Hypo

SEQ ID NO: 112857 - DNA, 38 bp, Homo sapiens; identical to SEQ ID NO: 80529
  chr17:4487283-4487321
  Hyper

SEQ ID NO: 112858 - DNA, 786 bp, Homo sapiens; identical to SEQ ID NO: 80545
  chr17:4544270-4545056
  Hyper

SEQ ID NO: 112859 - DNA, 146 bp, Homo sapiens; identical to SEQ ID NO: 80560
  chr17:4622963-4623109
  Hypo

SEQ ID NO: 112860 - DNA, 41 bp, Homo sapiens; identical to SEQ ID NO: 44973
  chr17:4699211-4699252
  Hypo

SEQ ID NO: 112861 - DNA, 30 bp, Homo sapiens; identical to SEQ ID NO: 80678
  chr17:4841792-4841822
  Hypo

SEQ ID NO: 112862 - DNA, 30 bp, Homo sapiens; identical to SEQ ID NO: 80700
  chr17:4891311-4891341
  Hyper

SEQ ID NO: 112863 - DNA, 27 bp, Homo sapiens
  chr17:4976841-4976868
  Hypo
gtgtaataaagcagacggtgggccagg

SEQ ID NO: 112864 - DNA, 615 bp, Homo sapiens
  chr17:4981370-4981985
  Hyper
gagagttaaaagggtcgcgcaaacggtccccgcgggaatgcgaagcggattctcgagttcttgagcctagagcaatgcttggggagcgacacgagggcgcagagcggcagatcgcggagcggaagttcatccccggagccgttctaggaaacccggaggactcaggtcgtcaatgattccggggctgaagtgggcatcgacgggtgcactttgctgttccagggagccggctcggcaggcggcggcgacgtggaacttgggctagggctagaaccggcgaaaagcaagccggaaaaggcaagggggcgtcggtgcgctgaccacctgttcctccagcggagtgcgacgcgcgccgattggctggagtgccgcccgggtaccggaagtggccgatgcccgtcgccagtgacaccgggacaacagctgcgggctctgtgcgagcggcccagcagcgcggagcctcagcggagtgagcgagcgcggggcagtagcggcctgcggtgagacctcattccgtcgcggctgtgggggtaggcgggggctgggctcccagctccctagagagccgagcggaaaccctacgtttaggcccgttctgaccggggttcgctgtgt

SEQ ID NO: 112865 - DNA, 864 bp, Homo sapiens
  chr17:5000354-5001218
  Hyper
cccagtgggaaggagcggggacgattctggcgatcacatgaggaagggagcagcctcagcagcgcaggtggacacagtcgtcaaccactcgctggccgcctgcgacgtgaagcacctgcgctgggcgcggcgggtaagcgccgacactagcgggcgcctgaacagtccagcggcgtcagcgctgcggagcaggaaagggtcccaaacgcagggcggccatgcagcgtggcgcccacctgtccctctcctcgaagcgctgagccagcacgatgcacataagggaaggaggaaggtggcttgagggcagtgaccgagcggacagcggaagcccatttcaggagccccggtacccgagctcgggcccctttccaatcccccaggcgtccttcccatgtccttgtctcctagtcctgggaatccacggccactccactctcctgcagtaccgcggacaagaacaccatgtactcttcacaggcaggtgtcttctggtggacccaactctgttggtacttgtcgtctccaaaaagtccccaaatgcgctagaggccagccagcccggtatccgagaggtaagagccccggcggcgcaggcggaagcgtgtctgtcgcgaggcctctctaggactccgggaggacccctcgttagcgcaggacctcggcagccgggggttgggctcgagggctgagggcggcgcgccatgcgcggattagctgccatccggcgggtctttctgccggggaccagtggggtcggacgctgagggccgaggaaccccgcccccccaccgcaccgggcgggctctggggcgtccgcggaggctcccgcgtgcgtgtgcggggtggggtcggggtggcagttgg

SEQ ID NO: 112866 - DNA, 40 bp, Homo sapiens; identical to SEQ ID NO: 80711
  chr17:5014692-5014732
  Hyper

SEQ ID NO: 112867 - DNA, 30 bp, Homo sapiens; identical to SEQ ID NO: 80717
  chr17:5039277-5039307
  Hypo

SEQ ID NO: 112868 - DNA, 48 bp, Homo sapiens; identical to SEQ ID NO: 80718
  chr17:5094851-5094899
  Hyper

SEQ ID NO: 112869 - DNA, 20 bp, Homo sapiens
  chr17:5320631-5320651
  Hypo
aagtaaatagccaggcgtgg

SEQ ID NO: 112870 - DNA, 120 bp, Homo sapiens; identical to SEQ ID NO: 44976
  chr17:5320771-5320891
  Hypo

SEQ ID NO: 112871 - DNA, 157 bp, Homo sapiens; identical to SEQ ID NO: 80734
  chr17:5436596-5436753
  Hypo

SEQ ID NO: 112872 - DNA, 1050 bp, Homo sapiens
  chr17:5973275-5974325
  Hyper
tgggaagcagtgattcgggatgtgtgtgtcaggcagtgtgcggctgtcgctgtgagtctgcatgggagagtggcggcgtgctctcctctgcgcggcagtgccccgtgtgtttgtgggtctgtgtctgggtgtgagcgtcatggtgcgtgtgttagagcccgtggggccccggtgaaaggctgtggctctgggtgactggtgtgtgtgtgtgtgtgtgtgtgtatcagagtgggtggcggcgtctctgctcggcagtggcgcgtgtggcccgccccgcgcgcgtgttctcgcgggccggggcagggcgtgggccccctccggcggagccgcgacccctcccccgggcggcgggaggtgcgcaccggcgcctctaggacccggcggcggccggccgctgtccccgggccgcgcgagtgagcatgtgcagagcccggcgcccgctcgcccgcccgctgcccgccccggctccgcgcccgcccgcccgccccgccgttcagcccggacgccagcagccccggggagccaggcggcggcgccctgtgcccgggcgcgtgggtccgcttgccgcgggcggccggagacgtgcgggcgccggggcttctgggctccgggcactgcggggggctgcgggctcggcgcccggggaaggcgggccatgggcgcgggtgcgggcgccccagccggccgcgatcgcggggtgagtcctgtctctcggcgctccagccggacccccgcgcgggctgcgagcagggtgttccccttgccgcgggcaaacaagtttgtgcagacgcggttgggagcgcggcggggctgcacctgctccggctgcagggcgggcttgccgggggcaccttcccgggggcccggggcggctcggccggggcaggggagagtgagcgggtgcgtgcaggggttgtgggggggcgggggcggcgctcggcgcggccgggatggggtgggggtgcgcgaggcgccgcacgagccgcgtccccctccggagtcctgagagcccgtccgtcacccgggagggcgctgcggttggtcccgggg

SEQ ID NO: 112873 - DNA, 195 bp, Homo sapiens; identical to SEQ ID NO: 80807
  chr17:6023680-6023875
  Hypo

SEQ ID NO: 112874 - DNA, 30 bp, Homo sapiens; identical to SEQ ID NO: 80815
  chr17:6070721-6070751
  Hypo

SEQ ID NO: 112875 - DNA, 85 bp, Homo sapiens; identical to SEQ ID NO: 80829
  chr17:6120251-6120336
  Hypo

SEQ ID NO: 112876 - DNA, 30 bp, Homo sapiens; identical to SEQ ID NO: 80858
  chr17:6294932-6294962
  Hypo

SEQ ID NO: 112877 - DNA, 221 bp, Homo sapiens; identical to SEQ ID NO: 80859
  chr17:6297080-6297301
  Hypo

SEQ ID NO: 112878 - DNA, 30 bp, Homo sapiens; identical to SEQ ID NO: 80862
  chr17:6347790-6347820
  Hyper

SEQ ID NO: 112879 - DNA, 147 bp, Homo sapiens; identical to SEQ ID NO: 80867
  chr17:6454672-6454819
  Hypo

SEQ ID NO: 112880 - DNA, 37 bp, Homo sapiens; identical to SEQ ID NO: 80868
  chr17:6456361-6456398
  Hypo

SEQ ID NO: 112881 - DNA, 820 bp, Homo sapiens
  chr17:6616271-6617091
  Hyper
gatctgtgctcacttcgaggtttccgtgcttgcctggacggctcttgcgccctgggatctgtaaaccccaagggtggtgcgccctggggtcgccatgcccctcagattctttacagggcacctcccatccggcacctggagctcctgagtgcgcgcgccccgggagagctgtgctccccgcgaaatccgtgcgctccagctcagggctcccgggatcggtgcccgttagtgggcacaggacgccgggtgtccgaagggctgcctggagatgcaactgaccttggcgggcatcagaatgacgagtggcagcagcaggagcggggtgacgaacaagatcacgaaggacttgaacttggagacatagctcagcgccgaggccatcgcgcgggagggagactggcgggcgagacgagtgaggggcagctagaggcgccgcgggcttaagaaggggccacagtccccggggattggggagggggcggtgacaactccgccccgcacgggggcgcctccccgcggccctggggcggggccacccctcggggtctgtgggacgcgcctgcccccaattctgccacccggcggcggtgggaggcgtctttggactccaacgcttcgggccagccctctaggggcagcctgggccctagcatctcgcgctgtccaagcctctcctgcgctgccgaggcagaggtgcgtcccggggctgccaagcggggcgtgttttggtcactggtgctgcccgctttggcgtaaggcgccctcccgcgtccgcatctgctctttcctgggctctgaagggtcccggatgaaactctct

SEQ ID NO: 112882 - DNA, 30 bp, Homo sapiens; identical to SEQ ID NO: 80893
  chr17:6662975-6663005
  Hypo

SEQ ID NO: 112883 - DNA, 492 bp, Homo sapiens; identical to SEQ ID NO: 80895
  chr17:6679303-6679795
  Hyper

SEQ ID NO: 112884 - DNA, 423 bp, Homo sapiens; identical to SEQ ID NO: 80899
  chr17:6735130-6735553
  Hyper

SEQ ID NO: 112885 - DNA, 30 bp, Homo sapiens; identical to SEQ ID NO: 80906
  chr17:6882316-6882346
  Hypo

SEQ ID NO: 112886 - DNA, 250 bp, Homo sapiens
  chr17:6926178-6926428
  Hyper
acccaagaccccctacgttacgaccaccccttgtttctgaggtcccgccctcgagacggagaccccgccctggactcgccatctggagagcgagggaggaaggaaggatacagacccaggcgttcaccccacctccacccccgcccccgacatcccggccagataaaggagccgaggccaagaggggagagagaccccgccccccttaagaagagaagccgcggcccctgcaggacgggggtaagaacaa

SEQ ID NO: 112887 - DNA, 279 bp, Homo sapiens
  chr17:6946212-6946491
  Hyper
tcaccctgaatgacccgggcatcccacttccctcaccagcgaggaggcccaggccgaggtagagatgcagcagatcgctggcgaaagccgagaagacgaagcccagcgaggcgaggacgcccccaaccatcaccacggggcgggccccccagcgcgtgctcagggcgctgcccacggggcctgaaagggggcggagtcaacggaagacacgcccccgggcccccaaactctctccaacacttctcattggctgtttgcctccctcgaactaatggttct

SEQ ID NO: 112888 - DNA, 124 bp, Homo sapiens; identical to SEQ ID NO: 80911
  chr17:6946872-6946996
  Hyper

SEQ ID NO: 112889 - DNA, 30 bp, Homo sapiens; identical to SEQ ID NO: 80912
  chr17:6947321-6947351
  Hyper

SEQ ID NO: 112890 - DNA, 30 bp, Homo sapiens; identical to SEQ ID NO: 80913
  chr17:6978470-6978500
  Hypo

SEQ ID NO: 112891 - DNA, 98 bp, Homo sapiens; identical to SEQ ID NO: 44977
  chr17:7047830-7047928
  Hypo

SEQ ID NO: 112892 - DNA, 101 bp, Homo sapiens; identical to SEQ ID NO: 80932
  chr17:7107617-7107718
  Hypo

SEQ ID NO: 112893 - DNA, 31 bp, Homo sapiens; identical to SEQ ID NO: 80945
  chr17:7136114-7136145
  Hypo

SEQ ID NO: 112894 - DNA, 30 bp, Homo sapiens; identical to SEQ ID NO: 44979
  chr17:7156905-7156935
  Hypo

SEQ ID NO: 112895 - DNA, 41 bp, Homo sapiens; identical to SEQ ID NO: 80959
  chr17:7164579-7164620
  Hyper

SEQ ID NO: 112896 - DNA, 104 bp, Homo sapiens; identical to SEQ ID NO: 80964
  chr17:7197588-7197692
  Hyper

SEQ ID NO: 112897 - DNA, 30 bp, Homo sapiens; identical to SEQ ID NO: 80966
  chr17:7219436-7219466
  Hypo

SEQ ID NO: 112898 - DNA, 28 bp, Homo sapiens
  chr17:7243860-7243888
  Hypo
gataagatttgatctcggtcaggccagg

SEQ ID NO: 112899 - DNA, 30 bp, Homo sapiens; identical to SEQ ID NO: 81007
  chr17:7285270-7285300
  Hypo

SEQ ID NO: 112900 - DNA, 45 bp, Homo sapiens; identical to SEQ ID NO: 81034
  chr17:7343074-7343119
  Hyper

SEQ ID NO: 112901 - DNA, 226 bp, Homo sapiens; identical to SEQ ID NO: 81036
  chr17:7348747-7348973
  Hyper

SEQ ID NO: 112902 - DNA, 33 bp, Homo sapiens; identical to SEQ ID NO: 81037
  chr17:7349226-7349259
  Hyper

SEQ ID NO: 112903 - DNA, 275 bp, Homo sapiens; identical to SEQ ID NO: 81053
  chr17:7368947-7369222
  Hypo

SEQ ID NO: 112904 - DNA, 30 bp, Homo sapiens; identical to SEQ ID NO: 81084
  chr17:7419628-7419658
  Hypo

SEQ ID NO: 112905 - DNA, 30 bp, Homo sapiens; identical to SEQ ID NO: 81097
  chr17:7460469-7460499
  Hypo

SEQ ID NO: 112906 - DNA, 270 bp, Homo sapiens; identical to SEQ ID NO: 81099
  chr17:7466705-7466975
  Hypo

SEQ ID NO: 112907 - DNA, 30 bp, Homo sapiens; identical to SEQ ID NO: 81107
  chr17:7491930-7491960
  Hypo

SEQ ID NO: 112908 - DNA, 33 bp, Homo sapiens; identical to SEQ ID NO: 81109
  chr17:7493033-7493066
  Hypo

SEQ ID NO: 112909 - DNA, 202 bp, Homo sapiens; identical to SEQ ID NO: 81130
  chr17:7554591-7554793
  Hyper

SEQ ID NO: 112910 - DNA, 66 bp, Homo sapiens; identical to SEQ ID NO: 81132
  chr17:7555185-7555251
  Hyper

SEQ ID NO: 112911 - DNA, 30 bp, Homo sapiens; identical to SEQ ID NO: 81154
  chr17:7608216-7608246
  Hyper

SEQ ID NO: 112912 - DNA, 97 bp, Homo sapiens; identical to SEQ ID NO: 81155
  chr17:7608731-7608828
  Hyper

SEQ ID NO: 112913 - DNA, 58 bp, Homo sapiens; identical to SEQ ID NO: 81170
  chr17:7621433-7621491
  Hyper

SEQ ID NO: 112914 - DNA, 93 bp, Homo sapiens; identical to SEQ ID NO: 81237
  chr17:7727249-7727342
  Hypo

SEQ ID NO: 112915 - DNA, 75 bp, Homo sapiens; identical to SEQ ID NO: 81295
  chr17:7856906-7856981
  Hypo

SEQ ID NO: 112916 - DNA, 160 bp, Homo sapiens; identical to SEQ ID NO: 81324
  chr17:7906254-7906414
  Hyper

SEQ ID NO: 112917 - DNA, 43 bp, Homo sapiens; identical to SEQ ID NO: 81343
  chr17:7919589-7919632
  Hyper

SEQ ID NO: 112918 - DNA, 49 bp, Homo sapiens; identical to SEQ ID NO: 36363
  chr17:7976269-7976318
  Hyper

SEQ ID NO: 112919 - DNA, 125 bp, Homo sapiens; identical to SEQ ID NO: 81381
  chr17:7982585-7982710
  Hyper

SEQ ID NO: 112920 - DNA, 30 bp, Homo sapiens; identical to SEQ ID NO: 81400
  chr17:7996014-7996044
  Hypo

SEQ ID NO: 112921 - DNA, 30 bp, Homo sapiens; identical to SEQ ID NO: 81413
  chr17:8021183-8021213
  Hyper

SEQ ID NO: 112922 - DNA, 50 bp, Homo sapiens; identical to SEQ ID NO: 81425
  chr17:8027872-8027922
  Hyper

SEQ ID NO: 112923 - DNA, 657 bp, Homo sapiens; identical to SEQ ID NO: 81453
  chr17:8055166-8055823
  Hyper

SEQ ID NO: 112924 - DNA, 18 bp, Homo sapiens
  chr17:8075326-8075344
  Hypo
aaacaagagatgggccgg

SEQ ID NO: 112925 - DNA, 29 bp, Homo sapiens
  chr17:8104161-8104190
  Hypo
gggtgcggtggctcacggctgtaatccca

SEQ ID NO: 112926 - DNA, 209 bp, Homo sapiens; identical to SEQ ID NO: 81494
  chr17:8104430-8104639
  Hypo

SEQ ID NO: 112927 - DNA, 28 bp, Homo sapiens
  chr17:8104911-8104939
  Hypo
tataggctgaaaggccgggcgcggtggc

SEQ ID NO: 112928 - DNA, 25 bp, Homo sapiens
  chr17:8123524-8123549
  Hypo
cccatcccaccggttttgtttttca

SEQ ID NO: 112929 - DNA, 884 bp, Homo sapiens
  chr17:8229958-8230842
  Hyper
gccctcttccccccacgccccggcccccaagcctgctcactagctctctcctcctccttccacccgcaaggaaccctccagcccacttcctgtgatcctttccggagcccttcagcctggctggctctccagccatctcggaaagcttctctttcctaaaccctccatactcgcaggttcagctacagaggtaactgcaggctcaggttctccagggtggccagcccaccagcccaccgtcccggtgcagcagtgcctctccagcgacagctccaccgcgagcctggcgggctcccgaccttgctccccagcacgtcgtctccaagccacggtctcaccaccctccatcagcctcgggcgacaccaaggggaacagagcgctggagctcctcgaagtcctcccgaccttagcggggctccgttcatcctcccggacgtggccaggccccgctctggccccgcgcccgcccctcccgcggggctgcccctgtctctctgccggagacccggactcagtgagtgagcgcagcgcggccatagggcttcctgcagcggggtctcagcacgtcttctggctggactctggggtctcctggcctggctgtgtctcctggttctcagcgctcgcctcccacgcggggcggagtatgggagtgggctgctcccgcggaagaatcctggggaagttgaggcactggctcccgctgttcagaacactgcccgacgtccccagagctagccactcctccttcccacccacccgcagcactctcgaggtcgcaacggcagtcaccaggtcccggggcctgcgttcagctgcttgatccgactaggtttggcttcggacccgaatgggtcagctccacgcccgatggagtttttca

SEQ ID NO: 112930 - DNA, 37 bp, Homo sapiens; identical to SEQ ID NO: 81514
  chr17:8287722-8287759
  Hypo

SEQ ID NO: 112931 - DNA, 186 bp, Homo sapiens; identical to SEQ ID NO: 81515
  chr17:8296142-8296328
  Hypo

SEQ ID NO: 112932 - DNA, 30 bp, Homo sapiens; identical to SEQ ID NO: 81516
  chr17:8328350-8328380
  Hypo

SEQ ID NO: 112933 - DNA, 45 bp, Homo sapiens; identical to SEQ ID NO: 81517
  chr17:8338095-8338140
  Hypo

SEQ ID NO: 112934 - DNA, 30 bp, Homo sapiens; identical to SEQ ID NO: 81519
  chr17:8365197-8365227
  Hypo

SEQ ID NO: 112935 - DNA, 391 bp, Homo sapiens; identical to SEQ ID NO: 81520
  chr17:8384513-8384904
  Hypo

SEQ ID NO: 112936 - DNA, 36 bp, Homo sapiens; identical to SEQ ID NO: 81521
  chr17:8397135-8397171
  Hypo

SEQ ID NO: 112937 - DNA, 97 bp, Homo sapiens; identical to SEQ ID NO: 81522
  chr17:8398223-8398320
  Hypo

SEQ ID NO: 112938 - DNA, 44 bp, Homo sapiens; identical to SEQ ID NO: 81523
  chr17:8409685-8409729
  Hypo

SEQ ID NO: 112939 - DNA, 30 bp, Homo sapiens; identical to SEQ ID NO: 81524
  chr17:8456005-8456035
  Hypo

SEQ ID NO: 112940 - DNA, 18 bp, Homo sapiens
  chr17:8464515-8464533
  Hypo
ggggcctctcctctccgg

SEQ ID NO: 112941 - DNA, 30 bp, Homo sapiens; identical to SEQ ID NO: 81527
  chr17:8532918-8532948
  Hyper

SEQ ID NO: 112942 - DNA, 38 bp, Homo sapiens; identical to SEQ ID NO: 36367
  chr17:8533161-8533199
  Hyper

SEQ ID NO: 112943 - DNA, 170 bp, Homo sapiens; identical to SEQ ID NO: 81529
  chr17:8533692-8533862
  Hyper

SEQ ID NO: 112944 - DNA, 88 bp, Homo sapiens; identical to SEQ ID NO: 81530
  chr17:8572343-8572431
  Hypo

SEQ ID NO: 112945 - DNA, 76 bp, Homo sapiens; identical to SEQ ID NO: 81531
  chr17:8586787-8586863
  Hypo

SEQ ID NO: 112946 - DNA, 30 bp, Homo sapiens; identical to SEQ ID NO: 81532
  chr17:8624511-8624541
  Hypo

SEQ ID NO: 112947 - DNA, 30 bp, Homo sapiens; identical to SEQ ID NO: 44992
  chr17:8732186-8732216
  Hypo

SEQ ID NO: 112948 - DNA, 30 bp, Homo sapiens; identical to SEQ ID NO: 81535
  chr17:8774759-8774789
  Hypo

SEQ ID NO: 112949 - DNA, 102 bp, Homo sapiens; identical to SEQ ID NO: 81536
  chr17:8789475-8789577
  Hypo

SEQ ID NO: 112950 - DNA, 71 bp, Homo sapiens; identical to SEQ ID NO: 81537
  chr17:8789780-8789851
  Hypo

SEQ ID NO: 112951 - DNA, 30 bp, Homo sapiens; identical to SEQ ID NO: 81538
  chr17:8849594-8849624
  Hypo

SEQ ID NO: 112952 - DNA, 889 bp, Homo sapiens
  chr17:8868582-8869471
  Hyper
ccctacgacacagggcgtcctgtgtcagaggcaggaggctgaggacacagctgcgcagagccgcccagcagaggttacccggataacgataagtggtccccgcgacgccccttaagtctctggggttatctggagcgcaggtttgcagacccgctgcccccgcggtgggccaggtccacggggccggaagatagcaggatctgtccagccctcgggctgcggcggctgctcgcggagcccactctccccgacggtccccagcttgctccagctctgcctggagctcccatgcgtgccctccgcatccgccctggccgcccagtcacacacctgcagtccccgccgggcgccgagcccctctccagcggcgactccctgcgattcgggtgaccgtcgggaccaccgcgccccagctggagccgcgcggcgagccgcagcatctgcccagcctgggctcctccggcgggcggggcggagcctgtcagggggcggggcctaatggggcggggctgaccgcggagccggcctctccagccacctggcggcccggcagcgtcagccaggtgcgcgcccggccccacatcctctgggtcacgcccccgaggccgcaaggcgtctgagaagcagccccggctctgacccgccagccctcggaagaagcagaccctggccggtccatggcagtggcccgaggggcaccagcgcggagcaccagcgacccccaaggagtaaggggaggttaggcccccgcgtcggaagcgcggctttggccccgcaggagggctgggcggagcaggggggcaggtctggggtaggggcttaggggaaagacgagaaagaggaagctccgacgagctgcttccttctctcactgcgacccacttcctct

SEQ ID NO: 112953 - DNA, 1650 bp, Homo sapiens
  chr17:8906188-8907838
  Hyper
gtgtcccaagttacacgcatcctatcttggcccagctccactggagcccgagcggcggggcgcagggtgcgagcgggaggctggtgttctgcccgcgatgggcaggggagccgggtggccgcggggcgaggagccgcgagggccgggccggcgtgacaccacctggcggagtctcggggaagagtcttaaaggcgcgcgctcctccgtgccccgcgcactcgaacgggagccgcggagagctcgcctcccgctgccgccggcgcctcggggaggtaagtgccacccgcggatcccgagtcgcggccgggtgggggcggcccgcggctgccccgcgctcgggaagctctggctggggctgcggtcggagggcggcgcccaagttttcttgaaggcctcggagggcagctggagcggcgtagagcctgcgcggggatggcgggggtggccgcgggccggggccgtctgggggcggccatcccgggcggtgcgtggaaaagtaggcactggtgcgcggcgaggggcgcacgccagagccccagccccgcgtcctgcgcacttggcgcgctctggccgcggtcccggcgagccccagcctgctccgggccgcgaccccggctccgcgccttcctgcccgcccgggtcctttgtagcccgctggccccgcggtcgcgcacggtcacgccggcaggtcgcgctcggcggccggccaagccagccccggccctgccgcgcccgcgccccgggccaccccgcccggccccctcggcgctgcacccctcgctttccccatctccagccgctcgctattttcacacctcccggtgccccggccccggcgcctgattcagtgcttagtaattaatttggcgtttcagaatggtcagcgggctggataatgggtgcattcatcccccgggctaatctgaacagaggtgggaagaaaggctttcacagacagaaaatgccattcgccgagcgctcaaaggggctgtcactcccagaataaatcgccgccgcgcccgccggctcctctggccatttccatacagctccggcccgcgccgcggacccgccggcctcggcctcggctcccgggaatcactcactcgagtgccttcgacgggaaagtcgggcgagagctggacccaggcgggggccgagggaaacggggaaactggagactcgggtgaaggccgcaggggacaaagagattgattagaaaatcaaacgcgcatctagaaggaggcgcaggcgactgctcaaggcgcggacggcggagctggggctcgggagcgtccgtccaaaacccccgaggttcgccaaagaggagggcccgcggcccagaccctccggagcgtgcccgaggcgacacggcaagcttctggggctcccaaattgtgaatggagttcaatgcacaagcatagatagtagaaacagggtcgacctgcacagactttttattccgagttccttgtgctatcagccccgtcgccctcgcggcctggaaggtgacacggtgtcttccccggcctcctgctcgccacccctgttgggaccctcgggtccgcctggggacatctgctgagcgggtgacggaggctttatcctttgatcccttctggatccggtgacgcgctaagtgttgggc

SEQ ID NO: 112954 - DNA, 30 bp, Homo sapiens; identical to SEQ ID NO: 81545
  chr17:8924243-8924273
  Hyper

SEQ ID NO: 112955 - DNA, 243 bp, Homo sapiens; identical to SEQ ID NO: 81546
  chr17:8925590-8925833
  Hyper

SEQ ID NO: 112956 - DNA, 42 bp, Homo sapiens; identical to SEQ ID NO: 81547
  chr17:8926060-8926102
  Hyper

SEQ ID NO: 112957 - DNA, 83 bp, Homo sapiens; identical to SEQ ID NO: 81549
  chr17:9029329-9029412
  Hypo

SEQ ID NO: 112958 - DNA, 30 bp, Homo sapiens; identical to SEQ ID NO: 81550
  chr17:9065719-9065749
  Hypo

SEQ ID NO: 112959 - DNA, 44 bp, Homo sapiens; identical to SEQ ID NO: 81551
  chr17:9143066-9143110
  Hyper

SEQ ID NO: 112960 - DNA, 39 bp, Homo sapiens; identical to SEQ ID NO: 81552
  chr17:9143465-9143504
  Hyper

SEQ ID NO: 112961 - DNA, 58 bp, Homo sapiens; identical to SEQ ID NO: 81555
  chr17:9547977-9548035
  Hyper

SEQ ID NO: 112962 - DNA, 36 bp, Homo sapiens; identical to SEQ ID NO: 44995
  chr17:9808139-9808175
  Hypo

SEQ ID NO: 112963 - DNA, 188 bp, Homo sapiens; identical to SEQ ID NO: 81557
  chr17:9810166-9810354
  Hypo

SEQ ID NO: 112964 - DNA, 42 bp, Homo sapiens; identical to SEQ ID NO: 81558
  chr17:9851040-9851082
  Hypo

SEQ ID NO: 112965 - DNA, 26 bp, Homo sapiens
  chr17:9913746-9913772
  Hypo
gcatgagccaccgcgcccagcctgat

SEQ ID NO: 112966 - DNA, 1609 bp, Homo sapiens
  chr17:10101056-10102665
  Hyper
ccaaggcagcacgaccgtccacgggtcatcaggctctagactccggggtggagacgcggggctgcgggaccgagtcggtgccactttctcgcacccctgatcctccgtgcctcttcccaagaccgccagacccttcaccggcccctgccactgccgggaacgctcccgcctgctccttaactcacacaggcaacaagttctcgcttcctcagagcagccacggtgtgctccggaggcccggcgcaaggtggaagctccccgcgagtccgcgttgcccacgccccgaggggcgcccgctgccgtcgctgccccccaggagcgtggagctacaggtagcgccggcaagggctgccccccggggcgcccctccgaccgggacgctgcggcatccccggaacgggcaacaggtacgcgagcgcaccgaggaccgcagccccggctcctacagccccggccctcgccccttacctccagcaactgcacgtagctcgccgggaaccagccacggagcccgtcctccttctcgccttcccaccagccgccgtccgggacctgcagcagcgtgatcagctcgcccgcggcgaagcgcagcccctggccgtgccgctccccggagaaggggtacagggtccggcagcgagcgccggacatggccttggcgcccgggttcacagcgcagcctgcattcccgccgagccccacgggctgggcagcggctccgcggggtcccaggcgcccggcgctccgggctcccgcgctctgggcgcgcgccgtctctggggtgcgcgggggtcctcaggcaggcgggggacgcgcgctccgcgccgggaagcagagactcgttggcttcgcagagcgagcggcgacgcccccgggccgggcagctcgcggatcctagctctgggctggggggcggggctcagggggaggagacccaggcgccgcgggctccggagacaacttcccgggaacgcggaacgcgggctgccgccgcgagggctggccggggccggggccgggaccggggccggggccgccctggcgcgcggaaatgcgcagctcccccgggaggtgggacccggagcatcccccgcggcaggactccgcggcgggcggccgtggagaggagctggcggccgggtggccgggcgggggttagctcactggcgagggggcgggccggggcggggccagggcggccacgcccgcggagggctgcgcgctccctcgcagaggggcctgtcactggggagaggggctcccactcgcgcccccaccgccggggaccgcgggaatggaaacgcccctctgttctgtgcctgctttgtaggcctggcggcccgtggcgtgcgggcggcttcttcgaggtgtctgcgagggatcgtttgtggttgtcattgtagtggttgaacctggggttgaacttgtctcaccggaaactgaacaatgggtgaaagacaggtttgaagcctggcgcctgagcccagcagcctggtggcagcgtggcacgctggagggacggaatggagagaagacggggtcggagttgatagaattggaaacagtcgatggggataaatggaggaaaggcgaacggtgagaggaacag

SEQ ID NO: 112967 - DNA, 43 bp, Homo sapiens; identical to SEQ ID NO: 79962
  chr17:10146608-10146651
  Hypo

SEQ ID NO: 112968 - DNA, 42 bp, Homo sapiens; identical to SEQ ID NO: 79963
  chr17:10212555-10212597
  Hypo

SEQ ID NO: 112969 - DNA, 201 bp, Homo sapiens; identical to SEQ ID NO: 79964
  chr17:10212807-10213008
  Hypo

SEQ ID NO: 112970 - DNA, 30 bp, Homo sapiens; identical to SEQ ID NO: 79965
  chr17:10303782-10303812
  Hypo

SEQ ID NO: 112971 - DNA, 161 bp, Homo sapiens; identical to SEQ ID NO: 79966
  chr17:10404695-10404856
  Hypo

SEQ ID NO: 112972 - DNA, 30 bp, Homo sapiens; identical to SEQ ID NO: 79967
  chr17:10558730-10558760
  Hypo

SEQ ID NO: 112973 - DNA, 463 bp, Homo sapiens; identical to SEQ ID NO: 79968
  chr17:10632887-10633350
  Hyper

SEQ ID NO: 112974 - DNA, 131 bp, Homo sapiens; identical to SEQ ID NO: 79972
  chr17:11143519-11143650
  Hyper

SEQ ID NO: 112975 - DNA, 218 bp, Homo sapiens
  chr17:11144318-11144536
  Hyper
gccccaccccgtgaccggctccccgtcttgtcccgcaggacccgcccggacgggaccacgccgccgccgccgccgccgccgcccggagccgcgcttcgggtcctgcctgagccgagccgcgcgcggggccgcagtcaccgccggcgggggatggggctgcccaggaggcgcgccgagcccgcagggggagcgcggagccggcgcgcagcctgagagcc

SEQ ID NO: 112976 - DNA, 370 bp, Homo sapiens
  chr17:11144914-11145284
  Hyper
acggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctg

SEQ ID NO: 112977 - DNA, 45 bp, Homo sapiens; identical to SEQ ID NO: 79977
  chr17:11461634-11461679
  Hypo

SEQ ID NO: 112978 - DNA, 97 bp, Homo sapiens; identical to SEQ ID NO: 79978
  chr17:11501937-11502034
  Hyper

SEQ ID NO: 112979 - DNA, 30 bp, Homo sapiens; identical to SEQ ID NO: 79979
  chr17:11507618-11507648
  Hypo

SEQ ID NO: 112980 - DNA, 158 bp, Homo sapiens; identical to SEQ ID NO: 79980
  chr17:11572707-11572865
  Hypo

SEQ ID NO: 112981 - DNA, 165 bp, Homo sapiens; identical to SEQ ID NO: 44999
  chr17:11637555-11637720
  Hypo

SEQ ID NO: 112982 - DNA, 192 bp, Homo sapiens; identical to SEQ ID NO: 79983
  chr17:11672352-11672544
  Hypo

SEQ ID NO: 112983 - DNA, 16 bp, Homo sapiens
  chr17:11808260-11808276
  Hypo
agagaataggctgggc

SEQ ID NO: 112984 - DNA, 32 bp, Homo sapiens; identical to SEQ ID NO: 79988
  chr17:11820735-11820767
  Hypo

SEQ ID NO: 112985 - DNA, 40 bp, Homo sapiens; identical to SEQ ID NO: 79989
  chr17:11836966-11837006
  Hypo

SEQ ID NO: 112986 - DNA, 40 bp, Homo sapiens; identical to SEQ ID NO: 79990
  chr17:11838965-11839005
  Hypo

SEQ ID NO: 112987 - DNA, 30 bp, Homo sapiens; identical to SEQ ID NO: 79991
  chr17:11866757-11866787
  Hypo

SEQ ID NO: 112988 - DNA, 97 bp, Homo sapiens; identical to SEQ ID NO: 79993
  chr17:12150178-12150275
  Hypo

SEQ ID NO: 112989 - DNA, 66 bp, Homo sapiens; identical to SEQ ID NO: 79994
  chr17:12568725-12568791
  Hyper

SEQ ID NO: 112990 - DNA, 230 bp, Homo sapiens; identical to SEQ ID NO: 79995
  chr17:12569172-12569402
  Hyper

SEQ ID NO: 112991 - DNA, 297 bp, Homo sapiens; identical to SEQ ID NO: 79996
  chr17:12693203-12693500
  Hyper

SEQ ID NO: 112992 - DNA, 48 bp, Homo sapiens; identical to SEQ ID NO: 79997
  chr17:12877698-12877746
  Hyper

SEQ ID NO: 112993 - DNA, 30 bp, Homo sapiens; identical to SEQ ID NO: 79998
  chr17:13400298-13400328
  Hypo

SEQ ID NO: 112994 - DNA, 1814 bp, Homo sapiens
  chr17:13503842-13505656
  Hyper
ctcaccggtaccaggcgaggcccttgtcgtagctgcggtcgaagaagtggggctcggcgcccacggcgcgcacgtcggggtgcacgcgcaggaactccagcagcgcccgcgtgccgcccttcttcactccgatgatgatggcctgcggcagctgcttgctgccttcgtccaggagcagcgccagggtccccggcggggcctcggccacggtgcttccggccccggagccgcccggaccccctgacaggccaggggactcttcttcccaggccgcctcctcgccgtcgtcgcggggcgcgggcggccggcgcctccgccactgcggcagttgcaggaggcgctttctctgtgccgccgccggccacaccgccagctccctcgggcctccggccaggacgccgccaccaggggcccccgcctcctcgccgccgccggacagccccacgacggggccggacagggtctggcagcgctcggccaggcagtagaagacgtaaagggacgtgagcagggagcagagcatcagcaagaacttccggaagatgctgcgggacagcggctcggccgaggtggagagggcactggccgggcccggaggggccatcctagccggaggcgacgtcgggcaacgcgccggccatgctaggcctggaccccgacaggtgccagagcatccccccggcgggccagcgcgctggacggaggccacatcgccgtgcgcccctgtggccgtgcgaactgtcccgggaggcagcggccggggctccgcggggaaacggaatcccgggggccccgcgcaggatccctgcctccagtcgagggagcgggaaggggaacgcgggtccgtgcttaagaaaccatcgtcttagactcgcccaagtcctgagcttggggcagccttggcccctcggttccccgcaagagtcgccggaatcggggtcttggcagcggtgtcgaaggcgtgcgtctcagccccggccccgagagacttctcggcgcggatctccgctcagcgatcctgcatcactggctcggtccccgtgagggcacgcgcggctgccgggcctctgcgctccgtgcgctccagacagtggcgagcgacagtgacttccagccccggctttctctggtccccttgcccgcctgggcgcgttctctccgcccgagttcaggttctctcagccaaggagcgaggtccccccgagtccctctgcccgagcgggagacaggaggcccgtgcagagccgtccacccctctccgtagcgccgggttgctccaaactgctcttggaccccacctgtgagccgcgtggctgggctgggctgggctgcgcgggacctgtcagcggcccccgccactctgctcgcaggcgctcaccggctgcctcctgggccgccgctggccgccgccacacgtgggacgccgagggcagcaaacttgctggtgacgtcaaaggcccgggccggaccagcccccggacgagcgcagcggggcgcggaccagcggccaggcggggccagacgggcggggtgggatggagaaaaggtggcgcgggctccgcagcagccgcccaatggcactggagagggcgggggcggcaggggcgacgccccttccccagtgtcccccattcctccccgcggcttcgcccccttccagtggatccggtgtctgcggcggctccggggttgcctgagtgacagctaaggccggccggatctctgggggcctgacttccacccaagacgccactagcttggtgaggggccccagagctctccaccgcagctcagccctccgcagccctgaccct

SEQ ID NO: 112995 - DNA, 30 bp, Homo sapiens; identical to SEQ ID NO: 80002
  chr17:13791939-13791969
  Hypo

SEQ ID NO: 112996 - DNA, 663 bp, Homo sapiens
  chr17:14200545-14201208
  Hyper
tctcatccctgcagtcggcttggccagcagcagccgcggggctgcgccagtgcccgcctctggccaggggttcccgcgcctcgagcagcgccctgggcccttctacgggaagaggggatcgcggcgcccgcgacacccaggagctcggacgaccgcagcctcaccactaacccccaacaaaggtacagcgggagtccaggccgagataaagttcccttcccagtccgctggggagacaactggccgcggctgccctctgctccgctcccggctgtcccgcagctgcgaggccggggccagagcgctcccttccgggcgggcatcggagccgctgcggcgccgaccgcccttcgcgcccgggccgctggagaaggcggagcgagctcgcagctgctaacccccgaggggccgcctcgctggcgaggggagcgggaggaaggtccggattccggtggcaggaactggggctctgggccaccggttcaggctgccccaggaaatgcctgctttgcggtgccgcagagggtatagaggagctcggccccagagggtggctgttggggaggcggagctggccgcaggctggagcagctgcggagcctcccatcccgagcctagaatcggagaaatttcaggcggaaaatactgcggggatggtttggc

SEQ ID NO: 112997 - DNA, 326 bp, Homo sapiens; identical to SEQ ID NO: 80007
  chr17:14202945-14203271
  Hyper

SEQ ID NO: 112998 - DNA, 30 bp, Homo sapiens; identical to SEQ ID NO: 80008
  chr17:14203695-14203725
  Hyper

SEQ ID NO: 112999 - DNA, 231 bp, Homo sapiens; identical to SEQ ID NO: 36390
  chr17:14204011-14204242
  Hyper

SEQ ID NO: 113000 - DNA, 332 bp, Homo sapiens; identical to SEQ ID NO: 80010
  chr17:14204502-14204834
  Hyper

SEQ ID NO: 113001 - DNA, 1203 bp, Homo sapiens; identical to SEQ ID NO: 80011
  chr17:14205175-14206378
  Hyper

SEQ ID NO: 113002 - DNA, 142 bp, Homo sapiens
  chr17:14212544-14212686
  Hyper
ggtgtcgcgcgggatcgccgcctctggcccgggggccgctgagccggagacagatggcggagcttcccagtgcgggggcagggctggcagccgagactggggccgcctcccccgcccctaggctggccgggtagtcctccgt

SEQ ID NO: 113003 - DNA, 186 bp, Homo sapiens; identical to SEQ ID NO: 80016
  chr17:14861051-14861237
  Hypo

SEQ ID NO: 113004 - DNA, 17 bp, Homo sapiens
  chr17:14914268-14914285
  Hypo
tataaaacccgatgtcg

SEQ ID NO: 113005 - DNA, 20 bp, Homo sapiens
  chr17:15149034-15149054
  Hypo
gagccacaggccgggcgcag

SEQ ID NO: 113006 - DNA, 63 bp, Homo sapiens; identical to SEQ ID NO: 80020
  chr17:15164652-15164715
  Hyper

SEQ ID NO: 113007 - DNA, 41 bp, Homo sapiens; identical to SEQ ID NO: 80021
  chr17:15164923-15164964
  Hyper

SEQ ID NO: 113008 - DNA, 895 bp, Homo sapiens; identical to SEQ ID NO: 80022
  chr17:15165949-15166844
  Hyper

SEQ ID NO: 113009 - DNA, 295 bp, Homo sapiens; identical to SEQ ID NO: 80024
  chr17:15244291-15244586
  Hyper

SEQ ID NO: 113010 - DNA, 370 bp, Homo sapiens
  chr17:15244894-15245264
  Hyper
accacctgcagccctcgactggggcccagaccagtctggccctggccccgcctttcctatctgtgacgatagcagcgcctgagggccactcagcggccgccccggccggctcgccggagctgactggccagttataggagaggcgggagctgtcaggccaggagggaaacccgtcgggcggcggttactatggacgcgctcacgcttagtaaccgaggctccccgccctccgggagacctccttggtttgggaggtgaaaggggtgaagagtagcccaagggagaggcctcggtgatttcccgacctctcctgtgaagcctgattcggaactcttccagctgcgaagaacttggccgattctaaggcaca

SEQ ID NO: 113011 - DNA, 299 bp, Homo sapiens
  chr17:15820731-15821030
  Hyper
ggcgccaggctgagccggcgcagccaaatctcctcagggctgcggccgcccatcctgggaccgcgcccctgcaccatgtggacggtgcaggctgggctggggtctgacgcccgaggaccccttccccctgcccagccctgcccccgcaggcactggagggctcccctaggcggggctccgggctagggaacagggatgcccagcaatctcgcgctcccggggccggactccagcggcaggggcctccccaggctgcggctccgcgccggtgacgggggctctgccgaagggctcctgcc

SEQ ID NO: 113012 - DNA, 146 bp, Homo sapiens; identical to SEQ ID NO: 80034
  chr17:15847860-15848006
  Hyper

SEQ ID NO: 113013 - DNA, 312 bp, Homo sapiens; identical to SEQ ID NO: 80035
  chr17:15848567-15848879
  Hyper

SEQ ID NO: 113014 - DNA, 68 bp, Homo sapiens; identical to SEQ ID NO: 80036
  chr17:15849143-15849211
  Hyper

SEQ ID NO: 113015 - DNA, 30 bp, Homo sapiens; identical to SEQ ID NO: 80037
  chr17:15855838-15855868
  Hypo

SEQ ID NO: 113016 - DNA, 34 bp, Homo sapiens; identical to SEQ ID NO: 80042
  chr17:16255661-16255695
  Hyper

SEQ ID NO: 113017 - DNA, 97 bp, Homo sapiens; identical to SEQ ID NO: 80043
  chr17:16256941-16257038
  Hyper

SEQ ID NO: 113018 - DNA, 316 bp, Homo sapiens; identical to SEQ ID NO: 80045
  chr17:16282207-16282523
  Hypo

SEQ ID NO: 113019 - DNA, 23 bp, Homo sapiens
  chr17:16283522-16283545
  Hypo
tccgcgcccggccaggggcgcgc

SEQ ID NO: 113020 - DNA, 277 bp, Homo sapiens; identical to SEQ ID NO: 80047
  chr17:16310319-16310596
  Hyper

SEQ ID NO: 113021 - DNA, 159 bp, Homo sapiens; identical to SEQ ID NO: 80048
  chr17:16432126-16432285
  Hypo

SEQ ID NO: 113022 - DNA, 30 bp, Homo sapiens; identical to SEQ ID NO: 80049
  chr17:16440314-16440344
  Hyper

SEQ ID NO: 113023 - DNA, 812 bp, Homo sapiens; identical to SEQ ID NO: 80050
  chr17:16471976-16472788
  Hyper

SEQ ID NO: 113024 - DNA, 109 bp, Homo sapiens; identical to SEQ ID NO: 80051
  chr17:16492360-16492469
  Hyper

SEQ ID NO: 113025 - DNA, 400 bp, Homo sapiens
  chr17:16570153-16570553
  Hyper
gctgccctttggtggcgttgggcacagatcaccgcctggcagaagcccgcgacagcgtggagggagcgatgcccccgcccgggactcctggtgggtgatggcgccgggaggccttggctgggacagatcggggcctcccggtcggtcagcgactcgcgcccggctgcgactttcagaggcttttggacaccgcctgccatcccgccgcgcctctcggggtccgctcccccggactggccctgcccacggagcgcgggtagcagccggcggccaggagccagtggcgggagccaccggtgggaaaaccggcaggaggctgcgctggaccccgctgggcagcgccaatccctaaggcagccgggcgggtgagctaacggcggcgggggcggctgagaggctg

SEQ ID NO: 113026 - DNA, 280 bp, Homo sapiens; identical to SEQ ID NO: 80054
  chr17:16570673-16570953
  Hyper

SEQ ID NO: 113027 - DNA, 39 bp, Homo sapiens; identical to SEQ ID NO: 80056
  chr17:16830521-16830560
  Hypo

SEQ ID NO: 113028 - DNA, 30 bp, Homo sapiens; identical to SEQ ID NO: 80058
  chr17:16993611-16993641
  Hypo

SEQ ID NO: 113029 - DNA, 59 bp, Homo sapiens; identical to SEQ ID NO: 80059
  chr17:17062602-17062661
  Hypo

SEQ ID NO: 113030 - DNA, 30 bp, Homo sapiens; identical to SEQ ID NO: 80060
  chr17:17067369-17067399
  Hypo

SEQ ID NO: 113031 - DNA, 30 bp, Homo sapiens; identical to SEQ ID NO: 80061
  chr17:17090124-17090154
  Hypo

SEQ ID NO: 113032 - DNA, 30 bp, Homo sapiens; identical to SEQ ID NO: 80062
  chr17:17100986-17101016
  Hypo

SEQ ID NO: 113033 - DNA, 105 bp, Homo sapiens; identical to SEQ ID NO: 80063
  chr17:17123888-17123993
  Hypo

SEQ ID NO: 113034 - DNA, 84 bp, Homo sapiens; identical to SEQ ID NO: 80064
  chr17:17146203-17146287
  Hypo

SEQ ID NO: 113035 - DNA, 67 bp, Homo sapiens; identical to SEQ ID NO: 80065
  chr17:17204144-17204211
  Hyper

SEQ ID NO: 113036 - DNA, 30 bp, Homo sapiens; identical to SEQ ID NO: 80066
  chr17:17250180-17250210
  Hypo

SEQ ID NO: 113037 - DNA, 100 bp, Homo sapiens; identical to SEQ ID NO: 80067
  chr17:17395947-17396047
  Hypo

SEQ ID NO: 113038 - DNA, 966 bp, Homo sapiens
  chr17:17398606-17399572
  Hyper
cttcttgttccgcagcgccttcttgtgcagcacgtcgcagtactgcaccgagaccttgcggtgcaggtctgggctcatctcgctgggcagcttggccatggcgaagagcgcgcggaacatctggtccaggctgctgttcttcttggccgagatctcgaagtaggcgcagcgctgggggtcgtcgcccaccagctgctcgatctcgcgctggtccacctcgcggtagaagtcgcggtcacccttgttgccgcagatgaccaggggcacgtccacgttctccttggttttgttcttgaggcaagacttggtgtcgaggatctgctgcctgagccgctgcacctcctcgaaggagtcgcggttgtccagactgaacaccaggatgaaaacgtctcctagagggggcacagagagcagaaaaggagaaggtgagggtggccgcccaggggacaagtcgggctgactttgaggccgcgcggggcgcgctagcctctctaagcgcgaagcgcactactcggcgcgcggcagccggaccggcgctcgcggggcgccctggccgagggttccccgcccttccctcccgcacctgcccggcccccggctcacctgtgaggatggagaggcgccgcatggcggggaacgggtggttgccggacgtgtcgaggatgtcgagctggtagacctcgccgcggatggagtagaacttgcggtggaagtcctcgatggtaggcgtgtaggcgtcctcgaagcggccggtgaggaagcgcgacacgatggccgtcttgcccaccttggacgagccgaggatgaccatgcgatagcagttcttggccgggatactcagctccgagtcgctcgggcacatcttcttgatcatcgcggccagtttcattgggcagaggggccgcgagggcgggcgcggggccgagagaagggcagagagcggctgagggtcgctggggtggcacg

SEQ ID NO: 113039 - DNA, 30 bp, Homo sapiens; identical to SEQ ID NO: 80070
  chr17:17466959-17466989
  Hypo

SEQ ID NO: 113040 - DNA, 198 bp, Homo sapiens; identical to SEQ ID NO: 80071
  chr17:17579330-17579528
  Hypo

SEQ ID NO: 113041 - DNA, 39 bp, Homo sapiens; identical to SEQ ID NO: 45009
  chr17:17592178-17592217
  Hypo

SEQ ID NO: 113042 - DNA, 30 bp, Homo sapiens; identical to SEQ ID NO: 80073
  chr17:17612465-17612495
  Hypo

SEQ ID NO: 113043 - DNA, 46 bp, Homo sapiens; identical to SEQ ID NO: 80074
  chr17:17687009-17687055
  Hyper

SEQ ID NO: 113044 - DNA, 36 bp, Homo sapiens; identical to SEQ ID NO: 80075
  chr17:17700921-17700957
  Hypo

SEQ ID NO: 113045 - DNA, 183 bp, Homo sapiens; identical to SEQ ID NO: 80076
  chr17:17717969-17718152
  Hypo

SEQ ID NO: 113046 - DNA, 30 bp, Homo sapiens; identical to SEQ ID NO: 80077
  chr17:17750275-17750305
  Hypo

SEQ ID NO: 113047 - DNA, 114 bp, Homo sapiens; identical to SEQ ID NO: 80078
  chr17:17891258-17891372
  Hypo

SEQ ID NO: 113048 - DNA, 40 bp, Homo sapiens; identical to SEQ ID NO: 45011
  chr17:17910311-17910351
  Hypo

SEQ ID NO: 113049 - DNA, 38 bp, Homo sapiens; identical to SEQ ID NO: 45012
  chr17:18070928-18070966
  Hypo

SEQ ID NO: 113050 - DNA, 142 bp, Homo sapiens; identical to SEQ ID NO: 80082
  chr17:18127894-18128036
  Hypo

SEQ ID NO: 113051 - DNA, 38 bp, Homo sapiens; identical to SEQ ID NO: 80083
  chr17:18157976-18158014
  Hypo

SEQ ID NO: 113052 - DNA, 261 bp, Homo sapiens; identical to SEQ ID NO: 80084
  chr17:18163093-18163354
  Hypo

SEQ ID NO: 113053 - DNA, 30 bp, Homo sapiens; identical to SEQ ID NO: 80087
  chr17:18267413-18267443
  Hypo

SEQ ID NO: 113054 - DNA, 196 bp, Homo sapiens; identical to SEQ ID NO: 80088
  chr17:18314944-18315140
  Hyper

SEQ ID NO: 113055 - DNA, 34 bp, Homo sapiens; identical to SEQ ID NO: 80091
  chr17:18538112-18538146
  Hyper

SEQ ID NO: 113056 - DNA, 93 bp, Homo sapiens; identical to SEQ ID NO: 80092
  chr17:18538206-18538299
  Hyper

SEQ ID NO: 113057 - DNA, 120 bp, Homo sapiens; identical to SEQ ID NO: 80093
  chr17:18760619-18760739
  Hypo

SEQ ID NO: 113058 - DNA, 30 bp, Homo sapiens; identical to SEQ ID NO: 80097
  chr17:19211734-19211764
  Hypo

SEQ ID NO: 113059 - DNA, 34 bp, Homo sapiens; identical to SEQ ID NO: 45015
  chr17:19230161-19230195
  Hypo

SEQ ID NO: 113060 - DNA, 41 bp, Homo sapiens; identical to SEQ ID NO: 80099
  chr17:19230676-19230717
  Hypo

SEQ ID NO: 113061 - DNA, 844 bp, Homo sapiens; identical to SEQ ID NO: 80102
  chr17:19436820-19437664
  Hyper

SEQ ID NO: 113062 - DNA, 30 bp, Homo sapiens; identical to SEQ ID NO: 80103
  chr17:19482865-19482895
  Hyper

SEQ ID NO: 113063 - DNA, 312 bp, Homo sapiens; identical to SEQ ID NO: 80104
  chr17:19483115-19483427
  Hyper

SEQ ID NO: 113064 - DNA, 30 bp, Homo sapiens; identical to SEQ ID NO: 80109
  chr17:19611097-19611127
  Hypo

SEQ ID NO: 113065 - DNA, 49 bp, Homo sapiens; identical to SEQ ID NO: 80110
  chr17:19618412-19618461
  Hypo

SEQ ID NO: 113066 - DNA, 228 bp, Homo sapiens; identical to SEQ ID NO: 80111
  chr17:19622428-19622656
  Hypo

SEQ ID NO: 113067 - DNA, 177 bp, Homo sapiens; identical to SEQ ID NO: 80112
  chr17:19648102-19648279
  Hyper

SEQ ID NO: 113068 - DNA, 95 bp, Homo sapiens; identical to SEQ ID NO: 80113
  chr17:19769817-19769912
  Hypo

SEQ ID NO: 113069 - DNA, 470 bp, Homo sapiens; identical to SEQ ID NO: 80114
  chr17:19770389-19770859
  Hyper

SEQ ID NO: 113070 - DNA, 135 bp, Homo sapiens; identical to SEQ ID NO: 80115
  chr17:19771274-19771409
  Hyper

SEQ ID NO: 113071 - DNA, 118 bp, Homo sapiens; identical to SEQ ID NO: 45018
  chr17:19771594-19771712
  Hypo

SEQ ID NO: 113072 - DNA, 150 bp, Homo sapiens; identical to SEQ ID NO: 80117
  chr17:19890251-19890401
  Hypo

SEQ ID NO: 113073 - DNA, 41 bp, Homo sapiens; identical to SEQ ID NO: 80118
  chr17:19925117-19925158
  Hypo

SEQ ID NO: 113074 - DNA, 30 bp, Homo sapiens; identical to SEQ ID NO: 80119
  chr17:19985359-19985389
  Hypo

SEQ ID NO: 113075 - DNA, 189 bp, Homo sapiens; identical to SEQ ID NO: 80120
  chr17:19995800-19995989
  Hypo

SEQ ID NO: 113076 - DNA, 34 bp, Homo sapiens; identical to SEQ ID NO: 80121
  chr17:20008373-20008407
  Hypo

SEQ ID NO: 113077 - DNA, 30 bp, Homo sapiens; identical to SEQ ID NO: 80122
  chr17:20014279-20014309
  Hypo

SEQ ID NO: 113078 - DNA, 30 bp, Homo sapiens; identical to SEQ ID NO: 80123
  chr17:20108333-20108363
  Hypo

SEQ ID NO: 113079 - DNA, 30 bp, Homo sapiens; identical to SEQ ID NO: 80125
  chr17:20218717-20218747
  Hypo

SEQ ID NO: 113080 - DNA, 30 bp, Homo sapiens; identical to SEQ ID NO: 80126
  chr17:20516049-20516079
  Hypo

SEQ ID NO: 113081 - DNA, 241 bp, Homo sapiens; identical to SEQ ID NO: 80127
  chr17:20747219-20747460
  Hyper

SEQ ID NO: 113082 - DNA, 380 bp, Homo sapiens
  chr17:20755766-20756146
  Hyper
tcaccgagcgcacctcgcaatctctgatcttcgaacccactgaaaaagcacaaggcatggggagtcctgttggttcacgccccgggtgcgaataccaaaagcaactcccgctggaaagcctgcaggaaactcgagacaaagacagaggcaaacgcaacgctgggaagagccaggggtgctgccgtctgcaaaagcagagacgcgtctcccttcgggcaaagtgactgctacaaagtctgttccctcctgcgcagggacagagacatttaaaggcctgaacggacgtcagcaccagtagagctcgctgggtgagcgccaggcctccccgccccaaggatagcgcgcacagggcgatctgctgctcgcgaggtagaaagtgg

SEQ ID NO: 113083 - DNA, 198 bp, Homo sapiens; identical to SEQ ID NO: 80130
  chr17:20771771-20771969
  Hypo

SEQ ID NO: 113084 - DNA, 78 bp, Homo sapiens; identical to SEQ ID NO: 80131
  chr17:20813557-20813635
  Hypo

SEQ ID NO: 113085 - DNA, 39 bp, Homo sapiens; identical to SEQ ID NO: 80132
  chr17:20817539-20817578
  Hypo

SEQ ID NO: 113086 - DNA, 39 bp, Homo sapiens; identical to SEQ ID NO: 80133
  chr17:20817878-20817917
  Hypo

SEQ ID NO: 113087 - DNA, 114 bp, Homo sapiens; identical to SEQ ID NO: 80134
  chr17:21104001-21104115
  Hypo

SEQ ID NO: 113088 - DNA, 145 bp, Homo sapiens; identical to SEQ ID NO: 80135
  chr17:21147453-21147598
  Hypo

SEQ ID NO: 113089 - DNA, 64 bp, Homo sapiens; identical to SEQ ID NO: 80136
  chr17:21150794-21150858
  Hypo

SEQ ID NO: 113090 - DNA, 27 bp, Homo sapiens
  chr17:21168792-21168819
  Hypo
acctgaggctcttaacgattctctgga

SEQ ID NO: 113091 - DNA, 30 bp, Homo sapiens; identical to SEQ ID NO: 80138
  chr17:21178051-21178081
  Hypo

SEQ ID NO: 113092 - DNA, 196 bp, Homo sapiens; identical to SEQ ID NO: 80139
  chr17:21859901-21860097
  Hypo

SEQ ID NO: 113093 - DNA, 37 bp, Homo sapiens; identical to SEQ ID NO: 80140
  chr17:21911061-21911098
  Hypo

SEQ ID NO: 113094 - DNA, 30 bp, Homo sapiens; identical to SEQ ID NO: 80141
  chr17:21953249-21953279
  Hypo

SEQ ID NO: 113095 - DNA, 30 bp, Homo sapiens; identical to SEQ ID NO: 80152
  chr17:25309119-25309149
  Hypo

SEQ ID NO: 113096 - DNA, 40 bp, Homo sapiens; identical to SEQ ID NO: 80154
  chr17:25432176-25432216
  Hypo

SEQ ID NO: 113097 - DNA, 142 bp, Homo sapiens; identical to SEQ ID NO: 1616
  chr17:25620573-25620715
  Hypo

SEQ ID NO: 113098 - DNA, 163 bp, Homo sapiens; identical to SEQ ID NO: 80156
  chr17:25676870-25677033
  Hypo

SEQ ID NO: 113099 - DNA, 18 bp, Homo sapiens
  chr17:25680258-25680276
  Hypo
cctgtaatcccagcacgt

SEQ ID NO: 113100 - DNA, 30 bp, Homo sapiens; identical to SEQ ID NO: 80158
  chr17:25825913-25825943
  Hypo

SEQ ID NO: 113101 - DNA, 30 bp, Homo sapiens; identical to SEQ ID NO: 80159
  chr17:25879017-25879047
  Hypo

SEQ ID NO: 113102 - DNA, 160 bp, Homo sapiens; identical to SEQ ID NO: 80160
  chr17:25907710-25907870
  Hypo

SEQ ID NO: 113103 - DNA, 60 bp, Homo sapiens; identical to SEQ ID NO: 80161
  chr17:25928294-25928354
  Hypo

SEQ ID NO: 113104 - DNA, 201 bp, Homo sapiens; identical to SEQ ID NO: 80162
  chr17:25931558-25931759
  Hypo

SEQ ID NO: 113105 - DNA, 30 bp, Homo sapiens; identical to SEQ ID NO: 80163
  chr17:25936581-25936611
  Hypo

SEQ ID NO: 113106 - DNA, 30 bp, Homo sapiens; identical to SEQ ID NO: 45035
  chr17:25957285-25957315
  Hypo

SEQ ID NO: 113107 - DNA, 39 bp, Homo sapiens; identical to SEQ ID NO: 80165
  chr17:25977721-25977760
  Hypo

SEQ ID NO: 113108 - DNA, 30 bp, Homo sapiens; identical to SEQ ID NO: 80166
  chr17:25982331-25982361
  Hypo

SEQ ID NO: 113109 - DNA, 30 bp, Homo sapiens; identical to SEQ ID NO: 80167
  chr17:26078326-26078356
  Hypo

SEQ ID NO: 113110 - DNA, 102 bp, Homo sapiens; identical to SEQ ID NO: 80168
  chr17:26085974-26086076
  Hypo

SEQ ID NO: 113111 - DNA, 454 bp, Homo sapiens
  chr17:26120462-26120916
  Hyper
tctaaaagaggaaaacgcttttagtaaaccctcaggaatcccacagagcgcacatccccgccctccgatttctcccagagagagatggggccccgcccgggctcggagcccaccgcttccctcccagggcggacttcggcccgcggggtacctggctctgcgcgggcagcagtcaggcttcggccggaggatcctgcagagcagcctgcacagccggggcccggcggcctcgcacgccgcgcccagcccctcgcgcatggcccggctccttaggcgcagctccgctggctccacgcgcctcccagcgcccgcgctttatcgctcggagcctgcagcccccgccccgggggcggggcgagccgagcagcggcgggggctcttcacccacgcgatgtcccgggccgagctgcccctccttccctgccttccccggcgatcccgggacccaagcacc

SEQ ID NO: 113112 - DNA, 36 bp, Homo sapiens; identical to SEQ ID NO: 80171
  chr17:26125647-26125683
  Hypo

SEQ ID NO: 113113 - DNA, 31 bp, Homo sapiens; identical to SEQ ID NO: 80172
  chr17:26263183-26263214
  Hypo

SEQ ID NO: 113114 - DNA, 170 bp, Homo sapiens; identical to SEQ ID NO: 80178
  chr17:26346789-26346959
  Hypo

SEQ ID NO: 113115 - DNA, 23 bp, Homo sapiens
  chr17:26420105-26420128
  Hypo
accgcacccggcctagtggcttg

SEQ ID NO: 113116 - DNA, 639 bp, Homo sapiens
  chr17:26554500-26555139
  Hyper
tcctggtcactcagccgtcgtgagcgcaggcgcggggcgggcggagcgggacccctggggctctccccctgcggccccgctccaccgggggcgtggctagatctgaccgcgcccttccaggccccgccctcaggtatgggaaactaggccgcccggtcgcgcgcctctccaaaacgttcttcccagactgcgaggaccgcctcggcaggtggcggtaaaagcgcccccatcaagtcacataacatcctgcctccgagagcgcggtctggccccaccctggtccatcacttacgacgtctcccaggcttgcctccccggatcggattcctttcccttcgatcccgcaggccggaggcgcagacctgtggtgaggacacccgaggcctcctgggagacctgcagaccacgcccacctcatttacatgttcactcccgaccctggaaacccggatttcgcctccggacagcggcgtctgggcagggttcgggtactgcagtcccgcgtctggatgcccccgccccctgagctgcagggctgtgtgtggtccttccctggtcccaaaataaagagcgaattgcacagaaacggaatgtgtgcctttgtattttctttcctttctccttcgtggaggtggcgtc

SEQ ID NO: 113117 - DNA, 357 bp, Homo sapiens; identical to SEQ ID NO: 80183
  chr17:26578290-26578647
  Hyper

SEQ ID NO: 113118 - DNA, 38 bp, Homo sapiens; identical to SEQ ID NO: 80186
  chr17:26634205-26634243
  Hyper

SEQ ID NO: 113119 - DNA, 30 bp, Homo sapiens; identical to SEQ ID NO: 80189
  chr17:26897238-26897268
  Hypo

SEQ ID NO: 113120 - DNA, 48 bp, Homo sapiens; identical to SEQ ID NO: 80190
  chr17:26926767-26926815
  Hyper

SEQ ID NO: 113121 - DNA, 22 bp, Homo sapiens
  chr17:26927142-26927164
  Hypo
actggatttcaaacacgtcgta

SEQ ID NO: 113122 - DNA, 133 bp, Homo sapiens; identical to SEQ ID NO: 80192
  chr17:26961803-26961936
  Hypo

SEQ ID NO: 113123 - DNA, 528 bp, Homo sapiens
  chr17:27038663-27039191
  Hyper
cgtcctgacccacatcgctctccgcccaggtcttcgtctctacaggactcttgcgtgaagtccaaccctgagcctcagcccggccgagccctcggcccagccgtgaactccagtctcggcttcgcccccgcctagcccctaaccccgcctcatgctggcgcagcccccgccggcctccccagcccggctccaggctgcgtagtcttcccagctgggtctcagcgtcagccgcgttcttcatccggggcctccggcgcctcccaggcccctctttatctcagaccttaaccttacaggcccagctctcaccacccatctctggttccagcttgcagtccaaaccccagattttcaccctgcctccagatcgtagccccaattcttagtgttacaacgagccttgcccccagccccattcttagccccgccccggccattctctaaaccgcacactcccgtcccgctccccgccccaccgacccttgggaacccagccgcagccccgcctctgcccgctggcgagagagc

SEQ ID NO: 113124 - DNA, 33 bp, Homo sapiens; identical to SEQ ID NO: 80195
  chr17:27039851-27039884
  Hypo

SEQ ID NO: 113125 - DNA, 410 bp, Homo sapiens
  chr17:27044472-27044882
  Hyper
acaatcacccggggccgcggcgagcccaaaatcacccgggccctgggcgtcccgaagatgactctggggcgaggagactcttcggccgccaattgggggcggggagtcccgtctggtgggggccgggcccgcgcagaccctacgattacgcggggccggatagttcctacgattacgcggggccggatggttcctacaataacccggggccgcggagacccgacgtcatctcggggctgaggctgccctaccattacagagcggcccgggggcgcggagcggccccgccacacggggtcagtgtgggcaggggcggcgctgccaaggcccgcaggccgctggaggagggggcgaggggcccagtccggctacagggcctcgagtcccactccgctcgggctccgccaacg

SEQ ID NO: 113126 - DNA, 24 bp, Homo sapiens
  chr17:27056401-27056425
  Hypo
ctccctctgtcaccccggctggag

SEQ ID NO: 113127 - DNA, 24 bp, Homo sapiens
  chr17:27056845-27056869
  Hypo
gagccaccgcgacaggccagaagt

SEQ ID NO: 113128 - DNA, 30 bp, Homo sapiens; identical to SEQ ID NO: 16185
  chr17:27074858-27074888
  Hypo

SEQ ID NO: 113129 - DNA, 30 bp, Homo sapiens; identical to SEQ ID NO: 80201
  chr17:27085505-27085535
  Hypo

SEQ ID NO: 113130 - DNA, 20 bp, Homo sapiens
  chr17:27170162-27170182
  Hypo
tttttttttctgagtcgaag

SEQ ID NO: 113131 - DNA, 76 bp, Homo sapiens; identical to SEQ ID NO: 80203
  chr17:27181283-27181359
  Hypo

SEQ ID NO: 113132 - DNA, 30 bp, Homo sapiens; identical to SEQ ID NO: 80204
  chr17:27271675-27271705
  Hypo

SEQ ID NO: 113133 - DNA, 30 bp, Homo sapiens; identical to SEQ ID NO: 80205
  chr17:27299598-27299628
  Hypo

SEQ ID NO: 113134 - DNA, 367 bp, Homo sapiens; identical to SEQ ID NO: 80206
  chr17:27332366-27332733
  Hyper

SEQ ID NO: 113135 - DNA, 100 bp, Homo sapiens; identical to SEQ ID NO: 80207
  chr17:27333101-27333201
  Hyper

SEQ ID NO: 113136 - DNA, 30 bp, Homo sapiens; identical to SEQ ID NO: 16187
  chr17:27411663-27411693
  Hypo

SEQ ID NO: 113137 - DNA, 321 bp, Homo sapiens; identical to SEQ ID NO: 80209
  chr17:27419250-27419571
  Hypo

SEQ ID NO: 113138 - DNA, 30 bp, Homo sapiens; identical to SEQ ID NO: 80210
  chr17:27426754-27426784
  Hypo

SEQ ID NO: 113139 - DNA, 30 bp, Homo sapiens; identical to SEQ ID NO: 36425
  chr17:27466437-27466467
  Hyper

SEQ ID NO: 113140 - DNA, 30 bp, Homo sapiens; identical to SEQ ID NO: 80212
  chr17:27467405-27467435
  Hyper

SEQ ID NO: 113141 - DNA, 88 bp, Homo sapiens; identical to SEQ ID NO: 80215
  chr17:27716046-27716134
  Hypo

SEQ ID NO: 113142 - DNA, 120 bp, Homo sapiens; identical to SEQ ID NO: 80216
  chr17:27716194-27716314
  Hypo

SEQ ID NO: 113143 - DNA, 28 bp, Homo sapiens
  chr17:27716614-27716642
  Hypo
gagccaccgcgcccggccttacactttt

SEQ ID NO: 113144 - DNA, 30 bp, Homo sapiens; identical to SEQ ID NO: 80218
  chr17:27909175-27909205
  Hypo

SEQ ID NO: 113145 - DNA, 769 bp, Homo sapiens
  chr17:27940142-27940911
  Hyper
ggatccaggcttcaccgcggagttcagactctccccaggcattgacggggagaacttggtagggtctgggctccgccacgaccaggtgggggccaggacgccgcgggactgaccgcctccactagagggtggtggccgcgggccgccctggagcctccacgccgtgtcccggccccggccggtgggtgggtgcgcccgggagcccgcgacattccttccccacccccaggagcgccccgcccacgccgcagcgccagcctgcgcccccggcgtcagtgcccagccctcggcccagctcagggccaggttccggcggccacgtgttccggagctacgacgagcagctgcggctggcgatggaactgtcggcgcaggagcaggaggagaggcggcggcgcgcgcgccaggaggaggaggagctggagcgcatcctgaggctctcactgaccgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcaggcacggttcggggagggattcggcatggccgcggggtaccttcccaggccagggccctggaggcaactggcacggcctggtccccctgctttgctgtattctgattccccaacccgctcccctgggctcagatctgtcctgtcctagggcggagccaggcggtcctgaggggga

SEQ ID NO: 113146 - DNA, 850 bp, Homo sapiens
  chr17:27949432-27950282
  Hyper
gtgcccttcaaggcgcgtctgcggccccgagcctgaggcccggcctccctgcacccttcttcagcctgctgccctgacactgcgttcttgcgagacgaggtgtctgcgccctccgggagcgctggctgctgtccggccaaatatagacaccacgtcctccccgcccgaaaccgaatttggcggcgcggggggaggaggcgcagacctctgcccctcagggaccccgcccgctccgctggctgcggtgacggccgggtgtggggggctgggtacctggtcctgagcgggctgcggggcgctcacgctgcgaatcctctgcggaaggggcccgagtgcgtagggggccgaggaaggcttcagggcgaaggagccacctctccgggtgtctgtagtatctgggacccgggtgtccagctccgcactctggccgatcctgcggctctctagagcccggcgccgctgcagccccagctgccgctgccatcaacctaagagggcggggctagcataggggcggggccagagcccaagttgccccgccccctccagcggcgggaaagtcgagcgaccccgactcccctcccagcttccgccggcctcggagaaccatcgaaaataaatgtgcagctgtgtgctaggtgcgcacgctgcttccctccctccatgactcccgggtaggctggggaggctcgggttcgcagacctagagcaggacgcttggagagggaacgggcgagggggcgtgcgcccctagagcgggcagccgagggagaccaggtgcctccacccgcattccagcctcaatcgcgctcccaatttagctgtcccgatcggccgggactgcgggact

SEQ ID NO: 113147 - DNA, 30 bp, Homo sapiens; identical to SEQ ID NO: 80223
  chr17:27956058-27956088
  Hypo

SEQ ID NO: 113148 - DNA, 544 bp, Homo sapiens
  chr17:28088129-28088673
  Hyper
gagcgttcgcggaggcggagggcgcgcggcggactcacagctggttgatggcgttctgcgagatgaccgcgttggcggagaagtaaggaatcatgtcggggccaccgaggctgcaggtgcaagcgaggggcgccttcctcttgcgggccaacgtgctcagggtcatggggccggctcaaagtgcacaactccgcatcctggcctctgctctgctccggcacgaggcgcaggctgcgcgtgcacccggcggcggaggcgggcccgccgggtcgcgcggaggcagccgccgaagccccagggctcggcggtagagtccggactgacgggcgtcgccagcagttcgcccccacccgcgtccggggcgggacgggcgggtcctgagagcggagagggtaggcccggccggcgccccgccccagatctcgggacgcccgcgcggatcccgcagcgcgcgtcacagcctttagggcatccggcggccccaagacactgctgcctcggtaagggagtgaagctactcaagggtggacgagaaaggcttgca

SEQ ID NO: 113149 - DNA, 105 bp, Homo sapiens; identical to SEQ ID NO: 80227
  chr17:28089170-28089275
  Hypo

SEQ ID NO: 113150 - DNA, 35 bp, Homo sapiens; identical to SEQ ID NO: 80228
  chr17:28112487-28112522
  Hypo

SEQ ID NO: 113151 - DNA, 18 bp, Homo sapiens
  chr17:28299358-28299376
  Hypo
gcccggcccaggcatttt

SEQ ID NO: 113152 - DNA, 465 bp, Homo sapiens; identical to SEQ ID NO: 80232
  chr17:28562551-28563016
  Hyper

SEQ ID NO: 113153 - DNA, 61 bp, Homo sapiens; identical to SEQ ID NO: 36431
  chr17:28563999-28564060
  Hyper

SEQ ID NO: 113154 - DNA, 175 bp, Homo sapiens; identical to SEQ ID NO: 36432
  chr17:28705281-28705456
  Hyper

SEQ ID NO: 113155 - DNA, 102 bp, Homo sapiens; identical to SEQ ID NO: 80236
  chr17:28715707-28715809
  Hypo

SEQ ID NO: 113156 - DNA, 30 bp, Homo sapiens; identical to SEQ ID NO: 80237
  chr17:28836503-28836533
  Hypo

SEQ ID NO: 113157 - DNA, 30 bp, Homo sapiens; identical to SEQ ID NO: 80238
  chr17:28894952-28894982
  Hypo

SEQ ID NO: 113158 - DNA, 33 bp, Homo sapiens; identical to SEQ ID NO: 80239
  chr17:28902754-28902787
  Hypo

SEQ ID NO: 113159 - DNA, 206 bp, Homo sapiens; identical to SEQ ID NO: 80240
  chr17:28973624-28973830
  Hyper

SEQ ID NO: 113160 - DNA, 25 bp, Homo sapiens
  chr17:28988903-28988928
  Hypo
aaagagagaggcggccgggtgcggt

SEQ ID NO: 113161 - DNA, 205 bp, Homo sapiens; identical to SEQ ID NO: 80242
  chr17:29020865-29021070
  Hyper

SEQ ID NO: 113162 - DNA, 30 bp, Homo sapiens; identical to SEQ ID NO: 80243
  chr17:29032502-29032532
  Hypo

SEQ ID NO: 113163 - DNA, 185 bp, Homo sapiens; identical to SEQ ID NO: 80244
  chr17:29033276-29033461
  Hyper

SEQ ID NO: 113164 - DNA, 23 bp, Homo sapiens
  chr17:29232244-29232267
  Hypo
aggtttgtcttaggccgggcgcg

SEQ ID NO: 113165 - DNA, 27 bp, Homo sapiens
  chr17:29234370-29234397
  Hypo
cgcctggccaaccgtaaggaattgaac

SEQ ID NO: 113166 - DNA, 525 bp, Homo sapiens
  chr17:29249414-29249939
  Hyper
gagcccttccagtcccgctctcttccctggccaggcacccgaccgcccgagtccgggctctcgatgtctgcgcacccaggcgcgccccacgccctcggactcagacatcccagccagggctaaacgtcgggcccaggccgccgacagtcctgtgccccctgcccgctcccagacgccccccgaaggcctccccagcgccccacctcggggacgccgagggccccctaactcagcctccccacctgcagctccgcgccgagccccgcggtgcgccccccgcgccctcctctcggttccttctgagtcccttcacttccacgtcgcgcagcctcagactctctccccgggccctgaactgcctccaggatcttcaccccggtcgccgcgcagcggccggtgggctaaccagaaggtgccaggctggccgcttagttcgccttaggtgggagaaggggcgccccacctgccccagtgccccgagcccagccctggtttcttcaccgcgctttccgctcagctcctctc

SEQ ID NO: 113167 - DNA, 286 bp, Homo sapiens
  chr17:29298080-29298366
  Hyper
gcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagat

SEQ ID NO: 113168 - DNA, 508 bp, Homo sapiens
  chr17:29335342-29335850
  Hyper
ggaaaagcaaaatcccgggtccctcagacaaaagggcgggtggaggaggagaagccgagagtcctgctccggcgccgccggagcaccgcctgcctcagccgaccagcgccgtcgactactgggcctagcccagacgagaggagggaaaggccgcagaggccgcgaggatgctgcggaggcgcgggcggccggctgccgcctagttgtgcagcccagaccaaggaaagagaagtgggaggagcggggagctcggcgtcccgcgtcctccgcggctcaggacgactacgctcggcacgtccgggaccctccggccgtggcggttgcagcgccaaaagctcgggcctcagcccctgacgctgtggtgactccgccgcgcctcgccgtcgcccctgtccccgtcctgcccgccgcctccgccgctggggacatgtccaaccccggaagccggaggaacgggcccgtcaagctgcacctgacaggtgagggggagcgccgggccgggctgggc

SEQ ID NO: 113169 - DNA, 41 bp, Homo sapiens; identical to SEQ ID NO: 80251
  chr17:29396500-29396541
  Hypo

SEQ ID NO: 113170 - DNA, 427 bp, Homo sapiens; identical to SEQ ID NO: 80253
  chr17:29718113-29718540
  Hyper

SEQ ID NO: 113171 - DNA, 509 bp, Homo sapiens
  chr17:29718778-29719287
  Hyper
ggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccgggtatccctggcccagccgggccctcgctttccgccccccggcgcccgtgccccgagcgtcacgcgtcacgcctagggtggcttctgcgcccaccttccttc

SEQ ID NO: 113172 - DNA, 32 bp, Homo sapiens; identical to SEQ ID NO: 80255
  chr17:29805337-29805369
  Hypo

SEQ ID NO: 113173 - DNA, 276 bp, Homo sapiens; identical to SEQ ID NO: 80256
  chr17:29886452-29886728
  Hyper

SEQ ID NO: 113174 - DNA, 235 bp, Homo sapiens; identical to SEQ ID NO: 80257
  chr17:30243754-30243989
  Hypo

SEQ ID NO: 113175 - DNA, 43 bp, Homo sapiens; identical to SEQ ID NO: 80258
  chr17:30244921-30244964
  Hypo

SEQ ID NO: 113176 - DNA, 36 bp, Homo sapiens; identical to SEQ ID NO: 80259
  chr17:30250325-30250361
  Hypo

SEQ ID NO: 113177 - DNA, 30 bp, Homo sapiens; identical to SEQ ID NO: 45052
  chr17:30333112-30333142
  Hypo

SEQ ID NO: 113178 - DNA, 32 bp, Homo sapiens; identical to SEQ ID NO: 80261
  chr17:30334317-30334349
  Hypo

SEQ ID NO: 113179 - DNA, 180 bp, Homo sapiens; identical to SEQ ID NO: 80263
  chr17:30389685-30389865
  Hyper

SEQ ID NO: 113180 - DNA, 144 bp, Homo sapiens; identical to SEQ ID NO: 80264
  chr17:30622364-30622508
  Hypo

SEQ ID NO: 113181 - DNA, 28 bp, Homo sapiens
  chr17:30710928-30710956
  Hypo
aacaaaaaaacatcgactagagcagtgg

SEQ ID NO: 113182 - DNA, 78 bp, Homo sapiens; identical to SEQ ID NO: 80266
  chr17:30822187-30822265
  Hypo

SEQ ID NO: 113183 - DNA, 176 bp, Homo sapiens; identical to SEQ ID NO: 80267
  chr17:30846483-30846659
  Hyper

SEQ ID NO: 113184 - DNA, 66 bp, Homo sapiens; identical to SEQ ID NO: 80268
  chr17:30954269-30954335
  Hypo

SEQ ID NO: 113185 - DNA, 36 bp, Homo sapiens; identical to SEQ ID NO: 80269
  chr17:30986312-30986348
  Hypo

SEQ ID NO: 113186 - DNA, 45 bp, Homo sapiens; identical to SEQ ID NO: 80270
  chr17:31144850-31144895
  Hypo

SEQ ID NO: 113187 - DNA, 30 bp, Homo sapiens; identical to SEQ ID NO: 45056
  chr17:31162054-31162084
  Hypo

SEQ ID NO: 113188 - DNA, 155 bp, Homo sapiens; identical to SEQ ID NO: 45057
  chr17:31214020-31214175
  Hypo

SEQ ID NO: 113189 - DNA, 27 bp, Homo sapiens
  chr17:31370236-31370263
  Hypo
tcggcacatccccgttttactgatgag

SEQ ID NO: 113190 - DNA, 30 bp, Homo sapiens; identical to SEQ ID NO: 80274
  chr17:31372520-31372550
  Hypo

SEQ ID NO: 113191 - DNA, 2156 bp, Homo sapiens
  chr17:31618291-31620447
  Hyper
gttctgccttggcatcgtggagtggtaacactgcaagaggcctggggacagccccgagggggcggaacaccaggcctcctgactgccggggagtggggcgcagagggagcgggttcgcgcggagggcaactcacggaggagaagttgtgcggcccgcagagctcgccgcggtacttgcaggagagcagcatgtcctccagctggtggcccaggcggtccatgaaggcggcgctgattccctcgaagtggcgcggaggcaggaagaggcggaagtccgccagcttgcggaaccactggcggcgcggctcgtcgccccgcagcagctcgctgacaagcgggcgcgcggtgcggttgggcagcagcagcccgagccagtggccggcatagtagaggtcccccttggagaggcgcgggaagcgcagcgggttgttgttgcacacagtgacggcggggaagggtaactggcggctccactcgcggtgcacccgcgtgtgtgacgggaagctgagccagtagagcaagcggttcgaggaccaggacagcagcaagccgaaggatgtacagaaggccagcacccacagcgcccgccgctggaaggagcccccagccgccgtgcgcccggcacacatgtgccgcagcccgtgcagtttagcgcggctcagcgatggccgccccctgcgggcgacccctggcccctgcagcgcccgctcgccgcctctgccgcccccgggctgcccggcagccgccaacgccgcgggcgccggctcctcgcgggccatgcggaagcgtcccgggccggtgagcgcggctgcgggcagcccggctccgccaatccggctcattcattcagcccgcggctggcggcagcggcggcggccccggccgggcggagccgccatgggagtccgcagcagcagtggaagcagcagcagcggcagccgcgcgcagcccgcgccagggaagcgtgcgcccgaaaggagctccggtggcgcggcatgcccgcccggcgccgccgctgccgcctccgcgggcgcccgcccggggctgagcgccgcctcagcccgcagcccctggcagtggcctctcccgagcgcctcccaggctttcccggcccctggtcttcctggaggatgcccggcgcccggcactacttctggaggggtcccactgggagccgcctctccagtccctgggtgctgcgcccgccttccctcgtcctggacctcgggggaccctgagccgagtcccccctgccccgcctaaccccagcttttacgctggtcctgggagaagggccactcggccaccatgcctgatctggacatccccagggaccccaccagcccggcccgtagcccagcggtgctgggacacgggagagaaggcgccaaggaacgagcgcccccagaggcgcaccgcggctcctggctgggcgggcggggtgggtgtgtacgggggtgagtggtcgccttgccggctgccgccttctttcccttcccctccaggacccttccttgttactgctccctgggctgcgctcggcagagacctgcttaggcttccccaagtcctgcgcctaagtcctgccaggcgcccgctctcgcctggggctgagagcttctcagggcgtcctgcgggaggctgttcgccgccggggtccttcaaggatgctagccgcagggaagtgtcgcttctcgcctcggctctcccaggtgcctcgcgtctccagaaaagcccagccttgctgtctctcgcgtcttctctctgcccccgcggcgacaagagctggggactgcggggacccgccaacacctcccgggggtgacccggactcgctgctccgcgcgcccttctcctctcgagactccgagctcgcggtggccgtgacgccggctaagctccttccccggttgcccgggagaaccctctttgggccccaggcgaacttgggcagcggccgcgcgacgctggcgcggctgggctccgagcacctgctcctcagctcgctggccccgcggctccgggcgggcggggcggcggcggccgtgagcgccgtgcgctcctggagacgcggtgctgacgcgcccggctcctcctcgctgcattttaattcctggccactgtggccgctgcacaccgagcgggaagcctcttgc

SEQ ID NO: 113192 - DNA, 184 bp, Homo sapiens; identical to SEQ ID NO: 45058
  chr17:32237066-32237250
  Hypo

SEQ ID NO: 113193 - DNA, 82 bp, Homo sapiens; identical to SEQ ID NO: 80278
  chr17:32239182-32239264
  Hypo

SEQ ID NO: 113194 - DNA, 23 bp, Homo sapiens
  chr17:32239704-32239727
  Hypo
attatagactagggccgggtgag

SEQ ID NO: 113195 - DNA, 30 bp, Homo sapiens; identical to SEQ ID NO: 80280
  chr17:32257150-32257180
  Hypo

SEQ ID NO: 113196 - DNA, 109 bp, Homo sapiens; identical to SEQ ID NO: 80281
  chr17:32275435-32275544
  Hypo

SEQ ID NO: 113197 - DNA, 32 bp, Homo sapiens; identical to SEQ ID NO: 80282
  chr17:32478151-32478183
  Hypo

SEQ ID NO: 113198 - DNA, 221 bp, Homo sapiens; identical to SEQ ID NO: 80283
  chr17:32483992-32484213
  Hyper

SEQ ID NO: 113199 - DNA, 112 bp, Homo sapiens; identical to SEQ ID NO: 80284
  chr17:32905966-32906078
  Hyper

SEQ ID NO: 113200 - DNA, 715 bp, Homo sapiens
  chr17:32906304-32907019
  Hyper
aggggcgagcggaatcgcgaggtcggcccttggcccgagtctcattaaggagccgcgcgcgccgccaggctaggaatgcggaatggacacgtggacagaggagggggagctaggagtcggggagtctccgtggcgcgcgagctgtgggccgcgcgctcgggggccacgtgaccacggggaatctgggaggggtgggagtgagcgcgccaagctcggcgcccgcttctgcccgggtgggcgctgaatcccggacggaggaggagggcgggcgagcgcgagtgtgtgtgtctctctcgagtcatttacggcggagcagccggcgcgagcgccgaggaggcggcgacggcggcggcggctgcttcgtgcaactgtggcttcccccacctcctcttcctttttgctcctcgattcttcttcttcccccacacacgtccatggggagccggctcccctgccagcacctcctctcctctcggccccgtaggcaccagctgccgcttccctggccgcaagctgcgcaggtgccggctgccctggcccctggcgccgcgcccgcgtctcaccgcccgcagcccggactggcgcggcgatccgctcgcccaaactgactcggagggagcgggagccgatgcccggcagcatcgagacagcgggcgaacgggcgtccggggacagggtgggggcggcggggaggaggcgtcggagactctgaacc

SEQ ID NO: 113201 - DNA, 1922 bp, Homo sapiens
  chr17:32907224-32909146
  Hyper
attagccggctttctcgctccctcgcttctccaagccccatctacatggggcagcccgttctggccgcgccacccttgccccagccgccgagcggctgcctgggcaggaggcgctgagccggcctgtgtggagcctgggccctgatccagactggagaaagcgcgctggagcggaggagcgagccttgcgaggggacaaacatctggccgcccgcctcgggcatccggtctgggcgtcgcctagggtggtggcgaccggcgtcgccagtttcagcaccgcacggaaacttttccttctccagatggattaaagttgtctggattttctctttctttgagaaagacagcattcatttgcacctgacctgggatttttatgctgggctgctgcaggggcttggaggaagaaagcggcgctatccatgtgcggttactaccgaaaccgaggaaactggggattgcgttggaagtcggcaccctcgagtgagttcggattcgagctgggccgtgaggccgggagattcagcactgggctctaggtagcccccgggacgcccgcggccaccgggctccggactgcacgtgcagctccccccgcgcctcgcagatcctgcagggggcaccagctgggggaggtggaggctcctcccgcccggagctgcgcccccaccggctccgagggtgtagccgccagcgcctgggacgccccctccccgcaaagtgtccccgaattgcactctctggtcccggagctgcatctgagacagccgggcgccacggcagccctgagttggatgtgaccaagcccagcctggggccaagtcgtcgtcgactgttgctctctcggacccctcccgcccccgcctcggccatggccccggggatgtcgggccgcggcggcgccgccctgctctgcctctcagcgctactcgcccacggtaagtgtcgcggcgcggactgggggtgaggatgcggcaggcgccactggagggggtacggggaagactggggagaggagcacccacaccccctggactcgcagccgccactccgggtttggcgtctctggctgcagctcgagttaccgccagcccccgagccctccggcgagctcagctgaggggaccgagcccggcgccagaaaagggtggggggagggtgtcgctccagtcctctcctggttataaagaagggttcgaacccgaaggtctggggtcgtgtccgcccacggaaatctagagggatccgagggatcctccggatcgcgtccaggccgccccccgcccccgtctctccctgcagccggccgggctgggggctgttgggatccgccgggatcgcgtctttcctcgccccgggcgcgcaggccggtgcggggccgcgccgcccgtcgcctcgcttcctgcggcggtcctcgggaagggaagtggactgactccgggccggggagccgccgcggctcgcacgcccgcggtcctgtgagctgcatctaaatggccggcttaggcgagcccggagggcgggggtctgggcacccgcacaggccggggcggtgggccgcgggccgcgcgcggagggagcgggctccgcgctctcgcattctgcaatctgttgcgtctgctccccaggctcgccccgggctccgcggtaaagggggtgggagaaggagggattgaggttggcgcgctttggcggtgggacagcgggcatacgggtggggggcagcgggtttttgaacagcccccaagaatgggaaatcagaccagagggaaggaggctgcagcgggccttccgcaagctggagacgctccaggaggcgaggggagcagaccgaggtgggagggagagagctccgaaaggagagtggagaagcggggccctctgctccctcctaacgtgaaaccagccgacctgggatacat

SEQ ID NO: 113202 - DNA, 205 bp, Homo sapiens; identical to SEQ ID NO: 80291
  chr17:32953266-32953471
  Hyper

SEQ ID NO: 113203 - DNA, 30 bp, Homo sapiens; identical to SEQ ID NO: 80292
  chr17:32953682-32953712
  Hyper

SEQ ID NO: 113204 - DNA, 64 bp, Homo sapiens; identical to SEQ ID NO: 80293
  chr17:32965239-32965303
  Hyper

SEQ ID NO: 113205 - DNA, 211 bp, Homo sapiens; identical to SEQ ID NO: 80294
  chr17:33102688-33102899
  Hypo

SEQ ID NO: 113206 - DNA, 30 bp, Homo sapiens; identical to SEQ ID NO: 80295
  chr17:33124973-33125003
  Hyper

SEQ ID NO: 113207 - DNA, 30 bp, Homo sapiens; identical to SEQ ID NO: 80296
  chr17:33179323-33179353
  Hypo

SEQ ID NO: 113208 - DNA, 100 bp, Homo sapiens; identical to SEQ ID NO: 80298
  chr17:33447192-33447292
  Hypo

SEQ ID NO: 113209 - DNA, 27 bp, Homo sapiens
  chr17:33601404-33601431
  Hypo
atggctgaataggaacggctccagtct

SEQ ID NO: 113210 - DNA, 220 bp, Homo sapiens; identical to SEQ ID NO: 80300
  chr17:33672862-33673082
  Hyper

SEQ ID NO: 113211 - DNA, 320 bp, Homo sapiens; identical to SEQ ID NO: 80301
  chr17:33673302-33673622
  Hyper

SEQ ID NO: 113212 - DNA, 34 bp, Homo sapiens; identical to SEQ ID NO: 80302
  chr17:33688778-33688812
  Hypo

SEQ ID NO: 113213 - DNA, 904 bp, Homo sapiens; identical to SEQ ID NO: 80303
  chr17:33700472-33701376
  Hyper

SEQ ID NO: 113214 - DNA, 30 bp, Homo sapiens; identical to SEQ ID NO: 80304
  chr17:33701582-33701612
  Hyper

SEQ ID NO: 113215 - DNA, 120 bp, Homo sapiens; identical to SEQ ID NO: 80305
  chr17:33718792-33718912
  Hypo

SEQ ID NO: 113216 - DNA, 30 bp, Homo sapiens; identical to SEQ ID NO: 80306
  chr17:33772552-33772582
  Hypo

SEQ ID NO: 113217 - DNA, 444 bp, Homo sapiens; identical to SEQ ID NO: 80307
  chr17:33775327-33775771
  Hyper

SEQ ID NO: 113218 - DNA, 17 bp, Homo sapiens
  chr17:33877286-33877303
  Hypo
aggtgcagtggctcacg

SEQ ID NO: 113219 - DNA, 38 bp, Homo sapiens; identical to SEQ ID NO: 45062
  chr17:33917230-33917268
  Hypo

SEQ ID NO: 113220 - DNA, 30 bp, Homo sapiens; identical to SEQ ID NO: 80310
  chr17:33933196-33933226
  Hypo

SEQ ID NO: 113221 - DNA, 30 bp, Homo sapiens; identical to SEQ ID NO: 80311
  chr17:33991634-33991664
  Hypo

SEQ ID NO: 113222 - DNA, 30 bp, Homo sapiens; identical to SEQ ID NO: 80314
  chr17:34400013-34400043
  Hyper

SEQ ID NO: 113223 - DNA, 399 bp, Homo sapiens; identical to SEQ ID NO: 36457
  chr17:35014243-35014642
  Hyper

SEQ ID NO: 113224 - DNA, 30 bp, Homo sapiens; identical to SEQ ID NO: 80316
  chr17:35042671-35042701
  Hypo

SEQ ID NO: 113225 - DNA, 41 bp, Homo sapiens; identical to SEQ ID NO: 80317
  chr17:35054437-35054478
  Hyper

SEQ ID NO: 113226 - DNA, 445 bp, Homo sapiens; identical to SEQ ID NO: 80318
  chr17:35060232-35060677
  Hyper

SEQ ID NO: 113227 - DNA, 189 bp, Homo sapiens; identical to SEQ ID NO: 45063
  chr17:35061647-35061836
  Hypo

SEQ ID NO: 113228 - DNA, 424 bp, Homo sapiens; identical to SEQ ID NO: 80320
  chr17:35078532-35078956
  Hyper

SEQ ID NO: 113229 - DNA, 834 bp, Homo sapiens
  chr17:35165308-35166142
  Hyper
gtgtccttgccttgccgtctcccgcattcgggccgctccccgcatttccaccccgctcccactgctgggtaaatgttcatctggacggggacaggatcgggaaccgccgggcagggggtctgcgcggcggcgtcctcccctccccgcccggctctcccgctccatccccgcggcctggccaagggcagcgccaagggcgcccgcggagggcgcagctgccccggacggagcccccgccacccccacagccgcgcgggtgctccagagcatccaacttcatttccacttcaattttatcagcggccggggagccgggcgggagataggaggccggccctgacacgaattagcccggagattgtccgatacgccttggccagggcgccggcgccgcgcgctcgcctccctcgcctctcctttgtgtccgcctcgcctcgcctctcggcctcgccgcgctccattcccgcggcgctggcccgggccgagcgaactgctttgcctttggccacgttgagcgcgccgaggcagccgggggcgcggggctccaggacccgtctgctcctggtgcccccagctcctcagggtccggccgggtcacctgggccgatccaggcgggcaggggcctcgctgctcctcccccgcagcccctctcgccctcccggggaccgtgtgcggggagcagctgggagctgcgtctggaggggctgtccgactggggaacttgtcctgtgccttgtccatgccattacattcatcctcccaagaaccctgagaaatgaggagatcgtcagagaaggggaaactgaggctcagagaggcgacagtactcgccc

SEQ ID NO: 113230 - DNA, 181 bp, Homo sapiens; identical to SEQ ID NO: 80323
  chr17:35242096-35242277
  Hyper

SEQ ID NO: 113231 - DNA, 30 bp, Homo sapiens; identical to SEQ ID NO: 80324
  chr17:35248683-35248713
  Hypo

SEQ ID NO: 113232 - DNA, 358 bp, Homo sapiens; identical to SEQ ID NO: 12667
  chr17:35285437-35285795
  Hyper

SEQ ID NO: 113233 - DNA, 432 bp, Homo sapiens; identical to SEQ ID NO: 80326
  chr17:35289269-35289701
  Hyper

SEQ ID NO: 113234 - DNA, 48 bp, Homo sapiens; identical to SEQ ID NO: 80327
  chr17:35290025-35290073
  Hyper

SEQ ID NO: 113235 - DNA, 775 bp, Homo sapiens; identical to SEQ ID NO: 80328
  chr17:35290334-35291109
  Hyper

SEQ ID NO: 113236 - DNA, 1341 bp, Homo sapiens
  chr17:35291320-35292661
  Hyper
ctctccatgtccctgcgaccgattatgttttaaaacaaaagctcaatggaaacgaaaacaaaacaaaacccaccatttgtctaatgtgctgtccccgtggaggagttaaatctggactccaaacctagaatctggagccaagaggcgcactttgagttgcgctcctggccccccttgcagagacgccagggttggctcctgcggacctgtttactgagccatctggacaccaggacgagcggagcctgacgccctagagcgagcgtcctgtcctcatcctcaactctcctgcctcgctggtccgtctgtggggaggggccttctttcccctatacctaggtcccaaggttcttacacccctaaatggatggagcaacctcctcctgcccaccagagggaggtgacaggccctgggttggggaagggccgacagctaggtccagctgtcgtccggtaggtcccactgaccgccccacactccaccgtgacccctctgctttgcatgagaaggagcccagctgggacgggggcggaggcaagccacccgggactggggccactatagattccagaaaggggcggttgggtcgagggcgctggcggcgagaaccgggacagctgcggggaggggaggagtgtgaggacagcagggctggactggccccctccccgcaggcctcacgcagcgcagcaggctgggaggcgcctgggggtccgggtggaagaagtggggaccccatgccacacggcttttggcgcttgcgggggtgccagaagcctaccgagtaccggtcgtcttccgccgggaagtgccgggtccgcaggaggagcgcgaagccgagtccgagcccgcggagcccgccccctagatcgcagaaccgccttctccatcctctgccctgccccgcgtcggggtctgggagcgaccggcggaggccggcggcgcgccggagctgactagtcccctacgctcctccggcccgcagcggggagcccacatgtgtatgtgcaagaaggtgtggagaaggcgttagggtcccggcacccacgggtcagggcagaacgccaacgagtcgcactgcgggtctccgcggcttcggtttccatgacatggtgacgccggcggcaaggcggggggctgcctgtgggccttgaggttgctgggcggtgcgggcggagtcagcaaaggggcgttggcaaagccctaaaaccccacggttccacggagcgcaagccagattctctgaagcagcttccccgttcgtccgaagagggtattccatctgcacagcgggattccctgccagcccaggttcactgcgactccgcttccccgagcat

SEQ ID NO: 113237 - DNA, 35 bp, Homo sapiens; identical to SEQ ID NO: 36469
  chr17:35292896-35292931
  Hyper

SEQ ID NO: 113238 - DNA, 4542 bp, Homo sapiens
  chr17:35293669-35298211
  Hyper
gacaatggcaacagccgctgaattgcaaagcccagcagtgcaggggagccgcctgggattccggacccggctgcaccccaaccttccacaaggctcggtcttggactacccccactctacagcagaactctggcctccgcctgcgcctattcccgctctctctctgtccctcccatcgaaacccacgccttaccggagcaggagggggcccaggcacggtgctgcccgccgtccgcgccgcgcggggccgcgggtgccgccgccactgatcctctaaacgcggtctccccgcactctcccgggccgggggatgcagaatggtttacagagggaccgcgaggcgctgattggtcgcaggccgcagtgacgtcggcgggcgctgcattaaggcgagggggcttccagagctcagccaacagccaggagcagtgaccaagccgccggagctggggagagacgcaccggggcggcgactgggccaggagaccagggactgagggacgcgcccggggagggccagcaacaagccgcggcccgggcgcgacagcggcggtccgcgccgagccgttccagccgccggcctactgtagccgctgcgccaggacatttttttttaaagctctccaagctgcccccctcctccccgactcctcccgctgcaaaagaaaaacaaaaaaaaaaaaggaaggaggctagaaaggaaacccagatttgccaccacaacgaaaaaaagaaggggaaaaggaaaaggagagaaagtcgagcgactgtggggttagacggaggcagacagagcgtgggccgagcgatgcggggctgtgcgcccaggcggccgcgagttgtgactggagccacgatgcacggccaggcgcggtgagaagccagcccgtagtgcctcccgaaggagcccgggcgcagggagggtcgccctgaggacacggaggccgccaggcaggccaagggccgaggtgactgggctggggcggtagggaaggagcgagtgcgcctggctgcctccgcacggagttgtccctctctgttttcgattgacacaaacacttctccaaaagcggggaaacctaagcaacaacagcaatcaacaccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgagtactttcctcccacgcctctgctgctacctccccgcgggcccttcccggccagcttcggatcagaggttagcgtggcctcgctgcccagttaggaactgcttctagagagggcagccaagtcccgcgggcgcccgcctctccgccagctggcgcgctgggagcccgggacgcggccctgcttgcatcctggaaactatgggtctgggtttggctgcatgtgcctgggaagaaagggtctgagcctgactcggcccagaagccccttcaagcttggaagagacagggcagcctcgggcgttgtagcccggactgctgtctttcccggagccaagctctgcagcaactgcattctccaggccttcggggttgtttgccctccaggcagagcccaggctccctcccggccactaccttttccgaccccgagcggtcttggcggtaagctccgagccttttgcgtagagtgtctgggccaactgccctgtcagcggcaggaaagaactcggccttaaagccgatcctgcacgcccgggggtcttccccaaacccggacatgcctccgagtgcagacctggacaaactgctgcactgtagcctgcgaagtgcccggagctttttcctgcttccctggctgccgaagttgtctggtggttcggcttcagccccaggtgactccgactcccacgggctccgctcagtagtcctcctaggaaactgccagccacagccagcaacctccttgatgaaacctgggggaaagccgagacctccagcttgctggtggggagacttctccctaccccccttattcgtttagcattttaattatattatcgtacactcacaattttgccgctccattcacacaaacacacaagtcaacagagaagaacgggcacaaatgcgaattgtaattccaccctacggatgtgaaatatcgcaatttactcggctgacttggtctctgcttttctgagtttgtggtcatagttcaaaccagggagcaggaggaagagggattcaaagccactcagagggccaagacgcgctgtccccagtgccgctccaggactcgtggctggggttgggttgcgtggaaccatgaagcaaagctccgtgctcgctggtatttcgggagaacgcgcaggctgagcctctgagcctccgcgggctgcccggttttcctcaaggactggatcatagcgggagggtggcaaaccgtactcgtacccgctgccagtgggtccctgagcctggcttccacaacccgcggcagagcgcccagagccagctcccgcagctcccgcttttgccaacctgtcccgctttaggcaagagcgtggcggcggccccgctaaggctacggaggggggctctccgcggctatgtttgtttaccaacagcggggctagacatcgccaaccccatgcctatgtgcgggtccttttgcgatgaaggagagaaaagcggcgctccgcgcacgtttatatagagttctaattgtaattcgacttttctgaatctaatcggaaaataagtgccccgttccccccgcccacacaggtcactgccttgccaccttctttagacgatgcatctttcctctgggataacgctgggagtgaggctggggcttggcgggtagcttgggcccctggctctaaccgcgtgtatcccctccctaactcttccctggtgccgcgctctctctcctgctgcctcctcacctgcttaaccggaattctgcctctctttatctctctcttcccttctttctgtgctccattcctcctctcctacttcctccactttttacatcttccctctttctcgctgtcatctttctctccgcctgtctccccttgcccctggctgacccatccccgcccccgccccccacccccacccccccgcaggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcgggtgaggccccaattcctggctggctaggtgcaagcgggtcctgggggaggaaggctcgccaaggccccggctcatctgtcctttccctcttagccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtcaggccccggcgcgcctctccatcc

SEQ ID NO: 113239 - DNA, 1993 bp, Homo sapiens
  chr17:35299152-35301145
  Hyper
attattttggagaggcgtagtctctatgtgtgtacagccccagagaagcggtaactgtgatagtgtgactgttagaaaaactccagctataccacaactctccccctccagacacggcggcctgtccaggtcctcctgtgggattcctgctcaccattggctcagggtccgccctgagtggtcctagtcagagatcgcaccgtcaccactaccctacacacacacacaagcgcgcgcgcgcggtgtcggctagccaggcggtgaaggggtgctggctaggcccggagcaccccggggtcgggggtggagtctcggtggcctcaccccgccgccatgtgctgcaggtctggttccagaaccggcgctccaaggagcggaggatgaagcagctgagcgccctgggcgcccggcgccacgccttcttccgcagtccgcgccggatgcggccgctggtggaccgcctggagccgggcgagctcatccccaatggtcccttctccttctacggaggtgggtgcgcgccgaatggcggggcacggccaggtcggggcgggcttcgttggaagcgggtggcagcgcgggggggcacgcctcgctctctgtaagccactggagagttggggcgagtagggagaaggctgggagtaaatcaaggggaggcggcgagaccgaggacccaattcacggccctgaataacgggggtagctggtaaggggcagctcccgggcttgcgcccagcctcctccctgcacccaggcccgcgagggctccccgcgatccgcgagttccccgcgtggccttcctcagcccgccgaggtcgcgtcttccctccctttcggtcccgccggcccccggccgggccctgacgtcctgcgccctccccgccgctccgcagattaccagagcgagtactacgggcccgggggcaactacgacttcttcccgcaaggccccccgtcctcgcaggcccagacaccagtggacctacccttcgtgccgtcatctgggccgtccgggacgcccctgggtggcctggagcacccgctgccgggccaccacccgtcgagcgaggcgcagcggtttaccgacatcctggcgcacccacccggggactcgcccagccccgagcccagcctgcccgggcctctgcactccatgtcggccgaggtcttcggacccagcccgcccttctcgtcgctgtcggtcaacggtggggcgagctacggaaaccacctgtcccacccccccgaaatgaacgaggcggccgtgtggtagcggggtctcgcacggtctgcggagttcgtggttgtacagaaatgaacctttatttaagaaaaatagaaaaaaaaaaaaacataaaaagcaagtccccacccccttcctccagcctcgagaaccattctccttctggggagaccggatggaaaagggggacacgaaataggatccaaatcggcctcgaggtgggactgggatccgcgcactggctgtcgacgtgcagaactggggctccccaaaggaaacgcagacctctccccaactcccacctggacccggatccgtagacagaccccgcgggcgtgtgcgcctggcaggcgggcggcgaaaagacgtccagggcagccgcgggtgcgcacagccgttggcgatgccaggagccgtggggagggaggccgtgagcacagccgggtgaaggaagtgaagcggcccagggcgctcccgggccagccaggagggttctagctctgggatatcccttattagtgttgtctcagagttcaacaacagcgacaaaaaactcttatagcttcagaaacgccgacctgccgtgcatcaggtgggactatatatatattttttgtctatctggatttttggtttttgtttttgccaaaattgcaaaattctaaatgtaaagccctccgtatcaactcttctaccttcgcaaaactacacatacacacatacacacgtacacggacacactcggta

SEQ ID NO: 113240 - DNA, 592 bp, Homo sapiens; identical to SEQ ID NO: 80340
  chr17:35303075-35303667
  Hyper

SEQ ID NO: 113241 - DNA, 30 bp, Homo sapiens; identical to SEQ ID NO: 80343
  chr17:35870444-35870474
  Hypo

SEQ ID NO: 113242 - DNA, 49 bp, Homo sapiens; identical to SEQ ID NO: 80345
  chr17:36102031-36102080
  Hyper

SEQ ID NO: 113243 - DNA, 3446 bp, Homo sapiens
  chr17:36102282-36105728
  Hyper
gagaaaggccagctccggccgggagccggggaccgggaagcgcgcagtcccgaccttcctcccctgcctttctcttccaggaggtttactagaactccaggaactccaaaacgcgacttttctttctctttgcttttcgtcttaagggaacacggtgggcaaaagaagggagtgcgtgtgcccgaggcttgggagccccctgtgcagtgacctaggaaccgctagcgatttcttgaaaaattactttaatcaagtccggcgctcccgggagcgggggaggaaaggcagcacccgctcgggacgggagaaaaaagcctccaggtctgtcccgcgtctccaactcggcgagggtctccggctccccagtccctctccctgccctgctggggcctggggctttggggagggaagagcggggctggggtctaaggaccctgggccgggcctggctctccgccggccgggcctgcgggtgtcggcgacccgggggctccgcgggcggctcgggcgctcacagagcccgcgtcccgcgccagagcggtgaggccgcggggccgcacggggcgcctggctgggtgcgcgctgggagcggcgagcagccccgcgcccgcgttttgatctccttcccccctctaagccgcgtttacaacttcaccaatgaataacccgcctctcttttcaacctaatcacggctctttgtgtatctttctgttgatgatttatagaaataaattaataacaccccaactccacgtgctgcagtttatgttacgtctcagctgcggccagcccggcgcggggctgggtgcggaggggcgccccaggtccttccagcgccgcgctagaaagcgggcgcctgcggccgggtgggagggcctaggccctgtggcccccggtggccggcggtgggagcctggttcatccgccaggtcctgagcgacctccccggcagccctggcgccccagccgctcctaggggccactctctcgacccctcttagcctccgcgactcacaccttccgcctcgcggaactctcttgcaggagttctctcccggtaggggagaaatcacctccgggcgggagagcgacgagggaagaacctcaaacctatgaattataccaaagtgtgtttggggaaaaaaaatctacaagttcccctgattgttttggctagagggcaaaccgccaggccctcggagcacaaattcaaatgcaaggtcatatcccaccccaaaccgccgctgcggacgtgcggccaaggctcagccccgaaatcgcggcgcttcagtgtccgaagccacgcgatgggctctgtcctaaagcggagtggcccgggagcgacgtgctgtctcagggaaccgctcggctccttagataattagtaaccagctgtcaaagtctagggcggtcggggaggacccacaaacgatcccggccctggggatacactgccagccggcctgaactcccggggagaggccgggggtgggcagcgaggtctggaaacgccctcctttctcagactgagaccagatcctctgcgaactgaggtctgagacgcgttcgcccccacaccaccgcgcttcgtttctttggccccgcgcgtgtccacccggaccctgcatggaacatgccctttgcaaatctaaacccgcgttggggatcccggataattccgggccttgcatgggcgcggctaacaagagtgcccaccagggaactcgcctcccagatcccggctccggatgccgcctgtccttcggcaaagaactgcaggtcatcatgcaggtcaatgtgtccgaggccgacatgcggctttccagacccgaggcagcgcgcaggaaaaatgcgcggcctggggcttgcagcggcgcgaggctctgctcccgggaagtcgcagcggtttcactgcacccactcgcaccttcagtcgcgtgggcaaacctcccggcaaagggctccacagctccagttctccccggcccagccccagccccgcggggaaaagcccttgggtctcggacgctggcctgggcctggggagaagaagcccggtgggccgcagggtcgtcccgctaagggattgggaagggtccgggtgttgggagagaagcagagcgccccccgggggacttctctggtgggaaacgggcttggcgagtgtggtcgggcgcagtgtcactcaggcccggggccggggctccaggggttcgggtgggtcccctccacctcgctctgcgcctacctgagcatccggtccacctccgcccgctgctccgccgcctcctcggtgttgagcgcctgcagctccttgaggatgggaggtgtgtcatagtcgtcgccgtcctcggagccctcgtcgccggacaagcggcccttggcgtggccgttggtgagagtatggaagaccggcttggtgtcgggctcggccccgctgccaggggacaggggcagcgtctccagcttcaccccgaagttcggggatggcagcaactcctccaaggcctgaaccagcacctccttggtgaccccggagctcagcagggcgctcaggagttcttgctggagcgacgtgagcttggacaccattttccaaggacggaaaaagaagggggtgagggggtgggtgggtgcgagagaggagggtggaggggagtttcacaagcaaaccccaaatccaggaacccctccacccttcagcctccagacacctgttactccccggggtcccggaggctcctccgaaaggagtcagaaaacttctaacttgccatgatcgccaccattaggccatataagatatgcaaattagtgggaagggcccagctttcggctggatgcaaatgatggtggggagggggaaacccggagagagggagagccggaggggcagacctggagagcagaagacctgggccgggagcggggctttgccagggtccattgtactcacgctggggggctagagaccttcttttactggttctgcttatcagccaaacttcacctaacctttggacttgttaagccagtgccttgcagcctaggcgcggggcttttccaccggttctcagttccgctttagtccagagagaagacactacgcttcggggttcaggtgagagccagaggaagctggggtgctcgtggaagaaggggacgcaggaggaagcgaagagtagagaccctggatgcgtcccggccgacgcaggtggtgggccaggagagcccgcagggcggaagagaaactgaccacttaggaaggggcgccgaggccacgggggaggtgaggcagcgttaggtgtggtgagcatgccctggagggactccatttatttctacctcggttactacctccaggccccagaacctccctggcctggtctggcggtttgggtttgcagaactgcccgccagagagcgtaggcgagggtgaaggagt

SEQ ID NO: 113244 - DNA, 30 bp, Homo sapiens; identical to SEQ ID NO: 80351
  chr17:36149200-36149230
  Hypo

SEQ ID NO: 113245 - DNA, 94 bp, Homo sapiens; identical to SEQ ID NO: 80352
  chr17:36204447-36204541
  Hyper

SEQ ID NO: 113246 - DNA, 161 bp, Homo sapiens; identical to SEQ ID NO: 80355
  chr17:36714931-36715092
  Hyper

SEQ ID NO: 113247 - DNA, 177 bp, Homo sapiens; identical to SEQ ID NO: 80356
  chr17:36729010-36729187
  Hyper

SEQ ID NO: 113248 - DNA, 74 bp, Homo sapiens; identical to SEQ ID NO: 80357
  chr17:36829977-36830051
  Hyper

SEQ ID NO: 113249 - DNA, 30 bp, Homo sapiens; identical to SEQ ID NO: 80359
  chr17:36868552-36868582
  Hyper

SEQ ID NO: 113250 - DNA, 30 bp, Homo sapiens; identical to SEQ ID NO: 80360
  chr17:36874946-36874976
  Hypo

SEQ ID NO: 113251 - DNA, 458 bp, Homo sapiens; identical to SEQ ID NO: 80361
  chr17:36875921-36876379
  Hypo

SEQ ID NO: 113252 - DNA, 40 bp, Homo sapiens; identical to SEQ ID NO: 36491
  chr17:36905467-36905507
  Hyper

SEQ ID NO: 113253 - DNA, 30 bp, Homo sapiens; identical to SEQ ID NO: 80363
  chr17:36996160-36996190
  Hypo

SEQ ID NO: 113254 - DNA, 30 bp, Homo sapiens; identical to SEQ ID NO: 80364
  chr17:37006691-37006721
  Hypo

SEQ ID NO: 113255 - DNA, 32 bp, Homo sapiens; identical to SEQ ID NO: 80365
  chr17:37010814-37010846
  Hypo

SEQ ID NO: 113256 - DNA, 84 bp, Homo sapiens; identical to SEQ ID NO: 80366
  chr17:37011083-37011167
  Hypo

SEQ ID NO: 113257 - DNA, 30 bp, Homo sapiens; identical to SEQ ID NO: 80367
  chr17:37161944-37161974
  Hypo

SEQ ID NO: 113258 - DNA, 144 bp, Homo sapiens; identical to SEQ ID NO: 80368
  chr17:37183463-37183607
  Hyper

SEQ ID NO: 113259 - DNA, 40 bp, Homo sapiens; identical to SEQ ID NO: 80369
  chr17:37192161-37192201
  Hypo

SEQ ID NO: 113260 - DNA, 30 bp, Homo sapiens; identical to SEQ ID NO: 80370
  chr17:37211142-37211172
  Hypo

SEQ ID NO: 113261 - DNA, 245 bp, Homo sapiens
  chr17:37307508-37307753
  Hyper
ccccctcgcggacatcgccaggccgtccacacctgcccatgcccacacctgactgcccgtccctccccgcccccggcccacccgggccggctcccgccagtcctacctgctccgggctgggggctcagcgcccgggcagcctccctgagcaccagcaccaggagccagagctcgcctcgcatggtgggtgcccggacctgcccccggcctgcttgctgccccggtcctgacgagggagggggccc

SEQ ID NO: 113262 - DNA, 35 bp, Homo sapiens; identical to SEQ ID NO: 80373
  chr17:37307992-37308027
  Hyper

SEQ ID NO: 113263 - DNA, 756 bp, Homo sapiens
  chr17:37321152-37321908
  Hyper
atttgaatgccagaccgaggagccgcagtactaggaaggtccaagcagcgtgcccaatcgctcctccggactacagaggagcccgggaacccagggaagagctccagtgattggtccccctgcctgtcagtctggtgggaggcccagctctctaccctccccgcccgagagtcacttacaaccggtagagaatggtggtctttccttcattgtccagtcccacgatgatgaccgtgtgctctggaagcgtcggaggaagggcagcgtcagggccaaacccgaagaccaagggactgtgtgcccccaccagacctcccaggaaggagatagcgctccccgcaggctggggacctctgcccaccgtaccgcgtctgcttcccacccagctccgacacctgccccactccgggacggtggaaaagacagctgagcccccacctcccttcacattccagaaaagtgtctgaaaggcccggggcgcttcggggcttgccaagagacggtgtttagagaaagagcataacgcgaagtcacaatcgcaggaaactcgcagcagccccccatccccgccgctggctccgtttagcggggagaaaggagggtcgcccagctttgcgtcctggggcgcaccgaagcgccgggacccaagaggagcaggcagggacgggggcaggggaggccgcggggcagtcgaggagcgcccatatacgaccctcggagcccgaggtccccccgtgcgtccgaccacagatcaga

SEQ ID NO: 113264 - DNA, 55 bp, Homo sapiens; identical to SEQ ID NO: 80376
  chr17:37331238-37331293
  Hyper

SEQ ID NO: 113265 - DNA, 625 bp, Homo sapiens; identical to SEQ ID NO: 80377
  chr17:37366040-37366665
  Hyper

SEQ ID NO: 113266 - DNA, 216 bp, Homo sapiens; identical to SEQ ID NO: 80378
  chr17:37369107-37369323
  Hypo

SEQ ID NO: 113267 - DNA, 1619 bp, Homo sapiens
  chr17:37380799-37382418
  Hyper
caggagtctgggctccgcctgccttcgcggggagtaatttattcatggtgactccctcaggagtaacaatcatccataattagggttaatgatgacattcattaattacgatgacttctctttttgcttctacccgctccccctcctctggtcccgctcccgtggtggggcgcggggctgcctgtctttctggtctggagccacaaccgcaggcccccgtcctcgcccgtgaccgacggccggcgctgctgcaggccccctcgcggactccgcagctgcgcacccccggccgcggcctcgcgtccccgagcccaacagggctaggagcggggaatgcaggactgcggaggggcagggagagacgccctgagacgcggagataaacacccggagacgccgggagagacggggagagacgcacacagagacaccaagacacagacacgcaggttgtagagacaaattcagagacacgagcgaggatagaggcgcggactgagcccgggactgggacccggcggccgctggagggtgcgcctcgcacgcacagccgggcgcgtaccccgcccgcaccgctccacgcgcgccctccggcctcgctgcgcccatctctccaacgaagaccagtggccgcctccccagaaggtcgcgatggcgcgcgcgggcgtgcggtgccggtgtgatcgggggctccttgtggcccctcgtcgccaacccactcctacccccgggagcggcgcggagcctcagtggtcacgcgggcctcgcgaccgcgaccctaggacgcccgggcccacaggaggaccccgccgggaagagggcgcccgggcccggggcgcggacaggccttgcgccccccaagttaccttggtttcctggagggcggagacggtccctggggggctgtgggtggccgcgtcatccggttcgttctccttctcgctcatctcggtcatggttcggggagaggggaggagagggtgccgagatccgacggcaggcccaccgcgggcaggctgcgggtggcgggcgtctccgggactctgaagccgttctccagaggctgcccccagttagcccccggcacggcagcccccaacccgcgggagcgggcagagaaagttgccggggtggcgggcgaggggaggccaccacgctgagccgcaggagcgggacgaccccgggcgcgaggaccgagggtctgcagaggatgctgctcgcagcgcggggaggagggaagtggggccgcggggatgagccgagggagggagccaaggagctgtccgtgtccagccggctccgccgtccgctgcgcccgccccccatcccctcccctcccccgccggccccagcccggcacccggcggcccctccgcccagtcctcgccgcccaactttgatttaggaggtcgcctggtcccgccccctgccctacgccgctcccccgcgcagccctgcaaatcaggctctcagctattggctgcctcggtggccaggagggcgaactgggcggagtcttggggggctcgacacgatggggcggggcttggcggggaaagaagcggaggagggagtttcacactgaaaaacccgggatggaggggcgtgaccagattgag

SEQ ID NO: 113268 - DNA, 92 bp, Homo sapiens; identical to SEQ ID NO: 80382
  chr17:37388387-37388479
  Hyper

SEQ ID NO: 113269 - DNA, 38 bp, Homo sapiens; identical to SEQ ID NO: 80385
  chr17:37606487-37606525
  Hypo

SEQ ID NO: 113270 - DNA, 30 bp, Homo sapiens; identical to SEQ ID NO: 80387
  chr17:37725131-37725161
  Hypo

SEQ ID NO: 113271 - DNA, 574 bp, Homo sapiens
  chr17:37752808-37753382
  Hyper
aatccatcagtggggcggcagctcccgcgcccccaccccctgcccctgctggatcccgcggttgacgccctcctctcctcctccccgcactggccgcgtaggtggcctcgggtgcggaggtcccggcctggcgcaatcagttgcagagcggatggggcgggggcgcccagccttcttgcgcgcggtgtctcctccctgggtgaacagatgtctcggaattttagatgtgctctccgcccctcctcgcaataactccccccaccacccccgcagctggcaccggctgtggcgtggcgccctcctcctcccccaactcccaatagcaaaaccgggtgatggatccgggagcacggctggaggcttgggccaggaggcccgggaggcccgcggcgtggcagtggcggctcccagcgcggagggaaccattgggcgctgttcggacctcttcccttgtgtccttccttcccttctcccgcatccactcactcccatctctccactgtctatgtccttctcgacctctgccccaccctacagcccatcccagccaccgcgtctacgaagatcctctaca

SEQ ID NO: 113272 - DNA, 365 bp, Homo sapiens; identical to SEQ ID NO: 80390
  chr17:37755352-37755717
  Hyper

SEQ ID NO: 113273 - DNA, 214 bp, Homo sapiens; identical to SEQ ID NO: 80391
  chr17:37756190-37756404
  Hyper

SEQ ID NO: 113274 - DNA, 184 bp, Homo sapiens; identical to SEQ ID NO: 80392
  chr17:37757101-37757285
  Hyper

SEQ ID NO: 113275 - DNA, 679 bp, Homo sapiens; identical to SEQ ID NO: 80393
  chr17:37760128-37760807
  Hyper

SEQ ID NO: 113276 - DNA, 1660 bp, Homo sapiens; identical to SEQ ID NO: 80394
  chr17:37761179-37762839
  Hyper

SEQ ID NO: 113277 - DNA, 30 bp, Homo sapiens; identical to SEQ ID NO: 80395
  chr17:37763142-37763172
  Hyper

SEQ ID NO: 113278 - DNA, 49 bp, Homo sapiens; identical to SEQ ID NO: 80396
  chr17:37763437-37763486
  Hyper

SEQ ID NO: 113279 - DNA, 379 bp, Homo sapiens
  chr17:37763928-37764307
  Hyper
gcccctcctcccaaccggcgggtcagatctcgctccctttcggacaacttacctcggagaggagtcaaggggagaggggaggggagggggggagggggcaagagagagaggggggagaagagggatcttctcgcttatttcattgttcccccatcttcagggagcgggggcagcggctcctcaaggcggcgggcgccggcgtcttcagagcgccatgcgaaccgcggagcgagtgtggcatctctaccaggcggggtaccagcctctatgccaggccatatgggcttggcacgtcacgggcagcagctatcacatgagagacggtgattggcatgcgtctgcactgggggagagccggctcccccgggacccgccgcca

SEQ ID NO: 113280 - DNA, 30 bp, Homo sapiens; identical to SEQ ID NO: 80399
  chr17:37768957-37768987
  Hypo

SEQ ID NO: 113281 - DNA, 590 bp, Homo sapiens; identical to SEQ ID NO: 80400
  chr17:37783185-37783775
  Hyper

SEQ ID NO: 113282 - DNA, 177 bp, Homo sapiens; identical to SEQ ID NO: 80401
  chr17:37794035-37794212
  Hyper

SEQ ID NO: 113283 - DNA, 147 bp, Homo sapiens; identical to SEQ ID NO: 80402
  chr17:37823798-37823945
  Hyper

SEQ ID NO: 113284 - DNA, 314 bp, Homo sapiens; identical to SEQ ID NO: 80403
  chr17:37856412-37856726
  Hyper

SEQ ID NO: 113285 - DNA, 219 bp, Homo sapiens; identical to SEQ ID NO: 80404
  chr17:37857048-37857267
  Hyper

SEQ ID NO: 113286 - DNA, 121 bp, Homo sapiens; identical to SEQ ID NO: 80405
  chr17:37879785-37879906
  Hypo

SEQ ID NO: 113287 - DNA, 19 bp, Homo sapiens
  chr17:37887184-37887203
  Hypo
tttttttttttgagacgga

SEQ ID NO: 113288 - DNA, 17 bp, Homo sapiens
  chr17:37887620-37887637
  Hypo
cccggtgctgatggcat

SEQ ID NO: 113289 - DNA, 30 bp, Homo sapiens; identical to SEQ ID NO: 80409
  chr17:38179243-38179273
  Hypo

SEQ ID NO: 113290 - DNA, 44 bp, Homo sapiens; identical to SEQ ID NO: 80410
  chr17:38179589-38179633
  Hypo

SEQ ID NO: 113291 - DNA, 26 bp, Homo sapiens
  chr17:38237916-38237942
  Hypo
cctttaaaataaaggcgaggctgggt

SEQ ID NO: 113292 - DNA, 349 bp, Homo sapiens; identical to SEQ ID NO: 80412
  chr17:38264389-38264738
  Hyper

SEQ ID NO: 113293 - DNA, 554 bp, Homo sapiens
  chr17:38347464-38348018
  Hyper
cgccctcctgcctttcgctcctcatcgccttgcactgccatcttcccacccactcccctcaccccctggcgccctggccgcccctccgctgccgtgggtgcagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctgtgagtgcggccgtcggcgggatggggggccggaggccggaggcccgcgccgccgcccgcccctgaccccgcctcccacccccgcagctgcaagcagaaccaggacctgctgtctttctacgccgtggtcatggggctggacaacgccgctgtcagccgccttcgactcacctgggaggtgatgagacccctcccgttcctacctgggaatctgggcatcccgggctccccgaagtgcgtcctcccgggacggccgccggcctggagggagt

SEQ ID NO: 113294 - DNA, 30 bp, Homo sapiens; identical to SEQ ID NO: 80415
  chr17:38357434-38357464
  Hypo

SEQ ID NO: 113295 - DNA, 212 bp, Homo sapiens; identical to SEQ ID NO: 80416
  chr17:38445259-38445471
  Hypo

SEQ ID NO: 113296 - DNA, 264 bp, Homo sapiens; identical to SEQ ID NO: 80417
  chr17:38478595-38478859
  Hyper

SEQ ID NO: 113297 - DNA, 133 bp, Homo sapiens; identical to SEQ ID NO: 80418
  chr17:38497512-38497645
  Hyper

SEQ ID NO: 113298 - DNA, 29 bp, Homo sapiens
  chr17:38498083-38498112
  Hyper
ggtacaagggaggacgcccgcccctcttc

SEQ ID NO: 113299 - DNA, 48 bp, Homo sapiens; identical to SEQ ID NO: 80419
  chr17:38498548-38498596
  Hyper

SEQ ID NO: 113300 - DNA, 30 bp, Homo sapiens; identical to SEQ ID NO: 80420
  chr17:38604410-38604440
  Hyper

SEQ ID NO: 113301 - DNA, 180 bp, Homo sapiens; identical to SEQ ID NO: 80423
  chr17:39682549-39682729
  Hypo

SEQ ID NO: 113302 - DNA, 30 bp, Homo sapiens; identical to SEQ ID NO: 36515
  chr17:39683809-39683839
  Hyper

SEQ ID NO: 113303 - DNA, 30 bp, Homo sapiens; identical to SEQ ID NO: 80425
  chr17:39705165-39705195
  Hyper

SEQ ID NO: 113304 - DNA, 180 bp, Homo sapiens; identical to SEQ ID NO: 80426
  chr17:39768846-39769026
  Hypo

SEQ ID NO: 113305 - DNA, 30 bp, Homo sapiens; identical to SEQ ID NO: 80427
  chr17:39788206-39788236
  Hypo

SEQ ID NO: 113306 - DNA, 36 bp, Homo sapiens; identical to SEQ ID NO: 45073
  chr17:39803800-39803836
  Hypo

SEQ ID NO: 113307 - DNA, 20 bp, Homo sapiens
  chr17:39834139-39834159
  Hypo
acccctctgataaaacgaga

SEQ ID NO: 113308 - DNA, 30 bp, Homo sapiens; identical to SEQ ID NO: 45074
  chr17:39855665-39855695
  Hypo

SEQ ID NO: 113309 - DNA, 384 bp, Homo sapiens; identical to SEQ ID NO: 80432
  chr17:40332806-40333190
  Hyper

SEQ ID NO: 113310 - DNA, 205 bp, Homo sapiens; identical to SEQ ID NO: 80433
  chr17:40400826-40401031
  Hyper

SEQ ID NO: 113311 - DNA, 30 bp, Homo sapiens; identical to SEQ ID NO: 80434
  chr17:40427458-40427488
  Hyper

SEQ ID NO: 113312 - DNA, 334 bp, Homo sapiens; identical to SEQ ID NO: 80435
  chr17:40464190-40464524
  Hyper

SEQ ID NO: 113313 - DNA, 39 bp, Homo sapiens; identical to SEQ ID NO: 80436
  chr17:40477850-40477889
  Hypo

SEQ ID NO: 113314 - DNA, 24 bp, Homo sapiens
  chr17:40536417-40536441
  Hypo
gattacaggcgtgagccaccgcgc

SEQ ID NO: 113315 - DNA, 84 bp, Homo sapiens; identical to SEQ ID NO: 80438
  chr17:40573790-40573874
  Hyper

SEQ ID NO: 113316 - DNA, 350 bp, Homo sapiens; identical to SEQ ID NO: 80439
  chr17:40574086-40574436
  Hyper

SEQ ID NO: 113317 - DNA, 84 bp, Homo sapiens; identical to SEQ ID NO: 80440
  chr17:40669654-40669738
  Hyper

SEQ ID NO: 113318 - DNA, 46 bp, Homo sapiens; identical to SEQ ID NO: 80441
  chr17:40689596-40689642
  Hypo

SEQ ID NO: 113319 - DNA, 123 bp, Homo sapiens; identical to SEQ ID NO: 80442
  chr17:40705905-40706028
  Hypo

SEQ ID NO: 113320 - DNA, 24 bp, Homo sapiens
  chr17:40801969-40801993
  Hypo
ctccctctccgaaaaaaaaaaaac

SEQ ID NO: 113321 - DNA, 152 bp, Homo sapiens; identical to SEQ ID NO: 80444
  chr17:40831916-40832068
  Hyper

SEQ ID NO: 113322 - DNA, 15 bp, Homo sapiens
  chr17:40893475-40893490
  Hypo
cggcctgctcccaaa

SEQ ID NO: 113323 - DNA, 143 bp, Homo sapiens; identical to SEQ ID NO: 80446
  chr17:40912910-40913053
  Hyper

SEQ ID NO: 113324 - DNA, 30 bp, Homo sapiens; identical to SEQ ID NO: 80447
  chr17:40921807-40921837
  Hypo

SEQ ID NO: 113325 - DNA, 426 bp, Homo sapiens
  chr17:40932499-40932925
  Hyper
gctgctcgcgggatccgcaccgcgggagcagctcggaggggcggccctggggggcaagggcgggccgcggggcggcgacgggggcggggccaggccgagctgggggctggggccgcagccgctcagccggagcgcagcgcacccagcgagtccgtctgtcaggccgcctcctctccggccgtctgattttctacccttcggcgccctgctcttcctcatgttggcatccccggccacggagaccaccgtcctcatgtcccagactgaggccgacctggccctgcggcccccgcctcctcttggcaccgcggggcagccccgcctcgggccccctcctcgccgagcgcgccgcttctccgggaaggctgagccccggccgcgctcttctcgtctcagccgccgtagctcagtcgacttggggctgct

SEQ ID NO: 113326 - DNA, 40 bp, Homo sapiens; identical to SEQ ID NO: 80450
  chr17:40933234-40933274
  Hyper

SEQ ID NO: 113327 - DNA, 30 bp, Homo sapiens; identical to SEQ ID NO: 80451
  chr17:40951150-40951180
  Hypo

SEQ ID NO: 113328 - DNA, 103 bp, Homo sapiens; identical to SEQ ID NO: 16200
  chr17:40975574-40975677
  Hypo

SEQ ID NO: 113329 - DNA, 34 bp, Homo sapiens; identical to SEQ ID NO: 80453
  chr17:41131532-41131566
  Hypo

SEQ ID NO: 113330 - DNA, 30 bp, Homo sapiens; identical to SEQ ID NO: 45079
  chr17:41188525-41188555
  Hypo

SEQ ID NO: 113331 - DNA, 146 bp, Homo sapiens; identical to SEQ ID NO: 80455
  chr17:41278547-41278693
  Hypo

SEQ ID NO: 113332 - DNA, 35 bp, Homo sapiens; identical to SEQ ID NO: 80456
  chr17:41290312-41290347
  Hypo

SEQ ID NO: 113333 - DNA, 20 bp, Homo sapiens
  chr17:41416854-41416874
  Hypo
ccttgcgggatctgcagact

SEQ ID NO: 113334 - DNA, 280 bp, Homo sapiens; identical to SEQ ID NO: 80458
  chr17:41464702-41464982
  Hypo

SEQ ID NO: 113335 - DNA, 30 bp, Homo sapiens; identical to SEQ ID NO: 80459
  chr17:41651782-41651812
  Hypo

SEQ ID NO: 113336 - DNA, 80 bp, Homo sapiens; identical to SEQ ID NO: 36525
  chr17:41723454-41723534
  Hyper

SEQ ID NO: 113337 - DNA, 94 bp, Homo sapiens; identical to SEQ ID NO: 80461
  chr17:41723778-41723872
  Hyper

SEQ ID NO: 113338 - DNA, 56 bp, Homo sapiens; identical to SEQ ID NO: 80462
  chr17:41791451-41791507
  Hyper

SEQ ID NO: 113339 - DNA, 32 bp, Homo sapiens; identical to SEQ ID NO: 36527
  chr17:41832619-41832651
  Hyper

SEQ ID NO: 113340 - DNA, 66 bp, Homo sapiens; identical to SEQ ID NO: 80464
  chr17:41957220-41957286
  Hypo

SEQ ID NO: 113341 - DNA, 741 bp, Homo sapiens
  chr17:41983831-41984572
  Hyper
atcacccatagtgtccgcaggcgagcggaccagcagtgaaagggagaggtttcttccaacctcccacccatccctccatccatacacatacaaagaggtgcggagaagaaaggtctgacaaaggcgctttggagagcgagaggtcgcggggaggtctggacagaactgagggccagaggatggggtcgaaaggccaggcggacgtgcatgcttggaccatcagatcacccctgccccaacggacccagccctaacaccctgggcgctaggacctgggggaggggggcgtgttgtgagccatcaaagaaggctctctacgtgcgcgcccgccggagaccagggatgaggtcactaaatgactgccccggccaacccccaccccgtctttatccgcaccgccccccccttaattgacctaactttctaaccctagctcttcgcttctggcaccggtcccctcccaagtctccagaccctaaccctggctcccgacccgccccgctacagcttgggaagcgggagaagcagcgcgcgcccttctgcggaccccctcccagggaagattgtggtgttagctgcctagggggaccagggggccaccgggacccagcgcaacctctgtctcgctccccaacccccggaagcgctaacagcacggttcttacgtaatgccgggcttctaagtacccccaacccgcacagcccccggggaggccgcgcagataccggggcccctcacag

SEQ ID NO: 113342 - DNA, 39 bp, Homo sapiens; identical to SEQ ID NO: 80467
  chr17:41984976-41985015
  Hyper

SEQ ID NO: 113343 - DNA, 38 bp, Homo sapiens; identical to SEQ ID NO: 80468
  chr17:42015533-42015571
  Hyper

SEQ ID NO: 113344 - DNA, 465 bp, Homo sapiens
  chr17:42030329-42030794
  Hyper
caggtctgggccctccgacctgcggaagcgaaggggaaggaattggatctggggaggcgagcctgggagacgtcgttaagtgatgttgccagggtagggccaggccgcgctctcggatgcaggatgtgtggtaacgggcgcttttaccgcgacctgacggggcggtcctcgccgtcggggaagaacgttttggaaagaagcgtgtccgggccgtctcttttcccatacctgggggcggggaagggaagagcgtggtcagatctggccacgcccccaggtggagcggggccgcagggtgagagccccaggggtcccgctccgcgcctgcgctcaccgctgccgggtgaccaggttgaggtagtggcgcagggaggcgtagtagcggttcagctcctccggcgaggcgtcttcgcggggagcctcgggtttgatggggtaggcgtcgaccagcgcccctaggcagac

SEQ ID NO: 113345 - DNA, 187 bp, Homo sapiens; identical to SEQ ID NO: 80471
  chr17:42061233-42061420
  Hyper

SEQ ID NO: 113346 - DNA, 1570 bp, Homo sapiens; identical to SEQ ID NO: 80472
  chr17:42082149-42083719
  Hyper

SEQ ID NO: 113347 - DNA, 129 bp, Homo sapiens; identical to SEQ ID NO: 80473
  chr17:42091732-42091861
  Hyper

SEQ ID NO: 113348 - DNA, 229 bp, Homo sapiens
  chr17:42092128-42092357
  Hyper
tcttgcccacatcaccgccccctgccgcgtttagcggctgcgtaggcctgctcaccggcgtgcctcagccctctcagcgtacagcatgagctggctgaagcagccccaaaaggggcagcgtgtgagcagcaccgaacccaactgcatgatcagctgcaacatccaccgtctcgaacctatcttcgacgccatcttgggaaagggcagtccgctgcggcctcaccccagt

SEQ ID NO: 113349 - DNA, 89 bp, Homo sapiens; identical to SEQ ID NO: 80476
  chr17:42142826-42142915
  Hypo

SEQ ID NO: 113350 - DNA, 80 bp, Homo sapiens; identical to SEQ ID NO: 80477
  chr17:42222379-42222459
  Hypo

SEQ ID NO: 113351 - DNA, 75 bp, Homo sapiens; identical to SEQ ID NO: 80478
  chr17:42287799-42287874
  Hyper

SEQ ID NO: 113352 - DNA, 120 bp, Homo sapiens; identical to SEQ ID NO: 80479
  chr17:42301918-42302038
  Hypo

SEQ ID NO: 113353 - DNA, 23 bp, Homo sapiens
  chr17:42329685-42329708
  Hypo
acaacccccggcctctatcggtc

SEQ ID NO: 113354 - DNA, 325 bp, Homo sapiens; identical to SEQ ID NO: 80481
  chr17:42330572-42330897
  Hypo

SEQ ID NO: 113355 - DNA, 135 bp, Homo sapiens; identical to SEQ ID NO: 80482
  chr17:42331636-42331771
  Hypo

SEQ ID NO: 113356 - DNA, 58 bp, Homo sapiens; identical to SEQ ID NO: 80483
  chr17:42335454-42335512
  Hypo

SEQ ID NO: 113357 - DNA, 30 bp, Homo sapiens; identical to SEQ ID NO: 80484
  chr17:42335968-42335998
  Hypo

SEQ ID NO: 113358 - DNA, 30 bp, Homo sapiens; identical to SEQ ID NO: 80485
  chr17:42364250-42364280
  Hypo

SEQ ID NO: 113359 - DNA, 44 bp, Homo sapiens; identical to SEQ ID NO: 80487
  chr17:42390058-42390102
  Hypo

SEQ ID NO: 113360 - DNA, 664 bp, Homo sapiens
  chr17:42392337-42393001
  Hyper
tggtcatcgattacacgccctacctaaagttcacgcagaggtgagcggctccatgactgcggcggggcgggggacggggcctcgggacatcctggggacgtcctggtcccaccgccctcagcggccagcgcagacgcgcggggggaggggcgggaccggccgtgcccactgctccctctcccaagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaaggtgcgcgacgccggcgggcccggggggcgggcgggccgggcgggggatccgggcatcccggggcggggcggggatgggggccgcggccgggacgtcctcccagccgcccgggctgagccggcgccccgcagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgtgagcgcacggcctgccctaacc

SEQ ID NO: 113361 - DNA, 155 bp, Homo sapiens; identical to SEQ ID NO: 80491
  chr17:42393420-42393575
  Hyper

SEQ ID NO: 113362 - DNA, 329 bp, Homo sapiens; identical to SEQ ID NO: 80492
  chr17:42393870-42394199
  Hyper

SEQ ID NO: 113363 - DNA, 41 bp, Homo sapiens; identical to SEQ ID NO: 16204
  chr17:42395128-42395169
  Hypo

SEQ ID NO: 113364 - DNA, 30 bp, Homo sapiens; identical to SEQ ID NO: 80494
  chr17:42395520-42395550
  Hypo

SEQ ID NO: 113365 - DNA, 24 bp, Homo sapiens
  chr17:42401293-42401317
  Hypo
caccgcacccggcccactgtgaga

SEQ ID NO: 113366 - DNA, 124 bp, Homo sapiens; identical to SEQ ID NO: 80496
  chr17:42402772-42402896
  Hyper

SEQ ID NO: 113367 - DNA, 20 bp, Homo sapiens
  chr17:42587335-42587355
  Hypo
ccagacgccttctcaaaaaa

SEQ ID NO: 113368 - DNA, 612 bp, Homo sapiens; identical to SEQ ID NO: 80498
  chr17:42635148-42635760
  Hyper

SEQ ID NO: 113369 - DNA, 414 bp, Homo sapiens; identical to SEQ ID NO: 80499
  chr17:42733506-42733920
  Hyper

SEQ ID NO: 113370 - DNA, 43 bp, Homo sapiens; identical to SEQ ID NO: 80500
  chr17:42734191-42734234
  Hyper

SEQ ID NO: 113371 - DNA, 17 bp, Homo sapiens
  chr17:42737897-42737914
  Hypo
cccggccagaattacat

SEQ ID NO: 113372 - DNA, 82 bp, Homo sapiens; identical to SEQ ID NO: 45090
  chr17:42787212-42787294
  Hypo

SEQ ID NO: 113373 - DNA, 82 bp, Homo sapiens; identical to SEQ ID NO: 45091
  chr17:42787534-42787616
  Hypo

SEQ ID NO: 113374 - DNA, 142 bp, Homo sapiens
  chr17:42835736-42835878
  Hyper
tggttggagtgacagcgatccctgaagccctcctggaggccggggcatctttggcggggagaaggagccgatgggaaggggtctgtaccgcgggcgtgagaggactccgcagtgacacgacccgtagcgaaggtgcaagaaa

SEQ ID NO: 113375 - DNA, 30 bp, Homo sapiens; identical to SEQ ID NO: 80505
  chr17:42849487-42849517
  Hypo

SEQ ID NO: 113376 - DNA, 30 bp, Homo sapiens; identical to SEQ ID NO: 80506
  chr17:42865115-42865145
  Hypo

SEQ ID NO: 113377 - DNA, 1569 bp, Homo sapiens
  chr17:42906582-42908151
  Hyper
tcccaatcagacaatcgcaaaaaaaagaacaaaatctaaaccatacattcacgtacatcttttcaactcagagctccaaacgcagccgccaaccacacaactgcccacaatcacagcggtagcgcctactcttaattttgaagctagagacttaaggaaacacacacacacacaaaacagttctcaagtttgacaaagtgggggaaaagtcattttaagtaaagacaacgagttaatcaggaggcgatgagcccagtccttccgccccgctttcccgcttccagccctcgaacgaaccctcctctaacccccgggaggcaggagttccagcggggagatgcgggaagcctcagacgagcccgcacgccgccggagacgcagggatcgaggtcggggagacaaagagcagcccgcgaagagcccgggcggcgaggggcggcccggctccgccctgcgcccctaaccgcccgggtagttgtcggcaccgccggggcgccgccgagtgcgcgccgcttctgtccgggctccccgaccgtcgcccgacacctccgcggcccaggacacccccgagccgtttccctcccgatttgggagccgcgcgcctggggacaaagagggagggtgcgccggggacagtggcaggacgcgggccggcgacgcccctccggactcggcgggaacccctcggcggcgcccccctccttctcccgctctggccgcgctcctccccggacctccggaggttctcctcggcccctccccgggctccccaagagttctcccgcctccccctgggaccccgcccctggcccgcttctcctcagccggccctgcggccgcccctcacccggcggcgggttcccccggagccgcctcctccgccgggcctcggcccgtcccgccggtcgcggcctcatgtgccccgcgtcgccatcgccttcaccctcgcctctcctccacctcctccgccgctgccgccttcgcctcagtctccagccgaggcagaagccgctcccgccgctgccgccgccgccgccgcctcccgctcccgccgccgcgacccgcgggaaggcgcctgcgcactgcgcgctgcggtgggggcgggggcgtcccgccgcggcccgggagcggggggcgcgcggcacgtggcgctcgagtgggaggggggcgccccagaacgcgcgggaagcgacgcgagcgccaactttccgcggtcgagtcctcgccgctctctcggatagtccgggacgcggcggaggcgcggcgcgcgtgggagtcacccgcgtggagtctggaccccgggtgggcgcagacttcgctccggacagttcattcttccaagctgattttcgggcgagagtcccccgccagccgcgcctcagtttgagcgggccgctaacggcgccgtgggttctcgccttacctgggtatcctgggttggtttagcgggcccagagttgtcttctgcgcgctccgccgaggccttggtccattgtagcacgggatgctaatgtctcctcccaggttctgctctacaattcctcgaggatctggcgggccctgcgtgga

SEQ ID NO: 113378 - DNA, 200 bp, Homo sapiens; identical to SEQ ID NO: 80509
  chr17:42988598-42988798
  Hyper

SEQ ID NO: 113379 - DNA, 254 bp, Homo sapiens; identical to SEQ ID NO: 80510
  chr17:43001692-43001946
  Hypo

SEQ ID NO: 113380 - DNA, 205 bp, Homo sapiens
  chr17:43037484-43037689
  Hyper
agtcatcgtctgccccgcccggaggggaccccggcgggtgagggacgtgggtggagggagacgtggggagctcagtcggagtagatgatgaagccagagaacgtgctgtatttgttgctgttgccgccgtgtgctttgcctccatccagcttgatgaagacctcgtcgccggcgtccaggtgcaggatcacgctgttgctggcgt

SEQ ID NO: 113381 - DNA, 1021 bp, Homo sapiens
  chr17:43044508-43045529
  Hyper
ccccaagggcaagtccgtgcacctgggagccctgcgctctgactagttgggttcatttcccgcatttccagtagcgttccagacggtgcccagcagcgtctgtcttggagcgggaacccaggaactgaggatcggcgatgtccgctggctccgaccatccccacacgtgatgaccaagcggggccgctgtggggtgggatctccacctgcgtccgcctggcgcccccgccaactccgatcaggtacccatttgccccgggctccctgggtgccctgggcccagcccagccccatgcccccgcctggcccacctggccattcttgcagaggtctgcccacatactggtgccgtcgccgccgcgcatgaggacatggtaggtgaaaaagtaggtgccgggaatgttgcacgtaaacttgccgctggccgcgtcgtagttgttgcctaggttggtgaccacgtcgtcaaacttgagtacctcgtaaccctcgtgggggttcttgaggccggcgtagaaggccacgcgcggcaccgtggtgtaggtggcagtgctgatggcgccgctgccccccgcgcccggcagccccggagggcccggcttgcctggctcacccttctcccccggcggccccacagggccgggaggacctgggtccccgggaggccccggagggccgggcttgccggtgcggcccggcttcccctgggggccctgcaccagcgtggaaggcgggggcgcgccgctctgctcgctcagggcgtcgccgccgtcggtccgcgcgccggcgccggggccccgcgcggggtaggggtcgcacaccatgcggcaggtgcccagcatctcatagtggccttccgggccgcccgagctcaccagcacggggatgagcaccaccagcaccagcagcatcaccacacccgcggcggccgctagcagcgtctttcggcccgcgcggagcctggggagcgccgggccgcccggccgcgccgtcggggcaatggtgccggcgggcagggggcgcg

SEQ ID NO: 113382 - DNA, 551 bp, Homo sapiens
  chr17:43047434-43047985
  Hyper
ctcttccaacctcagcgcgatagagtctctaggtaccgtttactgcccaaagcccaggggtagggggctcagggcagccagacctccctaggctcaggaagagtagtcttcagcgctcggctgtcaggcaatccggtccccggttccccacggcggtctcctcggtgtgccccaccaagagcgacagggctggtgacccgaggggcgcgtgcgcggtcgtcagcctgggatttgcacggacccccttctccctagtacgctcgctcgggggcccctcctctgctacgccgctggggctcgcccgccacccacagccctcgcagagccctccgggcacaccgcggctggccgcccggggccaaggatggggcgggagcgcccacccacccccgcgccggccggggcatccaagaggcgcgctcgcagccacacggcgccccgcctcccgctccgaaaaagctcctgctcccctggcgcggtgtggcgtctccgtcagcccagccggattctccccgcttcgctggagtggaaaataacggcttcaaactttg

SEQ ID NO: 113383 - DNA, 126 bp, Homo sapiens; identical to SEQ ID NO: 80517
  chr17:43099263-43099389
  Hyper

SEQ ID NO: 113384 - DNA, 104 bp, Homo sapiens; identical to SEQ ID NO: 80518
  chr17:43175938-43176042
  Hypo

SEQ ID NO: 113385 - DNA, 18 bp, Homo sapiens
  chr17:43233608-43233626
  Hypo
caccgtactccagcctgg

SEQ ID NO: 113386 - DNA, 41 bp, Homo sapiens; identical to SEQ ID NO: 80520
  chr17:43298625-43298666
  Hyper

SEQ ID NO: 113387 - DNA, 30 bp, Homo sapiens; identical to SEQ ID NO: 45093
  chr17:43318029-43318059
  Hypo

SEQ ID NO: 113388 - DNA, 51 bp, Homo sapiens; identical to SEQ ID NO: 80522
  chr17:43321296-43321347
  Hypo

SEQ ID NO: 113389 - DNA, 224 bp, Homo sapiens; identical to SEQ ID NO: 36552
  chr17:43339109-43339333
  Hyper

SEQ ID NO: 113390 - DNA, 305 bp, Homo sapiens; identical to SEQ ID NO: 80524
  chr17:43339632-43339937
  Hyper

SEQ ID NO: 113391 - DNA, 41 bp, Homo sapiens; identical to SEQ ID NO: 80525
  chr17:43827217-43827258
  Hypo

SEQ ID NO: 113392 - DNA, 227 bp, Homo sapiens
  chr17:43974207-43974434
  Hyper
aacgaatccatgcctcgccctcctgtgatgaacctggtacgcacggttttctggttaattctatcgctgaaaactggtgcggggggcgcacttctgagacggaagagcatctaggagctgaatcctccacgcgggtcgcccaggttgatctgaatttctggggaatggcttggctgcccgcccgggaccaggccgaccctccttgacggtggcgtagagggctggag

SEQ ID NO: 113393 - DNA, 317 bp, Homo sapiens; identical to SEQ ID NO: 80530
  chr17:44919021-44919338
  Hyper

SEQ ID NO: 113394 - DNA, 113 bp, Homo sapiens; identical to SEQ ID NO: 80531
  chr17:44928624-44928737
  Hyper

SEQ ID NO: 113395 - DNA, 297 bp, Homo sapiens
  chr17:44929063-44929360
  Hyper
cgccgcctcctacttcgggtcagtgcccgccgcgccccccgcccgctccccggcctgcctgtctctccctcctgcgctacagctgggccaatttttccctcccgctgtccttggccccgccgaggtctcgaactcagaccctagcccggcgcgacccaacccacttcgcagtcggagttcgcgccctgagttcggtctccagcttccccggctccgaatccatcgccctgttcagtgtccgagtctctggtcgccccccagccgccgctctcctcatcccgccgggtctcggactct

SEQ ID NO: 113396 - DNA, 136 bp, Homo sapiens; identical to SEQ ID NO: 80534
  chr17:44929567-44929703
  Hyper

SEQ ID NO: 113397 - DNA, 46 bp, Homo sapiens; identical to SEQ ID NO: 80535
  chr17:44953620-44953666
  Hypo

SEQ ID NO: 113398 - DNA, 30 bp, Homo sapiens; identical to SEQ ID NO: 80536
  chr17:44953868-44953898
  Hypo

SEQ ID NO: 113399 - DNA, 38 bp, Homo sapiens; identical to SEQ ID NO: 80537
  chr17:45022231-45022269
  Hypo

SEQ ID NO: 113400 - DNA, 586 bp, Homo sapiens
  chr17:45055719-45056305
  Hyper
actcccaccctgccccgaacgtcttaaaaaacaaacaaacaaaaaaaactggtaagaaccctcaccccacattctcccaccccgcaacgctgcagcgcacacaggacagagccgggcgtccaagtcccttcccgcgcccccgccgacagtctcgccgcgtccccgcccgggcgccccaggcacgtagctgcccgcccggaggcggcggcagagcgcagagagcggggcgagggtccgggtctccggggtccttcttgcagcagcgctggcgagggcggacccagatggcgctcagtacagccccaggatggctgcgcccacgtccttggagggccggcgctcctgcaccagaaagttgatcatgctctcggacttgatgagcaggttgcagcccaggaagaagacgccgaagaccacggtaagcgacagcacgcagagcacggcgatctgcgccacccgcgacacccacaggctgcgctcgtcgggcgccagccccgcggggaccccgtcgctggcggccagcggtgcgccccctggacagcagcccagccacgtgcccagcccgtgggtgcggtttcccagggcg

SEQ ID NO: 113401 - DNA, 277 bp, Homo sapiens; identical to SEQ ID NO: 80540
  chr17:45056574-45056851
  Hyper

SEQ ID NO: 113402 - DNA, 17 bp, Homo sapiens
  chr17:45187461-45187478
  Hypo
tttttttttttgagacg

SEQ ID NO: 113403 - DNA, 45 bp, Homo sapiens; identical to SEQ ID NO: 80542
  chr17:45268793-45268838
  Hypo

SEQ ID NO: 113404 - DNA, 243 bp, Homo sapiens; identical to SEQ ID NO: 80543
  chr17:45331432-45331675
  Hyper

SEQ ID NO: 113405 - DNA, 30 bp, Homo sapiens; identical to SEQ ID NO: 80544
  chr17:45331924-45331954
  Hyper

SEQ ID NO: 113406 - DNA, 129 bp, Homo sapiens; identical to SEQ ID NO: 80546
  chr17:45786739-45786868
  Hypo

SEQ ID NO: 113407 - DNA, 1106 bp, Homo sapiens; identical to SEQ ID NO: 80547
  chr17:45810394-45811500
  Hyper

SEQ ID NO: 113408 - DNA, 567 bp, Homo sapiens; identical to SEQ ID NO: 80548
  chr17:45867017-45867584
  Hyper

SEQ ID NO: 113409 - DNA, 76 bp, Homo sapiens; identical to SEQ ID NO: 80549
  chr17:45970972-45971048
  Hypo

SEQ ID NO: 113410 - DNA, 30 bp, Homo sapiens; identical to SEQ ID NO: 80550
  chr17:46030424-46030454
  Hypo

SEQ ID NO: 113411 - DNA, 184 bp, Homo sapiens; identical to SEQ ID NO: 80551
  chr17:46036392-46036576
  Hypo

SEQ ID NO: 113412 - DNA, 32 bp, Homo sapiens; identical to SEQ ID NO: 80552
  chr17:46080796-46080828
  Hypo

SEQ ID NO: 113413 - DNA, 38 bp, Homo sapiens; identical to SEQ ID NO: 80553
  chr17:46089245-46089283
  Hyper

SEQ ID NO: 113414 - DNA, 521 bp, Homo sapiens; identical to SEQ ID NO: 80554
  chr17:46089581-46090102
  Hyper

SEQ ID NO: 113415 - DNA, 54 bp, Homo sapiens; identical to SEQ ID NO: 80555
  chr17:46100803-46100857
  Hyper

SEQ ID NO: 113416 - DNA, 247 bp, Homo sapiens
  chr17:46124901-46125148
  Hyper
agcaagactaagctgcgtgggaggccaaacgaggggggtcctttgggctgtttctaccatgacaaaaatcgccattaccccacacctctcacaccgccaacgttccgccaacgttccgccaacgtcccaccaccctcatgatatccgtccgcggtactgctccagcgaaggtacccttgcctgggccatgaggcgcaaccgtccctcacagctggggtggcttctccaggttcgcaccgaggggaag

SEQ ID NO: 113417 - DNA, 17 bp, Homo sapiens
  chr17:46176758-46176775
  Hypo
cccgaccctactattta

SEQ ID NO: 113418 - DNA, 81 bp, Homo sapiens; identical to SEQ ID NO: 80559
  chr17:46177127-46177208
  Hypo

SEQ ID NO: 113419 - DNA, 24 bp, Homo sapiens
  chr17:46344157-46344181
  Hypo
caccgtgcccggccctgttttcct

SEQ ID NO: 113420 - DNA, 251 bp, Homo sapiens; identical to SEQ ID NO: 80562
  chr17:46507487-46507738
  Hyper

SEQ ID NO: 113421 - DNA, 256 bp, Homo sapiens; identical to SEQ ID NO: 80563
  chr17:46570216-46570472
  Hyper

SEQ ID NO: 113422 - DNA, 63 bp, Homo sapiens
  chr17:46619072-46619135
  Hyper
atccagctgggaggacgcaggggcgggggcagatcccggctgggccggcgcctcctgcagcgg

SEQ ID NO: 113423 - DNA, 1106 bp, Homo sapiens; identical to SEQ ID NO: 80565
  chr17:46620352-46621458
  Hyper

SEQ ID NO: 113424 - DNA, 272 bp, Homo sapiens
  chr17:46621779-46622051
  Hyper
gaaccccaacaggctcgccaccattttttttaaacctccttccactgctttttctccccctcttctagctgcccctcaccccacccccaccacgcttaccgacctgcaggcgatccgaccccggaggccggaacggcggaggcggccggagaaggagacgtggcggattggctgggtttcttggcggatttcttctctttcatccaagggaactcgggggccgggggggcagcggggagtggcggcggcggtggcggcggcagagcaggccc

SEQ ID NO: 113425 - DNA, 1480 bp, Homo sapiens
  chr17:46654951-46656431
  Hyper
actgtatctccctggcgaaaaagtcgctggtgagaatggtgaagaggatggggaacctacttcaaaggcgcagggcccaccaggccataaaaatttatgggggatgtaattatgtggctctgaaaacaggcgaccgtaaatctccggcaatggcgagtttatagcggggacaattggcttccccagctcaacccccccccaacccatgcctccgaagtccctttggtgtaaagctccaggggtgggagggggaaggggtgcccacgcactcacccgtgctcacgtgaactttgcgcatccaggggtagacgacgggctctttgcacgcggagtgggacgggctggggtgcagggggttctgggcgcagggaggcggcggggggctgctgctgaccgcctcgcagcgctggccgggctccgggaggagggccccggcgggtggcggcgcaggagcccgaggggacagaccgggcggtggcgggggcggcgggggtggtggcggaggcggcgggggcccagggtcccggcaggccgcgtagcgctgcacggtgcacgccgcgcgccgcccgaagcccgcctccggctggaagctgctctctcgcctctggccgccggcgtagtacccgggcgagtggtcgctgggtaggtaatcgctctgtgaatattcctcgcatggagggaacttggggtcgacatagtttgagttgatcaaaaaagaactcatagccattaatttctgggaattgcccacaaaatatactaaaatttattccgacccctgactcgttttcctgtttccgaaagccctcctacttactgtcaagtgaacaaagttaggcgcccacgtgatcctccgagccaatggccgccccgcctgcgattcccggataaggaaatctgctcacccggaccccactccagccaaagaggtttatttccccttcttcccttccccctccccacccacccacccaacaccaggatttacatagggctcctgcggggcgaccccctccttgcctcgctctctccgggatcagagagagagcgagagagagagcgcgcgcaggttgcgactggagggcctgttggggcgctaggcagagcgcaaaccctagatcccttaagaagttggggctcccggtgtagccctcctgttctgcctcacctctgcccagcattctgtaccttccaaaggccccagtctcctcccctcggcgggagggagcgctagcaccctgcgtctctatggggagttaggttactggcgggttgggggctccgtctcgaaaggggaacccatacgggggccagagcacagagcttggggcttttctctgcagctggatggggaagggtaggggtgagagaggaggcgtccagagctagagggcgggtgcgcagagggacttgtcagagatgaatggaaccgcgggcggatcgataggaaattcatgcactaattcggggagacttcgcc

SEQ ID NO: 113426 - DNA, 480 bp, Homo sapiens; identical to SEQ ID NO: 4434
  chr17:46659429-46659909
  Hyper

SEQ ID NO: 113427 - DNA, 440 bp, Homo sapiens
  chr17:46663408-46663848
  Hyper
ccgcaaggctcagcccggatccactaggggagaggcagtccagagggcggcctcgcagactgggaactgtttccggggaggagaagctagaggatactgcagagagtgcatttttctctccaagaggaactttagggggagaagagacaagagaggagacgcctaaatcactgagaaaaggaataagaagagagggaagagaaacgttaaaacttggggacaaggtgctttttgggatccgacaggttcccgaattgcccgaagtccaatactctccaggctcccaaatttcccctcttcctcttggagcctgcaatcagtaaattcgccaaaagaaagaacgaaagatccgcctaaacctgccggcgtgcccccacccccggtctacagaggcggaggtggctgcggcggtgtggccggcggcgcgtaatgtatgctgc

SEQ ID NO: 113428 - DNA, 682 bp, Homo sapiens; identical to SEQ ID NO: 80574
  chr17:46670849-46671531
  Hyper

SEQ ID NO: 113429 - DNA, 835 bp, Homo sapiens; identical to SEQ ID NO: 36578
  chr17:46674922-46675757
  Hyper

SEQ ID NO: 113430 - DNA, 1216 bp, Homo sapiens; identical to SEQ ID NO: 80576
  chr17:46687590-46688806
  Hyper

SEQ ID NO: 113431 - DNA, 919 bp, Homo sapiens
  chr17:46689986-46690905
  Hyper
cagagagaaagccagcgagctggggggttgcagaggggagagaggattgggaggggaaatgaggacgcagcgagagagagcgagagcgagagcgagcgagcgagagagagagagagaagggagacagaaagaattacggcgtgaataggcagtttcatgttgttgggagaacttagcagaaatcggtaccttggtcattacaaagaagcacgttcaaaggaaaaaaaagacaattgcacaaggaggctttttacacggggaggggaggggcatggggggctcagccgggcctttgccgctcgccctcacagggcgagggagcctttgcttaaatccttttctttccccccggcccccaagagaagggaaggagatccacggtagctcacacacagaagctattacgagatactaccactagcggggactggcgcggcgggggacgctgcggtgggaggcccggctcctggccccgctagcggggccagagctctctcgggcaggggcgcgcggcggcggcgcggccgggacccgcggacgtgcgggcggccgcggccctggcagtcccagctgaagcctacttcttgtcgcccttctgcgcgtcgccctcgtccgccgcctctggggcccgctccagcttctgtttctccagctcctcctgctcgcatttgctgctggggaacttgtctttgttgttctcttttttccacttcatcctccggttctggaaccagattttgacctgtctctctgtcagtcccagggcgtgcgatacctcgattcgccgcttacgagtcagatagggattaaataggaactccttctccagctccagggtctggtagcggctgtaggtctgtcggcctcgcctgcgtccggcggctgctgggaatgggggaaagggcgagacagaggggag

SEQ ID NO: 113432 - DNA, 1211 bp, Homo sapiens
  chr17:46691213-46692424
  Hyper
aaagccgggtggggacgaatggacccaccttgaaaagcccccagagcctctgccccagaagaaaagtttcttcagggtaattaaactataaagcaattgagaagtgcaaaagttgagcgcccccactcccaccaccctctcttcactaccccccataaaacagtaaaaggggaaaaaaaggaggagaagaagaagaaaagtaaggcaggatgaggggtttatagattcaggaaatgtttctaagcgacccccttcaagggaaagaaaaaagaaagaagaaagaaagataagaaagaaaggggaaaagcggcaggcgatcggaacggagccggcaagtcttccagaagctggaggaaatgcgccccggcctgccaggccttgggcccttccggccccctcctgcccttgtcggccccgaggcgagctcaccttgcgggcgcatccaggggaagagctgtgtgggcgacgggctctgctcggagccctcggcctcctcgcccaggccgctggcggcggcaagcttgcagtctgcgtactgcaccaggtctggatcctgcgcaccgaataggctctggcgttgcagcgggtcgtagccgtagaaattgccggggtccccgtggcacgccacggcgcacgggttctgctggtagggagccgtggacagcgacgacggcccgtggtagaactcctggatttgcgacgggtgctggaagctgccgccgctgctgggaccgtacaccacggtgggtcggccgcccaggtcctgggcgaagccgcagtcataataattggggcgcagggactccccggttttgtatttggagaacagtgagttgacgaaataagagctcattttattgaattttgaggcggcggcggcggcggaggctatagttgggggctgttggggagggggtggggagggggaaagggagggagagagagaaaaaaacgcggattcgccggctcctagtcaccctcgccaggaaaggagagggaaagagaggagggaaaaaaagaaaagaaagaaaaggcgaagaagatctcgaagccgacacactttttgtggtttccaggaatagaaaaggacagagaagcctccaaaagtctaagcttgcatggcagccgcggctcgctcgccctccccccaccccccaccccccaaacaaaaatataccaccacttaaagaggtcctcgctttacatttcga

SEQ ID NO: 113433 - DNA, 27 bp, Homo sapiens
  chr17:46696538-46696565
  Hyper
aatcaagaggctgcccgcgcccagacg

SEQ ID NO: 113434 - DNA, 226 bp, Homo sapiens; identical to SEQ ID NO: 80583
  chr17:46702529-46702755
  Hyper

SEQ ID NO: 113435 - DNA, 30 bp, Homo sapiens; identical to SEQ ID NO: 80584
  chr17:46703929-46703959
  Hyper

SEQ ID NO: 113436 - DNA, 186 bp, Homo sapiens
  chr17:46710940-46711126
  Hyper
gtccaggctccctcccgccctcgcccagaagcgagggtccgagtggccacgtgtccggcagggaagtccgaggtagcgagggagtccacctggccgcccgctccccctcccgggtataaatcttggggaccggaaatacaataaaacttcaccgtgttgatgaacttcaaacggtttacatcccct

SEQ ID NO: 113437 - DNA, 154 bp, Homo sapiens
  chr17:46711342-46711496
  Hyper
gcagagactggaagccgccgcctacacggaaaatccacagagccccgcgcagaccctatgatcggctcggcccgccgggcttgggatgaggctccctgcttctcgctagagcagaactgggctccctggcgcttccttgcgaaagcccaggctc

SEQ ID NO: 113438 - DNA, 379 bp, Homo sapiens
  chr17:46713933-46714312
  Hyper
cggctggggaagcagctctgtggtctcccggcgggtgaggccgagacagagaccaacctctaggcggcgccctggcgttgagtccgcgctgaacaagattctctcgcagctctgcgtcccgcgccgggtgaaggggcgtgttcctgcaggcgctcggggctcggcctggagctggcggccggcacgtcgcctttggcgccctctgccaaccaagagaaacacggttaaatgagtgcgctgggacagaaatccacagctaatcaaggccccatccgctcccaccccctggcccttacctcctaactccatctccgacgctagggagccttccacagcccgaatctcctttgatgtccccagcagccggctagagggcagc

SEQ ID NO: 113439 - DNA, 39 bp, Homo sapiens; identical to SEQ ID NO: 80588
  chr17:46719480-46719519
  Hyper

SEQ ID NO: 113440 - DNA, 484 bp, Homo sapiens; identical to SEQ ID NO: 80589
  chr17:46723716-46724200
  Hyper

SEQ ID NO: 113441 - DNA, 152 bp, Homo sapiens; identical to SEQ ID NO: 80590
  chr17:46724752-46724904
  Hyper

SEQ ID NO: 113442 - DNA, 115 bp, Homo sapiens; identical to SEQ ID NO: 80591
  chr17:46755586-46755701
  Hyper

SEQ ID NO: 113443 - DNA, 1184 bp, Homo sapiens
  chr17:46795361-46796545
  Hyper
attataaaacatacacgttgaaacaatttttttaatttaaaaggggctgtttataaaaaagttttaaaagtagctctgtgttttaagacccgtgttctacttgctgcgatcgggatagtttttttttccactttgaggctctttttttttttttttaaggggcaggaacatcattttgcatcaggccctgtaaaaaaaaaaagggggggggggtgggtaggaaccaggatgttggggaaaattatttcaatgtgttgagtctgaagctttttggaaagcaatgtagatgtgatctcgtttgctctgaatcgaattccacagaaaccgctgtgccgaatactgcaaatccttaactttcataaacgccggcaccgaactcaacgcaaaactacccaagtgccaaagaccatttctgggaagctcattccatgagaccttcgcatttttccaaatcaaaggcttcccttcggatctaattatttctcctctacagggctgcgggagggggaggggatgtgagactagggcaacagattaagattgaaagtcctttctcgcagcttcattttcgcccccacactgtcccaaatgcttagaaccctcctcgtcagaatgggaacggtgcccccgcttgtcctaaaagacacagaccaggtccgtgaacttgacccaggcgcccacgcctcttttccccgaaggtcagacaaaggcagaagggttggctggattctttcccgggccgcgaaggcctggggatcgcaagttgaggaggagaagaccgcaaacccctttggttcaagcaagctctgcggcaggtaaaaggcaaattggtggggacgggtaggacagggagagcattatctggctaactcccgcaggcctcttccgatttgtcggcggggacctgactccctgcggtgtctctggccccaaatacggaggccaggagcttttcgttgtctcgcccgatttggtatcttattagccggtgtcgctgagccgcgggggactcccggctggaaaggaagccctgcgctcgaagcgccccacgccagacggagtggcccctgcgcctccccgcgcgccggcgcgccctgttcaccttcgactggatgttaccgagccagggagagacccggagatcgagtgtttgatcttcccttgctccaggatcctgaattctt

SEQ ID NO: 113444 - DNA, 1124 bp, Homo sapiens
  chr17:46796605-46797729
  Hyper
cgcacacgcagcactactaccgtctgagcaggccgctcctcgcagcctccgcagtcggcgggtcgcctggaaagacgcgccggtttcccgggtcggatggctctccaggccgctatttcctccgccaccgagtagggagacgccccatttgcgaagtttaagtttccaggtcctgggaaggcagctgggaaacccgcggggctcggcagccgccctggtagcagccagggatcggatagcgcggcgggcgacagccccccggataaccccgccgagggaggggcgcttgtaaaaccgagcggcgacggcctcgttacgaccgactcgaacattctctaataaatcatcggccttagctagtattcgtttgtgtacgcatctgtttatcctgattattaaaataaattaaggattagactgcctagaataaggtaaacgaacatgaaatgccaaggaggaaaacagaaaaagttacaccatgtcgatcccgaccaaaacattggcctgacttgccggatggcctcaagaatccggcttttagctgcaggcccggcgggtgttccccggaaggcaaggattggaagctctttgataaagccgcgcgaggcccggtttctcgcgtttcgggtcgctccacagccccctccgcccttcccctccacccctccgcgtctcggcctggctccggaggggtgaaggaatgtttatagcctgactcaagttcaatgacaaaaacctgcctggaatgggaggtgcggcgagcttcagccatcaacatgacaaaggctggacgcaggtctcgggcgggggcgacgggctgggcccacctagagatggggagctgagggcccacaggatgggtacggaccccgcagaccaagagctgcctctctgccctcagcctggggtctgcggagtttggcgagtagtgcgggtgtgtgcccgcctggatgagggtaaggcgatcagcctctgagtgggcaaggggacgtctgattactgcccaggcttcgcctgggggtccaggaccctgtgagatgcccctgctctctgcctggccagctctagctcacccggagtaaggatccgcaccgtccttctatccaccgcgacctgcattttct

SEQ ID NO: 113445 - DNA, 2040 bp, Homo sapiens
  chr17:46799288-46801328
  Hyper
tttaaataataataacgttatcaatattaattttgcttatgccaggactccatcccattggagacaaacattaagtcttatggcagaccttacagcgggtgctagttcccactcccaagcctctcccccgcctaggtcctgcaggtcccgcgtgctgcgaaacattttctttgtccctttctgcccagggcggctgccggtctctccaggaaccgcgagtaggtgctcccgccaggtggtatcggtgaaagcctgctgctcacccttcccttgtttcccaaaacttctgaaggctcccaaattcctgggagaccctctcccagggcctcctgatgcagctaccatactgagcgatccgtcgataacgcccttggcccaccgatcagtttaccttattagagagaaaagcactcttggaggtagtaagatgggccggtccttgatctgagaaatgggcgcacaacatcgctgttctctctgcaaaggtggggaccagaatccagcttgcctgaccttgcaagcaagcatcggcctaaaggtttcagcctcccagtggcgctctgtttgcacgccttaggctaggagaggaaggacgggagcacagcactgggtgcccctctccctgtagagtctggggcggggctcagtaagaaggcctgcggttggtggctccccacctcatagctgcaagtaggggcgaaagctggagtgtctcctcccagcagcctcctcgcctccccgcaaacctccgaatctccctggacctcctggttgctgtggcccttcctcccctgattggcttcctccctctttcccaaggccagagaagtcctctcttcccctcaccttcctccctcttcccataaaacttttaggaaaatgggggcgggggcggtggagaccaccagcctggaacttcaagttcaatggcaaagtccctgaccctccccccaggctgggcgccagcattattctaggggcgattaaactcttttgctgccccctgtgcacctcccagttcgggggcagtttaggggaggagagaaggtaatggtggaattctttccctcactctcccccgaccacttcgtcccctccccctcatcccctctacacagaactaactggtagggagagaggaagaaaggctggcatcggttcctcattggatgttttaaatctgtctcaggcccaggccagtgcctggggggaggggcggggtgtcctgcttttgggctagaggcccggggccgctcccgagctttctcccctcttccctggagagcgactgttcgggagggtgagaatggtataaatttcaaaaacaacgaaaccttcttttgccccctccgcagcagtcgcctccgggctttattgcaagtttacggtaacgagttcatctatttaattcgcggttgcagctcggggatttctattagacaggacgggttggggccggggggcacagggtctcccctgaaggaaacccaattagagtgcagcacttagcaccttcaatataactttaatgaagggggggaggggagctgcagggaagagaagtttgctctaggttggggaaggaaagctggagctgctcccgagaactggggggcctggatgaggctttttcctgcttcgagggctttccagcttccggcccgggaactactatttggagtagggatcgcctgcagggaaggcggggcggattctcggctggcggcggcctcgcagggttcccggaagcgctagccagccggagtaaaacccgaaagatggagcctcaggttcgcgctctgcgttgcgggtgctggaaccgagattcaaaaagagcttccggaggtagtttctacgcattgcgccactactcccttattcggcttctggaggcctaataaaatccacttgctttggagttagaaattatttcgggcctggagcccgcgtagacgcgaccctgtgatcccatttcgtagcttgctgagagattcgctgcgggagtttggctctgagggaggggaacggtctggagggcag

SEQ ID NO: 113446 - DNA, 30 bp, Homo sapiens; identical to SEQ ID NO: 36601
  chr17:46801636-46801666
  Hyper

SEQ ID NO: 113447 - DNA, 1178 bp, Homo sapiens
  chr17:46802007-46803185
  Hyper
cgatgaaagcctgcccgcaggttctcctggagtggtgagcctctgtcggaagggggcgcccacgtctttttaatggtcctaacacaccagtggaataaatctctaagattccacatcttttgtttgctctgaatttattgcgagtgaaaaacagagaaaatcctcaagtttaagtttctgatagcagagtgtgggagttagagcatggggagtccagaggttccagacccccaaaggtctctaccagggccatctccgttagtggcggtggcagcccctcttgtggcctttttcctctctccaaggggtcaccccgcaccatgccgctccccctcatctatcttgccccctccccacaggcccatctgcgctgaactctcgccagttccgaagtcggcgagggagggggtttacttgcccgatcgttggtgggtttgagcttatagaggcagaggagtaagaacctgcgatattgaaagctacccacatggggcttccttgaaggaggacgtggaaggcagaaagtgacctgctctgagcggcgcatgtaaccgaggaccttaagctggaccacggggcttggacgattttttaaatcaggaaatcgacctcatcttcctcctcctcgtcctcttcccctgaacccccagtccgcatgcactcacactctttggccttttccctcagtcccgggctcctctttggtaaatagatttgtaggtgtctaagtcacgtcccaccctcactccttcccaggagaggagacagggctaggatcccacccgaccgcgggccataaacacttggctgcggcggccgccgcggggtttctaggagagctggctccgggagggaaatgtcctcgaggtagtggcggccgcggcccaccaccaactgctcgccaccgaccccactactcgccaccgacccgctgctcggagcttcggttctgcgggttgtccagacttcaggcctgtgcgctcaatcgtggagaatgcgccggcaggccccccacccccagcctaaggtgcaggaaggaccagcacgaacccgctggctttgctgcgcggccaggagatgagtcccaccgggcactgagcccaggtacaggacatcagagaatgaacacagaggcagaggccctcatgtccctctcagagtcccggctctgcaaagag

SEQ ID NO: 113448 - DNA, 71 bp, Homo sapiens; identical to SEQ ID NO: 80602
  chr17:46803745-46803816
  Hyper

SEQ ID NO: 113449 - DNA, 321 bp, Homo sapiens; identical to SEQ ID NO: 36605
  chr17:46804107-46804428
  Hyper

SEQ ID NO: 113450 - DNA, 539 bp, Homo sapiens; identical to SEQ ID NO: 80604
  chr17:46805572-46806111
  Hyper

SEQ ID NO: 113451 - DNA, 303 bp, Homo sapiens; identical to SEQ ID NO: 80605
  chr17:46806788-46807091
  Hyper

SEQ ID NO: 113452 - DNA, 848 bp, Homo sapiens; identical to SEQ ID NO: 80606
  chr17:46810248-46811096
  Hyper

SEQ ID NO: 113453 - DNA, 295 bp, Homo sapiens
  chr17:46811354-46811649
  Hyper
tctttctctcatctccgttttacttcccttcctccgcccgccacacacgtttttcctttgcagcgctctcgcccagtttttccattgttcttctctgaagtctggaaagggcctgcggggctatagctctcagcggccggagcctgcgcttggcaggggacggcctggaggacggcctagtgtggctggtgggttcgcggagccctgccctggagctctgcctgaggctagaacagcacccgctggagatgaagggtgactccggcctttcgccctgaaacgaagtcaagcgggg

SEQ ID NO: 113454 - DNA, 47 bp, Homo sapiens; identical to SEQ ID NO: 80609
  chr17:46812568-46812615
  Hyper

SEQ ID NO: 113455 - DNA, 106 bp, Homo sapiens; identical to SEQ ID NO: 80610
  chr17:46815930-46816036
  Hyper

SEQ ID NO: 113456 - DNA, 499 bp, Homo sapiens; identical to SEQ ID NO: 80611
  chr17:46816240-46816739
  Hyper

SEQ ID NO: 113457 - DNA, 1373 bp, Homo sapiens
  chr17:46824310-46825683
  Hyper
gcttctgagaggctgcgttttgaggagacaccagaagcctgggaagttcgcttactggttctcaagtcagagtcccccttcccggggctccttctggggactccgggggagagggatctctctgtccatcctgcaactcctctcctggcatagatgccccgcacccccaccttgggccatccttatctgcctgttccccatcacgattgatcctccagggtcgccaaggctcctgctgactacaaaaacatccccaagattcccttcttgacccggttcaggcatatctctttatacttccatgtctccgtttctctatatttttactgtggaggactcagaagagagctgaggctattgtccggggaggaaaggaattcgggcaaatttgtgggtaggggcccagacccaagacccgtgtttctcctgcgtgggttggagtctgtctcaggtcgctccagggacatcaagagcccgcgccgccgagagcccgcgccgccgtccagcgggaagcagcggacccacaggggcctccagccgcctccccgctcccgccccgtgtttctcctgggcctccagctccgtggagagagctgagagttctcggcccgcgggcttcctcaccaaatccccaaaaaccgacgcaggcacagagggctgactgtgttttgagtaatgcacgcgaggcagtccaatccggcgagatggcccgaagcggggcccagcggtcgggggtgtgggtctggagagagagggtctccccacttccttcctccggctgctcggtcacccatcgactacccgggcggaagcggggcgcagaggggcgcagagggaggcattgccctccaggagtatctattcccatcggggtatggtgaatgccatctaggcccatgctccattcccagggccccctcggttcctccaaaggcgtccacccagaagcagccccagtgtcgcgcattgactcccgccggccaagtcgccgccgaaacaggatctcctaaagcgggctccaccgggtcccagggcgaaaaggtccgaagatctacgctgtcggaaagacctggagaactcgggaagcccagcaacaacaaacaggtttcaacttggaaacaaaccattaaagtttggcttagtttttggtgtgaatggtgcaaataatttctcctcttcactcttcagtcgatctcagctgtatagagctgctctgcaagctaaaaagaaattagtatctattccccccgccaacaatttttttttaacccgggctaccagcttaagcaactggtatcattcttgttgaattaagctctgaaagctcgcctcagaaaaaaagtttttattttaaaaaacgaattattaagtcg

SEQ ID NO: 113458 - DNA, 97 bp, Homo sapiens; identical to SEQ ID NO: 80614
  chr17:46826997-46827094
  Hyper

SEQ ID NO: 113459 - DNA, 426 bp, Homo sapiens
  chr17:46827330-46827756
  Hyper
tccttggaggacaggcggctgcttaggagtgggacagtaaggactaggctgggtctggagggctggcggggcaggagttgggggccaggtaggaaagccaggggtcgaagggatcgattctaggggccgcagaggctactctcgtgctctggagaagcaccgcatctttctccggacccccgcgctcagccaatcgccccaaagtctccaggtgggggctccgcattaccagtcttggtcgcaaaagcagccctttcaatcgcaccgaatttcccctggtgtgaaaaggcgccatcgccagcattttgccggggtttatgcctcaatcccgcattccagccacttccacgaattacttggaagacagaatggtttgtgcccatttatcctacctggagcacagacaagaaacggccaaaaaatgaa

SEQ ID NO: 113460 - DNA, 221 bp, Homo sapiens; identical to SEQ ID NO: 80617
  chr17:46829434-46829655
  Hyper

SEQ ID NO: 113461 - DNA, 676 bp, Homo sapiens
  chr17:46829979-46830655
  Hyper
ccccaggttggttcacgcgagttttaaaatgaatcggaggtgaaatggagctcattaccctctcttcagcccgaccctcaatctttggcagcgaggggcagttatgggacggggggcgggtgggaagagcgcccagggccccctccgggttctcccacggtttcccgcatctgggcctggccagcgcctttgggaggaagggcctaggcgcggtagggatgcctgggagtctagggagtggcgggggtgtttcttggcccggcagggtggggtttccaagcgtgatctcctcgccctggcagagccggggtgccgggtgggggcaggctcgggggcctgcctgcggtgaatcaggcttgtgacctcaggccgtccaggtaaacatcctctgcgctttggaaactgttgggactagaaaggagcgggcggcagggagagggaagggggaaggagggattctgagtggaggagacctctgaaatcctctctcctgccaggaaaccagggcggtcttccaagcgggcagccacgttgcctacttgaggccaaggcagaagcatcaatcacatggggcgtagtttctgtctggctaaagaacggctcacgcggacctcgggaatgcgactgtggaaacgacggggaagctggaagggctgggtggcgggggaagctggag

SEQ ID NO: 113462 - DNA, 1161 bp, Homo sapiens
  chr17:46831726-46832887
  Hyper
acactgtaaaattggcgtaaccaccattccctcccagtctttctctggagtcctaatgggaacagtgacggaatgaaagtgaccacgctggaacccgaagcgctgttcccctccgtggcttcacactgatctccacactagaattccgtgtctgcagttcaagttcaaactactgtggtcggggaagggctacagagatctcgcttggccgtggagtcaccggccccgtccagtcttgcttgggacacatactggtttacactctctcgggttcagtttcctcatctgtaaatggggctcgtatccccctcataaagtggtttgggggataataaagcttgtaaaagcgctttgccccagtgcttggcacataatacgcgctacgttaacaatgtcgcgtacacgcccgaaccggaggaaccccattccacgctccttctggaaccgaattcacctctgaggctttggggcttcagagccggagccgcttgggcaaaaccagcagaacagcgagagggaacgggctggtctagccctgccctgagcatttctactgagacccccggtcctgcttcttccagcctctgctggatttctctccgacccctctggagcgaagccctttggccctgcgttgcatgcggcacggtgcgggttcgggctctgcgctggagccgggatgccctccggcggagggtgcgcgtaggcggcgcctgggcgtgagccccgcctgcaaggctcagcgtcggggaagcacttttctcgtcgacccggggtctttttccgccaaggagctcggggctcaagaactcgggactgggctgtgggcggggcatggttttcctctctgggcgtcctaatctccaatttcaggcaaattcgctaggaagaaccttcccgagcgcgccttctccaacaggacctccaagccagcctcacgcacgcaggcctggctctctcctgcagaatccccacctgccctataactacccacttcagatatgggggaatggaggagatattccaatcacgccatctacctacagtttccacggccccttctgttgaatggtattttcctttagggtccctagaagcagagcaaatgaaaaggccagggggaaaaaaaaaaaaaaaagaaagaaccggtgaattggctct

SEQ ID NO: 113463 - DNA, 57 bp, Homo sapiens; identical to SEQ ID NO: 80622
  chr17:46863338-46863395
  Hypo

SEQ ID NO: 113464 - DNA, 61 bp, Homo sapiens; identical to SEQ ID NO: 36623
  chr17:46918852-46918913
  Hyper

SEQ ID NO: 113465 - DNA, 116 bp, Homo sapiens; identical to SEQ ID NO: 45097
  chr17:46946208-46946324
  Hypo

SEQ ID NO: 113466 - DNA, 884 bp, Homo sapiens
  chr17:47072676-47073560
  Hyper
acaaaaacaaaaatccgacaaacacgtggctgggtagaacaaaacgctcattggggagggtgggctctaaggtggtggaggatatagagaaaccgagttggaagccctcccccgcccctaagtcccagccccatttcttttcagcgcgccgggaaaacggggagggggacaaaggtgctgcgtgctgtctttcaactcccgactttttgaatggcatacaatcgtccggccgcagagcggtgagccaaagtcggagtcagctcagactctgcaaacgaaaaataataacaataaaaaaaattcaaggcattcatatcggtgtagtcaacacgtgttgcggagtcggcccgggccgcaggcgactgagacaatggggtcggggactggggaaggggagtgacccccttcctcacctgccctcccagcacgcgtgcccccgctagaattatcctccctcccacagagtccggagtaacaccccagttttcgccctgttcaaggggattccagaatttctgggggtcgacccctcctttttccccgttccctgggcgagggggttccagggtctccgggccgcgctctcggccacccctggcgccatcccagcctccgccgctagaaactcgttggcctcgctcgccgctccgccgtggagccggggcttgcccgtggaccgcgcgtcccgctctccgccgcgtatccgggactccgaaacgcgcggcgagcagccccctcccccaccgcccagacggggtgcgaccgcccacgtgtcgccccttgcccagtcgggtccttccctcgggctccgggagccggaggatccggaatgagttggtcaaagccgagggaagggacccaggcggatccgcttccccctcccc

SEQ ID NO: 113467 - DNA, 501 bp, Homo sapiens; identical to SEQ ID NO: 80629
  chr17:47073908-47074409
  Hyper

SEQ ID NO: 113468 - DNA, 1598 bp, Homo sapiens
  chr17:47074697-47076295
  Hyper
tgggggctgtcaccacgtggcttctcctttttttttttttttttttttccgctccattttttttcaagtcgattttatttagaggcggcgccagggcggccgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccggtaagaacacagccacctcccggaaaagccacaacgagagccccgaacaacggagacccgcaccttccggttcctctcccgccaactcctctcttcccgggcctgcggggtttggcctccgtacccaccctcgacctacccccttcgatgccccctccctcgctctgcgcctcccacccccgcgcagaaacattcgggatttcctcatccctttctcccagcctgagataaggagctctggcttcccccatccttcctccccaccgacggggcgggagcccccactggcagtagtggggggttgaatttagggacacggggatgacccctggctgggcgttatttccacgcccagcccctccctatccgccggtggacgcccccccagctggaaaaccccggctcccgttcctcagtcttaggcctttccaggcgtggaaggggtacccggaccgcctgcgatctgtccgcttcgcgtggggaatgcagccctccagcaggacttgcaaggaagggggtcttgcctcccgcccagggcctggggcttgagccattttgatttgaaagtggggcgtgagcggggtggcgcggcggcggcggcgccgggtcgccatgctgcttcccgagacgccgaggctgggccgagaggcgcgcgcggtggcagtgagggaccctccccgccaggccccgctccgctcccccaggtccaccccttcccaaaccagccccgacaggtgaccgctccgtggcccaaagcccgtcttcctggccaacagagaaaaataaagtttcattctgcacactgcctcccgccccgcgccccactttctgaggaacggggagccctttctttcctggctccttcccacatctgggagctgtgtaggcagcgcacccacacaaatggcctcgcacctttcccaaatcgggattccagagcgatccactcaacaagcctcagtgatttaataaagcaaaaattaaaaaatgaataataacgaatttacagactc

SEQ ID NO: 113469 - DNA, 270 bp, Homo sapiens; identical to SEQ ID NO: 80632
  chr17:47081179-47081449
  Hyper

SEQ ID NO: 113470 - DNA, 170 bp, Homo sapiens; identical to SEQ ID NO: 80633
  chr17:47170202-47170372
  Hypo

SEQ ID NO: 113471 - DNA, 30 bp, Homo sapiens; identical to SEQ ID NO: 80634
  chr17:47170926-47170956
  Hypo

SEQ ID NO: 113472 - DNA, 480 bp, Homo sapiens; identical to SEQ ID NO: 80635
  chr17:47210020-47210500
  Hyper

SEQ ID NO: 113473 - DNA, 81 bp, Homo sapiens; identical to SEQ ID NO: 80636
  chr17:47226409-47226490
  Hypo

SEQ ID NO: 113474 - DNA, 102 bp, Homo sapiens; identical to SEQ ID NO: 80637
  chr17:47227368-47227470
  Hypo

SEQ ID NO: 113475 - DNA, 30 bp, Homo sapiens; identical to SEQ ID NO: 80638
  chr17:47287915-47287945
  Hyper

SEQ ID NO: 113476 - DNA, 81 bp, Homo sapiens
  chr17:47302296-47302377
  Hyper
ccacgatagtctcgtcgaagtcgaaggtcaggaggaagcgcggcgcgccctgcgcggccatcctgccgtcctgggagcagg

SEQ ID NO: 113477 - DNA, 281 bp, Homo sapiens; identical to SEQ ID NO: 80639
  chr17:47307520-47307801
  Hyper

SEQ ID NO: 113478 - DNA, 275 bp, Homo sapiens; identical to SEQ ID NO: 80640
  chr17:47308444-47308719
  Hyper

SEQ ID NO: 113479 - DNA, 30 bp, Homo sapiens; identical to SEQ ID NO: 45100
  chr17:47330524-47330554
  Hypo

SEQ ID NO: 113480 - DNA, 19 bp, Homo sapiens
  chr17:47336379-47336398
  Hypo
gccacggtgccaggcccta

SEQ ID NO: 113481 - DNA, 28 bp, Homo sapiens
  chr17:47355143-47355171
  Hypo
gagccaccgcgtccggcctccaatcaat

SEQ ID NO: 113482 - DNA, 30 bp, Homo sapiens; identical to SEQ ID NO: 45101
  chr17:47449030-47449060
  Hypo

SEQ ID NO: 113483 - DNA, 118 bp, Homo sapiens; identical to SEQ ID NO: 80645
  chr17:47547799-47547917
  Hyper

SEQ ID NO: 113484 - DNA, 30 bp, Homo sapiens; identical to SEQ ID NO: 80646
  chr17:47559443-47559473
  Hypo

SEQ ID NO: 113485 - DNA, 41 bp, Homo sapiens; identical to SEQ ID NO: 80647
  chr17:47572358-47572399
  Hyper

SEQ ID NO: 113486 - DNA, 2283 bp, Homo sapiens; identical to SEQ ID NO: 80648
  chr17:47572971-47575254
  Hyper

SEQ ID NO: 113487 - DNA, 30 bp, Homo sapiens; identical to SEQ ID NO: 80649
  chr17:47643694-47643724
  Hyper

SEQ ID NO: 113488 - DNA, 30 bp, Homo sapiens; identical to SEQ ID NO: 80650
  chr17:47644064-47644094
  Hypo

SEQ ID NO: 113489 - DNA, 64 bp, Homo sapiens; identical to SEQ ID NO: 80651
  chr17:47653309-47653373
  Hyper

SEQ ID NO: 113490 - DNA, 97 bp, Homo sapiens; identical to SEQ ID NO: 80652
  chr17:47657497-47657594
  Hypo

SEQ ID NO: 113491 - DNA, 36 bp, Homo sapiens; identical to SEQ ID NO: 80653
  chr17:47756022-47756058
  Hypo

SEQ ID NO: 113492 - DNA, 62 bp, Homo sapiens; identical to SEQ ID NO: 80654
  chr17:47840698-47840760
  Hyper

SEQ ID NO: 113493 - DNA, 32 bp, Homo sapiens; identical to SEQ ID NO: 16208
  chr17:47851118-47851150
  Hypo

SEQ ID NO: 113494 - DNA, 31 bp, Homo sapiens; identical to SEQ ID NO: 16209
  chr17:47851390-47851421
  Hypo

SEQ ID NO: 113495 - DNA, 163 bp, Homo sapiens; identical to SEQ ID NO: 80657
  chr17:47865437-47865600
  Hyper

SEQ ID NO: 113496 - DNA, 376 bp, Homo sapiens; identical to SEQ ID NO: 80658
  chr17:47928151-47928527
  Hyper

SEQ ID NO: 113497 - DNA, 152 bp, Homo sapiens
  chr17:47967958-47968110
  Hyper
ctccgggcccgacgccggcccagcccagcagtgccgggcgccgggcccaagccgaccccctgttttggctctgccgcctgatttctaccgcaggcagatatcttccgagaccccgggcccctaggctggcctcgcgccgctaccccagggcc

SEQ ID NO: 113498 - DNA, 39 bp, Homo sapiens; identical to SEQ ID NO: 80661
  chr17:47979358-47979397
  Hyper

SEQ ID NO: 113499 - DNA, 605 bp, Homo sapiens; identical to SEQ ID NO: 80662
  chr17:47987509-47988114
  Hyper

SEQ ID NO: 113500 - DNA, 85 bp, Homo sapiens; identical to SEQ ID NO: 36640
  chr17:48040403-48040488
  Hyper

SEQ ID NO: 113501 - DNA, 677 bp, Homo sapiens; identical to SEQ ID NO: 80664
  chr17:48041100-48041777
  Hyper

SEQ ID NO: 113502 - DNA, 945 bp, Homo sapiens
  chr17:48042039-48042984
  Hyper
caatccctgagaaagcgctcaggggcttgctgaggtgagcgcaaatggaagcacaaggccgggctggccgtgggctcagtaaccagtcggctgcccggcttgcgccagcactaaatgctcgatcagaaagagaaaaagaggcgcaataattccaaatttcaggaaaagtcaaatcggagaggggggacgcaggtctcttcagactgcccattctccgggcctcgctgaatgcgggggctctatccacagcgcgcggggccgagctcaggcaggctggggcgaagatctgattctttccttcccgccgccaaaccgaattaatcagtttcttcaacctgagttactaagaaagaaaggtccttccaaataaaactgaaaatcactgcgaatgacaatactatactacaagttcgttttggggccggtgggtgggatggaggagaaagggcacggataatcccggagggccgcggagtgaggaggactatggtcgcggtggaatctctgttccgctggcacatccgcgcaggtgcggctctgagtgctggctcggggttacagacctcggcatccggctgcaggggcagacagagacctcctctgctagggcgtgcggtaggcatcgtatggagcccagagactgccgagagcactgcgcactcaccaagtgttaggggtgcccgtgatagaccgccagggaaggggctggttcggagggaattcccgctaccgggaaggtcggaactcggggtgatcaaacaaggaatgcatctcacctccgtgggtgcttgtgctgcgcaaggaattattaccggagcggttgcgatggcctttgcccggcgacccaagaagagtaagcaaactaccgtccacccagcggatcaggtccaatccctgcgcctcggcccaatccctagagccccgcggcgccgtatcccctccccc

SEQ ID NO: 113503 - DNA, 319 bp, Homo sapiens
  chr17:48046722-48047041
  Hyper
gctggctggggggcccgtccggcccaacgccggaggcttggaaaagagagttggcagcgggagcggactacgtgccgggccatggcccttctgcccgggccctggccacaatgacctctttgccctgccccctccccggccgggacgcctccaaagctgtcttcccagacctcgcccctgtcccgtcggtagcggctgcctacccgcttggcttgtcccctacaaccgcagcctcccccaatttgtcctactccaggccgtatggccacctcctgtcttacccctacaccgagccagcgaaccccggagactcctacct

SEQ ID NO: 113504 - DNA, 1787 bp, Homo sapiens; identical to SEQ ID NO: 80669
  chr17:48048796-48050583
  Hyper

SEQ ID NO: 113505 - DNA, 1226 bp, Homo sapiens
  chr17:48070654-48071880
  Hyper
agagttccaggagcccgcagggcccttcagtggccagccaggctcggcagcgcgcggggaactacggggtcccgcgcgcccccgcggccctggacagccaaacaccaacctgtgtctgcgtgaggcccagctgcgcggccagctcggcgcgctcgggcagcgccaggtactgggccttctggaagcggcgctgcagggcggccagctggtagctggagtagatcgtacgcggctttcggaccttcttgggcttcccattcaccatgcgcacctctgcttccggctcctccttcaccgacactgcggggaacgcaccgggcggaagagggggcggttcagcctcggcctgcgactcctgcgaccctccagggccccgccggacgcccctcgcttccgcccaccgactcgccgcgggattcccggccgcgcgctccgctgcccgcggcccaggggggagccgcggccccagagccagaactggccgcggcccacaacgcggcgctcccagctccgcgcccggccgccgcagcactgtccccggcgccagccgccgcctgcgccaggaccgcctcggcttcgctcacgacgccttcccggctcgcctcccagcctcggggctcctcgccgcccggctgctagccgcccccttcccagtcccatctcgccgtcggttgtttctctcgctccttcccgtccgccccccgccctttaaaaaagtttcattttagaatctctttagattttcagaaaagttgcaaggatagtgcagactttctttctttccctgtcccccttcttccccccttccttctctccttcctttcttgtttcttctgccctttctctcactgtctttccatacttccctcttgctgccttcacttttccctttttcagcttctctgcctctcggtggctgcttccctccgctttcccgcaacttccgtgggtccttctcattgccccctcacgactcctagtctccccatcccttatccaaaggagggcccctagagtttccagcccctgccgcctacccccaagccctctgcgacttgatcgaggatcgcctgctgaaatgcccacgaaatcacctcgattcggaggtttcctaacaacccacagccttccccttcctctctcagctcatcccgatcctcatccgggaccgcggcgcactgcgcacatcgcgccccaaatgcttgcacacccggggctggaaggtc

SEQ ID NO: 113506 - DNA, 88 bp, Homo sapiens; identical to SEQ ID NO: 80672
  chr17:48190266-48190354
  Hypo

SEQ ID NO: 113507 - DNA, 277 bp, Homo sapiens; identical to SEQ ID NO: 80673
  chr17:48206298-48206575
  Hyper

SEQ ID NO: 113508 - DNA, 30 bp, Homo sapiens; identical to SEQ ID NO: 80674
  chr17:48207718-48207748
  Hyper

SEQ ID NO: 113509 - DNA, 30 bp, Homo sapiens; identical to SEQ ID NO: 80675
  chr17:48225911-48225941
  Hyper

SEQ ID NO: 113510 - DNA, 33 bp, Homo sapiens; identical to SEQ ID NO: 80676
  chr17:48239531-48239564
  Hypo

SEQ ID NO: 113511 - DNA, 39 bp, Homo sapiens; identical to SEQ ID NO: 80677
  chr17:48278705-48278744
  Hyper

SEQ ID NO: 113512 - DNA, 30 bp, Homo sapiens; identical to SEQ ID NO: 80679
  chr17:48503171-48503201
  Hyper

SEQ ID NO: 113513 - DNA, 30 bp, Homo sapiens; identical to SEQ ID NO: 80680
  chr17:48550296-48550326
  Hypo

SEQ ID NO: 113514 - DNA, 177 bp, Homo sapiens; identical to SEQ ID NO: 80681
  chr17:48585866-48586043
  Hyper

SEQ ID NO: 113515 - DNA, 369 bp, Homo sapiens; identical to SEQ ID NO: 80682
  chr17:48611939-48612308
  Hypo

SEQ ID NO: 113516 - DNA, 30 bp, Homo sapiens; identical to SEQ ID NO: 80683
  chr17:48617944-48617974
  Hypo

SEQ ID NO: 113517 - DNA, 640 bp, Homo sapiens
  chr17:48619096-48619736
  Hyper
tcagagcctagcctccgccggaggagcccactcttcttcccaacttccacgacctcccggtgtagggctctgaaccccgggtcactcaaagccactctcgttctgcaggtctcagcgctccgtcccccaccaacccgttcggcgcgggcgagccgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgttctcagctctca

SEQ ID NO: 113518 - DNA, 30 bp, Homo sapiens; identical to SEQ ID NO: 80686
  chr17:48620645-48620675
  Hypo

SEQ ID NO: 113519 - DNA, 882 bp, Homo sapiens; identical to SEQ ID NO: 80687
  chr17:48636387-48637269
  Hyper

SEQ ID NO: 113520 - DNA, 71 bp, Homo sapiens; identical to SEQ ID NO: 80688
  chr17:48637706-48637777
  Hyper

SEQ ID NO: 113521 - DNA, 103 bp, Homo sapiens; identical to SEQ ID NO: 80689
  chr17:48638942-48639045
  Hyper

SEQ ID NO: 113522 - DNA, 501 bp, Homo sapiens; identical to SEQ ID NO: 80690
  chr17:48639331-48639832
  Hyper

SEQ ID NO: 113523 - DNA, 449 bp, Homo sapiens; identical to SEQ ID NO: 80691
  chr17:48652975-48653424
  Hypo

SEQ ID NO: 113524 - DNA, 35 bp, Homo sapiens; identical to SEQ ID NO: 80692
  chr17:48673781-48673816
  Hypo

SEQ ID NO: 113525 - DNA, 71 bp, Homo sapiens; identical to SEQ ID NO: 80693
  chr17:48678374-48678445
  Hypo

SEQ ID NO: 113526 - DNA, 88 bp, Homo sapiens; identical to SEQ ID NO: 80694
  chr17:48687158-48687246
  Hypo

SEQ ID NO: 113527 - DNA, 158 bp, Homo sapiens; identical to SEQ ID NO: 80695
  chr17:48712444-48712602
  Hyper

SEQ ID NO: 113528 - DNA, 24 bp, Homo sapiens
  chr17:48799846-48799870
  Hypo
gcgcccggccggctcctcttatgc

SEQ ID NO: 113529 - DNA, 105 bp, Homo sapiens; identical to SEQ ID NO: 80697
  chr17:48805065-48805170
  Hypo

SEQ ID NO: 113530 - DNA, 36 bp, Homo sapiens; identical to SEQ ID NO: 80698
  chr17:48846173-48846209
  Hypo

SEQ ID NO: 113531 - DNA, 43 bp, Homo sapiens; identical to SEQ ID NO: 80699
  chr17:48911187-48911230
  Hypo

SEQ ID NO: 113532 - DNA, 273 bp, Homo sapiens; identical to SEQ ID NO: 80701
  chr17:49008614-49008887
  Hyper

SEQ ID NO: 113533 - DNA, 38 bp, Homo sapiens; identical to SEQ ID NO: 80702
  chr17:49012104-49012142
  Hypo

SEQ ID NO: 113534 - DNA, 30 bp, Homo sapiens; identical to SEQ ID NO: 80703
  chr17:49021785-49021815
  Hyper

SEQ ID NO: 113535 - DNA, 120 bp, Homo sapiens; identical to SEQ ID NO: 80704
  chr17:49229481-49229601
  Hypo

SEQ ID NO: 113536 - DNA, 124 bp, Homo sapiens; identical to SEQ ID NO: 80705
  chr17:49462711-49462835
  Hypo

SEQ ID NO: 113537 - DNA, 40 bp, Homo sapiens; identical to SEQ ID NO: 80712
  chr17:50234619-50234659
  Hyper

SEQ ID NO: 113538 - DNA, 197 bp, Homo sapiens
  chr17:50235160-50235357
  Hyper
tccaagtgcatcactcgacgggaaaacggggggaaggggggagcccgacacggcacacacacatacacactcgcacacacttccgagcgagtgcacactcgcactcccacccgacagccggccagggacagtcacccccaagatcaatatcgcagtttgaattgttccggcaaatctcccctcgggctcgacggatg

SEQ ID NO: 113539 - DNA, 751 bp, Homo sapiens; identical to SEQ ID NO: 80714
  chr17:50235728-50236479
  Hyper

SEQ ID NO: 113540 - DNA, 60 bp, Homo sapiens; identical to SEQ ID NO: 36657
  chr17:50236690-50236750
  Hyper

SEQ ID NO: 113541 - DNA, 30 bp, Homo sapiens; identical to SEQ ID NO: 36658
  chr17:50237251-50237281
  Hyper

SEQ ID NO: 113542 - DNA, 30 bp, Homo sapiens; identical to SEQ ID NO: 45112
  chr17:51321147-51321177
  Hypo

SEQ ID NO: 113543 - DNA, 21 bp, Homo sapiens
  chr17:51787080-51787101
  Hypo
aggcacggtggctcacgcctg

SEQ ID NO: 113544 - DNA, 178 bp, Homo sapiens; identical to SEQ ID NO: 80721
  chr17:51900906-51901084
  Hypo

SEQ ID NO: 113545 - DNA, 50 bp, Homo sapiens; identical to SEQ ID NO: 80722
  chr17:52978290-52978340
  Hyper

SEQ ID NO: 113546 - DNA, 270 bp, Homo sapiens; identical to SEQ ID NO: 80725
  chr17:53341212-53341482
  Hyper

SEQ ID NO: 113547 - DNA, 1474 bp, Homo sapiens
  chr17:53342183-53343657
  Hyper
gtgctgcaaggtccccgaaaatcggcgcgagcggcgacgctaaacacgcggcggcggggcgagcgggccaggcgggcggtgccgcgcgtggccccgcccccgcacgcctatgggcgcgaggtgcgggccctgacgtcactcttgtcagggccgcggcacatgggcggccggatgcgctgagcccggcgctgcggggccgcggagcgctggggagcagcggccgccggcgcggggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacggtgagcgctgccgcggccccgctccgggaagggacgacgctccgggggtccccctccgcggccgggcacgcccgctggagcatcccccaaccccgctcccgccctgtcccgcggcgccccggccccgcgctgatgaaattgaggagctcacccagcacccttcctccccttcctcctcctccatgaaaggggagggacccctcctgagctacatttaaaagagcttcgggcacccggcctccctgggtcccgctcctgcggcgcgggtgggaggtgtaacttgacaggtcaggatcgttccctagaacgaggcacacccgcacgcagagcgagcccgcctgcggagggcagagcctcccgggctggggaggagaaaccctggggcctggttctgtgcggggcagggggcgggggtcggcttgagggagggggtttcactgcgtagcctgggttttggggttgtgttacagcttctgttactggttagtatttggaactcacgaggtgtgagagaagactcgttttcttctggtgaagggtagctgagaaagcggggtgggggctggggccggtggggggagtggtctctcggcgggaagccgtgcacgcctccagcgttgacactttcccggtgcactttttctggtgggaggggagagcggagcaggctcacgtgtaaccgcgcaggagcctcctc

SEQ ID NO: 113548 - DNA, 40 bp, Homo sapiens; identical to SEQ ID NO: 80728
  chr17:53479136-53479176
  Hypo

SEQ ID NO: 113549 - DNA, 87 bp, Homo sapiens; identical to SEQ ID NO: 80730
  chr17:53916938-53917025
  Hypo

SEQ ID NO: 113550 - DNA, 357 bp, Homo sapiens; identical to SEQ ID NO: 36663
  chr17:53922649-53923006
  Hyper

SEQ ID NO: 113551 - DNA, 28 bp, Homo sapiens
  chr17:54150661-54150689
  Hypo
cttaacatcctaacgttttattatgaaa

SEQ ID NO: 113552 - DNA, 22 bp, Homo sapiens
  chr17:54266818-54266840
  Hypo
ccgcgcccggcctgccctgact

SEQ ID NO: 113553 - DNA, 30 bp, Homo sapiens; identical to SEQ ID NO: 16216
  chr17:54473510-54473540
  Hypo

SEQ ID NO: 113554 - DNA, 52 bp, Homo sapiens; identical to SEQ ID NO: 80736
  chr17:54588100-54588152
  Hypo

SEQ ID NO: 113555 - DNA, 124 bp, Homo sapiens; identical to SEQ ID NO: 80737
  chr17:54670716-54670840
  Hyper

SEQ ID NO: 113556 - DNA, 1166 bp, Homo sapiens; identical to SEQ ID NO: 80738
  chr17:54671198-54672364
  Hyper

SEQ ID NO: 113557 - DNA, 183 bp, Homo sapiens; identical to SEQ ID NO: 80739
  chr17:54673501-54673684
  Hyper

SEQ ID NO: 113558 - DNA, 155 bp, Homo sapiens; identical to SEQ ID NO: 36666
  chr17:54673918-54674073
  Hyper

SEQ ID NO: 113559 - DNA, 571 bp, Homo sapiens
  chr17:54674738-54675309
  Hyper
aaactttctgtgccccgggccaatatttttttagacagagtttcacttgcgaggggcggaggtggtggggagtggggaagaggaggggtcttatgcgaggggggcgaaagcaagaattttcatgcctggtaaacacgcgaattatgcgaagagagttattcccagctgggcgggcagccaaaactcggagagcgcgccgaggccagcgcccccacccccacgttggcaatgtcattggattacaatgcgaggtcttcccctccgcgacgccccctcctccctccgcgggcccgcccgcccgcgcccctcctccccacccctgcccacttggaaaacccgcccgcagccggcgagcttctcggctttcagagcaggagccggtgtgagctgggaggacgcgggttgcagacgtgaccggcgacagacagaccaccggatgcacagaaccagagagcaggcccgaagccgctgcggccgcgggagaggacccagcgggacccaggcagtcccagaagctaacgaaggaagtgctggtcctggaacattgtgcctaatgcgcagctggttacct

SEQ ID NO: 113560 - DNA, 100 bp, Homo sapiens
  chr17:54755949-54756049
  Hyper
taaccccccaggaagcgctccacgtgctgctggtgcgagcgccggcgcggcgcactaaatcatcgctggcgtccacatttcaaagcggagccggaggagt

SEQ ID NO: 113561 - DNA, 136 bp, Homo sapiens; identical to SEQ ID NO: 80744
  chr17:54756259-54756395
  Hyper

SEQ ID NO: 113562 - DNA, 95 bp, Homo sapiens; identical to SEQ ID NO: 80745
  chr17:54911779-54911874
  Hyper

SEQ ID NO: 113563 - DNA, 32 bp, Homo sapiens; identical to SEQ ID NO: 80746
  chr17:55037248-55037280
  Hypo

SEQ ID NO: 113564 - DNA, 30 bp, Homo sapiens; identical to SEQ ID NO: 80747
  chr17:55139041-55139071
  Hypo

SEQ ID NO: 113565 - DNA, 82 bp, Homo sapiens; identical to SEQ ID NO: 80748
  chr17:55184753-55184835
  Hypo

SEQ ID NO: 113566 - DNA, 181 bp, Homo sapiens; identical to SEQ ID NO: 45118
  chr17:55364048-55364229
  Hypo

SEQ ID NO: 113567 - DNA, 30 bp, Homo sapiens; identical to SEQ ID NO: 80750
  chr17:55568360-55568390
  Hypo

SEQ ID NO: 113568 - DNA, 180 bp, Homo sapiens; identical to SEQ ID NO: 80751
  chr17:56024224-56024404
  Hyper

SEQ ID NO: 113569 - DNA, 79 bp, Homo sapiens; identical to SEQ ID NO: 80752
  chr17:56031530-56031609
  Hypo

SEQ ID NO: 113570 - DNA, 20 bp, Homo sapiens
  chr17:56092600-56092620
  Hypo
taagagctgaaatcacgaga

SEQ ID NO: 113571 - DNA, 569 bp, Homo sapiens; identical to SEQ ID NO: 36671
  chr17:56234271-56234840
  Hyper

SEQ ID NO: 113572 - DNA, 186 bp, Homo sapiens; identical to SEQ ID NO: 80755
  chr17:56326821-56327007
  Hyper

SEQ ID NO: 113573 - DNA, 79 bp, Homo sapiens; identical to SEQ ID NO: 80756
  chr17:56327222-56327301
  Hyper

SEQ ID NO: 113574 - DNA, 30 bp, Homo sapiens; identical to SEQ ID NO: 80757
  chr17:56435300-56435330
  Hypo

SEQ ID NO: 113575 - DNA, 30 bp, Homo sapiens; identical to SEQ ID NO: 80758
  chr17:56680534-56680564
  Hypo

SEQ ID NO: 113576 - DNA, 30 bp, Homo sapiens; identical to SEQ ID NO: 80759
  chr17:56742978-56743008
  Hypo

SEQ ID NO: 113577 - DNA, 30 bp, Homo sapiens; identical to SEQ ID NO: 80760
  chr17:56781879-56781909
  Hypo

SEQ ID NO: 113578 - DNA, 1435 bp, Homo sapiens
  chr17:56832946-56834381
  Hyper
ttcagagttggagagcgggcgagtggagtgtcctttagactccgcggactcgacgggagggaccctgcaatgcttaattagaaccggttgccatggcgacagtctctaggcagcgtgggctgagctctccgtaggaataaagggtgggccgccgctggaccctgcgcgcgcccgccaccaactttccctccagatccgagaggggcggcgcgctccgcccccgggccgcgcacgtcggtgctcggcggcgcgcacgcctgcgggagccctctccaggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccggggaggaggcggccacggtagccgcgacggaggagggggaccaggagcaagacccggagcccgaggaggaggcggcggttgagggtgaggaggaggaggagggcgcggcgacggcggcggcagccccggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatagttaagtagctgggcttggctggtggtgggcccgcggtccccaccgcgccggcctcggacgcggctccctcggcccctcaaactgctctcttttctgctcctctcccccgcacccgcgcctgccgccgctgaaagcgcccccgctgctcggacccgggcggtcggctgagagctgcccacgcccgcctcggcccccacgcccgcctcggcccccacgcctcctacccggccttgaagccgctctcctgagccccggcgccctcccgccgggcccgggcccctcatcccctttcacctcggcccccagcttctagctccacttcacgcaacctttccctttcctgcctggaaaggtccttcctcccaggcttgagctccctcttcttcccagatcccttctttctccgggaggtttcctcccaccccagtctgtcttttcccgggctgagtgccttgttgtttggcggcagagacgcgactcctttctagactgagctgcgaggtgcctcctgcgtaactgcaacaatgatggttataccggccccgtatccagatgaga

SEQ ID NO: 113579 - DNA, 102 bp, Homo sapiens; identical to SEQ ID NO: 45120
  chr17:57297027-57297129
  Hypo

SEQ ID NO: 113580 - DNA, 97 bp, Homo sapiens; identical to SEQ ID NO: 80764
  chr17:57299480-57299577
  Hypo

SEQ ID NO: 113581 - DNA, 22 bp, Homo sapiens
  chr17:57787544-57787566
  Hypo
cagactccgtctcaaaaaaaaa

SEQ ID NO: 113582 - DNA, 30 bp, Homo sapiens; identical to SEQ ID NO: 80766
  chr17:57866235-57866265
  Hypo

SEQ ID NO: 113583 - DNA, 26 bp, Homo sapiens
  chr17:57879973-57879999
  Hypo
tgtagtgcagtggcacgatctctgct

SEQ ID NO: 113584 - DNA, 30 bp, Homo sapiens; identical to SEQ ID NO: 45121
  chr17:57881555-57881585
  Hypo

SEQ ID NO: 113585 - DNA, 47 bp, Homo sapiens; identical to SEQ ID NO: 80769
  chr17:58212262-58212309
  Hyper

SEQ ID NO: 113586 - DNA, 735 bp, Homo sapiens; identical to SEQ ID NO: 80770
  chr17:58212587-58213322
  Hyper

SEQ ID NO: 113587 - DNA, 1361 bp, Homo sapiens
  chr17:58216263-58217624
  Hyper
actcaggagatggggcgttgtgtataggcaagtcgctaaccgggagccccgcgcctcattccgactggatcagggggccccgcctgtccacggtccccatgcgcggtgcgctccccctcctagggccgtaattgccgcagccatccctacgcgtctccagcccccgtcgtctttgtccattcggttccgaggccgcgcttggactggggcgcccacgactgaccccggaggcacagcgaacggggcagctgcagggactccctgtcctgcaggcgactgggctcccgcgaggcagcaggtgccgaggactagcagcagatctggtgtgcagaaccctggattcgagtcccggcttcagagaccctcggctgtgtgacgtggaggcgtcggccgccctctgagagccttcgtggatgacagctgatgcttgggcctaccttcctcggctgctgagaggctcagaagggaccgcgtgtaaaacgccttggaatcttaaatctacttaattccatttacctgcttcccagaaacggtccatggcttccgtcccggtcatagcgctgcgcagcgggaccgttctgccccgctgccctcgaacagcccgtccgcgctccattgcccctccaggtgccgttattttgccttttaacctggggcgggaggttttagacgaggctgcaagtctgggccagcggggacctgagggtcccttgcaaccagcacccgcgacggtgtctacactggaattccaaggaaaagagggctccaggggcgcgaccaaggtttggtcttctgctgagcgctgctggatgaatcgccagccttcgcccgcggccccctcctcctcatccctgaccccaactcgacaagatcccccgagcgcaggcccaaactccgcacagcttgtgggccgtgaggtccgggtctcgaagctcggtcccgctggggctgtccctccgcctctacttccagggtaaagaccgcggaaccaggcgggggtctggggagcctggctgcgacctcggctgcaggcttccgcagctgcttccagggtgctgtccaccccgtggtgctgaagtgccccacgcccctccgccacctaccggaagccgcgtccgcgctacagcctccactcaggattcgacccgaactccaagacgcgtccgcactggtccaacaaccctcatggatcgtcgcctgcctcaactgtttagaccaccgcgggtttcacccggaagcaccggggaggtcggagcttgcctgagaggctcagcgaaggtccatgccttgttcagtcccaggcagtgcgggacaggtgggcgaagctcgaaccccatgctctgtcccggcactggcaggaa

SEQ ID NO: 113588 - DNA, 446 bp, Homo sapiens; identical to SEQ ID NO: 80775
  chr17:58218611-58219057
  Hyper

SEQ ID NO: 113589 - DNA, 508 bp, Homo sapiens
  chr17:58227104-58227612
  Hyper
gctgagtggagaggacgcggagtgggtgagggggccttgcgcacagggcaagaggtggccaggcagggcgggggaccggggagagcggaggatttcagatgagggacaggggaaggtggagaggggagggcaggccccgccagggggaggagccgcctcccgcgtccagctgtcggggctccctcccgtcgcggctccgctataaaacccaggccggcaggatcgctgcacccgcggcggcctcctcggtgcgcgacccccggctcagaggactctttgctgtcccgcaagatgcggatgctgctggcgctcctggccctctccgcggcgcggccatcggccagtgcaggtgagctcccgggctccggccccaggtgcccctcggcggtcccctccgtgcccccagctcccgcccctgcagaggatccccccgcgggcgaccggtgagcgtcggtggcgctggggtcccgggttgcgtgtgcgccgggggccgcgagggtgcgggagg

SEQ ID NO: 113590 - DNA, 325 bp, Homo sapiens; identical to SEQ ID NO: 80777
  chr17:58228072-58228397
  Hyper

SEQ ID NO: 113591 - DNA, 88 bp, Homo sapiens; identical to SEQ ID NO: 80778
  chr17:58471337-58471425
  Hypo

SEQ ID NO: 113592 - DNA, 598 bp, Homo sapiens
  chr17:58498747-58499345
  Hyper
cccctctcctgtgcccgaggtggccgctgggtggcaggggaggcccgggccgacggcggtcccaccgcactgtcgcgaaggcaggcgaagaacagggccacactgagtggggacaactgggcccgggcccagaggacacgaaggaaggtccgggagaaggaattcctagtttcagggaagaaaaggtggctcgagtgaggaaactgcgggggcaacggtctctcgtcgccgggaccccgccgtgtgccgcccagggacgcgagggggcgctgctgccgcgccaggggcgagggtcccggggcctcctgagcacctcccggccctgcccggccaactcagactacacccggactctgcccaccgcgtttccgccctcggcctcgggtccctggagggctcgcgggtaggaagagtcggggtggcgggactttcgccgacacccggctccccgcctggtggctgcgcacacgaggccggcgacgggacttgcccgcgtctcagcgcctcctgtgtgaagcgggaccgctgcggtacctgccccagggaaggccgcggggagggttacagagcccgtaggcactggcggggatctttatac

SEQ ID NO: 113593 - DNA, 30 bp, Homo sapiens; identical to SEQ ID NO: 80781
  chr17:58896180-58896210
  Hypo

SEQ ID NO: 113594 - DNA, 30 bp, Homo sapiens; identical to SEQ ID NO: 80782
  chr17:59277972-59278002
  Hypo

SEQ ID NO: 113595 - DNA, 30 bp, Homo sapiens; identical to SEQ ID NO: 80783
  chr17:59380675-59380705
  Hypo

SEQ ID NO: 113596 - DNA, 128 bp, Homo sapiens; identical to SEQ ID NO: 80784
  chr17:59467426-59467554
  Hyper

SEQ ID NO: 113597 - DNA, 1413 bp, Homo sapiens
  chr17:59473731-59475144
  Hyper
gttggccccaccctgcgcgggataattgggacgggagggaggcgacgggagggcggcggctccagagagactgcgcgcctgtcagcggcaatttgtttaagtggacgggacgggccgggccgctgcgggctggggtcaccgaggccgcggcccccaccccaaccagacctgggaccgcgggggagcccggtccggccgctaaaccgggctggctggcgccagggctccgggaggtgcggtccggcggggaagccgtgatgggaagcgactctgtccagggagtgtccttcaccaccacactcctcacgtccaggcagtgatcgacggcctggcggcaccctcacagcgggcccatagcacggggccacacacgtcccctgagcttagcctgggcacattcgtctgccaccgagggcttaagccagtctgcagcccgcgccccgtcactcggacgcaagtccgtcgtccgctctgccacgcggccgcacagcccgagcttcctgctgcccactgcccgcggggtcacgcaaccccggccctgcacacagaggaggaagcggcggggaccccctgccacctggaggctcaacccggggaaggtcccagcagtgccccttaaccctgcgagaggtgacggggccggaggacggaagggcagccacgccaggctcaggaccgcggccccacccggcccaggccgtccccgctcccgccccatttcactgttgcgggaagcgcggggcgcacagaccgcgcgccaccagcccaagcccgcccgacgccctggccggagaccgcctgcgagagggaggggcggccgagcgcgcgtcccccgcctgtctgcgggacctggccgatgcgaagtgacaggggccggagctttgttgtggagcctcggccgcctggcgccagccgcccccgcccgcgccctccccctccagccccgggcggcccgcgaggcgccccccggggcctcttaaaggaacacgcacactcggcccccggggctccgccaggggagggggttcctgggaagggggagggggccggcctaggtgggggaggggcccagcggaggcctcacggcgccgctccagggcctcccaggcctccccagcgccagctttcggtgagcctcgggcattcctagctggagagtttggctgggggtcgctacagactcttcagagcggctgcagcaggacctcagggtgatcgcgggaccgcggggcggggcgagtggtgggatcctggcccggacagagccccggaaagccagagggaaggtcggtgccactgtaggtggggtcgccgtccccagatgcagccgctgcactgtcgccgccaggtttctcggtcaaataacccaggcctgagtgtttcaaactcttcaggcctcggacccctggacca

SEQ ID NO: 113598 - DNA, 3321 bp, Homo sapiens; identical to SEQ ID NO: 80787
  chr17:59475357-59478678
  Hyper

SEQ ID NO: 113599 - DNA, 32 bp, Homo sapiens; identical to SEQ ID NO: 80788
  chr17:59483112-59483144
  Hyper

SEQ ID NO: 113600 - DNA, 1012 bp, Homo sapiens
  chr17:59488100-59489112
  Hyper
cctgcctcagacctgcgggcaggtccgggaacccgacagggacagagaagcccgttttccagcctaaatagaagctcgtgggcagcgcgtttgctggaggtcgctttgggctgaaacgcctctcatactcctagaggagcggcgcgtttgcgtcccgcggcttctcactttcagcaggacattaggagggagacgagagtcggctgcgcgcccgcggcggcctacgtacagggctgcggacaccagggggcagcaccgacttagggtcgcgggaggggtgcgggtgcgggcatgggcgcgggggaggcgggtgcctgcgaaggccgggcggggcggcctagtcgcggccgtttttaggccgcgtcgttgctgcagcaacccgggtggggtggggtgggactccagggcctcgagatcccccacaccactttcgccgccacctcccgccgcacatgtcccctccgagtcgcccacccggcgctccgcggggccccagctggtagcctgagtgcgactgcgggaacccgcggccggcggctgggccttgtcccagacaaaggctaggccactcccatgtccaattaagccaccctcctccccggcctcccagccctcattgtccccggggtcgccaattagcctaggcgcccggcgtacccgccgctccggtgccgcaaggcctccttaacccttcagggcctggcccggggtccttggacggcagagccgccggcacacgcgtggcaggagggccagtgctgggacgatggcgatacctgctggcggcctagcctgtcgcctcgggctctcgcgtgtggggcgtgtgaggtctaagagggaattgtgcgtgtcggtgtggggtggcgcgtgcgattcccggaggaactcggagatggagggtgtgagtgcaggggctccgagagacccctagcggctaagccgcccggatcccaaggcccaggggacctcatttcctctcgggttaatcggaatcttccgagccctcaagccc

SEQ ID NO: 113601 - DNA, 172 bp, Homo sapiens; identical to SEQ ID NO: 80791
  chr17:59490094-59490266
  Hyper

SEQ ID NO: 113602 - DNA, 1476 bp, Homo sapiens
  chr17:59528876-59530352
  Hyper
atctcaaggagctgccgcggaatcctggccctgggccgcagtttccccaggaggctctgccaagcctggcaccttgcagcccggcctgggctctgtcaaggcccgagccggactcggctccactcagaggccggcccagcacttccctgccgccgccgccccgcacccggccaccgggcttcctcccagtcctcacccctgacctccgcggccgacttcgaggcgcgccaggccgggtccagcgcccgcggccccctgggccgggacaaggagggcgggtgagcagaagggccgtgcccagggcctggaagtgcaaggccgcgtggtgggcatggtagggaagcggagcgtgggcctgtgaggcgcgtgtgcgcctgcgacctcgggaccggggctcccaaatgaacagcgcgcacagctgggagcagggcttggggagcggggctctgcggccggggatccgtagaagccgctgcctggaagcgggcgccggcagggggtggccagacccggtcgtggagcgtcctagtcttcgggcacggcggggccaggcgagccctcctggttgtcgagcctcggctgagagccgggctgctcgcccttgcttcccgcctctctaatctaaaccatgcggggctcccagcccctacccggctcgcggggcccgagggccaagaggagggcactgggccgcgcggtggaggagccggcggctcgcgtggggctcgggatcttggggaccgcgacgccggggaaccctggagcccccctccccgggggacagcgggcgcagactgattgacagcggcgacgtcagcgcggagggggggcggccccagagggagggagggaggaggagggaattgaggccccaaagtgcagccttggagatcaagggcccgctccagagccgggatgtgtccagccccgagggcacggcaggcagctggaccctgacccagcggcgcggagtcggagccccggccgtcccgcgctcctcggacccgaacctgcaggggacctcgggccgctggcgcctccgcatgcggcaccgcaattagggtgagtgtgggttccagccgagtggggacgagctgggcgtgcggggctggggccacaggggctcagggttaggctgcggggacggacaggaggatgagctggaaaggggtgagtcacgcgacccggggaagaacttcaggggcggtcaaagttgcaggaaggcggcgcgaagtgccttgggtcgggccgccgcctcggcccgacacccagtagttggggcacgagccctcctctctgagtaacgcgatgaattgggtctagagatccaagagcatagaaatatcgacagcgccagcaccctaagaacaaggccgtgacaggcggagcggtggcctggaaattggtgtttgcagaatatgcaaggccaaggaagagggccccggtactggagcgaaaatccgtgtagatatgtga

SEQ ID NO: 113603 - DNA, 691 bp, Homo sapiens
  chr17:59531667-59532358
  Hyper
aaagagaaatgctgtcgtctttggaaaacgaggcagctgaaagcaacagaccccatcgcaaaggcagcggaggttgcgggccgcacccgcggaggagtggatgtgaaggacgagagcggaccgctatgcggtgctgagtgcgggaccccgcggtgctggcggcggccgagcgcgcccaagctcgaggtccgagaggaccgcgaggacggccgccccgggccagccgggcgtggaaaaaaggaaattgctgggaagggggcaagctgtcccgaggtctggatgtggcttcgtggcggagagaaaaggaagaggcaaaccctgagcccgggagggagagcactgagcaggcctcgtccccagtccgagctgcgggaccggcgtcagtggacgcgggcggtgaaccagctcctcacagggcagggctgagcgcgtaggactgagagcgcagggcgcgagccgcagggctccgctgcacggctccgggtgtgacaagagcccagcagaggaccccatggccatgcgggccaagcgcgagacggcccctccttgcgaccccgcaggccgccacatctgggaccagcggatcgcttggtcgctggagccgatcccgccggggccctagatatagttggacccagcgcgctggccggagcgggcagctaccctactggcgcagcggccctgtgtgggg

SEQ ID NO: 113604 - DNA, 1508 bp, Homo sapiens
  chr17:59533759-59535267
  Hyper
acgaagtcccggaatcggctggagagggccaggggtcctctggcgagtgtggacctgggcgagtgactcgttgtgtgctgtgcccgcaggagatgctgcaggataagggcctgtccgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcaggtagggctgcgccagccgtcgggtagaagtcgggcgtcggtctgtctgcggggccgcctgtgtccgtctttccgtccgattgtcggcaggactcgctttcaggaggacctggctgcattcaggacggtctgcccgttcgttctccactggacatggctcgctttctctgccttttgggtccttctccactttgagccctcggggctactctgggacaagcaagagctagagctagagatagaggagagggcggtaagagagagggagacccccgtagcatctgagcgagcctggaccaagtgtccagctccaacaacccgtagagggcctgggacccaacggcgagggggcaggaggaggccaccccgccggtgcgcacgggagccgctgcggggatccgaggcctctgggacgtcgccgagggcttcacagtgataatcggacgatcacagcgcacgggatgccgcctggggatctgtgtgcactatctgcaggcgcgcgcctggccgagggtgcgtgcgcctctccctgtctgtgtctgccccgggagcctgtggcgatggcccgccacagaaatgttcatgagtgagcaggagtgtcgtctaacctgcgctggccactatgtgtgtcctctgagggttcctccgtaggtgcagctttaaaggaggaagttttagccaccgattaattcttttatattcacgaatagttcaaaatcgttctgtgaaacgaaatctggagccatgggctccgggcgggcagggttccgcacagctcttcgggtctggttcttctttcctcaggctccgcgtggagccctgggcctggcagacacaagtttctctccctcccatccccagaccatcgagaacatcaaggtggggctgcatgagaaggagctctggaagaagttccacgaggcgggcaccgagatgatcatcactaaggctggcaggtcagcgctgggagatttacttccggggatggcggtggggagcaaggggggccagggaggtcccttagaagtcctctcggccccggcctggtggcctgtgggaggcctctctgcctcctcgggcgtcagtgccacctcccttcgcagcttgggactgggccgccaaagcccgcagggggccaccgcagccgcgcgggccttgcgggaaagaccgaggggaggggcagcgctatgcaaatgaatccaaacagggatcgcgacgctcaaaagtccca

SEQ ID NO: 113605 - DNA, 37 bp, Homo sapiens; identical to SEQ ID NO: 80800
  chr17:59535526-59535563
  Hyper

SEQ ID NO: 113606 - DNA, 728 bp, Homo sapiens; identical to SEQ ID NO: 80801
  chr17:59539215-59539943
  Hyper

SEQ ID NO: 113607 - DNA, 30 bp, Homo sapiens; identical to SEQ ID NO: 80804
  chr17:60214776-60214806
  Hypo

SEQ ID NO: 113608 - DNA, 158 bp, Homo sapiens; identical to SEQ ID NO: 80805
  chr17:60216617-60216775
  Hypo

SEQ ID NO: 113609 - DNA, 41 bp, Homo sapiens; identical to SEQ ID NO: 45124
  chr17:60221577-60221618
  Hypo

SEQ ID NO: 113610 - DNA, 30 bp, Homo sapiens; identical to SEQ ID NO: 45125
  chr17:60242060-60242090
  Hypo

SEQ ID NO: 113611 - DNA, 21 bp, Homo sapiens
  chr17:60499390-60499411
  Hypo
agactccgtctcaaaaataaa

SEQ ID NO: 113612 - DNA, 32 bp, Homo sapiens; identical to SEQ ID NO: 80810
  chr17:60669597-60669629
  Hypo

SEQ ID NO: 113613 - DNA, 42 bp, Homo sapiens; identical to SEQ ID NO: 80811
  chr17:60670437-60670479
  Hypo

SEQ ID NO: 113614 - DNA, 70 bp, Homo sapiens; identical to SEQ ID NO: 80812
  chr17:60704531-60704601
  Hyper

SEQ ID NO: 113615 - DNA, 30 bp, Homo sapiens; identical to SEQ ID NO: 80813
  chr17:60705143-60705173
  Hyper

SEQ ID NO: 113616 - DNA, 387 bp, Homo sapiens; identical to SEQ ID NO: 80814
  chr17:60705569-60705956
  Hyper

SEQ ID NO: 113617 - DNA, 30 bp, Homo sapiens; identical to SEQ ID NO: 80816
  chr17:60739876-60739906
  Hypo

SEQ ID NO: 113618 - DNA, 84 bp, Homo sapiens; identical to SEQ ID NO: 80817
  chr17:60743917-60744001
  Hypo

SEQ ID NO: 113619 - DNA, 156 bp, Homo sapiens; identical to SEQ ID NO: 80818
  chr17:60744464-60744620
  Hypo

SEQ ID NO: 113620 - DNA, 42 bp, Homo sapiens; identical to SEQ ID NO: 80819
  chr17:60747365-60747407
  Hypo

SEQ ID NO: 113621 - DNA, 30 bp, Homo sapiens; identical to SEQ ID NO: 80820
  chr17:60754622-60754652
  Hypo

SEQ ID NO: 113622 - DNA, 167 bp, Homo sapiens; identical to SEQ ID NO: 80821
  chr17:60765906-60766073
  Hypo

SEQ ID NO: 113623 - DNA, 173 bp, Homo sapiens; identical to SEQ ID NO: 80822
  chr17:60766934-60767107
  Hypo

SEQ ID NO: 113624 - DNA, 91 bp, Homo sapiens; identical to SEQ ID NO: 80823
  chr17:60843863-60843954
  Hypo

SEQ ID NO: 113625 - DNA, 234 bp, Homo sapiens; identical to SEQ ID NO: 45129
  chr17:60856637-60856871
  Hypo

SEQ ID NO: 113626 - DNA, 30 bp, Homo sapiens; identical to SEQ ID NO: 80825
  chr17:60869374-60869404
  Hypo

SEQ ID NO: 113627 - DNA, 100 bp, Homo sapiens
  chr17:60885448-60885548
  Hyper
cccttcctcccctgccggggctacaggggtcgaggggctgggcgggcgggccggtccagggcgcaggagccgcccattaattgcgcggggacggccctga

SEQ ID NO: 113628 - DNA, 30 bp, Homo sapiens; identical to SEQ ID NO: 80828
  chr17:61151401-61151431
  Hypo

SEQ ID NO: 113629 - DNA, 107 bp, Homo sapiens; identical to SEQ ID NO: 80830
  chr17:61553987-61554094
  Hyper

SEQ ID NO: 113630 - DNA, 87 bp, Homo sapiens; identical to SEQ ID NO: 80831
  chr17:61580782-61580869
  Hypo

SEQ ID NO: 113631 - DNA, 87 bp, Homo sapiens; identical to SEQ ID NO: 80832
  chr17:61580929-61581016
  Hypo

SEQ ID NO: 113632 - DNA, 30 bp, Homo sapiens; identical to SEQ ID NO: 80833
  chr17:61586953-61586983
  Hypo

SEQ ID NO: 113633 - DNA, 106 bp, Homo sapiens; identical to SEQ ID NO: 80834
  chr17:61600692-61600798
  Hyper

SEQ ID NO: 113634 - DNA, 66 bp, Homo sapiens; identical to SEQ ID NO: 45132
  chr17:61607855-61607921
  Hypo

SEQ ID NO: 113635 - DNA, 30 bp, Homo sapiens; identical to SEQ ID NO: 80836
  chr17:61611741-61611771
  Hypo

SEQ ID NO: 113636 - DNA, 33 bp, Homo sapiens; identical to SEQ ID NO: 80837
  chr17:61616015-61616048
  Hyper

SEQ ID NO: 113637 - DNA, 26 bp, Homo sapiens
  chr17:61677513-61677539
  Hypo
gccaccgcgcccggctgtcctgcttc

SEQ ID NO: 113638 - DNA, 508 bp, Homo sapiens
  chr17:61777872-61778380
  Hyper
ctcccggcctggctccgggataaccgggcggggcctgggccattcactgcctcggtttcccccggttggcctcgcgcgtaggcgccggcgcccccatccccgcccagagctgtggggccgcagagacccagccggggcgaccccggagcctggcccggggtccctcgggcggccgagtcctcccgccgccaggggccgcccccgcccctttgcggcccacgaggctggcggcggcgtccgggcacgcggtctccaggcccggccgcgaggctgcggggaggagcctgcacgagggcccggcagccccggcagcccccccagccctcggcgcctctgcaaccctgcgacgggctggggaggccggtatgcgtggttcccggagcacccgtcccccgaggctccacgtactcaagcgtttctggggcggaattctgtgggcagcaacgggggccccctctccaacaagcgcacctcatttctcacgtgggagccgcggcccagagagctg

SEQ ID NO: 113639 - DNA, 160 bp, Homo sapiens; identical to SEQ ID NO: 45134
  chr17:61817857-61818017
  Hypo

SEQ ID NO: 113640 - DNA, 89 bp, Homo sapiens; identical to SEQ ID NO: 80843
  chr17:61847615-61847704
  Hypo

SEQ ID NO: 113641 - DNA, 573 bp, Homo sapiens
  chr17:61926136-61926709
  Hyper
tttcaaaacaaaaaaacaagactttttgcaaattatccattgtcaaaactccgccaaatacatctcccagcccgccagggagcagccagcagaggccgcaagctcggccaagcgagccgggatgtccaaggcgggaacgtggcttcgcgcgcaactctctgagacgcgggccggctcacgtgtccgggccgcaccacgaaaacaacagccacaggggagaacaacctcttgttttcctcatacagccgagctttgctgcaaacgatccctttccttttgtttccacattgcgttattcagaagtggttatgcggcgccaaacacgcgctttctgccccacaggtttcagccttccccaccctcatcttccccgcgctcccctcccgtcgttgtagcttcctgctcgcccctctcatctcagccaaccctgctgagctttcgcgtgggcgtcacgagtttctaggcagatcaggaaaaccgctctccggccgcaccctcgcgcgcccccgcctggcggtgtagaacaaacggtctgagcgcttggcgggcgactgagagcggagcgggcgaggc

SEQ ID NO: 113642 - DNA, 73 bp, Homo sapiens; identical to SEQ ID NO: 80846
  chr17:62020120-62020193
  Hypo

SEQ ID NO: 113643 - DNA, 30 bp, Homo sapiens; identical to SEQ ID NO: 80847
  chr17:62022052-62022082
  Hypo

SEQ ID NO: 113644 - DNA, 144 bp, Homo sapiens; identical to SEQ ID NO: 80848
  chr17:62029028-62029172
  Hypo

SEQ ID NO: 113645 - DNA, 30 bp, Homo sapiens; identical to SEQ ID NO: 80849
  chr17:62032715-62032745
  Hypo

SEQ ID NO: 113646 - DNA, 23 bp, Homo sapiens
  chr17:62054825-62054848
  Hypo
agcaagaccgtgtctctaaaaat

SEQ ID NO: 113647 - DNA, 48 bp, Homo sapiens; identical to SEQ ID NO: 80851
  chr17:62066209-62066257
  Hypo

SEQ ID NO: 113648 - DNA, 92 bp, Homo sapiens; identical to SEQ ID NO: 80852
  chr17:62221901-62221993
  Hypo

SEQ ID NO: 113649 - DNA, 30 bp, Homo sapiens; identical to SEQ ID NO: 80853
  chr17:62773492-62773522
  Hyper

SEQ ID NO: 113650 - DNA, 54 bp, Homo sapiens; identical to SEQ ID NO: 36710
  chr17:62776217-62776271
  Hyper

SEQ ID NO: 113651 - DNA, 1364 bp, Homo sapiens; identical to SEQ ID NO: 80855
  chr17:62776506-62777870
  Hyper

SEQ ID NO: 113652 - DNA, 30 bp, Homo sapiens; identical to SEQ ID NO: 80856
  chr17:62782754-62782784
  Hypo

SEQ ID NO: 113653 - DNA, 30 bp, Homo sapiens; identical to SEQ ID NO: 80857
  chr17:62831104-62831134
  Hypo

SEQ ID NO: 113654 - DNA, 42 bp, Homo sapiens; identical to SEQ ID NO: 80860
  chr17:63063928-63063970
  Hypo

SEQ ID NO: 113655 - DNA, 38 bp, Homo sapiens; identical to SEQ ID NO: 80861
  chr17:63152807-63152845
  Hypo

SEQ ID NO: 113656 - DNA, 131 bp, Homo sapiens; identical to SEQ ID NO: 80863
  chr17:63533315-63533446
  Hypo

SEQ ID NO: 113657 - DNA, 30 bp, Homo sapiens; identical to SEQ ID NO: 80864
  chr17:63973353-63973383
  Hypo

SEQ ID NO: 113658 - DNA, 27 bp, Homo sapiens
  chr17:64197672-64197699
  Hypo
aaaatagaggatgggcggggcgcagtg

SEQ ID NO: 113659 - DNA, 30 bp, Homo sapiens; identical to SEQ ID NO: 80866
  chr17:64412556-64412586
  Hypo

SEQ ID NO: 113660 - DNA, 32 bp, Homo sapiens; identical to SEQ ID NO: 80869
  chr17:64671946-64671978
  Hypo

SEQ ID NO: 113661 - DNA, 272 bp, Homo sapiens; identical to SEQ ID NO: 80870
  chr17:64672325-64672597
  Hypo

SEQ ID NO: 113662 - DNA, 30 bp, Homo sapiens; identical to SEQ ID NO: 80871
  chr17:64751173-64751203
  Hypo

SEQ ID NO: 113663 - DNA, 289 bp, Homo sapiens; identical to SEQ ID NO: 80872
  chr17:64825601-64825890
  Hyper

SEQ ID NO: 113664 - DNA, 467 bp, Homo sapiens; identical to SEQ ID NO: 80873
  chr17:64831006-64831473
  Hyper

SEQ ID NO: 113665 - DNA, 561 bp, Homo sapiens; identical to SEQ ID NO: 80874
  chr17:64960744-64961305
  Hyper

SEQ ID NO: 113666 - DNA, 260 bp, Homo sapiens; identical to SEQ ID NO: 80875
  chr17:64961365-64961625
  Hyper

SEQ ID NO: 113667 - DNA, 314 bp, Homo sapiens; identical to SEQ ID NO: 80876
  chr17:64961827-64962141
  Hyper

SEQ ID NO: 113668 - DNA, 59 bp, Homo sapiens; identical to SEQ ID NO: 80877
  chr17:65021078-65021137
  Hypo

SEQ ID NO: 113669 - DNA, 61 bp, Homo sapiens; identical to SEQ ID NO: 80878
  chr17:65254229-65254290
  Hyper

SEQ ID NO: 113670 - DNA, 30 bp, Homo sapiens; identical to SEQ ID NO: 45139
  chr17:65298508-65298538
  Hypo

SEQ ID NO: 113671 - DNA, 90 bp, Homo sapiens; identical to SEQ ID NO: 80880
  chr17:65363297-65363387
  Hypo

SEQ ID NO: 113672 - DNA, 30 bp, Homo sapiens; identical to SEQ ID NO: 80881
  chr17:65712223-65712253
  Hypo

SEQ ID NO: 113673 - DNA, 80 bp, Homo sapiens; identical to SEQ ID NO: 80882
  chr17:65778166-65778246
  Hypo

SEQ ID NO: 113674 - DNA, 36 bp, Homo sapiens; identical to SEQ ID NO: 80883
  chr17:65789836-65789872
  Hypo

SEQ ID NO: 113675 - DNA, 39 bp, Homo sapiens; identical to SEQ ID NO: 45141
  chr17:66421027-66421066
  Hypo

SEQ ID NO: 113676 - DNA, 30 bp, Homo sapiens; identical to SEQ ID NO: 80887
  chr17:66426439-66426469
  Hypo

SEQ ID NO: 113677 - DNA, 30 bp, Homo sapiens; identical to SEQ ID NO: 80888
  chr17:66430633-66430663
  Hypo

SEQ ID NO: 113678 - DNA, 96 bp, Homo sapiens; identical to SEQ ID NO: 80889
  chr17:66434324-66434420
  Hyper

SEQ ID NO: 113679 - DNA, 41 bp, Homo sapiens; identical to SEQ ID NO: 80890
  chr17:66462815-66462856
  Hypo

SEQ ID NO: 113680 - DNA, 143 bp, Homo sapiens; identical to SEQ ID NO: 80891
  chr17:66506934-66507077
  Hypo

SEQ ID NO: 113681 - DNA, 1253 bp, Homo sapiens
  chr17:66596286-66597539
  Hyper
agccgtgggtggagccgctgcagccctgggccgggggcgtcaggaaactcgagactggggcgcggggaggccccggccagagcgcccgctctcccgcgtcccgggcggggtcctcacctgttccagcgggccaccttcctccggtaataccgcagcgcctcctggctggccaggagcgagtcctcggctcccaggagaggcggctcctccgggacgttgtacagcgggtgggcgaagagggcctgcaacttggagctcgacccgctgtggctgccgccagccggttcagtccggggctcggttcgggaaaagttgtgcacgatcgtgccggggtccgaggcagctgcggccgagtcccgcgccagggaggaggcgcggccggtgcacgggcacccccgcgggcgctcccgaggccgcagctggcgctgtacttggggccagaggtggaagtagaggtcggcggagagcagcgcgcccagcagcagcagagtcagtaggcggtcccggcgcagccccggcatggcgtgctggccaagggggacgccgggggcaggccggctgtctccggggtcccgggaggggtcgcggggtgcgggcagaagaggtgcctggagtcccgcgggtgggccggggtcagtgagaccggaatgctccccgcgcgggctagtcccctgtggaggggtgtcgctcctcaacttggggaccaggtgcacggagcaccggggctctcggagtcagcgggcgtcgcttctccgcgccgagtgagccgagggaatggggttcccggggtgcccgcttcttgcgccttttctcccgtgcgcccgcccgcccggacgctcgcggcaggtgaagggccccggggcgccggcgccggctgccaccgcgggcggacgggcgacggggcggggggcgaccgcggagggcggacggaggccgccggctgcaaagcccggggcgtctctcctgaggatgctgtcgctcggcggcggctgctagtgctcccgcgactcctcctgcgggcggcggagacgccagtgccggcggctggcacgggcggcgcgagtggggagttggcgaagcaggagcggctccggggagcttgtctgtgcgcctggactcctagaggcagaggtagcgcggggcctccccgagcctggcctggcgccggcacccccacccactctccgctggcacctgcctctggcgcagctgacggccaactcccgatccgaagccggcgctgcccttgcacc

SEQ ID NO: 113682 - DNA, 37 bp, Homo sapiens; identical to SEQ ID NO: 80894
  chr17:66643278-66643315
  Hypo

SEQ ID NO: 113683 - DNA, 30 bp, Homo sapiens; identical to SEQ ID NO: 80896
  chr17:66834845-66834875
  Hypo

SEQ ID NO: 113684 - DNA, 42 bp, Homo sapiens; identical to SEQ ID NO: 80897
  chr17:66872604-66872646
  Hypo

SEQ ID NO: 113685 - DNA, 53 bp, Homo sapiens; identical to SEQ ID NO: 80898
  chr17:66959344-66959397
  Hypo

SEQ ID NO: 113686 - DNA, 22 bp, Homo sapiens
  chr17:67410388-67410410
  Hypo
tccctctcgggaaaaaaacaac

SEQ ID NO: 113687 - DNA, 30 bp, Homo sapiens; identical to SEQ ID NO: 80901
  chr17:67410790-67410820
  Hyper

SEQ ID NO: 113688 - DNA, 30 bp, Homo sapiens; identical to SEQ ID NO: 80902
  chr17:68164507-68164537
  Hyper

SEQ ID NO: 113689 - DNA, 36 bp, Homo sapiens; identical to SEQ ID NO: 80903
  chr17:68164768-68164804
  Hyper

SEQ ID NO: 113690 - DNA, 1064 bp, Homo sapiens; identical to SEQ ID NO: 80904
  chr17:68165132-68166196
  Hyper

SEQ ID NO: 113691 - DNA, 34 bp, Homo sapiens; identical to SEQ ID NO: 80905
  chr17:68268160-68268194
  Hypo

SEQ ID NO: 113692 - DNA, 167 bp, Homo sapiens; identical to SEQ ID NO: 80914
  chr17:70026568-70026735
  Hyper

SEQ ID NO: 113693 - DNA, 67 bp, Homo sapiens; identical to SEQ ID NO: 80915
  chr17:70026970-70027037
  Hyper

SEQ ID NO: 113694 - DNA, 1821 bp, Homo sapiens
  chr17:70112816-70114637
  Hyper
aaattttccgcagggcgttctagggatgagttgagggaagccgcatgacgcgcggctccccggtgccacagctaaggacagatattttcgcaaaacccagaatgaaaaaagagcacgctccctttgggagcgctgtccctttgggactggggccttccactcccacccctcctttttccctgatcggctccgcagctccacgacaagccagctggtctggtctctgacttgggctccggtccgtacccccggggcgccctgctgtgttacagccgcccgacgcccccagacccggccaggtcaccagggcagattggaggttcgcgccccctcacccgacacctcccgtccacctcatctttctttttttcgaaaacaggaaagggaagaaaactgaaacgggcctcttggtctgcagttttagcggagtcgggattccacagccctgagtggcacatgccggtcaacttcccaaagtcgggctcccgtgtggggagaaatacacacgcaggaatgcacaagcatcgcgtgttcgcaactgtcgctgggaggtctggcggctgtgatgggacatgcactcactcgggcaacacgtccacaggtgacatctattcgatcagtcaacagatatttattgcgcacctacgacgctatctggtactttccttttccccttagctgttgctgtccagcccagcgccagtccagagacgggcttaccggccgctcccttccacaagaaactcgtgtccggcgtgaagagcggacgataaacactctccaagcccagcgaaatgtactaattacaggagcggctgggagcccgcgacacggggacctgtccctccagggataggagtcttctacctgcaagggacccggcctggggaactggaatagacaaggggtaaccccttctcccatcacctctaatgagaacattgtccggggctgagatatttgggggacgccgctgctcaccccaccaaactttccctagggacagaaaagcgtccctaccgaaaacggatttaaacaccgtccccacttttgctaaggaagtttggatagggaggttgtggtccttaattcgccaggtaaaaggaaccccatcagctcgcatccctcacccccatcctgagcactgagtgtttgcgagaaactcgccctgcgccagcaactctgggctccggtctcagctcccgcgtagacgcggaggagagattggcggcccccgctggggaaattgagcccggcgccggtccgggacgtgcaagagggggaaagggggagatcccagacctcggtttcccgagggcttccctggggagccactcgcacctctgtgtctccgctcccggcggcagacctcgcggcgcttgctcaagagcgggtatccgaaagcacgtcccgaacacggagaagcgccctccgtctcctgcctcgtgacctgcgccctttccctccctcaccgcatcagatggaggaccctggctcctttcgcccctggcaaaatgctctagccaacactgggtcaacagccttagtttccagatctgtaacctgaacatcaggagcgggttcctttccttctacctgtgtctgaggtcctctggtcggggactgcgcgcgtcttcccaggtcagggaggaggggtcggggcgacctgagaaagacacaacgaagcgaatggagcccctgaatggggaaaggggagtggacaccaggaggcccctgcagaaatgcaggaccgatccactcgcgagctgacaatgccacgcgctagacttggcctgacggtggcaacgcttggcacctggg

SEQ ID NO: 113695 - DNA, 30 bp, Homo sapiens; identical to SEQ ID NO: 36724
  chr17:70115315-70115345
  Hyper

SEQ ID NO: 113696 - DNA, 76 bp, Homo sapiens; identical to SEQ ID NO: 80920
  chr17:70116259-70116335
  Hyper

SEQ ID NO: 113697 - DNA, 38 bp, Homo sapiens; identical to SEQ ID NO: 80921
  chr17:70117768-70117806
  Hyper

SEQ ID NO: 113698 - DNA, 1028 bp, Homo sapiens
  chr17:70215667-70216695
  Hyper
ccagggcagcagacacgctctcccaaaggggcggacacagacgtcctcacaccgcggcccgaccggccgcacattaatccgggtggatttggccatcttgtgacatagccaatcagttcgagggaggggacggcaggaacgcctctcctttcacgccacaaaaggattttcgtcccttgagagcacaatgaaaaaaaaaaaaaaaaaaagccaatcaaggcgggatcagctgtgggctggtcgctgcagatctgtctctcccagaggggggtgggggcacatattggtccgtgtgggaaacccagagcctcagcttctcacacattgttctcctcctcttcaactgcaccccctccccaccagcccggaccctcccctctcccctccccaaagccgttattgccacaaaagatactttccccattgtgccccggacagctgagaggtccgagttagccatacacagctccgcgtcctctccagggagaaaggggatggaccctgcaagtggagagcgggatgcttatcatacaaaggaattaaacccacttgggctctctcgccatccaggactgtggggggttaaatacggttacattttcattaggtgctaatagcagaagggcagccccgggcagcacggaccagacattgttatgaagaacgtccccgacaagggaaggtcagggcaggtggggtgggaggtggggagagggacatgccagcgtcaaagccgggtccagggaaggggggcatgccatgggcgtattgttggcctgcgagttccgtcaatgggaaaagtcatgtttcctccgaaggaaacaagtggaaattgtcggggaggggaagggctggtgggtggctgggaagcagagctcggccagttgctactaaggctgccttcgaactgtccctccccactgccagtttctgcaaatgggcaagtctggtccttctggaaggcagttctggggaggggcagtggaagggaacgttttaatatcaggaagaaccgatgtaaatcctag

SEQ ID NO: 113699 - DNA, 33 bp, Homo sapiens; identical to SEQ ID NO: 80925
  chr17:70585967-70586000
  Hypo

SEQ ID NO: 113700 - DNA, 121 bp, Homo sapiens; identical to SEQ ID NO: 80926
  chr17:70588010-70588131
  Hyper

SEQ ID NO: 113701 - DNA, 189 bp, Homo sapiens; identical to SEQ ID NO: 80927
  chr17:70588893-70589082
  Hyper

SEQ ID NO: 113702 - DNA, 38 bp, Homo sapiens; identical to SEQ ID NO: 16227
  chr17:70657503-70657541
  Hypo

SEQ ID NO: 113703 - DNA, 30 bp, Homo sapiens; identical to SEQ ID NO: 16228
  chr17:70712704-70712734
  Hypo

SEQ ID NO: 113704 - DNA, 146 bp, Homo sapiens; identical to SEQ ID NO: 80933
  chr17:71160732-71160878
  Hyper

SEQ ID NO: 113705 - DNA, 320 bp, Homo sapiens
  chr17:71161118-71161438
  Hyper
atgtgccgaggggcccgggctggctgggccagtcccagcggcgcagccacccatgcgcgcgcgctcgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaaggtgaggggtgt

SEQ ID NO: 113706 - DNA, 979 bp, Homo sapiens; identical to SEQ ID NO: 80936
  chr17:71161498-71162477
  Hyper

SEQ ID NO: 113707 - DNA, 25 bp, Homo sapiens
  chr17:71183402-71183427
  Hypo
gagccaccgtcgccggccccaagtg

SEQ ID NO: 113708 - DNA, 19 bp, Homo sapiens
  chr17:71190303-71190322
  Hypo
gggtgcggtggctcacgcc

SEQ ID NO: 113709 - DNA, 30 bp, Homo sapiens; identical to SEQ ID NO: 80939
  chr17:71191269-71191299
  Hypo

SEQ ID NO: 113710 - DNA, 30 bp, Homo sapiens; identical to SEQ ID NO: 45149
  chr17:71201620-71201650
  Hypo

SEQ ID NO: 113711 - DNA, 30 bp, Homo sapiens; identical to SEQ ID NO: 45150
  chr17:71202377-71202407
  Hypo

SEQ ID NO: 113712 - DNA, 36 bp, Homo sapiens; identical to SEQ ID NO: 80942
  chr17:71202740-71202776
  Hypo

SEQ ID NO: 113713 - DNA, 126 bp, Homo sapiens; identical to SEQ ID NO: 80943
  chr17:71246047-71246173
  Hypo

SEQ ID NO: 113714 - DNA, 39 bp, Homo sapiens; identical to SEQ ID NO: 80944
  chr17:71283415-71283454
  Hypo

SEQ ID NO: 113715 - DNA, 30 bp, Homo sapiens; identical to SEQ ID NO: 45151
  chr17:71375377-71375407
  Hypo

SEQ ID NO: 113716 - DNA, 30 bp, Homo sapiens; identical to SEQ ID NO: 80947
  chr17:71378704-71378734
  Hypo

SEQ ID NO: 113717 - DNA, 61 bp, Homo sapiens; identical to SEQ ID NO: 80948
  chr17:71391476-71391537
  Hypo

SEQ ID NO: 113718 - DNA, 30 bp, Homo sapiens; identical to SEQ ID NO: 45153
  chr17:71417363-71417393
  Hypo

SEQ ID NO: 113719 - DNA, 30 bp, Homo sapiens; identical to SEQ ID NO: 45154
  chr17:71427753-71427783
  Hypo

SEQ ID NO: 113720 - DNA, 30 bp, Homo sapiens; identical to SEQ ID NO: 80951
  chr17:71439688-71439718
  Hypo

SEQ ID NO: 113721 - DNA, 30 bp, Homo sapiens; identical to SEQ ID NO: 80952
  chr17:71475104-71475134
  Hypo

SEQ ID NO: 113722 - DNA, 30 bp, Homo sapiens; identical to SEQ ID NO: 45155
  chr17:71484009-71484039
  Hypo

SEQ ID NO: 113723 - DNA, 1254 bp, Homo sapiens; identical to SEQ ID NO: 80955
  chr17:71639013-71640267
  Hyper

SEQ ID NO: 113724 - DNA, 123 bp, Homo sapiens; identical to SEQ ID NO: 80956
  chr17:71640470-71640593
  Hyper

SEQ ID NO: 113725 - DNA, 301 bp, Homo sapiens; identical to SEQ ID NO: 80957
  chr17:71640832-71641133
  Hyper

SEQ ID NO: 113726 - DNA, 325 bp, Homo sapiens; identical to SEQ ID NO: 80958
  chr17:71641358-71641683
  Hyper

SEQ ID NO: 113727 - DNA, 21 bp, Homo sapiens
  chr17:71879558-71879579
  Hypo
ctccaaaatccgaaacgctcc

SEQ ID NO: 113728 - DNA, 494 bp, Homo sapiens
  chr17:71897979-71898473
  Hyper
attcgcacctgattacgctgcgcggacacaacagaggcgcccggacccgcagccctgccttcgccgcctttgctgggctgtttgcgcttcgtttccttctcgccgccccatggcgcgctttctctcttctttatttcgccggttctccccgctcctaacctgcttaacaacttacctcgctctcccgcttgctctccccccgccccccatctccactggttcccgagcttctcttcatgtccctaatggcgtggctgcgccagcatttaataaaagctgctgaccgggaaatccgagctaactgaattacttcctcattaaagaggcgggcagattcttgggccccgcgtgcagccaccctcgctgcctccctccccgccccgctccgccctgctggtcccgcctgccgtccgcaattaggcggcagatgcttgccgcccggtggtggcctgggttctgcagggactgagggggctcgtcggcttctctccagg

SEQ ID NO: 113729 - DNA, 990 bp, Homo sapiens; identical to SEQ ID NO: 80963
  chr17:71948390-71949380
  Hyper

SEQ ID NO: 113730 - DNA, 30 bp, Homo sapiens; identical to SEQ ID NO: 80965
  chr17:72111461-72111491
  Hypo

SEQ ID NO: 113731 - DNA, 35 bp, Homo sapiens; identical to SEQ ID NO: 80967
  chr17:72203913-72203948
  Hypo

SEQ ID NO: 113732 - DNA, 30 bp, Homo sapiens; identical to SEQ ID NO: 80968
  chr17:72207414-72207444
  Hypo

SEQ ID NO: 113733 - DNA, 307 bp, Homo sapiens; identical to SEQ ID NO: 80969
  chr17:72208361-72208668
  Hyper

SEQ ID NO: 113734 - DNA, 176 bp, Homo sapiens; identical to SEQ ID NO: 80970
  chr17:72209140-72209316
  Hyper

SEQ ID NO: 113735 - DNA, 44 bp, Homo sapiens; identical to SEQ ID NO: 80971
  chr17:72220254-72220298
  Hypo

SEQ ID NO: 113736 - DNA, 30 bp, Homo sapiens; identical to SEQ ID NO: 80972
  chr17:72222074-72222104
  Hypo

SEQ ID NO: 113737 - DNA, 213 bp, Homo sapiens; identical to SEQ ID NO: 80973
  chr17:72233492-72233705
  Hypo

SEQ ID NO: 113738 - DNA, 30 bp, Homo sapiens; identical to SEQ ID NO: 80974
  chr17:72249016-72249046
  Hypo

SEQ ID NO: 113739 - DNA, 30 bp, Homo sapiens; identical to SEQ ID NO: 80975
  chr17:72249492-72249522
  Hypo

SEQ ID NO: 113740 - DNA, 80 bp, Homo sapiens; identical to SEQ ID NO: 80976
  chr17:72269879-72269959
  Hypo

SEQ ID NO: 113741 - DNA, 351 bp, Homo sapiens; identical to SEQ ID NO: 80977
  chr17:72270174-72270525
  Hyper

SEQ ID NO: 113742 - DNA, 128 bp, Homo sapiens; identical to SEQ ID NO: 80978
  chr17:72278015-72278143
  Hypo

SEQ ID NO: 113743 - DNA, 35 bp, Homo sapiens; identical to SEQ ID NO: 80979
  chr17:72287189-72287224
  Hypo

SEQ ID NO: 113744 - DNA, 36 bp, Homo sapiens; identical to SEQ ID NO: 80980
  chr17:72296926-72296962
  Hypo

SEQ ID NO: 113745 - DNA, 719 bp, Homo sapiens
  chr17:72321933-72322652
  Hyper
cacaggcacctgctgcgatgcacgcggcgcccacggaaacccgaggctgccagccgccgccctggagaccccagagacagcggcagatgcgtgtgcttcaaggggcagcgtggctgctggggcgctccctaaagggcagtggcacggggtcgcgccgcgagcagaggggcgcgggtgggcgcgcaggagttagcgaactgacacggaggcgccaggcggacgcacggacgcaccgagggccgcagggccgcacagccgggcacacatcgtcgcgcagcggttcaggctcgggggcctcctcggcggaggcggccaactctcaccctcagcgcggggaggggcgggcgccgggggcggggcggcgccgtccgggccctccccctgccccgcctcgggtcggcgtccttagccgctggcgcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtgagacccttttagaccctcctccccaccccgctccgtggtctacttcagtcggcctccagcgacagagtcctgtcccctcgccgccaccccactgagaggacaggcaacgaccagggccggga

SEQ ID NO: 113746 - DNA, 36 bp, Homo sapiens; identical to SEQ ID NO: 80984
  chr17:72346588-72346624
  Hypo

SEQ ID NO: 113747 - DNA, 473 bp, Homo sapiens
  chr17:72352964-72353437
  Hyper
aggcggccctgctggcgcgcccccaccagcaccgtcttctggaagctcacgcccgccgcgtcgccgccgctgctggccggcgtcaccaccagccgcggtcggccgtcctccgggcgcgcggcgggcagagcagtgcccgcggcgtccgcgtaaacgggccgcaggctgacgggcagccagcgcggcgagaagagcacgttccaggtgacccggcggcccgcgtcgtggccactcgggcccagctgcgtctggaagctggtgctgcggtcgtcgcgggccgggttgttgatgacccacggggcgccccaggcgggcgcgaggtagttgcggggcaggaaggcgctgccgttgacgtcgaagaacttggcgtagtgcagcggcgacgcggcgtggaactggtaggcctgcagcaggaggtcggccaccgcggggccgtggcgcgccagggctgccgagcgcgcctgcagctggaa

SEQ ID NO: 113748 - DNA, 236 bp, Homo sapiens; identical to SEQ ID NO: 80987
  chr17:72356203-72356439
  Hypo

SEQ ID NO: 113749 - DNA, 67 bp, Homo sapiens; identical to SEQ ID NO: 80988
  chr17:72368063-72368130
  Hypo

SEQ ID NO: 113750 - DNA, 30 bp, Homo sapiens; identical to SEQ ID NO: 16232
  chr17:72370768-72370798
  Hypo

SEQ ID NO: 113751 - DNA, 502 bp, Homo sapiens; identical to SEQ ID NO: 80990
  chr17:72427092-72427594
  Hyper

SEQ ID NO: 113752 - DNA, 59 bp, Homo sapiens; identical to SEQ ID NO: 80991
  chr17:72427813-72427872
  Hyper

SEQ ID NO: 113753 - DNA, 158 bp, Homo sapiens; identical to SEQ ID NO: 80992
  chr17:72428331-72428489
  Hyper

SEQ ID NO: 113754 - DNA, 43 bp, Homo sapiens; identical to SEQ ID NO: 80993
  chr17:72428829-72428872
  Hyper

SEQ ID NO: 113755 - DNA, 30 bp, Homo sapiens; identical to SEQ ID NO: 80995
  chr17:72539052-72539082
  Hypo

SEQ ID NO: 113756 - DNA, 30 bp, Homo sapiens; identical to SEQ ID NO: 80996
  chr17:72560329-72560359
  Hypo

SEQ ID NO: 113757 - DNA, 303 bp, Homo sapiens
  chr17:72667283-72667586
  Hyper
gctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactg

SEQ ID NO: 113758 - DNA, 30 bp, Homo sapiens; identical to SEQ ID NO: 45160
  chr17:72731669-72731699
  Hypo

SEQ ID NO: 113759 - DNA, 74 bp, Homo sapiens; identical to SEQ ID NO: 80999
  chr17:72733981-72734055
  Hyper

SEQ ID NO: 113760 - DNA, 30 bp, Homo sapiens; identical to SEQ ID NO: 81000
  chr17:72773643-72773673
  Hypo

SEQ ID NO: 113761 - DNA, 30 bp, Homo sapiens; identical to SEQ ID NO: 45161
  chr17:72800435-72800465
  Hypo

SEQ ID NO: 113762 - DNA, 211 bp, Homo sapiens; identical to SEQ ID NO: 81002
  chr17:72838894-72839105
  Hyper

SEQ ID NO: 113763 - DNA, 74 bp, Homo sapiens; identical to SEQ ID NO: 81003
  chr17:72839514-72839588
  Hyper

SEQ ID NO: 113764 - DNA, 61 bp, Homo sapiens; identical to SEQ ID NO: 81004
  chr17:72848164-72848225
  Hypo

SEQ ID NO: 113765 - DNA, 770 bp, Homo sapiens
  chr17:72848502-72849272
  Hyper
agcaggcgctgcgtgcgcgcgcgcggccctcccgggcccagctccagcgtgaccacgtccagcagccgccaactcacgtggctggcgtcggcgacggcgcgcacgccctccaggaagagcgcgtggcccgggtgcaggctggtgatgacggcgaaggcgctccagtcgtactcttccagcaccttgaacagcacctgcagctgctgctccagggacacgcccagctgcaggaaggcggagcccggctcctgggggcgggcggggcctgagcggggcgggagggccgagcccctcctcccgccccttccccgacctcggcccctccatcagctcccaggcgcccttgcgccggcggatgctccgcattccgggagccctctggcctgcgcctccctcccgccccaatgtggttccccgctgcctagtagcatggtcatgcccggcccccagcccaccacgctggcccgcagacccgcagcatcagcaccactggggagtttgtcagaaatgcagattctcaggtcgcaccccacaccgactggatcggagtcgctgggtatgccgcctggcatctgtattctcacaagctcttcagccgatccttgagcccgctagactgagaagcgctgccccagaccaactgaatctgaattccagaggtgcaaagccaggcgtccgtatttcctaagagcacgatgagggttgagagccaatgtcctgagatcttatgccggggccccaagaggacggggaaacgccaccctggttga

SEQ ID NO: 113766 - DNA, 539 bp, Homo sapiens; identical to SEQ ID NO: 81008
  chr17:72855927-72856466
  Hyper

SEQ ID NO: 113767 - DNA, 1084 bp, Homo sapiens; identical to SEQ ID NO: 81009
  chr17:72856941-72858025
  Hyper

SEQ ID NO: 113768 - DNA, 786 bp, Homo sapiens
  chr17:72889307-72890093
  Hyper
ccagactctcaggttcggggtgtgaccctccatccttgggtgcggggccccgaccacctccgcctccctgccgccgccagtccactccgcaggctgcactcccacggctgctgttgcagaccccgcgccgccacctccgccgcaccccgcccccacccgcagcccggccgggacgccgggtccccgcgttcctcacctgccggcaaggcgaagaggctgagcgcgaggatggcgcagtccacgccgtggcgctcccaccaggagctcgtcctcaccacgtcctgcaccagcacctccagctcccgcagcagcgcctcgcccccacggtgcgcgctccgcgccggttccatgggctccgtaggttccatgggctccgtgggttccatggactctgtgggctcgggcccgacgcgcacggaggactggaggactggggcgtgtgtctgcggtgcaggcgaggcggggcgggccggggcggagtcacgcgccgcctggggacacccgcccccggggtcaaggtgcgagacaccctggctcctctgctgcgggcgctggcgacccaggcccggctcaggcgcgcgaccctggcaggcggcatcagaaccgccgcggagggaggagccaggccgatgagctgagagtggctaggcggggaggcgaccctgcggtgagacccagcccaggtagtagggacggaggcgtcaggggcacggagaccccagtggagacaccccccacccccgccccgccccgagggccttccctgacctccgacctcaaataact

SEQ ID NO: 113769 - DNA, 791 bp, Homo sapiens; identical to SEQ ID NO: 81012
  chr17:72919501-72920292
  Hyper

SEQ ID NO: 113770 - DNA, 30 bp, Homo sapiens; identical to SEQ ID NO: 36757
  chr17:72920550-72920580
  Hyper

SEQ ID NO: 113771 - DNA, 278 bp, Homo sapiens; identical to SEQ ID NO: 81014
  chr17:72920796-72921074
  Hyper

SEQ ID NO: 113772 - DNA, 756 bp, Homo sapiens
  chr17:72931909-72932665
  Hyper
cccgagcggcggctgcgcagtcccgctgggggagggcgtcgcgggcatcggtctcacctggacggacgatccgctcagcgcccgcagtcggtggttagcccacggcgatgcctctcccggcctcaggtaagcccggagcgccggcggaactttcccagcttgcgcaccccagacactggcacatactacccacccccccaaaaggggggttcacaagtaggggctgcagggattggaacgggaaagcggggtgactgtggagaggtgaactccctttaatctgaggccggcccctccacccgccccgcaacccgcgctccgcgcccctactcctttccgtggacccggggagcacagagggcctcagggcgcgactcctcccggccgggtccacacagcagaaagcgcggaggcctggggtgtgaggttggttggggctgtctggacgcccggtctggggcacgcaggaagcggctgccccggccccgcagtccctaaaatggctcggaaggaaatcccgagggcgcccgcactcagcagcctcctcggagccggccctgcgctgctgggccgggcgccgggcccgacggctccgcggctttcatcgccaatccagccgagacccacaaaccagtccagtgtcccggccctcccttggactggcgtcgcgcccaggggcgtgccagggggcggcagagtactgcttgtcagttccaggtgcccttgccccagccttctgcccgagacccctaaatg

SEQ ID NO: 113773 - DNA, 30 bp, Homo sapiens; identical to SEQ ID NO: 81017
  chr17:72937996-72938026
  Hypo

SEQ ID NO: 113774 - DNA, 76 bp, Homo sapiens; identical to SEQ ID NO: 81018
  chr17:72950368-72950444
  Hypo

SEQ ID NO: 113775 - DNA, 30 bp, Homo sapiens; identical to SEQ ID NO: 45162
  chr17:72969610-72969640
  Hypo

SEQ ID NO: 113776 - DNA, 157 bp, Homo sapiens; identical to SEQ ID NO: 81020
  chr17:72971503-72971660
  Hypo

SEQ ID NO: 113777 - DNA, 39 bp, Homo sapiens; identical to SEQ ID NO: 81021
  chr17:73031580-73031619
  Hypo

SEQ ID NO: 113778 - DNA, 353 bp, Homo sapiens
  chr17:73073429-73073782
  Hyper
cgcagatgctgtgctcgcgcggcctgtccgagggccgccactaggacgggaggtggaggtgtccaactcgtgggtgtgcctgggcgtcacctacccccgcagctccccgctcggcggccgcccgagccgcagcgtggtctacctgctgggccgcaaccccttctcgtggtgcctggagtgggacgacaacgcgcagaccgtgctgcacggcgcctaccaccgcacgctgggcgtggcgctcgactgcgacgccggcggcttgtccttctacggcctggcgggtggcgccagcctcttctaccgcttcctggcagccttcctcgagccgctctaccccgcggtcatggtcagca

SEQ ID NO: 113779 - DNA, 24 bp, Homo sapiens
  chr17:73083439-73083463
  Hypo
cgagactcccggccaactgagtac

SEQ ID NO: 113780 - DNA, 504 bp, Homo sapiens; identical to SEQ ID NO: 81024
  chr17:73089623-73090127
  Hypo

SEQ ID NO: 113781 - DNA, 105 bp, Homo sapiens; identical to SEQ ID NO: 45166
  chr17:73091075-73091180
  Hypo

SEQ ID NO: 113782 - DNA, 30 bp, Homo sapiens; identical to SEQ ID NO: 45167
  chr17:73091437-73091467
  Hypo

SEQ ID NO: 113783 - DNA, 30 bp, Homo sapiens; identical to SEQ ID NO: 45168
  chr17:73124882-73124912
  Hypo

SEQ ID NO: 113784 - DNA, 39 bp, Homo sapiens; identical to SEQ ID NO: 81028
  chr17:73128817-73128856
  Hypo

SEQ ID NO: 113785 - DNA, 120 bp, Homo sapiens; identical to SEQ ID NO: 81029
  chr17:73135899-73136019
  Hypo

SEQ ID NO: 113786 - DNA, 25 bp, Homo sapiens
  chr17:73138356-73138381
  Hypo
agaaagcagtagaaccggccgggcc

SEQ ID NO: 113787 - DNA, 35 bp, Homo sapiens; identical to SEQ ID NO: 81031
  chr17:73145732-73145767
  Hypo

SEQ ID NO: 113788 - DNA, 35 bp, Homo sapiens; identical to SEQ ID NO: 81032
  chr17:73179829-73179864
  Hypo

SEQ ID NO: 113789 - DNA, 101 bp, Homo sapiens; identical to SEQ ID NO: 81033
  chr17:73236201-73236302
  Hypo

SEQ ID NO: 113790 - DNA, 123 bp, Homo sapiens; identical to SEQ ID NO: 81035
  chr17:73464698-73464821
  Hypo

SEQ ID NO: 113791 - DNA, 63 bp, Homo sapiens; identical to SEQ ID NO: 81038
  chr17:73518223-73518286
  Hypo

SEQ ID NO: 113792 - DNA, 37 bp, Homo sapiens
  chr17:73522412-73522449
  Hyper
ccgcgggagggacttcggtctccggcctttctccagc

SEQ ID NO: 113793 - DNA, 117 bp, Homo sapiens; identical to SEQ ID NO: 81040
  chr17:73545911-73546028
  Hypo

SEQ ID NO: 113794 - DNA, 269 bp, Homo sapiens
  chr17:73584682-73584951
  Hyper
ccacgccggagcctacggacatgggctcggaagggacaaaaaccgggccggagtcagcgctggagccaagcagcgacggcctggacagcgactggccccacgcagatacccggggccgggaagggtcgtcggggacggggcccctgggagccagcgagcattccggcggggactccgactcgagtccgctggggaccggacctggacggggctctcgggcagctatggcctccaggaccttcgaggacagctcgcgggctcctcgggac

SEQ ID NO: 113795 - DNA, 559 bp, Homo sapiens; identical to SEQ ID NO: 81042
  chr17:73585942-73586501
  Hypo

SEQ ID NO: 113796 - DNA, 48 bp, Homo sapiens; identical to SEQ ID NO: 45172
  chr17:73592635-73592683
  Hypo

SEQ ID NO: 113797 - DNA, 79 bp, Homo sapiens; identical to SEQ ID NO: 81044
  chr17:73606380-73606459
  Hypo

SEQ ID NO: 113798 - DNA, 109 bp, Homo sapiens; identical to SEQ ID NO: 81045
  chr17:73608267-73608376
  Hypo

SEQ ID NO: 113799 - DNA, 62 bp, Homo sapiens; identical to SEQ ID NO: 81046
  chr17:73613362-73613424
  Hypo

SEQ ID NO: 113800 - DNA, 658 bp, Homo sapiens; identical to SEQ ID NO: 81047
  chr17:73615929-73616587
  Hypo

SEQ ID NO: 113801 - DNA, 30 bp, Homo sapiens; identical to SEQ ID NO: 45176
  chr17:73635801-73635831
  Hypo

SEQ ID NO: 113802 - DNA, 359 bp, Homo sapiens; identical to SEQ ID NO: 81049
  chr17:73636032-73636391
  Hypo

SEQ ID NO: 113803 - DNA, 37 bp, Homo sapiens; identical to SEQ ID NO: 16241
  chr17:73638388-73638425
  Hypo

SEQ ID NO: 113804 - DNA, 30 bp, Homo sapiens; identical to SEQ ID NO: 81051
  chr17:73639482-73639512
  Hypo

SEQ ID NO: 113805 - DNA, 30 bp, Homo sapiens; identical to SEQ ID NO: 81052
  chr17:73641552-73641582
  Hypo

SEQ ID NO: 113806 - DNA, 259 bp, Homo sapiens; identical to SEQ ID NO: 81054
  chr17:73690259-73690518
  Hypo

SEQ ID NO: 113807 - DNA, 35 bp, Homo sapiens; identical to SEQ ID NO: 81055
  chr17:73693131-73693166
  Hypo

SEQ ID NO: 113808 - DNA, 138 bp, Homo sapiens; identical to SEQ ID NO: 81056
  chr17:73719889-73720027
  Hypo

SEQ ID NO: 113809 - DNA, 30 bp, Homo sapiens; identical to SEQ ID NO: 81057
  chr17:73805937-73805967
  Hypo

SEQ ID NO: 113810 - DNA, 30 bp, Homo sapiens; identical to SEQ ID NO: 81058
  chr17:73811184-73811214
  Hypo

SEQ ID NO: 113811 - DNA, 47 bp, Homo sapiens; identical to SEQ ID NO: 81059
  chr17:73879974-73880021
  Hypo

SEQ ID NO: 113812 - DNA, 30 bp, Homo sapiens; identical to SEQ ID NO: 81060
  chr17:73895697-73895727
  Hypo

SEQ ID NO: 113813 - DNA, 216 bp, Homo sapiens; identical to SEQ ID NO: 81061
  chr17:73909942-73910158
  Hypo

SEQ ID NO: 113814 - DNA, 110 bp, Homo sapiens; identical to SEQ ID NO: 81062
  chr17:73913787-73913897
  Hypo

SEQ ID NO: 113815 - DNA, 30 bp, Homo sapiens; identical to SEQ ID NO: 45180
  chr17:73931814-73931844
  Hypo

SEQ ID NO: 113816 - DNA, 30 bp, Homo sapiens; identical to SEQ ID NO: 81064
  chr17:73934350-73934380
  Hypo

SEQ ID NO: 113817 - DNA, 149 bp, Homo sapiens; identical to SEQ ID NO: 81065
  chr17:73993427-73993576
  Hyper

SEQ ID NO: 113818 - DNA, 69 bp, Homo sapiens; identical to SEQ ID NO: 81066
  chr17:73996851-73996920
  Hypo

SEQ ID NO: 113819 - DNA, 42 bp, Homo sapiens; identical to SEQ ID NO: 45181
  chr17:74005455-74005497
  Hypo

SEQ ID NO: 113820 - DNA, 74 bp, Homo sapiens; identical to SEQ ID NO: 81068
  chr17:74028304-74028378
  Hypo

SEQ ID NO: 113821 - DNA, 154 bp, Homo sapiens; identical to SEQ ID NO: 81069
  chr17:74047840-74047994
  Hypo

SEQ ID NO: 113822 - DNA, 30 bp, Homo sapiens; identical to SEQ ID NO: 45183
  chr17:74062044-74062074
  Hypo

SEQ ID NO: 113823 - DNA, 1344 bp, Homo sapiens
  chr17:74070385-74071729
  Hyper
gactccggggcccctcatccgcctccgccccgcgtttcctccccccgatctcccaggggtcctcttttgagggcaccccagcccctcgacggtcccgggatatcctgcacccctgccaggctgcagggaagcgccgaggcgcgcggagtgcgaggtccgtgctccctgcggcgcggcgcacacgcagggtccggggtcgacccctccaccgctccggcgtctgccggggaagtcagtccgcctggtcagcccagaacccccgactgcgggggctggagctcggaagcaggtacaagcgccactctccgcctgcgccgtggaatgcgcgccgggaccactccgcagcccttcccccagcgccgccggccgctgctggggacaacctcgccctcctgtctcttgctcctcctcctgaccccagcgcacccccatccccgccccagatgaggcaaggctccctccgccttcagcccggcagagtcgcactaggagttgcagcggccgcagccccgggagcttcccgctcgcggagacccagacggctgcaggagcccgggcagcctcggggtcagcggcaccatgaacgtctcgggctgcccaggggccgggaacgcgagccaggcgggcggcgggggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtgagccagcgccttggcctccctgggagatgggcatccacgcgggggatggagcgggaggcgggactggggaccaagaagggacgcgcagagtgggacaggacactaagaaggcagtggaagacaagcgggcgcggaggaggaaaaagaggaataagaatgggggaccgtggtgtccctcggttagatgcgtcctggggcctggaagcctggagaatgtggctctccagcgccgcccgtgcctgacaacgcgcagcgtttcccagtacgacgcgtttgtgcgcgttcatctcgcttgagcttaatgccctccgtgagggtgggataggacaaagtgcccaatatacagaagagttgagttcctaagtaactcgctcagagtcgccagccagggatc

SEQ ID NO: 113824 - DNA, 32 bp, Homo sapiens
  chr17:74072034-74072066
  Hyper
gcacattcgggagagcgcgggactcaggtgga

SEQ ID NO: 113825 - DNA, 103 bp, Homo sapiens; identical to SEQ ID NO: 36765
  chr17:74072477-74072580
  Hyper

SEQ ID NO: 113826 - DNA, 620 bp, Homo sapiens
  chr17:74072851-74073471
  Hyper
gctggccaacctgaccgtgtgccatcccgcgtggagcgcccctcgccgccgcgccatggacatctgcaccttcgtcttcagctacctgcttcctgtgctggttctcggcctgacctacgcgcgcaccttgcgctacctctggcgcgccgtcgacccggtggccgcgggctcgggtgcccggcgcgccaagcgcaaggtgacacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacatgagcgaggcggcgggggcccttcgtccctgccccggcgcttcccagccatgcatcctcgagccctgtcctggcccgtcctggcagggcc

SEQ ID NO: 113827 - DNA, 30 bp, Homo sapiens; identical to SEQ ID NO: 81076
  chr17:74076403-74076433
  Hyper

SEQ ID NO: 113828 - DNA, 30 bp, Homo sapiens; identical to SEQ ID NO: 81077
  chr17:74081696-74081726
  Hypo

SEQ ID NO: 113829 - DNA, 228 bp, Homo sapiens
  chr17:74117868-74118096
  Hyper
gcatccagagggtcccgggaacgcgacctgggggttggacaggaaaccaggggtcggggcagcctgctgggggcgtctcgtgccccccaccctccattcctctgaaccagtccggaaggggggttcggctggcaagccgcggtggcgtcagcctctggcacccgctgctgcccggcccgtggctccaggcaaccggggacgctgcgggggctgcgctgggcagcgggt

SEQ ID NO: 113830 - DNA, 183 bp, Homo sapiens; identical to SEQ ID NO: 81079
  chr17:74128189-74128372
  Hypo

SEQ ID NO: 113831 - DNA, 466 bp, Homo sapiens
  chr17:74136280-74136746
  Hyper
gcacctggtggtagccgtgggggtcggtgccccccgggggcagggcgggggccttggcgttgagaatggagaattcctgcagccactgcaggctggtcaggctgtcatccagggcgtcgggctcctccaggccgccctccggcccggcctcctccgccggcccggctcccgagaggcgcagccagctctccgccatgtctgcggggactctccgagggggcggtcagcatccacgggctgagccgggggtggcccgccgcgctctctggcccgctgagtcccgcagctcccgttacacggcctcccggacgcgcgcttccatctcgcgaccccgggggcgcctcctccgaataagtatgtggtgcctgcgaggaccacggtgggagctgagcactaccccacccccgaggggacagtgtgtgtacggggacgccctctctaacatcatccccgcagctggggagga

SEQ ID NO: 113832 - DNA, 74 bp, Homo sapiens; identical to SEQ ID NO: 81082
  chr17:74172769-74172843
  Hypo

SEQ ID NO: 113833 - DNA, 37 bp, Homo sapiens; identical to SEQ ID NO: 81083
  chr17:74187103-74187140
  Hypo

SEQ ID NO: 113834 - DNA, 74 bp, Homo sapiens; identical to SEQ ID NO: 81085
  chr17:74269861-74269935
  Hypo

SEQ ID NO: 113835 - DNA, 37 bp, Homo sapiens; identical to SEQ ID NO: 81086
  chr17:74299237-74299274
  Hypo

SEQ ID NO: 113836 - DNA, 22 bp, Homo sapiens
  chr17:74299969-74299991
  Hypo
aaaaagtcgccaccagcaaagg

SEQ ID NO: 113837 - DNA, 30 bp, Homo sapiens; identical to SEQ ID NO: 45185
  chr17:74362291-74362321
  Hypo

SEQ ID NO: 113838 - DNA, 68 bp, Homo sapiens; identical to SEQ ID NO: 81089
  chr17:74378890-74378958
  Hyper

SEQ ID NO: 113839 - DNA, 96 bp, Homo sapiens; identical to SEQ ID NO: 81090
  chr17:74390363-74390459
  Hypo

SEQ ID NO: 113840 - DNA, 38 bp, Homo sapiens; identical to SEQ ID NO: 81091
  chr17:74459661-74459699
  Hypo

SEQ ID NO: 113841 - DNA, 945 bp, Homo sapiens
  chr17:74533488-74534433
  Hyper
ggatggccacccccacgtcctcgcagttggcatagagccgggcccacatagcctgcaccgccttcctctccgcctcggacagctcctcgctccgctccctgcgctcgatctccatctcgcctggcactttctccatgagcagctccaagcccagcccggctttgctcggcggcggcggtggcggggcgcggggcgcggggcgcggggcgccgggagccggggccggctgcgtgcgcggcgggcgggcgaggggtagagcgcggagggagggagcgtgtgtctgtgcgcgccgggtgtgtgtgtgtgtgtgcgtgcgtgtgtgcagggtatatgtgcggggggcgggggacagccagcggtggggcggggatgtggtctgctggaaaatgtttaaaaaaacaaatccgctccaaacccccagccccgtgtgggtaagagccaatgccggcaaggtgaaggctgcgcggggtgggggcgacgcgactgccgcccgcccacccgcaggccacggcggagttgcaccgcggggcggggctcgggtaggtgtggccggggcgctgggggtcccgggaggaatgggcggtcacgcggcgctgggcggcgcgggccgcacaggagtgcgctggggcgggcgcgggccgggagcgctgggttccgggtcccagtgcttgcggcgtcgcgagtgtgcgcgtgcggacccttcccgcggcggggaactgactcaaagtccaacactcccgagctttcgcggcgaggccgaccgccagcccgcccgtgggggcgaacaggagcccctccggcggccgccgtggacctagctgggctcccctcgcccgggcctctccccgcgcccccgagccagccgctgggggccgcggcgccactcccacggctctggacgcccaggctctggggggttagcacgggggtcgtccccctgcccgc

SEQ ID NO: 113842 - DNA, 658 bp, Homo sapiens; identical to SEQ ID NO: 81096
  chr17:74581043-74581701
  Hyper

SEQ ID NO: 113843 - DNA, 30 bp, Homo sapiens; identical to SEQ ID NO: 81098
  chr17:74636168-74636198
  Hypo

SEQ ID NO: 113844 - DNA, 35 bp, Homo sapiens; identical to SEQ ID NO: 81100
  chr17:74823893-74823928
  Hypo

SEQ ID NO: 113845 - DNA, 43 bp, Homo sapiens; identical to SEQ ID NO: 81101
  chr17:74835961-74836004
  Hyper

SEQ ID NO: 113846 - DNA, 38 bp, Homo sapiens; identical to SEQ ID NO: 81102
  chr17:74854240-74854278
  Hypo

SEQ ID NO: 113847 - DNA, 651 bp, Homo sapiens
  chr17:74864643-74865294
  Hyper
cgcggggctgaggatcggcgcggcccggaggcgctggggaccggggcgcgggcccggggccgcctttagccggcaccgagggcgcggggccggggatgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggtaaagttccctcctggttggttttttccccaggggggcgccgggtggaggtgggcgaggtcggttcctgcgaacgttcaagtcctggtggcagagggggcggttcacacttcaa

SEQ ID NO: 113848 - DNA, 800 bp, Homo sapiens; identical to SEQ ID NO: 81105
  chr17:74865520-74866320
  Hyper

SEQ ID NO: 113849 - DNA, 84 bp, Homo sapiens; identical to SEQ ID NO: 81106
  chr17:74908730-74908814
  Hypo

SEQ ID NO: 113850 - DNA, 52 bp, Homo sapiens; identical to SEQ ID NO: 81108
  chr17:74920557-74920609
  Hypo

SEQ ID NO: 113851 - DNA, 506 bp, Homo sapiens; identical to SEQ ID NO: 81110
  chr17:74965247-74965753
  Hyper

SEQ ID NO: 113852 - DNA, 18 bp, Homo sapiens
  chr17:75047191-75047209
  Hypo
aatcatccgcttggccgg

SEQ ID NO: 113853 - DNA, 291 bp, Homo sapiens; identical to SEQ ID NO: 81112
  chr17:75049728-75050019
  Hypo

SEQ ID NO: 113854 - DNA, 30 bp, Homo sapiens; identical to SEQ ID NO: 81113
  chr17:75054527-75054557
  Hypo

SEQ ID NO: 113855 - DNA, 30 bp, Homo sapiens; identical to SEQ ID NO: 45189
  chr17:75207839-75207869
  Hypo

SEQ ID NO: 113856 - DNA, 30 bp, Homo sapiens; identical to SEQ ID NO: 81115
  chr17:75326544-75326574
  Hypo

SEQ ID NO: 113857 - DNA, 1195 bp, Homo sapiens
  chr17:75368715-75369910
  Hyper
gccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttcctt

SEQ ID NO: 113858 - DNA, 204 bp, Homo sapiens
  chr17:75370138-75370342
  Hyper
ccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagta

SEQ ID NO: 113859 - DNA, 253 bp, Homo sapiens; identical to SEQ ID NO: 81121
  chr17:75370564-75370817
  Hyper

SEQ ID NO: 113860 - DNA, 30 bp, Homo sapiens; identical to SEQ ID NO: 81122
  chr17:75385196-75385226
  Hyper

SEQ ID NO: 113861 - DNA, 30 bp, Homo sapiens; identical to SEQ ID NO: 81123
  chr17:75411816-75411846
  Hypo

SEQ ID NO: 113862 - DNA, 30 bp, Homo sapiens; identical to SEQ ID NO: 81124
  chr17:75413782-75413812
  Hypo

SEQ ID NO: 113863 - DNA, 265 bp, Homo sapiens; identical to SEQ ID NO: 81125
  chr17:75447462-75447727
  Hyper

SEQ ID NO: 113864 - DNA, 257 bp, Homo sapiens; identical to SEQ ID NO: 81126
  chr17:75523015-75523272
  Hypo

SEQ ID NO: 113865 - DNA, 609 bp, Homo sapiens
  chr17:75524585-75525194
  Hyper
cccccgaccccctctcgtggtcgccagggtaggggtgggaggaatctggaagccacgtgcgatgctcggagctgcgtcctctgtcctggggcgtgggtccgcgagcgccgcgcagcctcccggaccgccctgagctgctgcgcccggcgctgctcctccttccccagctccgcgccttcccctcgcgatccccctcctgcctcttcggtcctggaagcgtcccaagatggggtgggggcatggagggagagaggggaggagggagctgcccgggggcagtgccgccaggaagtgggacggggactctggcgcccctccaggctgctgcgcgcgggctggggaccgtgcaccgctttgcgcgccagacgatgcatcttctggaacggcagctgaggcaatgcggggtgtgaagtggcggcgggcagaggggctcgcaggggctgggatccgcgtgcccctctctgcctcggtgcggagcacgatgtgcccgggcgggggcgaggacgtccgggaggggctgggctgcgcacgctcgcggggccgtcgcagatgggcggtttggaggcgctgcagtccctgggaaatgggagcctccgtcctgttctctct

SEQ ID NO: 113866 - DNA, 102 bp, Homo sapiens; identical to SEQ ID NO: 81129
  chr17:75544144-75544246
  Hypo

SEQ ID NO: 113867 - DNA, 33 bp, Homo sapiens; identical to SEQ ID NO: 81131
  chr17:75548384-75548417
  Hypo

SEQ ID NO: 113868 - DNA, 79 bp, Homo sapiens; identical to SEQ ID NO: 81133
  chr17:75557167-75557246
  Hypo

SEQ ID NO: 113869 - DNA, 30 bp, Homo sapiens; identical to SEQ ID NO: 81134
  chr17:75587520-75587550
  Hypo

SEQ ID NO: 113870 - DNA, 56 bp, Homo sapiens; identical to SEQ ID NO: 45192
  chr17:75630378-75630434
  Hypo

SEQ ID NO: 113871 - DNA, 41 bp, Homo sapiens; identical to SEQ ID NO: 45193
  chr17:75733967-75734008
  Hypo

SEQ ID NO: 113872 - DNA, 30 bp, Homo sapiens; identical to SEQ ID NO: 81137
  chr17:75748192-75748222
  Hypo

SEQ ID NO: 113873 - DNA, 33 bp, Homo sapiens; identical to SEQ ID NO: 45194
  chr17:75770731-75770764
  Hypo

SEQ ID NO: 113874 - DNA, 30 bp, Homo sapiens; identical to SEQ ID NO: 81139
  chr17:75792358-75792388
  Hypo

SEQ ID NO: 113875 - DNA, 30 bp, Homo sapiens; identical to SEQ ID NO: 81140
  chr17:75797195-75797225
  Hypo

SEQ ID NO: 113876 - DNA, 30 bp, Homo sapiens; identical to SEQ ID NO: 45195
  chr17:75840791-75840821
  Hypo

SEQ ID NO: 113877 - DNA, 30 bp, Homo sapiens; identical to SEQ ID NO: 81142
  chr17:75849397-75849427
  Hypo

SEQ ID NO: 113878 - DNA, 91 bp, Homo sapiens; identical to SEQ ID NO: 81143
  chr17:75893341-75893432
  Hypo

SEQ ID NO: 113879 - DNA, 30 bp, Homo sapiens; identical to SEQ ID NO: 81144
  chr17:75895459-75895489
  Hypo

SEQ ID NO: 113880 - DNA, 43 bp, Homo sapiens; identical to SEQ ID NO: 45196
  chr17:75905178-75905221
  Hypo

SEQ ID NO: 113881 - DNA, 30 bp, Homo sapiens; identical to SEQ ID NO: 81146
  chr17:75925908-75925938
  Hypo

SEQ ID NO: 113882 - DNA, 30 bp, Homo sapiens; identical to SEQ ID NO: 81147
  chr17:75927761-75927791
  Hypo

SEQ ID NO: 113883 - DNA, 238 bp, Homo sapiens; identical to SEQ ID NO: 81148
  chr17:75953744-75953982
  Hyper

SEQ ID NO: 113884 - DNA, 57 bp, Homo sapiens; identical to SEQ ID NO: 81149
  chr17:75955156-75955213
  Hyper

SEQ ID NO: 113885 - DNA, 79 bp, Homo sapiens; identical to SEQ ID NO: 45197
  chr17:76021242-76021321
  Hypo

SEQ ID NO: 113886 - DNA, 27 bp, Homo sapiens
  chr17:76026881-76026908
  Hypo
tagaaatgcaaattccggccgggcatg

SEQ ID NO: 113887 - DNA, 30 bp, Homo sapiens; identical to SEQ ID NO: 81152
  chr17:76034067-76034097
  Hypo

SEQ ID NO: 113888 - DNA, 30 bp, Homo sapiens; identical to SEQ ID NO: 81153
  chr17:76073363-76073393
  Hypo

SEQ ID NO: 113889 - DNA, 205 bp, Homo sapiens; identical to SEQ ID NO: 81156
  chr17:76098484-76098689
  Hypo

SEQ ID NO: 113890 - DNA, 91 bp, Homo sapiens; identical to SEQ ID NO: 81157
  chr17:76101037-76101128
  Hypo

SEQ ID NO: 113891 - DNA, 34 bp, Homo sapiens; identical to SEQ ID NO: 81158
  chr17:76123797-76123831
  Hyper

SEQ ID NO: 113892 - DNA, 29 bp, Homo sapiens
  chr17:76125196-76125225
  Hyper
gcccccccccccgccgcccccgcaagcct

SEQ ID NO: 113893 - DNA, 30 bp, Homo sapiens; identical to SEQ ID NO: 81159
  chr17:76131445-76131475
  Hypo

SEQ ID NO: 113894 - DNA, 92 bp, Homo sapiens; identical to SEQ ID NO: 45199
  chr17:76134317-76134409
  Hypo

SEQ ID NO: 113895 - DNA, 122 bp, Homo sapiens; identical to SEQ ID NO: 81161
  chr17:76134633-76134755
  Hypo

SEQ ID NO: 113896 - DNA, 87 bp, Homo sapiens; identical to SEQ ID NO: 81162
  chr17:76135474-76135561
  Hypo

SEQ ID NO: 113897 - DNA, 87 bp, Homo sapiens; identical to SEQ ID NO: 81163
  chr17:76136101-76136188
  Hypo

SEQ ID NO: 113898 - DNA, 333 bp, Homo sapiens; identical to SEQ ID NO: 81164
  chr17:76137857-76138190
  Hypo

SEQ ID NO: 113899 - DNA, 120 bp, Homo sapiens; identical to SEQ ID NO: 81165
  chr17:76138614-76138734
  Hypo

SEQ ID NO: 113900 - DNA, 19 bp, Homo sapiens
  chr17:76146895-76146914
  Hypo
agcctacactccaaacggc

SEQ ID NO: 113901 - DNA, 39 bp, Homo sapiens; identical to SEQ ID NO: 81167
  chr17:76211240-76211279
  Hypo

SEQ ID NO: 113902 - DNA, 99 bp, Homo sapiens; identical to SEQ ID NO: 81168
  chr17:76211519-76211618
  Hypo

SEQ ID NO: 113903 - DNA, 89 bp, Homo sapiens; identical to SEQ ID NO: 81169
  chr17:76211992-76212081
  Hypo

SEQ ID NO: 113904 - DNA, 55 bp, Homo sapiens; identical to SEQ ID NO: 81171
  chr17:76217079-76217134
  Hypo

SEQ ID NO: 113905 - DNA, 625 bp, Homo sapiens
  chr17:76227749-76228374
  Hyper
tggctgctgaggagccgggggttcagggaaattaaggaacgtgcccagggacccggggccagcccgtggggacgctgggattggagcccaagccccaggttcgccgcgcggctctcgacttcctctcctttcccccaggggcgagctcagcgaccgcagagaggtggggtcgatctccctgcgaccccagggggcccgcgaggccagtgcgcgggcaggagcggggacgtgctcagaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcgcgctcctggccgccgcggtcgccagcgactactggtacatcctggaggtggcggacgccggcaatggcagcgcctggcccgggcgcgcagagctgctctcctcgcactcggggctctggcgcatctgcgaaggtaaccggccaccgcgccggccctcctccctccgcgacctcgtccctccgacacccccttaaccccgccctgctcgtgtt

SEQ ID NO: 113906 - DNA, 71 bp, Homo sapiens
  chr17:76254783-76254854
  Hyper
gctgagttcagtgtgcggattcctgtaacgctgggctgctggcaggaagtgcgcgccggggaggctgctgc

SEQ ID NO: 113907 - DNA, 125 bp, Homo sapiens; identical to SEQ ID NO: 45208
  chr17:76395588-76395713
  Hypo

SEQ ID NO: 113908 - DNA, 66 bp, Homo sapiens; identical to SEQ ID NO: 81176
  chr17:76396807-76396873
  Hypo

SEQ ID NO: 113909 - DNA, 44 bp, Homo sapiens; identical to SEQ ID NO: 45209
  chr17:76404759-76404803
  Hypo

SEQ ID NO: 113910 - DNA, 35 bp, Homo sapiens; identical to SEQ ID NO: 81178
  chr17:76405095-76405130
  Hypo

SEQ ID NO: 113911 - DNA, 114 bp, Homo sapiens; identical to SEQ ID NO: 81179
  chr17:76419325-76419439
  Hypo

SEQ ID NO: 113912 - DNA, 23 bp, Homo sapiens
  chr17:76441957-76441980
  Hypo
attgaccattttggccgggcaca

SEQ ID NO: 113913 - DNA, 165 bp, Homo sapiens; identical to SEQ ID NO: 81181
  chr17:76455024-76455189
  Hypo

SEQ ID NO: 113914 - DNA, 30 bp, Homo sapiens; identical to SEQ ID NO: 81182
  chr17:76458828-76458858
  Hypo

SEQ ID NO: 113915 - DNA, 94 bp, Homo sapiens; identical to SEQ ID NO: 81183
  chr17:76490678-76490772
  Hypo

SEQ ID NO: 113916 - DNA, 83 bp, Homo sapiens; identical to SEQ ID NO: 81184
  chr17:76498516-76498599
  Hypo

SEQ ID NO: 113917 - DNA, 71 bp, Homo sapiens; identical to SEQ ID NO: 81185
  chr17:76498901-76498972
  Hypo

SEQ ID NO: 113918 - DNA, 329 bp, Homo sapiens; identical to SEQ ID NO: 81186
  chr17:76501454-76501783
  Hypo

SEQ ID NO: 113919 - DNA, 66 bp, Homo sapiens; identical to SEQ ID NO: 81187
  chr17:76526194-76526260
  Hypo

SEQ ID NO: 113920 - DNA, 63 bp, Homo sapiens; identical to SEQ ID NO: 81188
  chr17:76526566-76526629
  Hypo

SEQ ID NO: 113921 - DNA, 86 bp, Homo sapiens; identical to SEQ ID NO: 81189
  chr17:76557425-76557511
  Hypo

SEQ ID NO: 113922 - DNA, 30 bp, Homo sapiens; identical to SEQ ID NO: 81190
  chr17:76562886-76562916
  Hypo

SEQ ID NO: 113923 - DNA, 109 bp, Homo sapiens; identical to SEQ ID NO: 81191
  chr17:76670709-76670818
  Hypo

SEQ ID NO: 113924 - DNA, 172 bp, Homo sapiens; identical to SEQ ID NO: 81192
  chr17:76676165-76676337
  Hypo

SEQ ID NO: 113925 - DNA, 30 bp, Homo sapiens; identical to SEQ ID NO: 81193
  chr17:76702385-76702415
  Hypo

SEQ ID NO: 113926 - DNA, 21 bp, Homo sapiens
  chr17:76779848-76779869
  Hypo
ccaccacgcctggctggattc

SEQ ID NO: 113927 - DNA, 185 bp, Homo sapiens; identical to SEQ ID NO: 81195
  chr17:76897086-76897271
  Hypo

SEQ ID NO: 113928 - DNA, 30 bp, Homo sapiens
  chr17:76921829-76921859
  Hyper
gactctggagggctacgctgctccgtcccc

SEQ ID NO: 113929 - DNA, 30 bp, Homo sapiens; identical to SEQ ID NO: 81196
  chr17:76932264-76932294
  Hypo

SEQ ID NO: 113930 - DNA, 33 bp, Homo sapiens; identical to SEQ ID NO: 45218
  chr17:76958740-76958773
  Hypo

SEQ ID NO: 113931 - DNA, 36 bp, Homo sapiens; identical to SEQ ID NO: 81198
  chr17:76967407-76967443
  Hyper

SEQ ID NO: 113932 - DNA, 30 bp, Homo sapiens; identical to SEQ ID NO: 81199
  chr17:76970826-76970856
  Hypo

SEQ ID NO: 113933 - DNA, 36 bp, Homo sapiens; identical to SEQ ID NO: 81200
  chr17:76972067-76972103
  Hypo

SEQ ID NO: 113934 - DNA, 374 bp, Homo sapiens; identical to SEQ ID NO: 81201
  chr17:76974125-76974499
  Hypo

SEQ ID NO: 113935 - DNA, 30 bp, Homo sapiens; identical to SEQ ID NO: 81202
  chr17:76975153-76975183
  Hypo

SEQ ID NO: 113936 - DNA, 38 bp, Homo sapiens; identical to SEQ ID NO: 81203
  chr17:76975538-76975576
  Hypo

SEQ ID NO: 113937 - DNA, 190 bp, Homo sapiens; identical to SEQ ID NO: 81204
  chr17:76991522-76991712
  Hypo

SEQ ID NO: 113938 - DNA, 61 bp, Homo sapiens; identical to SEQ ID NO: 81205
  chr17:76993358-76993419
  Hypo

SEQ ID NO: 113939 - DNA, 85 bp, Homo sapiens; identical to SEQ ID NO: 81206
  chr17:76996482-76996567
  Hypo

SEQ ID NO: 113940 - DNA, 62 bp, Homo sapiens; identical to SEQ ID NO: 81207
  chr17:76996979-76997041
  Hypo

SEQ ID NO: 113941 - DNA, 30 bp, Homo sapiens; identical to SEQ ID NO: 45221
  chr17:76997571-76997601
  Hypo

SEQ ID NO: 113942 - DNA, 526 bp, Homo sapiens; identical to SEQ ID NO: 81209
  chr17:77002640-77003166
  Hypo

SEQ ID NO: 113943 - DNA, 229 bp, Homo sapiens
  chr17:77020197-77020426
  Hyper
cggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcc

SEQ ID NO: 113944 - DNA, 30 bp, Homo sapiens; identical to SEQ ID NO: 81212
  chr17:77084562-77084592
  Hypo

SEQ ID NO: 113945 - DNA, 203 bp, Homo sapiens; identical to SEQ ID NO: 81213
  chr17:77104080-77104283
  Hypo

SEQ ID NO: 113946 - DNA, 235 bp, Homo sapiens; identical to SEQ ID NO: 81214
  chr17:77104986-77105221
  Hypo

SEQ ID NO: 113947 - DNA, 30 bp, Homo sapiens; identical to SEQ ID NO: 81215
  chr17:77114143-77114173
  Hypo

SEQ ID NO: 113948 - DNA, 48 bp, Homo sapiens; identical to SEQ ID NO: 81216
  chr17:77126443-77126491
  Hypo

SEQ ID NO: 113949 - DNA, 30 bp, Homo sapiens; identical to SEQ ID NO: 45226
  chr17:77126850-77126880
  Hypo

SEQ ID NO: 113950 - DNA, 53 bp, Homo sapiens; identical to SEQ ID NO: 81218
  chr17:77127124-77127177
  Hypo

SEQ ID NO: 113951 - DNA, 30 bp, Homo sapiens; identical to SEQ ID NO: 81219
  chr17:77135204-77135234
  Hypo

SEQ ID NO: 113952 - DNA, 72 bp, Homo sapiens; identical to SEQ ID NO: 45228
  chr17:77135878-77135950
  Hypo

SEQ ID NO: 113953 - DNA, 212 bp, Homo sapiens; identical to SEQ ID NO: 81221
  chr17:77143891-77144103
  Hypo

SEQ ID NO: 113954 - DNA, 154 bp, Homo sapiens; identical to SEQ ID NO: 45230
  chr17:77145129-77145283
  Hypo

SEQ ID NO: 113955 - DNA, 233 bp, Homo sapiens; identical to SEQ ID NO: 81223
  chr17:77147053-77147286
  Hypo

SEQ ID NO: 113956 - DNA, 182 bp, Homo sapiens; identical to SEQ ID NO: 81224
  chr17:77174854-77175036
  Hypo

SEQ ID NO: 113957 - DNA, 1662 bp, Homo sapiens
  chr17:77178580-77180242
  Hyper
cgcattgggtggcagcgcaggacccccgtcccctcccccaacgccccggccggccggcgggcaggcggctgctgatgctctgtgcgcacctccccacggggcatcctggggatctggtggctcagagtcgccgactttcctgcccccacccaaccccaactcgccagccggagcttcctgcgcagcccccaagattgcaaaagtctggccccagccccctccccggccagagctcctggggcctccctcgccaggcgggtggcccacctcccccgcctccccggaggcccggcgcgcggtctgcgctgcagcagagctcggcgcccccgccgccacctctgcgcgccccccggctttcccgacgctgccagggaggatgccccgctccccgccccgagtccccagcggcccggcgcgaagttccccaaagtgacccgggcgccgagaacccccgccccctcccctcgggcttccccggagactccgcccgccgccccctcccgcgccttcggaaaagttgcgagcgacgccccaaactccggcccccccgcctcgcgccgcgcgcgccctgggcgcccccgcgctcggccgccgcgcaggggcgcagttccccctaccccagccccggcgccatgacgcggggagcgcagcgggggccaccggtggcggcggcggcgcagaggcggccaagtgcggggcgtgggcggcagcgcggggcgcacgtgcgccgggccgggggccggggccgggcggggggccgcttacctgttggaggtagaggaaggcgggcgggcagggcacggagtgcgggagcatgctgccggagttggacagcaggaggcagcccgagttcgccatggagcacagcatggggcggcaggggggcgcccggcggcggctctgcgctcgctgcgtccctcggagtgtgcgcgcgccctgcctcccgggcgccctcccggtctctctcctcctcctcctctgggcctcccctccccctcgtggcgctctttaagagggaggcatcgaaaggagagcggcgcgcctctgcccggtgttccccctgcccgggcggggaggctggagagagcgcgcgcgagaatacggccagagagtctgtgcgcgagagatcgggcgagcgggcgagagcaggagtcagtcactttggagcctccggagccctgtctgcaaagagtggtgcgtgtgcgtgtgtgagtgcgcgcgtgtgcgcgcgtgtgtagcggtgggagggggagtccctggcgtactccaacatcaaacggagccccgcgcggagggaagagaatccggagcgacggcacaacagctgatcccacacttaacccctcgcccgccggcaccggggcagccctccctcgcgccctcccacgctcgggcccctgcgcgcccctcctcccccccgttgccagcacttgctcctggcctggggggtctggaatctccctttgcccccgctccgttctccggccgctgcggagaggaggagccgctccgccggctctgcggccgaccgaccggaaggcgcctcgtcctgtttcgcgttcagagaagcgcctttcctaagggaggccggctcagtggcggggatgtcggtgatgtaatccgagggcatctacgcagaggcttccgcgctggggaaggctt

SEQ ID NO: 113958 - DNA, 211 bp, Homo sapiens; identical to SEQ ID NO: 81233
  chr17:77188723-77188934
  Hyper

SEQ ID NO: 113959 - DNA, 65 bp, Homo sapiens; identical to SEQ ID NO: 81234
  chr17:77200378-77200443
  Hypo

SEQ ID NO: 113960 - DNA, 179 bp, Homo sapiens; identical to SEQ ID NO: 81235
  chr17:77216294-77216473
  Hyper

SEQ ID NO: 113961 - DNA, 198 bp, Homo sapiens; identical to SEQ ID NO: 81236
  chr17:77240121-77240319
  Hypo

SEQ ID NO: 113962 - DNA, 143 bp, Homo sapiens; identical to SEQ ID NO: 81238
  chr17:77290782-77290925
  Hyper

SEQ ID NO: 113963 - DNA, 30 bp, Homo sapiens; identical to SEQ ID NO: 81239
  chr17:77306065-77306095
  Hypo

SEQ ID NO: 113964 - DNA, 40 bp, Homo sapiens; identical to SEQ ID NO: 81240
  chr17:77356491-77356531
  Hypo

SEQ ID NO: 113965 - DNA, 183 bp, Homo sapiens; identical to SEQ ID NO: 81241
  chr17:77365331-77365514
  Hypo

SEQ ID NO: 113966 - DNA, 45 bp, Homo sapiens; identical to SEQ ID NO: 81242
  chr17:77390958-77391003
  Hypo

SEQ ID NO: 113967 - DNA, 171 bp, Homo sapiens; identical to SEQ ID NO: 81243
  chr17:77772124-77772295
  Hyper

SEQ ID NO: 113968 - DNA, 364 bp, Homo sapiens; identical to SEQ ID NO: 81244
  chr17:77772527-77772891
  Hyper

SEQ ID NO: 113969 - DNA, 30 bp, Homo sapiens; identical to SEQ ID NO: 81245
  chr17:77773662-77773692
  Hyper

SEQ ID NO: 113970 - DNA, 52 bp, Homo sapiens; identical to SEQ ID NO: 81246
  chr17:77774368-77774420
  Hyper

SEQ ID NO: 113971 - DNA, 165 bp, Homo sapiens; identical to SEQ ID NO: 81247
  chr17:77774622-77774787
  Hyper

SEQ ID NO: 113972 - DNA, 39 bp, Homo sapiens; identical to SEQ ID NO: 81248
  chr17:77775268-77775307
  Hyper

SEQ ID NO: 113973 - DNA, 1492 bp, Homo sapiens
  chr17:77776539-77778031
  Hyper
cttgggcatctggaccggttgggccacgtgggctcgctgggaaaacgcgccggcgtcccctcggagcgccgaggccgggcgagctgagggtgcggtgccgctggagcacgcgcacagcgcccgaaccagcacgcatgcgcgccgcgggccggccccatttccgccccccccccacgcgcccccccatcacacgcacacccaatccccggactgctcgctggtgctgcttgtgagacccattcctaggagccccaggcgcccttggggagcagaaagaggcggtccagagttgggccggacaaccgcaacctggaaggagtccgggagtccttgggtctgggcgctcagttctcacggtctggggagaaggggctcagacgggacggactaggcacagccaggggcggggactgcgagaggcgaggggaggccggcagggtgtggcggcagagcagcccgggacaagtgagcggcctagagatcaaggccttggagtcccgtccgagagcaggacgttatcagaaacctccagccccaacccctgcctggagatgcccggggcgcgctgactctgttctcgcatcaccccgggccctggctcaacgcgtgagcagcctgtggttccagataccccgagtggagagtttgaccccagattctgcctgcactgacaggcttggcctggcggttacgagccacggttgatgagcgcccctcctcccgtgacccagctcatgagaaaggcggggagcaccaaccctcccacgggaaaacacggggagaggctgggcgagtcaaggaatggtggcaccagagcctgggcgcagagaggcagctggacctcctgggctcccttgagccggagctccgccagggtgggcacttctgcctccagcgatgctgggtgccacagtcctcccgcctcctcctggaccacacgcggctctccagagtcccagggaagctccagggactcctcggactccgcctggcgcttcccgttttttcatttcctaccccacccccatgcagaaggaattgaagtgacttttttgctgggacgtcgggacctcaagtcagttccaaagtgggagtctctcagccggtgccgttcccttgcgagattgttaacgccaagagccacagtccagcttccccttttagagatcagaaaatcctaagtgcagggcctgccgggtcattcgagaaggcacaagctgcggaggccagtctggggcctctcgcagaacctcggggaacagaggcgtctgccgggccgcctaccctccgcaagagtgggccacgcgggcggcaaacccgagggcagacgtttgggagctgaccgagaaaacgcgacggtgccggcgaggttctgggcgaagcctcggcgtcctccactgtggtcgacgcctttcctcgcagccccggtacagggcttcctcggtgcacccctagccgttgccccgggaggaggcgccgtctgggacacgaa

SEQ ID NO: 113974 - DNA, 624 bp, Homo sapiens; identical to SEQ ID NO: 81254
  chr17:77778434-77779058
  Hyper

SEQ ID NO: 113975 - DNA, 30 bp, Homo sapiens; identical to SEQ ID NO: 81255
  chr17:77786072-77786102
  Hyper

SEQ ID NO: 113976 - DNA, 338 bp, Homo sapiens; identical to SEQ ID NO: 81256
  chr17:77786467-77786805
  Hyper

SEQ ID NO: 113977 - DNA, 739 bp, Homo sapiens
  chr17:77788761-77789500
  Hyper
gtcgcctgctagggtcgggaaaggaccctccaccgccaccctcggggttcggtcctcccccaccaacgtctgccagtccgcgtggattccgagcccggctccggaaaccagtctgaccacttcgcccatttcccaagcctccccgggcggcggccggccagcttccatggtgcggtgagccaggctcggccgccgcctcggccgccctgcgatgaatggctctgcccagaaggccggcgtccaagcgacgctcccgcccgcgcgcccggggcctccaggccgctccccgccccgtgtccccacattgcgaaacggacggtcggatgctccgctccagggccggggtcgcctgtcccctgccgacctggcgcagagccgccttctgcacccggccccgtgccgccctggggttgcttacagccgggctgtgccaccgagctgagcccggaatcgaatggcgggccgcggaaaaggcggccaggcccgcaggggcgactgctcgaggtcccagaacagcgcccggggagccccaggccggcctcgaggggaccgcgggcgggacaggaggggaacagctggcatcggcgcccggcttcagctgcccgactgcggtgggcgggtaggcacgttcccccgcagccacccgcgcacgggtttccaaggcgtcaagggcaattcacctggtcgctgcaagaaagcgactgcgcccccacgtccagccagccgccttgtccatgag

SEQ ID NO: 113978 - DNA, 57 bp, Homo sapiens
  chr17:77789749-77789806
  Hyper
gcgactcctggtgcccggctgggacacgtggggccggctttgcggagtcagcagggc

SEQ ID NO: 113979 - DNA, 569 bp, Homo sapiens; identical to SEQ ID NO: 81258
  chr17:77807459-77808028
  Hypo

SEQ ID NO: 113980 - DNA, 375 bp, Homo sapiens; identical to SEQ ID NO: 81259
  chr17:77808375-77808750
  Hypo

SEQ ID NO: 113981 - DNA, 80 bp, Homo sapiens; identical to SEQ ID NO: 81260
  chr17:77809064-77809144
  Hypo

SEQ ID NO: 113982 - DNA, 385 bp, Homo sapiens
  chr17:77814048-77814433
  Hyper
aagctaggcgagaggcgtaggaggcagagagagcgggcgcgggaggccagggtccgcctgggggcctgaggggacttcgtggggtcccgggagtggcctagaaacagggagctgggagggccgggaagagcttgaggctgagcgggggacgaacgggcagcgcaaaggggagatgaacggaatggccgaggagccacgcattcgccttgtgtccgcggacccttgttcccgacaggcgaccaagccaaggccctccggactgacgcggcctgagcagcagcgagtgtgaagtttggcacctccggcggcgagacggcgcgttctggcgcgcggctcctgcgtccggctggtggagctgctgcgccctatgcggcctgccgagggc

SEQ ID NO: 113983 - DNA, 179 bp, Homo sapiens; identical to SEQ ID NO: 81262
  chr17:77814750-77814929
  Hyper

SEQ ID NO: 113984 - DNA, 785 bp, Homo sapiens; identical to SEQ ID NO: 81263
  chr17:77815150-77815935
  Hyper

SEQ ID NO: 113985 - DNA, 30 bp, Homo sapiens; identical to SEQ ID NO: 81264
  chr17:77818158-77818188
  Hyper

SEQ ID NO: 113986 - DNA, 534 bp, Homo sapiens; identical to SEQ ID NO: 81265
  chr17:77825231-77825765
  Hypo

SEQ ID NO: 113987 - DNA, 44 bp, Homo sapiens; identical to SEQ ID NO: 81266
  chr17:77827279-77827323
  Hypo

SEQ ID NO: 113988 - DNA, 23 bp, Homo sapiens
  chr17:77837400-77837423
  Hypo
gagacagagtcttgccgtatcgt

SEQ ID NO: 113989 - DNA, 30 bp, Homo sapiens; identical to SEQ ID NO: 81268
  chr17:77899529-77899559
  Hypo

SEQ ID NO: 113990 - DNA, 313 bp, Homo sapiens; identical to SEQ ID NO: 81269
  chr17:77904151-77904464
  Hyper

SEQ ID NO: 113991 - DNA, 106 bp, Homo sapiens; identical to SEQ ID NO: 81270
  chr17:77926452-77926558
  Hypo

SEQ ID NO: 113992 - DNA, 221 bp, Homo sapiens; identical to SEQ ID NO: 81271
  chr17:77948898-77949119
  Hypo

SEQ ID NO: 113993 - DNA, 181 bp, Homo sapiens; identical to SEQ ID NO: 81272
  chr17:78010865-78011046
  Hyper

SEQ ID NO: 113994 - DNA, 30 bp, Homo sapiens; identical to SEQ ID NO: 81273
  chr17:78041466-78041496
  Hypo

SEQ ID NO: 113995 - DNA, 159 bp, Homo sapiens; identical to SEQ ID NO: 36819
  chr17:78045491-78045650
  Hyper

SEQ ID NO: 113996 - DNA, 138 bp, Homo sapiens; identical to SEQ ID NO: 81275
  chr17:78059751-78059889
  Hypo

SEQ ID NO: 113997 - DNA, 71 bp, Homo sapiens; identical to SEQ ID NO: 81276
  chr17:78073436-78073507
  Hypo

SEQ ID NO: 113998 - DNA, 279 bp, Homo sapiens; identical to SEQ ID NO: 81277
  chr17:78078871-78079150
  Hypo

SEQ ID NO: 113999 - DNA, 71 bp, Homo sapiens; identical to SEQ ID NO: 81278
  chr17:78083747-78083818
  Hypo

SEQ ID NO: 114000 - DNA, 93 bp, Homo sapiens; identical to SEQ ID NO: 81279
  chr17:78112862-78112955
  Hypo

SEQ ID NO: 114001 - DNA, 30 bp, Homo sapiens; identical to SEQ ID NO: 81280
  chr17:78122014-78122044
  Hypo

SEQ ID NO: 114002 - DNA, 89 bp, Homo sapiens; identical to SEQ ID NO: 81281
  chr17:78122164-78122253
  Hypo

SEQ ID NO: 114003 - DNA, 81 bp, Homo sapiens; identical to SEQ ID NO: 81282
  chr17:78143912-78143993
  Hypo

SEQ ID NO: 114004 - DNA, 178 bp, Homo sapiens; identical to SEQ ID NO: 81283
  chr17:78151768-78151946
  Hypo

SEQ ID NO: 114005 - DNA, 58 bp, Homo sapiens; identical to SEQ ID NO: 81284
  chr17:78152480-78152538
  Hypo

SEQ ID NO: 114006 - DNA, 30 bp, Homo sapiens; identical to SEQ ID NO: 81285
  chr17:78439146-78439176
  Hypo

SEQ ID NO: 114007 - DNA, 63 bp, Homo sapiens; identical to SEQ ID NO: 81286
  chr17:78447061-78447124
  Hypo

SEQ ID NO: 114008 - DNA, 30 bp, Homo sapiens; identical to SEQ ID NO: 81287
  chr17:78447361-78447391
  Hypo

SEQ ID NO: 114009 - DNA, 1512 bp, Homo sapiens; identical to SEQ ID NO: 81288
  chr17:78449408-78450920
  Hyper

SEQ ID NO: 114010 - DNA, 1683 bp, Homo sapiens
  chr17:78451302-78452985
  Hyper
gggtgtccacctgtgcgtggggggctgtttcccgtctgtccagccgcgcccacttctcaggcccaaaggccagcaggaagggtcccggaggtggctgggggcgtccacctgagaagctccgctctcgctcagacaccccacccggcacccgcgcactcgcgccttcatctggaccgcggggctcggctcccgagatcgcggtccgggttccggcgccgggctgggggctcaggaccagggctggcgcagccgccccgccccgccccgccccggggctatcagagcggtcaaagcctcggaaatccctccgtccacgctcccgtggtacagagaaggaaactgaggctccgagactgcggggccgggctacagccgtggccccccgacccctccccgccgcccccggcttctctggtctctgcgttctgcagcctttccctgcgcgcagccgggggctgggggtccccagccagcagggacccacgggcagtcccgggtgccgggatcgggcgtccgcccctcgggcgggagcagaggccggctcgatggagacctttttgagaaatggcggcctctacccgccccccagcccccgagcgcccgccgtctgcgttcagcatctcagcttttaagcctccctgagccggggctgcgttctcgttgtctccttcggccgccgcttcctggcgccagagggaccccgcggcccgcacgggcctgtcctcggctccgctcggagggtgtgcgggttcccgctccgctggccccgcttgcccaccacggcgcgcccaaacccacgcggcccgcggccccttgcgtgctctgccgaccccgggccgcaggaggggttagcctcgccggtccccacgcggggtctgcgccggcagcgccacgggctggaacgcgcctcgggagaaattacccgcgcggggtcgcggcgtcttctgccccaactcccgtagggagccgctaggcgggtgccctcctggccccagcgctttggcctcgccgccctcccgcacgcgtccagtggggaggccgcgcccgtcaggcctggagccggaccgtgcccagccgagagcgcgcgggcgcgggagaggagccctgccctgcccagggcaggctgtttagacggggcgggaacccttagcctggccccgcgtctctatccccagcagccgtggagccttcctagccgcccaaggccagggaccctgcctggcttttcctccagggcagcagatctcagcggcctggcacctcggcacagaggagcgtgtcccccttccgcagaggaagggagtggacggcgtcagaaagggaggggagcctggggcggtgtctggggctagcgggacctctgggcactgtggggccccaggagaggagaccctcgggtccagcctgcaactgttgtgcaggaggcgctgggcgggacacctgcaggcgctgcacacacacgcgagggccaccatgccgcgtttctccttcacaagaccctgggcaagcggagggtcgtatttaggattccctcggcctccccagtgttctgaaagtatctgagagggagggagcaggaaaacgaagggccgccctgcccaaactcatcggggtgtctggttactaggtcggaagaggggggatggtgttgtgaacagccagtgatcccggccctgcctgagt

SEQ ID NO: 114011 - DNA, 79 bp, Homo sapiens; identical to SEQ ID NO: 81291
  chr17:78496397-78496476
  Hypo

SEQ ID NO: 114012 - DNA, 33 bp, Homo sapiens; identical to SEQ ID NO: 81292
  chr17:78517569-78517602
  Hypo

SEQ ID NO: 114013 - DNA, 145 bp, Homo sapiens; identical to SEQ ID NO: 81293
  chr17:78518203-78518348
  Hypo

SEQ ID NO: 114014 - DNA, 33 bp, Homo sapiens; identical to SEQ ID NO: 81294
  chr17:78539654-78539687
  Hypo

SEQ ID NO: 114015 - DNA, 153 bp, Homo sapiens; identical to SEQ ID NO: 81296
  chr17:78587674-78587827
  Hypo

SEQ ID NO: 114016 - DNA, 346 bp, Homo sapiens; identical to SEQ ID NO: 81297
  chr17:78599426-78599772
  Hypo

SEQ ID NO: 114017 - DNA, 370 bp, Homo sapiens; identical to SEQ ID NO: 81298
  chr17:78667873-78668243
  Hypo

SEQ ID NO: 114018 - DNA, 52 bp, Homo sapiens; identical to SEQ ID NO: 81299
  chr17:78772792-78772844
  Hypo

SEQ ID NO: 114019 - DNA, 49 bp, Homo sapiens; identical to SEQ ID NO: 81300
  chr17:78773568-78773617
  Hypo

SEQ ID NO: 114020 - DNA, 30 bp, Homo sapiens; identical to SEQ ID NO: 81301
  chr17:78792696-78792726
  Hypo

SEQ ID NO: 114021 - DNA, 30 bp, Homo sapiens; identical to SEQ ID NO: 81302
  chr17:78794230-78794260
  Hypo

SEQ ID NO: 114022 - DNA, 65 bp, Homo sapiens; identical to SEQ ID NO: 81303
  chr17:78820077-78820142
  Hypo

SEQ ID NO: 114023 - DNA, 42 bp, Homo sapiens; identical to SEQ ID NO: 81304
  chr17:78861192-78861234
  Hypo

SEQ ID NO: 114024 - DNA, 65 bp, Homo sapiens; identical to SEQ ID NO: 81305
  chr17:78867045-78867110
  Hypo

SEQ ID NO: 114025 - DNA, 30 bp, Homo sapiens; identical to SEQ ID NO: 81306
  chr17:78869491-78869521
  Hypo

SEQ ID NO: 114026 - DNA, 96 bp, Homo sapiens; identical to SEQ ID NO: 81307
  chr17:78872638-78872734
  Hypo

SEQ ID NO: 114027 - DNA, 158 bp, Homo sapiens; identical to SEQ ID NO: 81308
  chr17:78874417-78874575
  Hypo

SEQ ID NO: 114028 - DNA, 83 bp, Homo sapiens; identical to SEQ ID NO: 81309
  chr17:78897683-78897766
  Hypo

SEQ ID NO: 114029 - DNA, 39 bp, Homo sapiens; identical to SEQ ID NO: 81310
  chr17:78946490-78946529
  Hypo

SEQ ID NO: 114030 - DNA, 30 bp, Homo sapiens; identical to SEQ ID NO: 81311
  chr17:78957836-78957866
  Hypo

SEQ ID NO: 114031 - DNA, 43 bp, Homo sapiens; identical to SEQ ID NO: 81312
  chr17:78968896-78968939
  Hypo

SEQ ID NO: 114032 - DNA, 77 bp, Homo sapiens; identical to SEQ ID NO: 81313
  chr17:78975561-78975638
  Hypo

SEQ ID NO: 114033 - DNA, 16 bp, Homo sapiens
  chr17:78975938-78975954
  Hypo
gcgggtccatcctgga

SEQ ID NO: 114034 - DNA, 226 bp, Homo sapiens
  chr17:78977598-78977824
  Hyper
gctgggtaatactcccggtgccgcccttgctgttcgtcgatgcacatctggctgcttttcgctggctgcgagcggagctgctagggacatggccacggggctgtgagagcggagtttcctctctccggtgaccctgagctgcgcctttctcagccgcctcccgaggccccaggcgctctgcgggggctctggcggggttggtgggggtgggcgttctcgttgtttc

SEQ ID NO: 114035 - DNA, 392 bp, Homo sapiens; identical to SEQ ID NO: 81317
  chr17:78978124-78978516
  Hyper

SEQ ID NO: 114036 - DNA, 30 bp, Homo sapiens; identical to SEQ ID NO: 45252
  chr17:79001034-79001064
  Hypo

SEQ ID NO: 114037 - DNA, 30 bp, Homo sapiens; identical to SEQ ID NO: 81319
  chr17:79001300-79001330
  Hypo

SEQ ID NO: 114038 - DNA, 52 bp, Homo sapiens; identical to SEQ ID NO: 81320
  chr17:79001565-79001617
  Hypo

SEQ ID NO: 114039 - DNA, 96 bp, Homo sapiens; identical to SEQ ID NO: 81321
  chr17:79009595-79009691
  Hyper

SEQ ID NO: 114040 - DNA, 74 bp, Homo sapiens; identical to SEQ ID NO: 81322
  chr17:79035028-79035102
  Hypo

SEQ ID NO: 114041 - DNA, 30 bp, Homo sapiens; identical to SEQ ID NO: 81323
  chr17:79048658-79048688
  Hypo

SEQ ID NO: 114042 - DNA, 142 bp, Homo sapiens; identical to SEQ ID NO: 81325
  chr17:79066660-79066802
  Hypo

SEQ ID NO: 114043 - DNA, 525 bp, Homo sapiens; identical to SEQ ID NO: 81326
  chr17:79093956-79094481
  Hypo

SEQ ID NO: 114044 - DNA, 46 bp, Homo sapiens; identical to SEQ ID NO: 45255
  chr17:79094742-79094788
  Hypo

SEQ ID NO: 114045 - DNA, 317 bp, Homo sapiens; identical to SEQ ID NO: 81328
  chr17:79096940-79097257
  Hypo

SEQ ID NO: 114046 - DNA, 48 bp, Homo sapiens; identical to SEQ ID NO: 45257
  chr17:79098155-79098203
  Hypo

SEQ ID NO: 114047 - DNA, 139 bp, Homo sapiens
  chr17:79098539-79098678
  Hypo
tcttggtctggtccacgacgagcaggttgctatgcacctcgtccaccagctctggcgcgatccagcgcagaggcacccacagctggtcggcagtcacgaagtagtcctcctgttggcacagggacgggtcacccctgcc

SEQ ID NO: 114048 - DNA, 188 bp, Homo sapiens; identical to SEQ ID NO: 81330
  chr17:79099741-79099929
  Hypo

SEQ ID NO: 114049 - DNA, 75 bp, Homo sapiens; identical to SEQ ID NO: 45259
  chr17:79100184-79100259
  Hypo

SEQ ID NO: 114050 - DNA, 352 bp, Homo sapiens; identical to SEQ ID NO: 81332
  chr17:79104807-79105159
  Hypo

SEQ ID NO: 114051 - DNA, 30 bp, Homo sapiens; identical to SEQ ID NO: 16265
  chr17:79107633-79107663
  Hypo

SEQ ID NO: 114052 - DNA, 84 bp, Homo sapiens; identical to SEQ ID NO: 81334
  chr17:79127888-79127972
  Hypo

SEQ ID NO: 114053 - DNA, 30 bp, Homo sapiens; identical to SEQ ID NO: 81335
  chr17:79130785-79130815
  Hypo

SEQ ID NO: 114054 - DNA, 141 bp, Homo sapiens; identical to SEQ ID NO: 81336
  chr17:79131533-79131674
  Hypo

SEQ ID NO: 114055 - DNA, 30 bp, Homo sapiens; identical to SEQ ID NO: 81337
  chr17:79133024-79133054
  Hypo

SEQ ID NO: 114056 - DNA, 256 bp, Homo sapiens; identical to SEQ ID NO: 81338
  chr17:79139708-79139964
  Hyper

SEQ ID NO: 114057 - DNA, 105 bp, Homo sapiens; identical to SEQ ID NO: 81339
  chr17:79155470-79155575
  Hypo

SEQ ID NO: 114058 - DNA, 168 bp, Homo sapiens; identical to SEQ ID NO: 81340
  chr17:79158112-79158280
  Hypo

SEQ ID NO: 114059 - DNA, 256 bp, Homo sapiens; identical to SEQ ID NO: 81341
  chr17:79166315-79166571
  Hypo

SEQ ID NO: 114060 - DNA, 30 bp, Homo sapiens; identical to SEQ ID NO: 81342
  chr17:79178454-79178484
  Hypo

SEQ ID NO: 114061 - DNA, 40 bp, Homo sapiens; identical to SEQ ID NO: 81344
  chr17:79197382-79197422
  Hyper

SEQ ID NO: 114062 - DNA, 212 bp, Homo sapiens; identical to SEQ ID NO: 81345
  chr17:79205207-79205419
  Hypo

SEQ ID NO: 114063 - DNA, 125 bp, Homo sapiens; identical to SEQ ID NO: 45263
  chr17:79211706-79211831
  Hypo

SEQ ID NO: 114064 - DNA, 30 bp, Homo sapiens; identical to SEQ ID NO: 81347
  chr17:79220179-79220209
  Hypo

SEQ ID NO: 114065 - DNA, 30 bp, Homo sapiens; identical to SEQ ID NO: 81348
  chr17:79220690-79220720
  Hypo

SEQ ID NO: 114066 - DNA, 30 bp, Homo sapiens; identical to SEQ ID NO: 45264
  chr17:79226304-79226334
  Hypo

SEQ ID NO: 114067 - DNA, 39 bp, Homo sapiens; identical to SEQ ID NO: 81350
  chr17:79257246-79257285
  Hypo

SEQ ID NO: 114068 - DNA, 18 bp, Homo sapiens
  chr17:79292579-79292597
  Hypo
ggccgggcatggtggcgg

SEQ ID NO: 114069 - DNA, 77 bp, Homo sapiens; identical to SEQ ID NO: 81352
  chr17:79292717-79292794
  Hypo

SEQ ID NO: 114070 - DNA, 38 bp, Homo sapiens; identical to SEQ ID NO: 81353
  chr17:79309612-79309650
  Hypo

SEQ ID NO: 114071 - DNA, 390 bp, Homo sapiens; identical to SEQ ID NO: 81354
  chr17:79316623-79317013
  Hyper

SEQ ID NO: 114072 - DNA, 94 bp, Homo sapiens; identical to SEQ ID NO: 81355
  chr17:79317370-79317464
  Hyper

SEQ ID NO: 114073 - DNA, 57 bp, Homo sapiens; identical to SEQ ID NO: 36829
  chr17:79317833-79317890
  Hyper

SEQ ID NO: 114074 - DNA, 36 bp, Homo sapiens; identical to SEQ ID NO: 81357
  chr17:79318173-79318209
  Hyper

SEQ ID NO: 114075 - DNA, 41 bp, Homo sapiens; identical to SEQ ID NO: 81358
  chr17:79505417-79505458
  Hypo

SEQ ID NO: 114076 - DNA, 221 bp, Homo sapiens; identical to SEQ ID NO: 81359
  chr17:79544089-79544310
  Hypo

SEQ ID NO: 114077 - DNA, 161 bp, Homo sapiens; identical to SEQ ID NO: 81360
  chr17:79609256-79609417
  Hypo

SEQ ID NO: 114078 - DNA, 48 bp, Homo sapiens; identical to SEQ ID NO: 81361
  chr17:79612764-79612812
  Hypo

SEQ ID NO: 114079 - DNA, 360 bp, Homo sapiens
  chr17:79615102-79615462
  Hyper
ctccggcggtggctgcgcgcgaacctggctgcctcgggcggctacgcaatcgcggtggtgctgctgcagggcgcggagctcctgctggccgcccggctactcggggccctcgctgcccgcaggggggcggcgtacggccccggagcgcgcggggaggaccgcgctggcccccagagccccagccccggcgccccgcccgctgccaagcccgcccggggctgagcgcacgccccgaggtccgagaccgccacgcacagggatacagggggcgcctccgcccggctaaaaagcgcggcctgcgccgccgccgccgcctgatttcgctcgggcttcgggtgacttcgccgcaggacctaccca

SEQ ID NO: 114080 - DNA, 256 bp, Homo sapiens; identical to SEQ ID NO: 81364
  chr17:79619054-79619310
  Hypo

SEQ ID NO: 114081 - DNA, 104 bp, Homo sapiens; identical to SEQ ID NO: 81365
  chr17:79626311-79626415
  Hypo

SEQ ID NO: 114082 - DNA, 104 bp, Homo sapiens; identical to SEQ ID NO: 81366
  chr17:79626655-79626759
  Hypo

SEQ ID NO: 114083 - DNA, 82 bp, Homo sapiens; identical to SEQ ID NO: 81367
  chr17:79634674-79634756
  Hypo

SEQ ID NO: 114084 - DNA, 30 bp, Homo sapiens; identical to SEQ ID NO: 81368
  chr17:79635057-79635087
  Hypo

SEQ ID NO: 114085 - DNA, 30 bp, Homo sapiens; identical to SEQ ID NO: 45271
  chr17:79643888-79643918
  Hypo

SEQ ID NO: 114086 - DNA, 37 bp, Homo sapiens; identical to SEQ ID NO: 81370
  chr17:79663023-79663060
  Hypo

SEQ ID NO: 114087 - DNA, 87 bp, Homo sapiens; identical to SEQ ID NO: 81371
  chr17:79668241-79668328
  Hypo

SEQ ID NO: 114088 - DNA, 145 bp, Homo sapiens; identical to SEQ ID NO: 45272
  chr17:79668589-79668734
  Hypo

SEQ ID NO: 114089 - DNA, 226 bp, Homo sapiens; identical to SEQ ID NO: 81373
  chr17:79677781-79678007
  Hyper

SEQ ID NO: 114090 - DNA, 30 bp, Homo sapiens; identical to SEQ ID NO: 81374
  chr17:79691709-79691739
  Hypo

SEQ ID NO: 114091 - DNA, 36 bp, Homo sapiens; identical to SEQ ID NO: 81375
  chr17:79695465-79695501
  Hypo

SEQ ID NO: 114092 - DNA, 1087 bp, Homo sapiens
  chr17:79761585-79762672
  Hyper
aagggggcgagggggcgcccagggaggcggagggagcgagaggaaggggggctgagccacggcccccacgcccgcgcgcccctccgcgtcccagggcgtcccctcccggagctgggacccaccgcgaccaccacctgctgggccagggtccgcgggctcaggggtctgcaggattagggtctgcggaaccaggacccgtgggacaaaggtctgtggggcgcgggtccgcggggtggaattcagcgcgccgagtctgcgtatggccggggtacgaggcgctccctgcgcagggtgggcaggaccgaagctcgccgggaggctgcgcggagggcgggcggggaccctcggctgccgctcccacccccgcggggccgcccccgagcccgccctccgccgccgccctcgccctgcgtcgccgccggaaagtttgcaccgaccccgatctggcagcgccgcgaagacgagcggtcaccggcgcccgacccgagcgcgcccagaggacggcggggagccaagccgacccccgagcagcgccgcgcggtgagcacctgggccgcggccccgaggggacgttggggagtcgacccggtggggacagagaccgcggggcgggcgcggcggggccgggggcgcggggagcggggagccggccgggcggtctccggggtccgggctggtgcgctcctcagtcccgtcagacacccccgttcccaaccccggctcggacaccacccggtcctgcaccgtcgggcaggtccaggggtctcagcccctcccccgttctctggtcctggggggcgcggctgggggcgggggtgtcgctggccgcctggcgccctgcggcggccacactgcagcggccacactccccactcagggccccgggccccgccgccctggggagcgcacaaagcgccgcggacgcgtccccgaggcgcggggtctcaccagcgctgtctcccctcggtgggctcctgccccgaggactgcccggtggcaccggcgcggcccaggatggggtgaggggtgtctgcgccccgcctggccgctcctcttccgcggcccacactggcgactttgaccccgg

SEQ ID NO: 114093 - DNA, 455 bp, Homo sapiens; identical to SEQ ID NO: 81379
  chr17:79769238-79769693
  Hypo

SEQ ID NO: 114094 - DNA, 95 bp, Homo sapiens; identical to SEQ ID NO: 81380
  chr17:79774960-79775055
  Hypo

SEQ ID NO: 114095 - DNA, 52 bp, Homo sapiens; identical to SEQ ID NO: 81382
  chr17:79826977-79827029
  Hypo

SEQ ID NO: 114096 - DNA, 34 bp, Homo sapiens; identical to SEQ ID NO: 81383
  chr17:79847763-79847797
  Hypo

SEQ ID NO: 114097 - DNA, 30 bp, Homo sapiens
  chr17:79856558-79856588
  Hypo
acaatgagtccatcccgcatcccaggggac

SEQ ID NO: 114098 - DNA, 751 bp, Homo sapiens; identical to SEQ ID NO: 81384
  chr17:79859940-79860691
  Hyper

SEQ ID NO: 114099 - DNA, 147 bp, Homo sapiens; identical to SEQ ID NO: 81385
  chr17:79870402-79870549
  Hypo

SEQ ID NO: 114100 - DNA, 391 bp, Homo sapiens; identical to SEQ ID NO: 81386
  chr17:79874636-79875027
  Hypo

SEQ ID NO: 114101 - DNA, 58 bp, Homo sapiens; identical to SEQ ID NO: 81387
  chr17:79886467-79886525
  Hyper

SEQ ID NO: 114102 - DNA, 30 bp, Homo sapiens; identical to SEQ ID NO: 81388
  chr17:79887265-79887295
  Hypo

SEQ ID NO: 114103 - DNA, 259 bp, Homo sapiens; identical to SEQ ID NO: 81389
  chr17:79887590-79887849
  Hypo

SEQ ID NO: 114104 - DNA, 77 bp, Homo sapiens; identical to SEQ ID NO: 81390
  chr17:79892813-79892890
  Hypo

SEQ ID NO: 114105 - DNA, 97 bp, Homo sapiens; identical to SEQ ID NO: 81391
  chr17:79899293-79899390
  Hypo

SEQ ID NO: 114106 - DNA, 23 bp, Homo sapiens
  chr17:79913143-79913166
  Hypo
actgcgcccggcctacaagacct

SEQ ID NO: 114107 - DNA, 30 bp, Homo sapiens; identical to SEQ ID NO: 81393
  chr17:79913444-79913474
  Hypo

SEQ ID NO: 114108 - DNA, 197 bp, Homo sapiens; identical to SEQ ID NO: 81394
  chr17:79914766-79914963
  Hypo

SEQ ID NO: 114109 - DNA, 66 bp, Homo sapiens; identical to SEQ ID NO: 81395
  chr17:79917369-79917435
  Hyper

SEQ ID NO: 114110 - DNA, 140 bp, Homo sapiens; identical to SEQ ID NO: 81396
  chr17:79918501-79918641
  Hyper

SEQ ID NO: 114111 - DNA, 30 bp, Homo sapiens; identical to SEQ ID NO: 81397
  chr17:79926633-79926663
  Hypo

SEQ ID NO: 114112 - DNA, 87 bp, Homo sapiens; identical to SEQ ID NO: 81398
  chr17:79950224-79950311
  Hypo

SEQ ID NO: 114113 - DNA, 30 bp, Homo sapiens; identical to SEQ ID NO: 81399
  chr17:79952351-79952381
  Hypo

SEQ ID NO: 114114 - DNA, 76 bp, Homo sapiens; identical to SEQ ID NO: 81401
  chr17:79973168-79973244
  Hypo

SEQ ID NO: 114115 - DNA, 30 bp, Homo sapiens; identical to SEQ ID NO: 81402
  chr17:79977416-79977446
  Hypo

SEQ ID NO: 114116 - DNA, 30 bp, Homo sapiens; identical to SEQ ID NO: 81403
  chr17:79982080-79982110
  Hypo

SEQ ID NO: 114117 - DNA, 54 bp, Homo sapiens; identical to SEQ ID NO: 81404
  chr17:79987004-79987058
  Hypo

SEQ ID NO: 114118 - DNA, 622 bp, Homo sapiens; identical to SEQ ID NO: 81405
  chr17:79988475-79989097
  Hyper

SEQ ID NO: 114119 - DNA, 30 bp, Homo sapiens; identical to SEQ ID NO: 45281
  chr17:80163670-80163700
  Hypo

SEQ ID NO: 114120 - DNA, 63 bp, Homo sapiens; identical to SEQ ID NO: 81407
  chr17:80186555-80186618
  Hyper

SEQ ID NO: 114121 - DNA, 231 bp, Homo sapiens; identical to SEQ ID NO: 81408
  chr17:80188720-80188951
  Hyper

SEQ ID NO: 114122 - DNA, 30 bp, Homo sapiens; identical to SEQ ID NO: 81409
  chr17:80192672-80192702
  Hypo

SEQ ID NO: 114123 - DNA, 30 bp, Homo sapiens; identical to SEQ ID NO: 81410
  chr17:80193470-80193500
  Hypo

SEQ ID NO: 114124 - DNA, 157 bp, Homo sapiens; identical to SEQ ID NO: 81411
  chr17:80194730-80194887
  Hypo

SEQ ID NO: 114125 - DNA, 30 bp, Homo sapiens; identical to SEQ ID NO: 45282
  chr17:80201941-80201971
  Hypo

SEQ ID NO: 114126 - DNA, 30 bp, Homo sapiens; identical to SEQ ID NO: 81414
  chr17:80222132-80222162
  Hypo

SEQ ID NO: 114127 - DNA, 90 bp, Homo sapiens; identical to SEQ ID NO: 81415
  chr17:80229870-80229960
  Hypo

SEQ ID NO: 114128 - DNA, 29 bp, Homo sapiens
  chr17:80230200-80230229
  Hypo
caagagcgaaactccgtctcaggaaaaaa

SEQ ID NO: 114129 - DNA, 252 bp, Homo sapiens; identical to SEQ ID NO: 81417
  chr17:80240815-80241067
  Hypo

SEQ ID NO: 114130 - DNA, 46 bp, Homo sapiens; identical to SEQ ID NO: 81418
  chr17:80246775-80246821
  Hypo

SEQ ID NO: 114131 - DNA, 99 bp, Homo sapiens; identical to SEQ ID NO: 81419
  chr17:80251905-80252004
  Hypo

SEQ ID NO: 114132 - DNA, 259 bp, Homo sapiens; identical to SEQ ID NO: 81420
  chr17:80254257-80254516
  Hypo

SEQ ID NO: 114133 - DNA, 30 bp, Homo sapiens; identical to SEQ ID NO: 81421
  chr17:80268179-80268209
  Hypo

SEQ ID NO: 114134 - DNA, 30 bp, Homo sapiens; identical to SEQ ID NO: 81422
  chr17:80272271-80272301
  Hypo

SEQ ID NO: 114135 - DNA, 63 bp, Homo sapiens; identical to SEQ ID NO: 81423
  chr17:80274115-80274178
  Hyper

SEQ ID NO: 114136 - DNA, 35 bp, Homo sapiens; identical to SEQ ID NO: 81424
  chr17:80277765-80277800
  Hypo

SEQ ID NO: 114137 - DNA, 80 bp, Homo sapiens; identical to SEQ ID NO: 81426
  chr17:80281051-80281131
  Hypo

SEQ ID NO: 114138 - DNA, 156 bp, Homo sapiens; identical to SEQ ID NO: 81427
  chr17:80287972-80288128
  Hypo

SEQ ID NO: 114139 - DNA, 497 bp, Homo sapiens; identical to SEQ ID NO: 81428
  chr17:80289234-80289731
  Hypo

SEQ ID NO: 114140 - DNA, 76 bp, Homo sapiens; identical to SEQ ID NO: 81429
  chr17:80290031-80290107
  Hypo

SEQ ID NO: 114141 - DNA, 43 bp, Homo sapiens; identical to SEQ ID NO: 81430
  chr17:80291659-80291702
  Hyper

SEQ ID NO: 114142 - DNA, 30 bp, Homo sapiens; identical to SEQ ID NO: 81431
  chr17:80294443-80294473
  Hypo

SEQ ID NO: 114143 - DNA, 135 bp, Homo sapiens; identical to SEQ ID NO: 45289
  chr17:80300182-80300317
  Hypo

SEQ ID NO: 114144 - DNA, 970 bp, Homo sapiens
  chr17:80329251-80330221
  Hyper
tttctatgaccctctcggggtttaggggtgttcctgccccccacctgcgcgcgggcgggtccagggcttggtggacacggagaatcccaggctccgtgccctgcaaacacgggcgtgaggggcgcaggggtgaacgctggaggcggagaacccaagaggggctgcggggtcagccttggggcagccgggctggaggcagcttcgctccgcagacgcagacgcgagacccgcctgggaccctccgccgaccccgctgcggccccgcgacccccgcgtcttcccggcgccgcgcggtcagcgccgccccctagacacccggcgccgtcccctccgcgcgcctgctgcccgctggggttattttaataccgggccctggcgcggggcgcggcgcattcccagctggcggcgggcaggtggcggcggcgcagagacccggcgcggggcggggggcgcggctttggtggcgggactggcgggcgcccctgccgtgtgctctggaagccgaggccaccgcggagcccctcgcgccccctctgcgctgggacaggggagcgcgcctcggaaagttccccgcggccccgctgcgcgaggagtttggagccgcgagcggctgcccccacgcgcgaccccaggctcggcgggcaggtctggccgctcagtgaccggaggcaggtgggtcctcggtgggtgaccgggagcgcgcggggactgccgggtctgtgcccttcggggccctccgcagggctgggccggggtttcgcggtgggaacccaccctgggcgaggggagcggggtccagcgaggcggcttctcccgtgccgtggaactttcggcccctccccttcccccctagcgaccctggagcaatcctagcggcccggcggccgctgtccccctgcccgtgactcgggctcgcgcacaactggggagcccggtgcaccctcggcttctgcgccgtcccctgggtgag

SEQ ID NO: 114145 - DNA, 43 bp, Homo sapiens; identical to SEQ ID NO: 81435
  chr17:80332249-80332292
  Hypo

SEQ ID NO: 114146 - DNA, 233 bp, Homo sapiens
  chr17:80333050-80333283
  Hyper
accaggccccgctggcgccgcggacggcgcgcatcgtcaactacctgaccacctgcctcacctacggcaacagctgcgccaaccccttcctctacacgctgctcaccaggaactaccgcgaccacctgcgcggccgcgtgcggggcccgggcagcgggggaggccgggggcccgttccctccctgcagccccgcgcccgcttccagcgctgttcgggccgctccctgtcttcc

SEQ ID NO: 114147 - DNA, 30 bp, Homo sapiens; identical to SEQ ID NO: 81437
  chr17:80336816-80336846
  Hypo

SEQ ID NO: 114148 - DNA, 151 bp, Homo sapiens; identical to SEQ ID NO: 45290
  chr17:80338743-80338894
  Hypo

SEQ ID NO: 114149 - DNA, 30 bp, Homo sapiens; identical to SEQ ID NO: 81439
  chr17:80344822-80344852
  Hypo

SEQ ID NO: 114150 - DNA, 49 bp, Homo sapiens; identical to SEQ ID NO: 81440
  chr17:80394753-80394802
  Hypo

SEQ ID NO: 114151 - DNA, 46 bp, Homo sapiens; identical to SEQ ID NO: 81441
  chr17:80395100-80395146
  Hypo

SEQ ID NO: 114152 - DNA, 216 bp, Homo sapiens; identical to SEQ ID NO: 81442
  chr17:80447977-80448193
  Hypo

SEQ ID NO: 114153 - DNA, 53 bp, Homo sapiens; identical to SEQ ID NO: 81443
  chr17:80448677-80448730
  Hypo

SEQ ID NO: 114154 - DNA, 30 bp, Homo sapiens; identical to SEQ ID NO: 81444
  chr17:80453489-80453519
  Hypo

SEQ ID NO: 114155 - DNA, 30 bp, Homo sapiens; identical to SEQ ID NO: 81445
  chr17:80453917-80453947
  Hypo

SEQ ID NO: 114156 - DNA, 56 bp, Homo sapiens; identical to SEQ ID NO: 81446
  chr17:80455848-80455904
  Hyper

SEQ ID NO: 114157 - DNA, 180 bp, Homo sapiens; identical to SEQ ID NO: 81447
  chr17:80479365-80479545
  Hypo

SEQ ID NO: 114158 - DNA, 32 bp, Homo sapiens; identical to SEQ ID NO: 81448
  chr17:80485937-80485969
  Hypo

SEQ ID NO: 114159 - DNA, 30 bp, Homo sapiens; identical to SEQ ID NO: 81449
  chr17:80517466-80517496
  Hypo

SEQ ID NO: 114160 - DNA, 84 bp, Homo sapiens; identical to SEQ ID NO: 81450
  chr17:80518273-80518357
  Hypo

SEQ ID NO: 114161 - DNA, 30 bp, Homo sapiens; identical to SEQ ID NO: 81451
  chr17:80526057-80526087
  Hypo

SEQ ID NO: 114162 - DNA, 64 bp, Homo sapiens; identical to SEQ ID NO: 81452
  chr17:80535317-80535381
  Hypo

SEQ ID NO: 114163 - DNA, 75 bp, Homo sapiens; identical to SEQ ID NO: 81454
  chr17:80572274-80572349
  Hypo

SEQ ID NO: 114164 - DNA, 95 bp, Homo sapiens; identical to SEQ ID NO: 81455
  chr17:80603615-80603710
  Hypo

SEQ ID NO: 114165 - DNA, 444 bp, Homo sapiens; identical to SEQ ID NO: 81456
  chr17:80654726-80655170
  Hypo

SEQ ID NO: 114166 - DNA, 222 bp, Homo sapiens; identical to SEQ ID NO: 81457
  chr17:80655505-80655727
  Hyper

SEQ ID NO: 114167 - DNA, 47 bp, Homo sapiens; identical to SEQ ID NO: 81458
  chr17:80657047-80657094
  Hyper

SEQ ID NO: 114168 - DNA, 21 bp, Homo sapiens
  chr17:80659786-80659807
  Hypo
agactccgtctcaaaaaaaaa

SEQ ID NO: 114169 - DNA, 30 bp, Homo sapiens; identical to SEQ ID NO: 81460
  chr17:80661495-80661525
  Hypo

SEQ ID NO: 114170 - DNA, 30 bp, Homo sapiens; identical to SEQ ID NO: 81461
  chr17:80673406-80673436
  Hypo

SEQ ID NO: 114171 - DNA, 20 bp, Homo sapiens
  chr17:80692466-80692486
  Hypo
aacctcatgcatggccgggc

SEQ ID NO: 114172 - DNA, 80 bp, Homo sapiens; identical to SEQ ID NO: 81463
  chr17:80692846-80692926
  Hypo

SEQ ID NO: 114173 - DNA, 76 bp, Homo sapiens; identical to SEQ ID NO: 81464
  chr17:80693424-80693500
  Hyper

SEQ ID NO: 114174 - DNA, 35 bp, Homo sapiens; identical to SEQ ID NO: 81465
  chr17:80712937-80712972
  Hypo

SEQ ID NO: 114175 - DNA, 44 bp, Homo sapiens; identical to SEQ ID NO: 81466
  chr17:80744257-80744301
  Hypo

SEQ ID NO: 114176 - DNA, 232 bp, Homo sapiens; identical to SEQ ID NO: 81467
  chr17:80747022-80747254
  Hypo

SEQ ID NO: 114177 - DNA, 74 bp, Homo sapiens; identical to SEQ ID NO: 81468
  chr17:80747816-80747890
  Hypo

SEQ ID NO: 114178 - DNA, 69 bp, Homo sapiens; identical to SEQ ID NO: 81470
  chr17:80772872-80772941
  Hypo

SEQ ID NO: 114179 - DNA, 1155 bp, Homo sapiens; identical to SEQ ID NO: 81471
  chr17:80797664-80798819
  Hypo

SEQ ID NO: 114180 - DNA, 30 bp, Homo sapiens; identical to SEQ ID NO: 81472
  chr17:80820683-80820713
  Hypo

SEQ ID NO: 114181 - DNA, 593 bp, Homo sapiens; identical to SEQ ID NO: 81473
  chr17:80832203-80832796
  Hypo

SEQ ID NO: 114182 - DNA, 36 bp, Homo sapiens; identical to SEQ ID NO: 81474
  chr17:80847858-80847894
  Hypo

SEQ ID NO: 114183 - DNA, 38 bp, Homo sapiens; identical to SEQ ID NO: 81475
  chr17:80859827-80859865
  Hypo

SEQ ID NO: 114184 - DNA, 30 bp, Homo sapiens; identical to SEQ ID NO: 81476
  chr17:80879262-80879292
  Hypo

SEQ ID NO: 114185 - DNA, 41 bp, Homo sapiens; identical to SEQ ID NO: 81477
  chr17:80879980-80880021
  Hypo

SEQ ID NO: 114186 - DNA, 95 bp, Homo sapiens; identical to SEQ ID NO: 81478
  chr17:80882906-80883001
  Hypo

SEQ ID NO: 114187 - DNA, 131 bp, Homo sapiens; identical to SEQ ID NO: 81479
  chr17:80965822-80965953
  Hypo

SEQ ID NO: 114188 - DNA, 35 bp, Homo sapiens; identical to SEQ ID NO: 81480
  chr17:80970418-80970453
  Hypo

SEQ ID NO: 114189 - DNA, 57 bp, Homo sapiens; identical to SEQ ID NO: 81481
  chr17:80972313-80972370
  Hypo

SEQ ID NO: 114190 - DNA, 315 bp, Homo sapiens; identical to SEQ ID NO: 81482
  chr17:81008590-81008905
  Hypo

SEQ ID NO: 114191 - DNA, 30 bp, Homo sapiens; identical to SEQ ID NO: 81483
  chr17:81014892-81014922
  Hypo

SEQ ID NO: 114192 - DNA, 166 bp, Homo sapiens; identical to SEQ ID NO: 45303
  chr17:81015300-81015466
  Hypo

SEQ ID NO: 114193 - DNA, 79 bp, Homo sapiens; identical to SEQ ID NO: 81485
  chr17:81015900-81015979
  Hypo

SEQ ID NO: 114194 - DNA, 36 bp, Homo sapiens; identical to SEQ ID NO: 81486
  chr17:81021220-81021256
  Hypo

SEQ ID NO: 114195 - DNA, 125 bp, Homo sapiens; identical to SEQ ID NO: 81487
  chr17:81024242-81024367
  Hypo

SEQ ID NO: 114196 - DNA, 30 bp, Homo sapiens; identical to SEQ ID NO: 81488
  chr17:81032806-81032836
  Hypo

SEQ ID NO: 114197 - DNA, 30 bp, Homo sapiens; identical to SEQ ID NO: 45307
  chr17:81033487-81033517
  Hypo

SEQ ID NO: 114198 - DNA, 30 bp, Homo sapiens; identical to SEQ ID NO: 81490
  chr17:81034580-81034610
  Hypo

SEQ ID NO: 114199 - DNA, 37 bp, Homo sapiens; identical to SEQ ID NO: 81491
  chr17:81040640-81040677
  Hypo

SEQ ID NO: 114200 - DNA, 167 bp, Homo sapiens; identical to SEQ ID NO: 81493
  chr17:81043026-81043193
  Hypo

SEQ ID NO: 114201 - DNA, 59 bp, Homo sapiens; identical to SEQ ID NO: 81495
  chr17:81047898-81047957
  Hypo

SEQ ID NO: 114202 - DNA, 30 bp, Homo sapiens; identical to SEQ ID NO: 81496
  chr17:81048443-81048473
  Hypo

SEQ ID NO: 114203 - DNA, 251 bp, Homo sapiens; identical to SEQ ID NO: 81497
  chr17:81048783-81049034
  Hypo

SEQ ID NO: 114204 - DNA, 317 bp, Homo sapiens; identical to SEQ ID NO: 81499
  chr17:81050023-81050340
  Hypo

SEQ ID NO: 114205 - DNA, 63 bp, Homo sapiens; identical to SEQ ID NO: 81500
  chr17:81050653-81050716
  Hypo

SEQ ID NO: 114206 - DNA, 78 bp, Homo sapiens; identical to SEQ ID NO: 81501
  chr17:81050921-81050999
  Hypo

SEQ ID NO: 114207 - DNA, 294 bp, Homo sapiens; identical to SEQ ID NO: 81502
  chr17:81062099-81062393
  Hypo

SEQ ID NO: 114208 - DNA, 102 bp, Homo sapiens; identical to SEQ ID NO: 81503
  chr17:81065766-81065868
  Hypo

SEQ ID NO: 114209 - DNA, 138 bp, Homo sapiens; identical to SEQ ID NO: 81504
  chr17:81068653-81068791
  Hypo

SEQ ID NO: 114210 - DNA, 82 bp, Homo sapiens; identical to SEQ ID NO: 45316
  chr17:81076347-81076429
  Hypo

SEQ ID NO: 114211 - DNA, 33 bp, Homo sapiens; identical to SEQ ID NO: 81506
  chr17:81081890-81081923
  Hypo

SEQ ID NO: 114212 - DNA, 30 bp, Homo sapiens; identical to SEQ ID NO: 81507
  chr17:81084673-81084703
  Hypo

SEQ ID NO: 114213 - DNA, 138 bp, Homo sapiens; identical to SEQ ID NO: 81508
  chr17:81087463-81087601
  Hypo

SEQ ID NO: 114214 - DNA, 120 bp, Homo sapiens; identical to SEQ ID NO: 81509
  chr17:81087901-81088021
  Hypo

SEQ ID NO: 114215 - DNA, 78 bp, Homo sapiens; identical to SEQ ID NO: 81510
  chr17:81088141-81088219
  Hypo

SEQ ID NO: 114216 - DNA, 85 bp, Homo sapiens; identical to SEQ ID NO: 81753
  chr18:266838-266923
  Hypo

SEQ ID NO: 114217 - DNA, 30 bp, Homo sapiens; identical to SEQ ID NO: 81904
  chr18:499528-499558
  Hyper

SEQ ID NO: 114218 - DNA, 1248 bp, Homo sapiens; identical to SEQ ID NO: 81905
  chr18:500042-501290
  Hyper

SEQ ID NO: 114219 - DNA, 86 bp, Homo sapiens; identical to SEQ ID NO: 82004
  chr18:597381-597467
  Hypo

SEQ ID NO: 114220 - DNA, 53 bp, Homo sapiens; identical to SEQ ID NO: 82294
  chr18:812816-812869
  Hyper

SEQ ID NO: 114221 - DNA, 174 bp, Homo sapiens; identical to SEQ ID NO: 82308
  chr18:903670-903844
  Hyper

SEQ ID NO: 114222 - DNA, 2558 bp, Homo sapiens
  chr18:904374-906932
  Hyper
ttcatgaataaaaatcggagcgcaacagtgcaacaaaatattctgtacttaaaggcaacaggcaggcagatgttgacaaagagggctctccaaaaaccatgttcggatagatttttgcgaactgcacagataaataggagcagaaggccggtcacctctgtaaccagcggtagcagcagcagaagccgcagcttcagaggcagccggagagacctcggagcagagaaggcgccgccgaccctcgcggctgcctggcccgcggctcctacaaaggcgggctagccgcccgccctctcccttgccttcctccccttcttttctgactttccctctttcccttaatcgcctgcttcttcctccgggtggacttacggccaccttgctcctccgcgcttcacctcatcgccccctctttctttcttctgcctctctctctgcgcccccttctctccgtgtcacgctccctcctggttctgcgcgtctacaaacttttgagcagaacacgagcctcggcaaacgagtcccgcagctcctcctgctgctcccgctggttcctgcggcttctgctcagacaccaacgccagacggcgatgcctctcgggtggtgactccagcgcaggaacttgaagaagcgctttgcccgccgtcctacctggcagctctcctggcagcgggaggagttgaagggtaagggagggaaaatcttaccaaagcgaccggctcactcgactgctgattctttcgcttggcatcgcgtcaggggagttagctttccttcagccgggtctggctagttattgggcgccgggtagatgcatatatatatatttttttctaactatagcaagcaagaagtggcagggcgcgcaccggctgtcgccaagtgctgttcaactcagggagccggggcttcgctccgtccctcccccggcttccagagctttttggggttggagggtgggaggccaggggcgttctcacagctgtgtgtcctctttcccatcctgcgcagaatgaccatgtgtagcggagcgaggctggccctgctggtctatgggataatcatgcacagcagcgtctacagctcacctgccgccgccggactccggttccccgggatcaggtaggtgctggctgcctggcccaagcaggagctggggcttcccaggcacagacgcttcctcacggtctccttcctgcagtcctttgggtccagactactagcatcgccctctgcgcccccggtgcgcctccgccagcctcggctggacagcgggtccccattctagccgagggtctggcaggctccgcgactgctcggacgcctcccccagccctaggcagctcagggtcccgggtagagccagtgagcttctggccgctggagaaccccccctcccccaacccggcccacaggatgggggcagggcacggcccctagcttggtttcttttacctattcttgggacgagttaggagaacttcagctctggagcctggccgggggttgagcgtgaagctccctcggactttgctttgttactgcttgttctggactatccgggtggggtctctctctctcctccaccctttcttttcatttcattccaattctttcccctgaagagctttctttcaagtgatccgtgttccaactgcattttgaatcccaggctgtcttggggggcgtgcggtggggagggtgttggcccggtgtgattgaggaaaagcgacttaagagagggaagaacaaggacgagactgcgaaggagggggaaaaacaggcgcaaaggaggaggaagggaaagccagcaggcaggcaggaccgggagagcagccctgcctggcccgggatggaggaaccttggcttttttcttaaccccgggtttctaaccggcaggcgcggcccaggttcccggaggcagccccagagtcgcggaccgatgtgccaggctgtggatgagccctgggtaggggagggttcgtaccagcggcgcctggggcagcgaggagcgcgcgttctgcctgcgaagctgccttctccgagccccgcccaggaacattagctctggggggccgctgatcattgatttggacggagagatgggttctgggttctgtattaggattccagcatctgggctcgaggcagggcaatatccagaaagaccccagggttcggggtacccgggccagggctgaggcgcatcgccgagcaaaggctgggtgcgaggcgtgcggaatgatgcgcttgccttgcccgggcctctccaaggatggagaaaaggcgagtgaagcagcgaagtacgactccaaccccgcccagagagtgctactagcgctggctgcacgccaagtctctccaggggtccaaagcgagagggatttgttttaacccatctctacccgtcctgtgtcaagaacggaggctgtagagggcgactgcgaagtcgccaggcactcgctggatctcggtccccctcctcgtgctctggggttgagatggggcaccgccatcgataacagatcagcgcgaactattcgtttagtggcctta

SEQ ID NO: 114223 - DNA, 1205 bp, Homo sapiens
  chr18:907314-908519
  Hyper
ggctcgggagccaggcggggaggggggcggtccttttccgtagacaggtgtgcgcgatcggcggagacgcctcggtttcccagcgcttgttgaggccgtggcccgcaggacgaccctttacccgcgaagggggggtgggcgggccgcccggcggggtaggagtggttgggtgtcgttgcctcctccttacctctgctcccacccccagtcctgggagaagagacaattctcagcggaggacttttatcacctgtgaaaatccgcgcgagccccttactttggatcctcgccgagctggggaggaacttgcactgaccacaccttctgtccccggccaccccgcaggccagaggaagaggcgtacggcgaggacggaaacccgctgccagacttcgatggctcggagccgccgggcgcagggagccccgcctccgcgccgcgcgccgccgccgcctggtaccgcccggccgggagaaggtgagattcgcgcggcctcgcgcacacccgcggctgggagctcgggactgcggtgacgggaggggcagtgtggtgacccacccaggatttttttttttttcccgtgaaagtcctcaagcctgtcctctccctggcccgatcctattgcagcgacagaaaatcagcagcgggcgggtctgtgtggacctgagggccgcgtggggaccgaggggggctgtggcccaaagagtggcagtgagtggcgtcaaggaacccacactccgcatctgccactcctagagccgggactagctcccgatcctagcagttgctctcgagatcatcccgggagttattggcgagttctgggcctctggaggtttccctgtcagcctccccggccgccgagggggcgcgcgcccaacaagggggtctctagcggccacctggggacagaaacagtgaccctgggcgcgcactttgcctccccgttagagatgtcgcccacgggatccttaacgaggcctaccgcaaagtgctggaccagctgtccgccgggaagcacctgcagtcgctcgtggcccggggcgtggggtaagagtttgtggaaggattaacctgcgcgcgccggggtgggtgcctgtgcggggcgcgcggggcgggcggcggtgggtgcccgtgggggccagggtgagtctgcgcccctgggtctggggtgggcatccgccacgggtcgcagttggagattt

SEQ ID NO: 114224 - DNA, 810 bp, Homo sapiens
  chr18:908922-909732
  Hyper
ttgcctacagcctgtcgacttatattattatcacgtttttcaactcggcgtgaggagggagaggagtgttcatatttgactaggaattgcaggatcgatgcaaactccagggcagcagccagactggcatatgtagggctctccggttactttctctgtatgtcgcgggtgagaggaacagcgaggacaatttagcgcaaacacacgaagggtcggatctcaagggggcagcgctgggagaaaggttaggcttgaagcgcgcgtcgcctgcccggatcttatcccgggccccctccgcagggtttggtgccaggagatcctgcgtggggaggggggcatcgaggggctgccgtctcggccctccccacggctgcttccaggcagaggcgggcgacgcggtgggcagtgcgagccccgggccctccccgaaggctcccgcgtggggtggggcccgcctgctccccgcggcgattgaacctgtgtctcccgccccgccaccctcttcccgacccctttgcttgcagtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatcca

SEQ ID NO: 114225 - DNA, 233 bp, Homo sapiens; identical to SEQ ID NO: 82323
  chr18:961751-961984
  Hyper

SEQ ID NO: 114226 - DNA, 30 bp, Homo sapiens; identical to SEQ ID NO: 81703
  chr18:2038636-2038666
  Hypo

SEQ ID NO: 114227 - DNA, 30 bp, Homo sapiens; identical to SEQ ID NO: 81752
  chr18:2623947-2623977
  Hypo

SEQ ID NO: 114228 - DNA, 24 bp, Homo sapiens
  chr18:2755854-2755878
  Hypo
gccctcggccgtgtattttctttt

SEQ ID NO: 114229 - DNA, 1715 bp, Homo sapiens; identical to SEQ ID NO: 81755
  chr18:2846451-2848166
  Hyper

SEQ ID NO: 114230 - DNA, 30 bp, Homo sapiens; identical to SEQ ID NO: 81763
  chr18:2879366-2879396
  Hypo

SEQ ID NO: 114231 - DNA, 463 bp, Homo sapiens
  chr18:2905967-2906430
  Hyper
gccgccgatttttgtcgggtcctaaacaaaaatcaaatgtgttgcgctttggaactctgggcatcgtgggcaccaggctgacgggggcggcggggatggcgtttcttggcgagcgggtccctcagccaggcccgggtattgtcaggcgtcccgtggacggtcgggaggggcttcctggagggctcgttccgggaacgagttcaaaggaggaaagggcggcagcttccggcgccttccccagagggccgggagacgcacgccaggagcttcctccgttggaagtcccttccgctggcgacgtgggcgctgtggccgcggccctcgtggagcctgagccctcctcacggcctccgcgcagccctggggccccccggcagggtccctcggcagcccgcgggagaggccgtggggccccggcaggagtgtggttcagagacggtgcgggggtcggtggcctcaggtc

SEQ ID NO: 114232 - DNA, 30 bp, Homo sapiens; identical to SEQ ID NO: 81765
  chr18:2907170-2907200
  Hyper

SEQ ID NO: 114233 - DNA, 98 bp, Homo sapiens; identical to SEQ ID NO: 81767
  chr18:2913170-2913268
  Hypo

SEQ ID NO: 114234 - DNA, 30 bp, Homo sapiens; identical to SEQ ID NO: 81768
  chr18:2917759-2917789
  Hypo

SEQ ID NO: 114235 - DNA, 30 bp, Homo sapiens; identical to SEQ ID NO: 81780
  chr18:3126638-3126668
  Hypo

SEQ ID NO: 114236 - DNA, 30 bp, Homo sapiens; identical to SEQ ID NO: 81781
  chr18:3152033-3152063
  Hypo

SEQ ID NO: 114237 - DNA, 42 bp, Homo sapiens; identical to SEQ ID NO: 81792
  chr18:3215130-3215172
  Hypo

SEQ ID NO: 114238 - DNA, 104 bp, Homo sapiens; identical to SEQ ID NO: 81797
  chr18:3330713-3330817
  Hypo

SEQ ID NO: 114239 - DNA, 89 bp, Homo sapiens; identical to SEQ ID NO: 81803
  chr18:3453723-3453812
  Hyper

SEQ ID NO: 114240 - DNA, 328 bp, Homo sapiens; identical to SEQ ID NO: 81809
  chr18:3499043-3499371
  Hyper

SEQ ID NO: 114241 - DNA, 161 bp, Homo sapiens; identical to SEQ ID NO: 81824
  chr18:3616260-3616421
  Hypo

SEQ ID NO: 114242 - DNA, 56 bp, Homo sapiens; identical to SEQ ID NO: 81826
  chr18:3771517-3771573
  Hyper

SEQ ID NO: 114243 - DNA, 113 bp, Homo sapiens; identical to SEQ ID NO: 81828
  chr18:3930496-3930609
  Hypo

SEQ ID NO: 114244 - DNA, 30 bp, Homo sapiens; identical to SEQ ID NO: 81834
  chr18:4334251-4334281
  Hypo

SEQ ID NO: 114245 - DNA, 186 bp, Homo sapiens; identical to SEQ ID NO: 81843
  chr18:4398414-4398600
  Hypo

SEQ ID NO: 114246 - DNA, 979 bp, Homo sapiens
  chr18:4453666-4454645
  Hyper
tatcctcaccttctacgaagccattcacgaagaccacaaaagctaaaagatctgtctttaattggtacttttattatatgtctttcctcgtaattccctaacttcacgtgttatggaaggaggcagggagcattcacctcccacgaccgggagtcagtctctgtgtcaggagtaaggagtgaagagtctcgcctggatccacaaaagacgtgacatctcccacccagcgtcccactgcttgccgcctggctacctttaaccccttgccctccgcacatcctccccttctctagcagaaaattccgcagcgctacggtcgggctggaggcaagccctgcagccgggggcgagcgcggcactcggacacaggcactcagtgtctccggcgccggcagccgagccacgggccaccccttcccacggcctcccggtgccacccagcgaggccgggacagcgcgccttccgcaaaaagcgcagcagccgaagtcctgaaagcagggtcttcatcgccgcgggccctccgaaggtgcctctcccagctgcagccgcccctcaatgaaagtgcaatgtgttatctcgcccagcccagaggagaggtccctgtttggccttggttccagcccggctcattcaattcgctgaatgtcgggtctcccggcccgccccgcgattctccgggaattggccttggccgcgggcagggggcgactctccagtgacctcctccttggaccccatttctctctctctctctctctctgtgcctgtctttgtgtctctgtttctttggctttctcttacaaacgcacgggggagttggtccttttccacaatgccaaaatgtcacccaaaaagctagtgcaacaacttgctttgcaaacgacccaggagcctgccgagaaagccctgcggggagcagccccctcctcccctgcaaggtgcatcgggggtggggtgggggtgcgaatttgaccggtg

SEQ ID NO: 114247 - DNA, 368 bp, Homo sapiens
  chr18:4455044-4455412
  Hyper
cgtccgttggtcccacgagcctcggaggaaggagagagatgtccccgcgaccaggaccggctctcagcgaggtgacgggaaggactcgagagaggagccgaggcggcggcggccgttcgcgccgcctatgctgccgattccccgaggcggaaggtgtccgcgaggccgtgtcctggagattgcggcgcccgaagcgcagcgctcgcctctggagcggaggctgagcgccgggacgcggcgggctggggctgcaaggctgggctggtgacccgcccctgggtgcatgttaatacggtggggaggaggagtcccgcgcttcctccgcccaaccaccggagccggcgggcgggcggcggccgcggcccgga

SEQ ID NO: 114248 - DNA, 30 bp, Homo sapiens; identical to SEQ ID NO: 81856
  chr18:4455651-4455681
  Hyper

SEQ ID NO: 114249 - DNA, 30 bp, Homo sapiens; identical to SEQ ID NO: 81857
  chr18:4455910-4455940
  Hyper

SEQ ID NO: 114250 - DNA, 219 bp, Homo sapiens; identical to SEQ ID NO: 81908
  chr18:5133145-5133364
  Hypo

SEQ ID NO: 114251 - DNA, 1531 bp, Homo sapiens
  chr18:5196228-5197759
  Hyper
tacccctagagacagcgtcggacgttcacaacgaccacgcttttccccgcttcctcgattagcctggcctcccttgctccagtggggcggactcaaatgcgcacgcacgcacacgccgccaagccggtcaaccgcagacaaatctgactcttcgccaactagtagccacggagagcagcaaagggaccaaggtccttcaccgcctgctccaaaaagacacggcaacctccagcggcgccgcagtagctgcctctgtgctgcagcctccggtcggagtttcaggtctaattccttaagaagtatcgctcctctgcccttcgtcctactccccttggcttcgcccacttcgcctccttctcctcgggaggccaggaggacccgggtcactttgccaattctgcggagggggaagtagcagtgagggagattcccacgcaagtagcccgaagcccactactctttgccccacctctccactctcttgcccgtgtaggtgccggtgctgctggcgaaagtcccagttcttaaggctcctgagctcggaaggggtgtggaggagccagatgggaagagaagcagcgggacgagggcgaggaagggctggagattgttagaggacagatggggcgggactggggagaggggcgaaggcgacgcgccgaggcactcctccgccccatgagcacagacagtaactccgaaacgcgcagatgggccgtaaggtaaagaggccttttttccctctcctctccgtcctctaccctgctcccctcctagacacttggtgaaaaagcaaggtgcggtgtacctggagcgaacaccatgatttcttccagccgctacgcccccagattaagagagaaagacaggcagacggaggatgggaagaaggccggacttggcggggtccggtgcaggagggcgcgctgggcgggcggcgggcggggcggtcagcaccccggacagctcccgccgctagatcctggggccgcagctccagccgccgccgcgcgctctgcctccacaatgcggccacagcggcggcgggaggaggagggtgaatccccgctcagtccatccctcattcctgtgccagctcggcgacgtacactgctgcttagggagcaaagcacttccaccgctttcacgcgacgaaggtcggaagagcaagagagagaaaggtaaacttcccggcaggggacagtgaattgcttttaattacctgctgtggctcgtcgccgtggatattggactgacatttaagatagatttgtcaaaaaaaaaaaactctaagagctttctttactctcgaggatgactctgagttctccgagttgggctggctcgaatagaggggcgggtctgtcaagttaataggtcctggaggtccgtgagtcctctctcgcgagtcccagtcctctgctaacgtcaggaagagagcaagaggaaggacacagtgactatggagcgctcgaggagggcgctactatcaggttccgctcccaggtggcaaatccggctctgaaagctc

SEQ ID NO: 114252 - DNA, 24 bp, Homo sapiens
  chr18:5233199-5233223
  Hypo
cgctaaggccgagagagcaaaagt

SEQ ID NO: 114253 - DNA, 744 bp, Homo sapiens
  chr18:5542700-5543444
  Hyper
ctgggctgcaactaacggaaaaaccctagaaaacttcagatccgtaatataaaaagaaaattgaaaagaatactctcattgcaagggaccacagttacaatttactaggtaaccacacccaccgcattgcagaagccatgaacttggcgggcgtgggggggaaggggaagaagtccggcgagattagaggggaaatccgaaaaagcaagcccctgcggcagcagccaggaaacactcgccaggaactggctgcgaccccaactccagcggtccgaagccctagcctccccacccccaccgcggcagagccgccttcgcagacacctcccgaggagaatcgcggccccgagggcgccaggtgagtcgcgccgccccgagcccccgggccacggcaggccgacccaggcgcccccggcccgcccgtgctcccgcgcccgggtgccagaggcgaggggccccggcaggtgcccaggcccagggcaaccccgcttggacgctccctcctcctcccccaccggccgggggccgctgccccagtttggggaacgaggcaagttatataaaagcggccggcccccctgcccagcggggatgctttgtgcggagcgcaccttatcggccccgcgctgcgcccgcccgcgcctgcacccgggacgagcccgctgccgccgcgcgctgagcgcagggcccctcccgcggcccgccagccgccacccgcccgggcggcgccgcagtgtcgccccc

SEQ ID NO: 114254 - DNA, 564 bp, Homo sapiens
  chr18:5543683-5544247
  Hyper
cgcggcgcgcaggctcggcccggtgggggtcccggcgagcgggagggcggttggggaccccggccgcgccgggcgcggggctcgggattcgggagaccgcgcggcgccgaagccacgcgtcagccccactgtcccgcgcgcctcgccccaggcctcgggctcttcctccgcacctcgtaaagccgagaccccctcgcagtcccccactccgagaggcggaaaagttacctgggatcagcagggagcccgggcgcgccgcggcgtggggactaggctcgggcgcgcgtcctcggcggcggtgcgcaggagactcgggcgtggggaggaagccgcagcccagggctgctcgccgctgttccccccgccccctgttgcaggagacaccgaggctccgcggagctgcggcgggggcccacgcccagagaccgtgcgaggaaagccaacctcgtcctgcctgccctcccagccgcgggggagggggccaccgcagtacttcaggacagttacatgggcacagcctcctccgtcctggcgcagggtcaggctccgcggacgacgcctgga

SEQ ID NO: 114255 - DNA, 30 bp, Homo sapiens; identical to SEQ ID NO: 81950
  chr18:5561844-5561874
  Hypo

SEQ ID NO: 114256 - DNA, 2716 bp, Homo sapiens
  chr18:5628082-5630798
  Hyper
cactggagcccaccccgctcctacgccgcaaagcagcacaattacagcctgggaggggcaagtcttgcggggcccgtcggtaactgccattatttgaatgcgatataggagatcccacatagaccctgctctaccgggttagaatctgtttctaatcacgtggaatttagatttaaaccacagttagatttgggatttaccatcgtttctactttcattcatttagtggcttccagccctctcgcggcccagtcttaatccatcgcacttcagagggaattacgagggagttgcggactggcgggggcgggggtctgtaactaacaccaggtgcctgtgagagagccccaagggcgggggcagcacctcctggctgggttgggtccgcctggcctcgcctcgcctccgggatccttggcgctcagcgccgccctcccgctactgcgctacccgccagagcccggcgtcttccctttccttgtcttgtggacgccgcccttcgctcccgggaggatttcgcctccagcacctcaggcttttctggcgcaaaggtcgccagcccgagcgagcccaggcggcggcttcacttctgcagagggaaagcgaaagacgcggccggcgggccgagggggcggccgaacgcgccgcgtggttgctgctcccgaatccgcagcggcggcgccagggcggtcaccgagccctgcggaccccggctcaacttccagcgccactcgggtgccccgagcccgccgcagctcccggcgcgccctccagccgcggcacgcagcccctgacgcgcccggggcgccctcccgcagcaccagccaggccaccccacctcccgcgccgcgcttccccgccagccgccggccaggagctccccggcttctgagcaggacgcgccaaagggagttgggaggctcagcagcccccagcgtcgccttctcgggtgacgtgacgctctctctggagcgcgggcccgcctccgccaagcctccaccgcaggtccttacagccgagccacgggaagatgcaacgccgggcgaggggcgcctcccggattttgaaaaacagcctcattcgcctcgggaacgcctcgatcccccacccgcaccctttggccagatgattttaatcctgggattccgcgttggtcgtgggggtaccgggagctggagctggaggagaggagccggcagcgcggagttgccggggtgcagctgcgcgcagctggcggcgaggggaggcggtccctgcggctccgccgggctgggggaactggctcctgcgcctctgcctcccggaggatcgcactcgctcatccttacacaccacacacacacacacacacacacacacacacacactgccgctagcgccccccacgccacaagccggaatgcggaggtcagagccactgtccacttgaaagcaggaaagcaggggctgaaacgctgagatggaggcggaggctctggcctcatctgcgaggttcgcaccttcccggaaggcccccccctcccccgcgtttccccagggcgagcaaggtctagcttctgagactccgctctctgggctagcggttcgagctgcaggggggcggggacggattcggagggagcactagagagagagcccgcgctcactcctgccctcctcgcaaagaactggccagccccactcgcgtccagcccacaactaggctgccgggaccggggagccagaccccaggtcgctccaactccggcgagggcggggaggggagtgacagcagcaactagcgcgcgctggcaaaagcacagagtctcggaataggctaaacggccggcgcggaggggtggaggcaagagggggcggaggaggagttgcccgagcggagagggatgacgtcctccagggccttgggctccgaggaaccgaagactggtgcgctcgccgggccccgcgcactagctctggggttcgcagaggcgccgcgcccggcttccgcggcagctccaacacagcgcgcaggcggtcgatcccggtcagcttaaaccgggcgcaagccctctgtccccctcaaagcacctctctgctcgtccctagtctccaggtgcccgtctgagagtccctgtcgcctccgggcggacccggccaggcagcccccggtcgggccagcctcgccccttcctcgctttctcccccatcgacctcgagccaagggcaggcggcccgcacccgcgcccctgcccacggggctaggcggcgctcccggcctacgcccggctgccaagaagagaaaggcgctcacctgagtcaccgaagccttcctttggggcccctcccggagcttgttcgcagcccgcaggcacaaccttccttggagaaaaaaagtagcgcaagggcagagagaggtagggctgctcacaggtccctccgcaggggctctttccttcgaattctccggggtccagtctcgggctcggcggcgggaaagagctcctggaggctggaaggggccgccagacccgggctcctcccgcagctgcggtggcggcacctccaagttgccacctgcagcgcgcttcgggcgcctgtgacagcccgcgccgctcagccctcgcgggcccgccctccccgtccgctcgttggctgcgcccggtgcccgggcggtccccgcgctctgccccgccctgagcccgcctcccagccgcgcgctcgcaaagtatgggtc

SEQ ID NO: 114257 - DNA, 1046 bp, Homo sapiens
  chr18:5890466-5891512
  Hyper
gctggatgggtcatccgactgggagctcccggagtcccgcctggtggggggcgagccctccagccgcaggggtggcgagggggaggcggccttggccagagggctggagtccgggtccgcactccccggggagggcgggggctcgggggacggcggcgcccggtagtccgggagcccgctggtgctgcggcgccgcaaggccgcgtacctgccggtcctgggcaggcggccgccctgccccctggcggcgcgcgccgctaccgcgccctcgggctcctccggctcccggcgcgccccgcgcatgctgccctctgcgccgcggaggttggtcatgctcaggtcgagctcgcccctcgggatctcctgggagccgcgttcccccggaggcctctgccagctgcagctcgcgccctccgcgtccccgcccctatcgcggcccccttgcaagggcagcagcgcgaaggcgctcagcgaggagtccacgaaggagctggccgtgctctggcgcccccagctctcgggtgggctgcagggcgccggactgctgcagctgctagcggctgcggcggcggtggcagcggcggcccggcgactgcctgccacgcccgagcgctcgcggtagacgctgtacacggcctcggccaggctcgggggctcccgcggacagcgcggggaagaggccaggtccggcggggacgcggcgccccgagggcggccgccgctcggcgccgcggggtgaggaggccacgagcccttggccagcatcgccgccgctccgaaggcgtccccggagccaccgcagcccccgggcttcagctccaggccccgcgactgcacgtagctgaggaagccgttgagcggtatggccccggggggcgccgcggcgggggcagacgacgacgaagaggcggcggcggccgcggcggcggccgcggcggccgccaggtctttggcgcggaggctgtgcacgtcgatgacggtggagtagaggtcccgcaggttgatgattttggtcttcttgtcccggttctcgtggaggaccgcgt

SEQ ID NO: 114258 - DNA, 1469 bp, Homo sapiens
  chr18:5894663-5896132
  Hyper
gcgctgtgctgtgcccggtacccaacccaggtcctcgaccccggcccctcactggcagggcggcgaccccctggcccctggctttggtctgcttattgatgttagctggagtcacatgagtgcagcagctgggagtccgcctctggaaagaagacaggcaggagccaagtgagggcaatcctgaactagctttttctgggcagcgcatcccgtgtagccagcccgggaaaaagcctctcaccgaacaccagcccggggcgcggggactcggggacccgaggggcggggaggggcccccaagggctggggactggcagaattgctcaaaatggcagcactctccgcacgcaagatcgctcacttacccagggagaccgagggaggtcggggccggcgaacgggcgctcgggcgacacaaaggaaccatggagaaactttttcagcccgagccgacggcggagcgcagggacagcgccccggggccccgcatccgagcgcgactcagcagccccgcgggggcgagcgcccgccccaggctcgcagtccccgccggcgctgtggcgggagccatttccaagagtttccaagaagtgtcaggtcctccgcatcccgcatcccgcatcccgcctcggagccctcctctccgccgctcatcctccagctcccggcgtcccctagcgcggcgctcccgggcgggcccctgcggccgcgccgccggccctcgcgcctcttttgtgtggctgcggcgcgccgggctccgccgggtggagttgagcccgcggcggcggctcggggcggccggactggcggctgttgctaagagaccggagccatgacacagggaaattgcggcagggtggcggtcggggcccgcccggctcggcggagtcggggggcgcccccgcccccgccccccgccccaccccctcctccggcgcccccccccacgccgccggccttccccgctcccccgcgtcctccgccgcccgccgcccgtcccttcggaagcgccgattcctcggggaggaggaggcgtgaggggaggcggcggaggcagccggcacggggcgctcgggccgcggggcagggggcgcggggtgcctcctcggcctcggctctccccgccccggggcgccccgagaccgccgcctgcctccgcgggcagctttgttcttctttcctccaactacctgtctgagccgcgggccccagaggccccaaagagaggcccggagggtctccccagcagcatccgaggggcgctctcggggagctaggggccagagtccgcggtccctccgtgcctgcctccctcccctcgtgcctcggtcttttgttgcctctactcctcggcacggcgcagcctgggctctcttccccctcccgcttgggagtttgcagtgtggacgctcggcaagcacagtaagttgtcccccagcgaactcgggcccgggcggagtggagccgcc

SEQ ID NO: 114259 - DNA, 98 bp, Homo sapiens; identical to SEQ ID NO: 82002
  chr18:5967868-5967966
  Hypo

SEQ ID NO: 114260 - DNA, 30 bp, Homo sapiens; identical to SEQ ID NO: 82003
  chr18:5969470-5969500
  Hypo

SEQ ID NO: 114261 - DNA, 39 bp, Homo sapiens
  chr18:6414162-6414201
  Hyper
ggccaggcgcccgcccgccctgcgcgcactccctgggct

SEQ ID NO: 114262 - DNA, 227 bp, Homo sapiens
  chr18:6414470-6414697
  Hyper
ccgcgcctggcaccccgaccctgccctcgcggctgaccgaggcgccgggctctgcggcggccgcgcccgtccaaagtaggcgacaagtgaggcagcgcctctcgcggggagcccggcgcgcgccccggcggcgaaagagaaagagaaagagcctgggccgggaccggggctatccccaaccgccaccgcccccaccggcccggccctcgccgcgggagtcgtgcagg

SEQ ID NO: 114263 - DNA, 279 bp, Homo sapiens; identical to SEQ ID NO: 82033
  chr18:6729441-6729720
  Hyper

SEQ ID NO: 114264 - DNA, 158 bp, Homo sapiens; identical to SEQ ID NO: 82034
  chr18:6729981-6730139
  Hyper

SEQ ID NO: 114265 - DNA, 37 bp, Homo sapiens; identical to SEQ ID NO: 82041
  chr18:6929750-6929787
  Hypo

SEQ ID NO: 114266 - DNA, 183 bp, Homo sapiens; identical to SEQ ID NO: 82053
  chr18:7109195-7109378
  Hypo

SEQ ID NO: 114267 - DNA, 147 bp, Homo sapiens; identical to SEQ ID NO: 82054
  chr18:7116490-7116637
  Hyper

SEQ ID NO: 114268 - DNA, 440 bp, Homo sapiens
  chr18:7116857-7117297
  Hyper
gcccgcaaaaacagaaaatgaaaattcgctctgagtttctcttctcaatccttgcaacgcgcatgcaaggtgctcccttctccgctggtccctcgccccggcgcgcccacggtcaatcccgcgcagtgaatgagcgggtttggccacttcgcctattgcacaaaaagcgcgggtcgggaaggcgcatcagtgccctggacgccgcctgcgggtccccctgcccgggacggctggctaggggcgcccttctcgccgcgtctctccccactagcccgcttggctgccaggggccccgaggaatccgccctttcccggccgccgcgacccagcttgcgcagccggacaatgagggcgactcgggagagctctttctccattcatcccccgcgcccggccaacagccccgccacccccgcccgcgcagccggggcactaaaagc

SEQ ID NO: 114269 - DNA, 690 bp, Homo sapiens
  chr18:7117522-7118212
  Hyper
ccgagacacccactccgaggtggatcaggatgcgcgcccggactccagcagccccaacgcgacgggctttgtccgcggccgcccccgcccgcccgcctgcgggggacagggaccctaggacccgggccgggctcacctctctgccggcactgcgcggcgacacacagcagcaagaccaggagcacgcccccgcgcatctcgcctccgccgccactcggtgggtctggggagaaagccgcgcgcccgcctggaacgctccacgggacgcgagtccgcgctgccctggccccgccgctcctggagtcctgccgcccctccctccagccgccctcggacacacccctcggctgcgccccgccccgccccgtcccgccccggcttggccccgccacccagacccctcccccgggggcgcccagcttggcctctgggtcccggcgcacgcggaccccaagtcggggaggccgggctgaccgcggccgcctccccggctccgggtaggaggtgggcagagaaggtgggctgaggggaggagaaactgggctgcgggggtccgggagggtggattccgagaaactatgtgcccagctgaccctgcccgccccgccgcggccctgcagtccccgggccaggacccacgcgcccctgccaggagctgggcgagaggcgacccctcgggaagccacccag

SEQ ID NO: 114270 - DNA, 19 bp, Homo sapiens
  chr18:7118760-7118779
  Hypo
agagcgagactctgtctca

SEQ ID NO: 114271 - DNA, 30 bp, Homo sapiens; identical to SEQ ID NO: 82101
  chr18:7444343-7444373
  Hypo

SEQ ID NO: 114272 - DNA, 211 bp, Homo sapiens
  chr18:7566582-7566793
  Hyper
cgcttcgggcccacacgggacaccgaggcatgatgaggacgcagaacagcagaagcgcgccctgcttcccgggcgccagtgctcggggccagcggcgtgtacccggcgggcccggccgggagcgggctggcgatcgcggggctcggcgctcccggctcccgcgccatctcccggcgcccgccaacttcgctccgcccgcggcgtagagaag

SEQ ID NO: 114273 - DNA, 326 bp, Homo sapiens; identical to SEQ ID NO: 82140
  chr18:7567009-7567335
  Hyper

SEQ ID NO: 114274 - DNA, 1071 bp, Homo sapiens
  chr18:7567750-7568821
  Hyper
ggccccctccgccctcgcgcgcccacccaccgccgccggggagcggcccggcccgcactcagcaccatgaggggacttgggacttgcctggcgactttggccggacttttgctaactgcggcgggcgagacgttctcaggtaagcgggaccgcctctgccgcccccgaggcgcgcgggccggcgcgggacgcccgggacgccgacagctccctggtggtagagccctaaggctggcgtcggggccgggcggggggcgcggcgggccggacaccgcttctgcctgtgagccgggcgctgggcgaggggccgtggggctggcaggcacccagtcctcgggcgggcggagcggacggaccccgagggcgagctccccagccgggactgccagctcggccgccgtccttccgcggcctgggctagtgctcaaggttgggcggcttgcactcttgagtccctggccggctgcaaaaggaacagcagaaaactttgcttgaagttcccagttgcagccgccgggccgcctggcgtaggcgctgcgcggtccccgccgaccccgagcagcggccgggcccaggccgctggtgttcggctgcgcccgcagcgatcgccgggaactggcggccgctccggcggcggcgatctcccggtgccctgccctccctgtcgccccctgcccggcgcggctggcgaccccgggaggtccccgcggtcgtgcagcgtctgcggagaggctggggggagttcctcgccggtcccagcggtagggcttggcggccgcggagggaagcgggcaggtccccaggccctggccacggccctgcgccccgctgggctccccctccccaccctcgtccccctagcggagcgccgcggccagctgcaacttgttcatccagcccggctgcccgggggtcccaggtgggaaggagaggcactggcggtgtgcgagcaagcgtgtgagtgtgtgcgcgtgtgtgcctgcacgcgcgcgcgggggcgttctaagcccagaggaacccctcacggagaggatctgtggatcggagtcgggggtccggcgtgggggcgaa

SEQ ID NO: 114275 - DNA, 36 bp, Homo sapiens; identical to SEQ ID NO: 82295
  chr18:8261957-8261993
  Hypo

SEQ ID NO: 114276 - DNA, 30 bp, Homo sapiens; identical to SEQ ID NO: 82296
  chr18:8390038-8390068
  Hypo

SEQ ID NO: 114277 - DNA, 97 bp, Homo sapiens; identical to SEQ ID NO: 45326
  chr18:8570976-8571073
  Hypo

SEQ ID NO: 114278 - DNA, 260 bp, Homo sapiens
  chr18:8608722-8608982
  Hyper
ctctgagtgagacagcgatcagagttaaaaataactgatttcgcgcgtttccgtgcaaaatgggagacagacgtgacggagagagaccgagcagtgccacggcccggtagagggtgcgggggcttgcacccgctggtgtttgtgagagagcgctggtgtagacgcgaacgcagcgcaggcggcccggcggcgcggcctcaggtcggggcctttccagcgttccagctacaccgagcgcgcgggggcgaaaacatgtgcat

SEQ ID NO: 114279 - DNA, 78 bp, Homo sapiens; identical to SEQ ID NO: 82300
  chr18:8612204-8612282
  Hypo

SEQ ID NO: 114280 - DNA, 30 bp, Homo sapiens; identical to SEQ ID NO: 82301
  chr18:8658999-8659029
  Hypo

SEQ ID NO: 114281 - DNA, 40 bp, Homo sapiens; identical to SEQ ID NO: 82302
  chr18:8659257-8659297
  Hypo

SEQ ID NO: 114282 - DNA, 30 bp, Homo sapiens; identical to SEQ ID NO: 82303
  chr18:8663049-8663079
  Hypo

SEQ ID NO: 114283 - DNA, 200 bp, Homo sapiens; identical to SEQ ID NO: 82304
  chr18:8706608-8706808
  Hyper

SEQ ID NO: 114284 - DNA, 84 bp, Homo sapiens; identical to SEQ ID NO: 82305
  chr18:8779033-8779117
  Hypo

SEQ ID NO: 114285 - DNA, 45 bp, Homo sapiens; identical to SEQ ID NO: 82306
  chr18:8823136-8823181
  Hypo

SEQ ID NO: 114286 - DNA, 40 bp, Homo sapiens; identical to SEQ ID NO: 16294
  chr18:8845133-8845173
  Hypo

SEQ ID NO: 114287 - DNA, 220 bp, Homo sapiens; identical to SEQ ID NO: 82319
  chr18:9333406-9333626
  Hypo

SEQ ID NO: 114288 - DNA, 156 bp, Homo sapiens; identical to SEQ ID NO: 82320
  chr18:9364375-9364531
  Hypo

SEQ ID NO: 114289 - DNA, 30 bp, Homo sapiens; identical to SEQ ID NO: 45331
  chr18:9547786-9547816
  Hypo

SEQ ID NO: 114290 - DNA, 30 bp, Homo sapiens; identical to SEQ ID NO: 82322
  chr18:9615430-9615460
  Hypo

SEQ ID NO: 114291 - DNA, 145 bp, Homo sapiens; identical to SEQ ID NO: 82324
  chr18:9707918-9708063
  Hyper

SEQ ID NO: 114292 - DNA, 192 bp, Homo sapiens; identical to SEQ ID NO: 82325
  chr18:9708338-9708530
  Hyper

SEQ ID NO: 114293 - DNA, 673 bp, Homo sapiens; identical to SEQ ID NO: 82326
  chr18:9708733-9709406
  Hyper

SEQ ID NO: 114294 - DNA, 39 bp, Homo sapiens; identical to SEQ ID NO: 82327
  chr18:9720510-9720549
  Hypo

SEQ ID NO: 114295 - DNA, 34 bp, Homo sapiens; identical to SEQ ID NO: 82328
  chr18:9737968-9738002
  Hypo

SEQ ID NO: 114296 - DNA, 59 bp, Homo sapiens; identical to SEQ ID NO: 82329
  chr18:9771710-9771769
  Hyper

SEQ ID NO: 114297 - DNA, 80 bp, Homo sapiens; identical to SEQ ID NO: 82330
  chr18:9797320-9797400
  Hypo

SEQ ID NO: 114298 - DNA, 30 bp, Homo sapiens; identical to SEQ ID NO: 82331
  chr18:9800222-9800252
  Hypo

SEQ ID NO: 114299 - DNA, 30 bp, Homo sapiens; identical to SEQ ID NO: 82332
  chr18:9836107-9836137
  Hypo

SEQ ID NO: 114300 - DNA, 236 bp, Homo sapiens; identical to SEQ ID NO: 82333
  chr18:9912767-9913003
  Hypo

SEQ ID NO: 114301 - DNA, 90 bp, Homo sapiens; identical to SEQ ID NO: 81560
  chr18:10132081-10132171
  Hyper

SEQ ID NO: 114302 - DNA, 30 bp, Homo sapiens; identical to SEQ ID NO: 81561
  chr18:10414395-10414425
  Hypo

SEQ ID NO: 114303 - DNA, 578 bp, Homo sapiens; identical to SEQ ID NO: 81562
  chr18:10454592-10455170
  Hyper

SEQ ID NO: 114304 - DNA, 46 bp, Homo sapiens; identical to SEQ ID NO: 81563
  chr18:10474416-10474462
  Hypo

SEQ ID NO: 114305 - DNA, 30 bp, Homo sapiens; identical to SEQ ID NO: 81564
  chr18:10562257-10562287
  Hypo

SEQ ID NO: 114306 - DNA, 543 bp, Homo sapiens; identical to SEQ ID NO: 81565
  chr18:10589037-10589580
  Hypo

SEQ ID NO: 114307 - DNA, 30 bp, Homo sapiens; identical to SEQ ID NO: 45335
  chr18:10664802-10664832
  Hypo

SEQ ID NO: 114308 - DNA, 149 bp, Homo sapiens; identical to SEQ ID NO: 81567
  chr18:10696211-10696360
  Hypo

SEQ ID NO: 114309 - DNA, 25 bp, Homo sapiens
  chr18:10809544-10809569
  Hypo
tgtgagccaccgcacctggcatctc

SEQ ID NO: 114310 - DNA, 30 bp, Homo sapiens; identical to SEQ ID NO: 45337
  chr18:10832633-10832663
  Hypo

SEQ ID NO: 114311 - DNA, 25 bp, Homo sapiens
  chr18:10906877-10906902
  Hypo
tgtcttttgtcgccttcctgagccc

SEQ ID NO: 114312 - DNA, 89 bp, Homo sapiens; identical to SEQ ID NO: 81571
  chr18:10907451-10907540
  Hypo

SEQ ID NO: 114313 - DNA, 86 bp, Homo sapiens; identical to SEQ ID NO: 45339
  chr18:11009583-11009669
  Hypo

SEQ ID NO: 114314 - DNA, 87 bp, Homo sapiens; identical to SEQ ID NO: 81573
  chr18:11074158-11074245
  Hypo

SEQ ID NO: 114315 - DNA, 36 bp, Homo sapiens; identical to SEQ ID NO: 81574
  chr18:11103949-11103985
  Hypo

SEQ ID NO: 114316 - DNA, 35 bp, Homo sapiens; identical to SEQ ID NO: 81575
  chr18:11148401-11148436
  Hyper

SEQ ID NO: 114317 - DNA, 593 bp, Homo sapiens
  chr18:11148663-11149256
  Hyper
ccgtctatggcctctcgccgccggcagctcgcagccacccgagcatcgcctcggcgcgggccgcgacgctctccgccccgagggcacgctcccggggctcttggccgcccctcgcccaccgggctctgggtagcccctcaccaggctcttggcggccacctagcccggcgcccggccccctgcggccggcccatttagtgtgaatcctggatccggcagcggcggcggcttcttcaggggtagctgatgccggggccttggagagggacgctttgggagggtcctgggaggcggcgcggcgagcaaagggggcaagaagggcgtgctgtgctcccgcctggctcccggggcgtcgtttgggggcggccggggagttttctacttggaagcccctctgaagccaccgcgtctcctttgcccggcctcgtctccgctgcccacgcaggctgccgcgctctggcctcggccccggctctcggagctgcccggcgggctccgggtctcgccctccagcccccaggcggcccgcggcggatccccgagaggcagcgcagctcagcccctgcgccccccagcttcgggccggagagacc

SEQ ID NO: 114318 - DNA, 494 bp, Homo sapiens
  chr18:11149498-11149992
  Hyper
gccgccttgcagcctcgccctcgcggcgcagccggggctccccggcggcgcgcgcttctccaccttcaatgaaactttcgaagccctcactcggggacgggcgtgtcccccggccaatgggatggcggctccggggcctgcgcgcgcggagcccgcccctgagcggctggggaagtgagagccttgcaccggcgcggagggcaagcccccacccgcggctcccgcgcctgggagagacccggcctggcctgccagtgggctgcgcgccttggctcgccctccgcgggcactcctgccccactggctcccgcagccccgcggctctgcgtggttctgtcattccggtggtgcaccctggcatccagtccacccggccgggccctgagcttgcccaaacccagggaaccgtttaaggtccgagggaaacgcacaggcccggcaggagagaagccaggggcttggagagtcctgtgcgaccccgacttctgctgggt

SEQ ID NO: 114319 - DNA, 30 bp, Homo sapiens; identical to SEQ ID NO: 81580
  chr18:11211262-11211292
  Hypo

SEQ ID NO: 114320 - DNA, 30 bp, Homo sapiens; identical to SEQ ID NO: 81581
  chr18:11214264-11214294
  Hypo

SEQ ID NO: 114321 - DNA, 88 bp, Homo sapiens; identical to SEQ ID NO: 81582
  chr18:11232104-11232192
  Hypo

SEQ ID NO: 114322 - DNA, 27 bp, Homo sapiens
  chr18:11263248-11263275
  Hypo
tgtgagccaccacgcccagcctaaaat

SEQ ID NO: 114323 - DNA, 30 bp, Homo sapiens; identical to SEQ ID NO: 81584
  chr18:11378497-11378527
  Hypo

SEQ ID NO: 114324 - DNA, 46 bp, Homo sapiens; identical to SEQ ID NO: 81585
  chr18:11379033-11379079
  Hypo

SEQ ID NO: 114325 - DNA, 129 bp, Homo sapiens; identical to SEQ ID NO: 81586
  chr18:11401631-11401760
  Hypo

SEQ ID NO: 114326 - DNA, 175 bp, Homo sapiens; identical to SEQ ID NO: 81587
  chr18:11430289-11430464
  Hypo

SEQ ID NO: 114327 - DNA, 458 bp, Homo sapiens; identical to SEQ ID NO: 81588
  chr18:11533257-11533715
  Hypo

SEQ ID NO: 114328 - DNA, 173 bp, Homo sapiens; identical to SEQ ID NO: 81589
  chr18:11546891-11547064
  Hypo

SEQ ID NO: 114329 - DNA, 30 bp, Homo sapiens; identical to SEQ ID NO: 81590
  chr18:11571295-11571325
  Hypo

SEQ ID NO: 114330 - DNA, 82 bp, Homo sapiens; identical to SEQ ID NO: 81591
  chr18:11580091-11580173
  Hypo

SEQ ID NO: 114331 - DNA, 39 bp, Homo sapiens; identical to SEQ ID NO: 81592
  chr18:11689795-11689834
  Hyper

SEQ ID NO: 114332 - DNA, 30 bp, Homo sapiens; identical to SEQ ID NO: 81593
  chr18:11749664-11749694
  Hypo

SEQ ID NO: 114333 - DNA, 1372 bp, Homo sapiens
  chr18:11751397-11752769
  Hyper
actgcacaggagaaacgggggctggaggtaaagacaggaggctcgggaggcggcgacgtgggcgagctggaatagtctagaagctgagcagaacaaaggcggtgtgactggtgagcctcggagggatcctcctccctgctagaatatgcatgatcctccgcgagtcttcgcccgccaggagcagggacgcgtccgagccaacacggggcgcgcgcccagacgcactttcccggctcggggtgcaagagagccaggcggccgcggcgcagcggaggggctgcgggcccggaacccaggccggtcagcgtgtaagcgccccagccggccgggctccgtggggggtcagctccctgacccctacagcgcggtagcgcctctccgagagctccgggaccagcggcccggccgcccccaaagccagcctccctctcccttccccgcaccgggatcccagaccagggagggggcgcacgtccgacggctgaggaatagcagggcgcgagccggcccggcaggtgcccatcgtcgccctctgggaccccggtggcgcgctctgtcctccgcgccacgctcagccaccaccccggctgtttgggacccggcacccagccgagcgcgccgccccctcggggacccgctgggcggggctgagcgaggcttggagtgcgggcgaagggacgtggggcgaacccggggcgctgcgccacctcggctgtctccagcggagaccggcgccctcgccccccgtctccgttcattgtgctgtattcatccagcagattttgaaacaattctcgtgtaaaaaggcattttactccgcgcgtcttccttacagccatttagttgggagtttgcggtgggcagggggagggagaagaaacgcctgctctgaatcggaaaacaccgaagagaccagaccatctctttcagcagcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggtaaggccgaggggcgcgcggcggctcccggccccagcggagcgcacagccaggagcggcgagcgccaggctgggcgggcagggccgggcgagggtcgcgcgcacctctgggccgcggagcccagacggcggccggggcgagctcctccagccaggaacccgcgtgtaggaaatccccgtgctgggggagga

SEQ ID NO: 114334 - DNA, 36 bp, Homo sapiens; identical to SEQ ID NO: 81597
  chr18:11822332-11822368
  Hypo

SEQ ID NO: 114335 - DNA, 37 bp, Homo sapiens; identical to SEQ ID NO: 81598
  chr18:11877710-11877747
  Hypo

SEQ ID NO: 114336 - DNA, 20 bp, Homo sapiens
  chr18:11921463-11921483
  Hypo
ctggccgacaggttctaatt

SEQ ID NO: 114337 - DNA, 18 bp, Homo sapiens
  chr18:11942728-11942746
  Hypo
tttttttttttgagacgg

SEQ ID NO: 114338 - DNA, 120 bp, Homo sapiens; identical to SEQ ID NO: 81601
  chr18:11942866-11942986
  Hypo

SEQ ID NO: 114339 - DNA, 239 bp, Homo sapiens; identical to SEQ ID NO: 81602
  chr18:11947249-11947488
  Hyper

SEQ ID NO: 114340 - DNA, 30 bp, Homo sapiens; identical to SEQ ID NO: 16298
  chr18:11979044-11979074
  Hypo

SEQ ID NO: 114341 - DNA, 102 bp, Homo sapiens; identical to SEQ ID NO: 81604
  chr18:11979855-11979957
  Hypo

SEQ ID NO: 114342 - DNA, 168 bp, Homo sapiens; identical to SEQ ID NO: 81605
  chr18:11989272-11989440
  Hypo

SEQ ID NO: 114343 - DNA, 30 bp, Homo sapiens; identical to SEQ ID NO: 81606
  chr18:11995477-11995507
  Hyper

SEQ ID NO: 114344 - DNA, 30 bp, Homo sapiens; identical to SEQ ID NO: 81607
  chr18:12005824-12005854
  Hypo

SEQ ID NO: 114345 - DNA, 19 bp, Homo sapiens
  chr18:12072041-12072060
  Hypo
actccgtctcaaaacaaaa

SEQ ID NO: 114346 - DNA, 30 bp, Homo sapiens; identical to SEQ ID NO: 45345
  chr18:12076093-12076123
  Hypo

SEQ ID NO: 114347 - DNA, 151 bp, Homo sapiens; identical to SEQ ID NO: 81610
  chr18:12208462-12208613
  Hypo

SEQ ID NO: 114348 - DNA, 30 bp, Homo sapiens; identical to SEQ ID NO: 81611
  chr18:12245897-12245927
  Hypo

SEQ ID NO: 114349 - DNA, 301 bp, Homo sapiens; identical to SEQ ID NO: 81612
  chr18:12253591-12253892
  Hyper

SEQ ID NO: 114350 - DNA, 526 bp, Homo sapiens
  chr18:12254104-12254630
  Hyper
tgaccaaaagagacccggggagcatctgggcttccaaggtcctcggtacggcccaaggcagcgaaggacgcgcggctccaggctgcgggagccaggacgaccgggggctcccagagcgcgaagtcgcgatcctcggcggtggagagctcgtgccaaaacgtcctcccctgcgccagtcaggccttcgcggggctggcaggcgggcgggggcggggccgccgcactttaagaggctgtgcaggcagacagacctccaggcccgctaggggatccgcgccatggaggccgcccgggactatgcaggagccctcatcaggcgagtgccccgcgtccccctgattgccgtgcgcttccaatcgccttgcgttcggtggcctcatattcccctgtgcgcctctagtaccgtaccccgctcccttcagccccctgctccccgcattctcttgcgctccgcgaccccgcgcacacacccatccgccccactggtgcccaagccgtccagccgcgcccgcgggcagagcccaat

SEQ ID NO: 114351 - DNA, 167 bp, Homo sapiens; identical to SEQ ID NO: 81615
  chr18:12258116-12258283
  Hypo

SEQ ID NO: 114352 - DNA, 171 bp, Homo sapiens; identical to SEQ ID NO: 81616
  chr18:12287792-12287963
  Hyper

SEQ ID NO: 114353 - DNA, 1065 bp, Homo sapiens
  chr18:12307144-12308209
  Hyper
ccactcccttccaaacgtacaaacatgcacacacacaattaggaatttcccaaagttttcatctgtctaaaaagaaagtgccagtgcaaattacagaacatcgtcgcttcctcatgtgcggcgtttctacgggcctgggaggggacgcagaggctaccccggtggtcccagcctgcagcgttcacgtgaggaaacttccgcaaaagccctgatgcatgcacattctgactgcagaggccagagcatcccgcattttggaggctgaaaggctcccctaggataaccttttccgttaacagaggagtccgctgaagcgcagagctaactgaaaacagctagaattaaaatccaagtcacccggccggcatcagcagtcattcctttccaccacacaaaactggccaggaagacggactctggcgcgccctcccaggccgaagcgcatttcttcgctaacgcgcgaggagtaggctgcatagacccggcgcaggaggtgttcattttcggatccagccctgtagtcactttagctaaacccggttccaaaggggtgggagtcgtcggagaggaatggcctctgtatctccggagacggaaacaccaggacgaagaggccctaagaacgtgtgcccggggtgcgaccggggggtggggggcagggggcagagaccctgaaaagctccaccgccgaaccccagggcagtgtcccggcttggctggactgggcgcgggcggctgcaatgctcccgggcgcggcgctgggaccccgcgggccacgtcggctccgctgccccgacgccagggcccgactcgcgtctccctctggcggggcaccacaaggggcagcgaaacggtggtgggggcgggcgccgcgctccttcccgtctcctccccgccagctccgggcccgtccttttccgcccggctcccggcaagggtcccccgactggcgcccgcgcgtcctccctcggctgctgcaggccgggccgcggcgtcgagcgggggcggcggggcggggcccgcagccattggcgagcggcggggcgggggcgggggcgcggaggg

SEQ ID NO: 114354 - DNA, 30 bp, Homo sapiens; identical to SEQ ID NO: 36912
  chr18:12308897-12308927
  Hyper

SEQ ID NO: 114355 - DNA, 27 bp, Homo sapiens
  chr18:12375267-12375294
  Hypo
ttaggagacagagtccgtcacccacgc

SEQ ID NO: 114356 - DNA, 120 bp, Homo sapiens; identical to SEQ ID NO: 81620
  chr18:12375354-12375474
  Hypo

SEQ ID NO: 114357 - DNA, 120 bp, Homo sapiens; identical to SEQ ID NO: 81621
  chr18:12375952-12376072
  Hypo

SEQ ID NO: 114358 - DNA, 29 bp, Homo sapiens
  chr18:12376132-12376161
  Hypo
ccttacagtgaagacgttgagctgactac

SEQ ID NO: 114359 - DNA, 96 bp, Homo sapiens; identical to SEQ ID NO: 81623
  chr18:12408021-12408117
  Hyper

SEQ ID NO: 114360 - DNA, 62 bp, Homo sapiens; identical to SEQ ID NO: 81624
  chr18:12420148-12420210
  Hyper

SEQ ID NO: 114361 - DNA, 59 bp, Homo sapiens; identical to SEQ ID NO: 81625
  chr18:12657095-12657154
  Hyper

SEQ ID NO: 114362 - DNA, 30 bp, Homo sapiens; identical to SEQ ID NO: 81626
  chr18:12700987-12701017
  Hypo

SEQ ID NO: 114363 - DNA, 30 bp, Homo sapiens; identical to SEQ ID NO: 16300
  chr18:12701811-12701841
  Hypo

SEQ ID NO: 114364 - DNA, 244 bp, Homo sapiens
  chr18:12911076-12911320
  Hyper
caggttggggcaggccgggtggggcccagcgagtgggcgggggcgcgagcgggagcggaagcgggcccgggccgcactgctgccgcgtctagccgcctcccaggctgcctgcgccgcgtggctcgcccccgggacttgccagcagcgagtggggcctgactagctcttcaccacgctccactgcatcggcaagggctggttctgggagaggcgcaagggcatcgacctccgcaccaatcaggtg

SEQ ID NO: 114365 - DNA, 157 bp, Homo sapiens; identical to SEQ ID NO: 81629
  chr18:12949178-12949335
  Hypo

SEQ ID NO: 114366 - DNA, 35 bp, Homo sapiens; identical to SEQ ID NO: 81630
  chr18:13036778-13036813
  Hypo

SEQ ID NO: 114367 - DNA, 19 bp, Homo sapiens
  chr18:13135175-13135194
  Hypo
gaggcgccaagagtgagcg

SEQ ID NO: 114368 - DNA, 28 bp, Homo sapiens
  chr18:13195551-13195579
  Hypo
ttttttctggtgtctcgctctgtcgccc

SEQ ID NO: 114369 - DNA, 27 bp, Homo sapiens
  chr18:13195819-13195846
  Hypo
agccaccgcacccggccaagaagtaca

SEQ ID NO: 114370 - DNA, 346 bp, Homo sapiens; identical to SEQ ID NO: 81634
  chr18:13218173-13218519
  Hyper

SEQ ID NO: 114371 - DNA, 30 bp, Homo sapiens; identical to SEQ ID NO: 81635
  chr18:13219094-13219124
  Hyper

SEQ ID NO: 114372 - DNA, 30 bp, Homo sapiens; identical to SEQ ID NO: 81636
  chr18:13228292-13228322
  Hypo

SEQ ID NO: 114373 - DNA, 119 bp, Homo sapiens; identical to SEQ ID NO: 81637
  chr18:13231199-13231318
  Hypo

SEQ ID NO: 114374 - DNA, 40 bp, Homo sapiens; identical to SEQ ID NO: 81638
  chr18:13233142-13233182
  Hypo

SEQ ID NO: 114375 - DNA, 127 bp, Homo sapiens; identical to SEQ ID NO: 81639
  chr18:13241262-13241389
  Hypo

SEQ ID NO: 114376 - DNA, 102 bp, Homo sapiens; identical to SEQ ID NO: 81640
  chr18:13241775-13241877
  Hypo

SEQ ID NO: 114377 - DNA, 64 bp, Homo sapiens; identical to SEQ ID NO: 81641
  chr18:13277290-13277354
  Hypo

SEQ ID NO: 114378 - DNA, 35 bp, Homo sapiens; identical to SEQ ID NO: 81642
  chr18:13295972-13296007
  Hypo

SEQ ID NO: 114379 - DNA, 115 bp, Homo sapiens; identical to SEQ ID NO: 81643
  chr18:13319261-13319376
  Hypo

SEQ ID NO: 114380 - DNA, 48 bp, Homo sapiens; identical to SEQ ID NO: 81644
  chr18:13369153-13369201
  Hypo

SEQ ID NO: 114381 - DNA, 102 bp, Homo sapiens; identical to SEQ ID NO: 81645
  chr18:13404829-13404931
  Hypo

SEQ ID NO: 114382 - DNA, 33 bp, Homo sapiens; identical to SEQ ID NO: 81646
  chr18:13405710-13405743
  Hypo

SEQ ID NO: 114383 - DNA, 20 bp, Homo sapiens
  chr18:13417718-13417738
  Hypo
caccacgcccagccagtttg

SEQ ID NO: 114384 - DNA, 127 bp, Homo sapiens; identical to SEQ ID NO: 81648
  chr18:13425990-13426117
  Hypo

SEQ ID NO: 114385 - DNA, 52 bp, Homo sapiens; identical to SEQ ID NO: 81649
  chr18:13430352-13430404
  Hypo

SEQ ID NO: 114386 - DNA, 33 bp, Homo sapiens; identical to SEQ ID NO: 81650
  chr18:13432064-13432097
  Hypo

SEQ ID NO: 114387 - DNA, 46 bp, Homo sapiens; identical to SEQ ID NO: 81651
  chr18:13452310-13452356
  Hypo

SEQ ID NO: 114388 - DNA, 111 bp, Homo sapiens; identical to SEQ ID NO: 45355
  chr18:13452723-13452834
  Hypo

SEQ ID NO: 114389 - DNA, 30 bp, Homo sapiens; identical to SEQ ID NO: 81653
  chr18:13457997-13458027
  Hypo

SEQ ID NO: 114390 - DNA, 283 bp, Homo sapiens; identical to SEQ ID NO: 45356
  chr18:13461100-13461383
  Hypo

SEQ ID NO: 114391 - DNA, 156 bp, Homo sapiens; identical to SEQ ID NO: 81655
  chr18:13477773-13477929
  Hypo

SEQ ID NO: 114392 - DNA, 30 bp, Homo sapiens; identical to SEQ ID NO: 81656
  chr18:13485138-13485168
  Hypo

SEQ ID NO: 114393 - DNA, 32 bp, Homo sapiens; identical to SEQ ID NO: 45357
  chr18:13486501-13486533
  Hypo

SEQ ID NO: 114394 - DNA, 30 bp, Homo sapiens; identical to SEQ ID NO: 45358
  chr18:13486818-13486848
  Hypo

SEQ ID NO: 114395 - DNA, 30 bp, Homo sapiens; identical to SEQ ID NO: 81659
  chr18:13491518-13491548
  Hypo

SEQ ID NO: 114396 - DNA, 164 bp, Homo sapiens; identical to SEQ ID NO: 81660
  chr18:13516316-13516480
  Hypo

SEQ ID NO: 114397 - DNA, 30 bp, Homo sapiens; identical to SEQ ID NO: 81661
  chr18:13523082-13523112
  Hypo

SEQ ID NO: 114398 - DNA, 115 bp, Homo sapiens; identical to SEQ ID NO: 81662
  chr18:13531749-13531864
  Hypo

SEQ ID NO: 114399 - DNA, 30 bp, Homo sapiens; identical to SEQ ID NO: 81663
  chr18:13543948-13543978
  Hypo

SEQ ID NO: 114400 - DNA, 30 bp, Homo sapiens; identical to SEQ ID NO: 81664
  chr18:13545314-13545344
  Hypo

SEQ ID NO: 114401 - DNA, 85 bp, Homo sapiens; identical to SEQ ID NO: 45359
  chr18:13583740-13583825
  Hypo

SEQ ID NO: 114402 - DNA, 30 bp, Homo sapiens; identical to SEQ ID NO: 45360
  chr18:13603756-13603786
  Hypo

SEQ ID NO: 114403 - DNA, 30 bp, Homo sapiens; identical to SEQ ID NO: 81667
  chr18:13605780-13605810
  Hypo

SEQ ID NO: 114404 - DNA, 30 bp, Homo sapiens; identical to SEQ ID NO: 81668
  chr18:13621196-13621226
  Hypo

SEQ ID NO: 114405 - DNA, 67 bp, Homo sapiens; identical to SEQ ID NO: 45361
  chr18:13621659-13621726
  Hypo

SEQ ID NO: 114406 - DNA, 237 bp, Homo sapiens; identical to SEQ ID NO: 45362
  chr18:13621998-13622235
  Hypo

SEQ ID NO: 114407 - DNA, 30 bp, Homo sapiens; identical to SEQ ID NO: 81671
  chr18:13645211-13645241
  Hypo

SEQ ID NO: 114408 - DNA, 59 bp, Homo sapiens; identical to SEQ ID NO: 81672
  chr18:13824214-13824273
  Hyper

SEQ ID NO: 114409 - DNA, 289 bp, Homo sapiens; identical to SEQ ID NO: 81673
  chr18:13826303-13826592
  Hypo

SEQ ID NO: 114410 - DNA, 267 bp, Homo sapiens; identical to SEQ ID NO: 81674
  chr18:13836758-13837025
  Hypo

SEQ ID NO: 114411 - DNA, 30 bp, Homo sapiens; identical to SEQ ID NO: 81675
  chr18:13837373-13837403
  Hypo

SEQ ID NO: 114412 - DNA, 33 bp, Homo sapiens; identical to SEQ ID NO: 81676
  chr18:13839105-13839138
  Hypo

SEQ ID NO: 114413 - DNA, 784 bp, Homo sapiens
  chr18:13868546-13869330
  Hyper
agcaagaatgcagcacggagcggagtccaggatgctcagcgtgggcctcggagtctgtgtgcgatcagctggagtccaggatgctcagcgtggacctcggagaccgtgtgggctctgcgctctgcagctgagacacagtcacccgcccgatgggcggagaaaggggcagctttgaaaacaagcgcaaggagatgcatccaaaagacaaccgaacccatcagggtaaggagcgcagcggtggagtgtgagggggaaccagaagggcggccagggccggcggcatgccatgccaggcagccccgcgccaccccggaacactgggacactctcatattcccaaagggacttctccatgcggcgctctgaccaggcatcgccgcaggacgcataacagagagagcgagcgcagggcacccggcccatcagctcttccttcacctgaactgccccggcctcgctgagacgcggattttaaaaccgccctgcacctatgtgctggcagccaggccctgggaacttcctccaaacactcccatgagttcgggatgactagcatcagttttcagctggagagcagacggcaactgaacgctgcgaagtcccacgatggggatgagaggaccagagccccgaggccagtcgcccccctcccgcccatccgcccgcccgcccgccacgcagggctgctctagcgcctgcctcttcctcttccatagaaacagggttggggagagaaatgttatgttgctggcccaggattggcattgagcgttgttcaattaag

SEQ ID NO: 114414 - DNA, 30 bp, Homo sapiens; identical to SEQ ID NO: 81679
  chr18:13886627-13886657
  Hypo

SEQ ID NO: 114415 - DNA, 121 bp, Homo sapiens; identical to SEQ ID NO: 81680
  chr18:13940522-13940643
  Hypo

SEQ ID NO: 114416 - DNA, 122 bp, Homo sapiens; identical to SEQ ID NO: 81681
  chr18:14450326-14450448
  Hyper

SEQ ID NO: 114417 - DNA, 80 bp, Homo sapiens; identical to SEQ ID NO: 81682
  chr18:14450712-14450792
  Hyper

SEQ ID NO: 114418 - DNA, 16 bp, Homo sapiens
  chr18:14475514-14475530
  Hypo
gaggacccagctcccc

SEQ ID NO: 114419 - DNA, 38 bp, Homo sapiens
  chr18:14748159-14748197
  Hyper
gagctgctgctgtaacgctctaacgttagagcagctaa

SEQ ID NO: 114420 - DNA, 44 bp, Homo sapiens; identical to SEQ ID NO: 81684
  chr18:15003453-15003497
  Hypo

SEQ ID NO: 114421 - DNA, 34 bp, Homo sapiens; identical to SEQ ID NO: 81685
  chr18:15017364-15017398
  Hypo

SEQ ID NO: 114422 - DNA, 101 bp, Homo sapiens; identical to SEQ ID NO: 81686
  chr18:15198000-15198101
  Hyper

SEQ ID NO: 114423 - DNA, 120 bp, Homo sapiens
  chr18:15198161-15198281
  Hyper
aaaagcagcggtggcgctgacaaaaagccgcaaaaagcagcggcagcgggggtaaaaagctgcaaaaagccgcggaggcgcgggcgataagccgcggcggcgtggagcaaaaagccgcgg

SEQ ID NO: 114424 - DNA, 85 bp, Homo sapiens; identical to SEQ ID NO: 81688
  chr18:18821400-18821485
  Hyper

SEQ ID NO: 114425 - DNA, 1284 bp, Homo sapiens
  chr18:18821698-18822982
  Hyper
cagagaaagcaattgcgcagaggcgagagcaggctgaatgaacgcgggctccaggggaaataatttttcctcctggcttcgcgcgtcagcacactggggtgcagccctccctcacagaagaccccccccccgcacgaccccctgtacacccccgcggggctgcgcgttcgtctgtgcggcggggtttgggaatggaggcgtgaggaccgcgcatcgagggctccacaggctgggcggggggcgtcgttggaggggggtaggggagaaatgcgcgcccaccaccctcacagagggcgagggacccccaaaagccactcgcggacgccgaggcagcgggaaggcgcgaggcggggcggggggagggggcgcgggggtccccgctgcggaggccagggcgggcgggaggggcagcacctgaggaatccgcctccggctgcggcggccgccgcctcgctccgccccggggaactgagcgcgcggaccgcgcgcctgccagagagacgccagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgagcggccgcggggactccggggcgcgggcaggaggtgagaggtcgcgaaccgggcgcgggagctcgcctgtgaccggcaggagctgccctttggcgggctggacgccctggccgcgcggggaagcgccgcagcggacttttccggagggatgggaagctcagcgggggtgtgagcggagcgcgtgcgggtggcgagggagcgccagtgccaacctgggagccgtgcctgccttccctgccgcctcgcgtcgcccaccgaagggacccggccgtgctgtccgcgcccagaggccgaaggcctgtcaccgggctctactcgctgcctttgtggcgggagcgagacggcccgggggtgggacgagggagctgcggcgcgccgagtagcgcggggtcccccggcggaggcggcgagggggcacctggttcgtctccccgagcccaggggcagtgagggggtgccgggcaggcgggcgggcgacaggtagggcgccgcggaggtggcggggagaggatggatggagttcagcctgggaaagttgagaacgtccagaggtggctgggcgctcgctcggcgtctgtgggtttttttcctcaacaccaaatgtcacttcgtcacgagcgggcg

SEQ ID NO: 114426 - DNA, 292 bp, Homo sapiens; identical to SEQ ID NO: 81691
  chr18:18823194-18823486
  Hyper

SEQ ID NO: 114427 - DNA, 86 bp, Homo sapiens; identical to SEQ ID NO: 81692
  chr18:18939050-18939136
  Hypo

SEQ ID NO: 114428 - DNA, 20 bp, Homo sapiens
  chr18:19181448-19181468
  Hypo
ctggacgagtgagaccctgt

SEQ ID NO: 114429 - DNA, 18 bp, Homo sapiens
  chr18:19191607-19191625
  Hypo
cagcgcctggcccattgt

SEQ ID NO: 114430 - DNA, 30 bp, Homo sapiens; identical to SEQ ID NO: 45366
  chr18:19243727-19243757
  Hypo

SEQ ID NO: 114431 - DNA, 88 bp, Homo sapiens; identical to SEQ ID NO: 36922
  chr18:19748288-19748376
  Hyper

SEQ ID NO: 114432 - DNA, 30 bp, Homo sapiens; identical to SEQ ID NO: 81697
  chr18:19748854-19748884
  Hyper

SEQ ID NO: 114433 - DNA, 37 bp, Homo sapiens; identical to SEQ ID NO: 81698
  chr18:19749409-19749446
  Hyper

SEQ ID NO: 114434 - DNA, 60 bp, Homo sapiens; identical to SEQ ID NO: 36923
  chr18:19749864-19749924
  Hyper

SEQ ID NO: 114435 - DNA, 30 bp, Homo sapiens; identical to SEQ ID NO: 81700
  chr18:19750360-19750390
  Hyper

SEQ ID NO: 114436 - DNA, 67 bp, Homo sapiens; identical to SEQ ID NO: 81701
  chr18:19750739-19750806
  Hyper

SEQ ID NO: 114437 - DNA, 77 bp, Homo sapiens; identical to SEQ ID NO: 81702
  chr18:20109538-20109615
  Hypo

SEQ ID NO: 114438 - DNA, 30 bp, Homo sapiens; identical to SEQ ID NO: 81704
  chr18:20680329-20680359
  Hypo

SEQ ID NO: 114439 - DNA, 135 bp, Homo sapiens; identical to SEQ ID NO: 81705
  chr18:20685485-20685620
  Hypo

SEQ ID NO: 114440 - DNA, 118 bp, Homo sapiens; identical to SEQ ID NO: 81706
  chr18:20716572-20716690
  Hyper

SEQ ID NO: 114441 - DNA, 32 bp, Homo sapiens; identical to SEQ ID NO: 81707
  chr18:20734199-20734231
  Hypo

SEQ ID NO: 114442 - DNA, 350 bp, Homo sapiens; identical to SEQ ID NO: 81708
  chr18:20911344-20911694
  Hypo

SEQ ID NO: 114443 - DNA, 187 bp, Homo sapiens; identical to SEQ ID NO: 81709
  chr18:21163405-21163592
  Hypo

SEQ ID NO: 114444 - DNA, 24 bp, Homo sapiens
  chr18:21164586-21164610
  Hypo
aagaggagggcggatcgctagagg

SEQ ID NO: 114445 - DNA, 39 bp, Homo sapiens; identical to SEQ ID NO: 81711
  chr18:21168942-21168981
  Hypo

SEQ ID NO: 114446 - DNA, 55 bp, Homo sapiens; identical to SEQ ID NO: 81712
  chr18:21242816-21242871
  Hyper

SEQ ID NO: 114447 - DNA, 260 bp, Homo sapiens; identical to SEQ ID NO: 81713
  chr18:21269423-21269683
  Hyper

SEQ ID NO: 114448 - DNA, 164 bp, Homo sapiens
  chr18:21269971-21270135
  Hyper
gcgccttttccttcccgcgccggccagacacccggagaagggatcgggccctttcctcacgcgcgctagtggctccgggcgactgggaagggcagcccccatccccgcgcgcgagggcccacgacccaggagcgatctcgtggaagcaccgcaccggcaccacc

SEQ ID NO: 114449 - DNA, 30 bp, Homo sapiens; identical to SEQ ID NO: 81715
  chr18:21456470-21456500
  Hypo

SEQ ID NO: 114450 - DNA, 144 bp, Homo sapiens; identical to SEQ ID NO: 81716
  chr18:21789694-21789838
  Hypo

SEQ ID NO: 114451 - DNA, 19 bp, Homo sapiens
  chr18:21796452-21796471
  Hypo
agagcgagactgtgtctcc

SEQ ID NO: 114452 - DNA, 53 bp, Homo sapiens; identical to SEQ ID NO: 81718
  chr18:21808513-21808566
  Hypo

SEQ ID NO: 114453 - DNA, 540 bp, Homo sapiens; identical to SEQ ID NO: 81719
  chr18:21977137-21977677
  Hyper

SEQ ID NO: 114454 - DNA, 32 bp, Homo sapiens; identical to SEQ ID NO: 81720
  chr18:21978002-21978034
  Hyper

SEQ ID NO: 114455 - DNA, 35 bp, Homo sapiens; identical to SEQ ID NO: 81721
  chr18:22006639-22006674
  Hyper

SEQ ID NO: 114456 - DNA, 162 bp, Homo sapiens; identical to SEQ ID NO: 81722
  chr18:22006877-22007039
  Hyper

SEQ ID NO: 114457 - DNA, 47 bp, Homo sapiens; identical to SEQ ID NO: 81723
  chr18:22136813-22136860
  Hypo

SEQ ID NO: 114458 - DNA, 102 bp, Homo sapiens; identical to SEQ ID NO: 81724
  chr18:22596688-22596790
  Hypo

SEQ ID NO: 114459 - DNA, 18 bp, Homo sapiens
  chr18:22736912-22736930
  Hypo
agaactttaagaggccga

SEQ ID NO: 114460 - DNA, 30 bp, Homo sapiens; identical to SEQ ID NO: 81726
  chr18:22756643-22756673
  Hypo

SEQ ID NO: 114461 - DNA, 30 bp, Homo sapiens; identical to SEQ ID NO: 81727
  chr18:22782434-22782464
  Hypo

SEQ ID NO: 114462 - DNA, 100 bp, Homo sapiens; identical to SEQ ID NO: 81728
  chr18:22799423-22799523
  Hypo

SEQ ID NO: 114463 - DNA, 30 bp, Homo sapiens; identical to SEQ ID NO: 81729
  chr18:22805066-22805096
  Hypo

SEQ ID NO: 114464 - DNA, 19 bp, Homo sapiens
  chr18:22900421-22900440
  Hypo
accgcgcctggcctaaagg

SEQ ID NO: 114465 - DNA, 2389 bp, Homo sapiens
  chr18:22928965-22931354
  Hyper
aatgctcagaagctgcgagtgaacaaaactgccaatcgtgcaaactttaataaacttttttttttttgaaaagaaaaatccctcccaaattccttcacggggtttcagaagcttcttggagccctttccaccggacaggcactaaccgctatcctacttcaactcggaaagttcttctttccaagtgactaggaagaggtttgtcctggtacttcgctcagcgttactttcaagaaagccggggtctcgggcaagtctcgccggcgcgagcctggtccaccgttaccctgacacccgcgcacgcccgtggcgtttcttttttcactgtcgacacttggatctttcaggccctgggtctaggtttcccccagaaaaatgaggggcccatgtgacggaaaccaccagacacactgtgtggagacacatgccaatgattcacctcgttcccgaactaaaacttctgcgctttaggaaaaaagcaagcgttccaatctgcgaggccctcccccaccccgtcccttcccaggagaagaaagaaagggctttgtgtgtgcggtgagggctccgttcatcgagttcaaaaatgcacagcggccgggggccgggaggcgtggggcgccgggccctgcccaccccttttccccgggccggcggcgagtcgggaagctggtgcgggaaccggggccacggggcgccgcggcccggcagccaggaggaagaggatgctgcgccgccggggaccagagggcggggccgggccgcgcggacctcggcgggacccagcgggcccgggcgggcgcaccagccgccctttgtcctccgcctccgggtcgcgggggccgcggccgcctccagcgctggccccctggccctcgccccggttccccgtcctgcccgcgcgcccctcctccggccctcgcgctccgccgcccgccctccccgctctccgcctcggagcgccggacctcgcggctcccctcggccgcccgcccccgatttcctcggaaggaggctcgcgaaggtggaggaggcggccgaggaggaggaggaggccgccacgtgactctcctcgccacattccaacacagccatcagatcgataacttcagggacccccgcccccgccgcagccagctagtgcgcccccaaaatcccgcacgcacgccccgcaacttccctctccaacagggacgacggagagctggaccccaccgcgaaacgcaaaggactccaggggcggcggggagaagtaggggcgaggggcggtcaacttctgggaatggccaagaggggtgctctgaggcccgagccggggtccggtgcccgcggccggcggccggggtctgtttactccggcgacgtgcggagaggacccaagcaggacgcgggcgggcgggaggcggcggccgggaccccgggccacgtttgtcacgagcgggggctgctccccacctccgagatgacttttttcttcttccaaagaaaaggaaaaaagaagcaccgcacggttttgcatatttattctttgcgaaaacacacaacagaaactttttcctccagcccagatgtagatctcagacgggatatttttttttcctccctctccggataatttcgtttctttctctctctctctctttttttttttcggttgttgttgtcttttctcgcccactttctaccgccgccccattcggggatcctcctcccgtcttcgtctccccccaccccgacacctcaccctcactccacctaggggctcagcggggaggggagcgcgcgcgcccccgcactcacactcacactcacgcgcgcacacgcctcgcagccacgcagccctcgctccgctacccacagtgacactcgcggatgggggaaagcggggagcagggggttcctccttacctttgagggatctcggtttcgcttgcttgcggcgagacatcctaaaagcaaacagctgaagttgtttcaattcagccctgaaagaaactatacttcctcgtggccgcgcgcccctcgggccgcggcgcctcgcgccctccgctcggcctccctcgcgccctcgctccgcgctccgctcctcgctccggctccggctcgcgctcgcgcgcggggctcgcggctgcccgagctccgcgctctgcacgacggcggcggcggcggcggcggctgctgcaccaaactttcccagccttcgacccccacccccaatctccaagaaaaaaaaaaaaaaaggaaaaagaaaaaaggaaaggagggaaaaaaagctaaaaaaaaaaccccaaagacaatgtttgaagagccgtcagctacactaaaaagagaaaatccgttactatttccacctcaatcaaaattcacatagttcatgcgaatagaaaaaaac

SEQ ID NO: 114466 - DNA, 30 bp, Homo sapiens; identical to SEQ ID NO: 81735
  chr18:23686462-23686492
  Hypo

SEQ ID NO: 114467 - DNA, 94 bp, Homo sapiens; identical to SEQ ID NO: 81736
  chr18:23745191-23745285
  Hypo

SEQ ID NO: 114468 - DNA, 40 bp, Homo sapiens; identical to SEQ ID NO: 45369
  chr18:23841433-23841473
  Hypo

SEQ ID NO: 114469 - DNA, 531 bp, Homo sapiens; identical to SEQ ID NO: 81738
  chr18:24127654-24128185
  Hyper

SEQ ID NO: 114470 - DNA, 800 bp, Homo sapiens
  chr18:24130387-24131187
  Hyper
acgctgctggtcctccgcgtgcctgcccggccctggacgccacccgagcttcggggaaaccgcgccaggtgtgaaacaagttagagcaagtccctgcctcgcgggccgcctccggctccttagggaaacacaagacacacagacacacacacacacacacacacacacacacacacacacaccacgctctcatccgcccggctctccgcggagaaccgtccgggaatcgtccccgaggtgcggcgcgggaggtggccggctttgttcacaatgcactgcccgccgcacccgccctggacacgtgcagaaaggcgtgctcgtttctccgaggctgcggtgagcagctaagttagttgcacactgggacccccacatacgagctggcacacactagtcacacacggctaattccagagggctggccctttgtcctgggacgctcccaggttttcgggccgcggtgcggagaactcaggtgggtgcccggcaagttacctaccaggggctgttcccccgcgaccctcgccataagcgcagggacccgggggccgcgctggctccgggctgcgctcctggcttggcaggggaccaggcccacgctgcagcctgggagcggagccgccccccaggtctccccacctctgcgggcggcggggtccacccccctcccaccagctcccctccctactgggcgagctgctttgaattgctcgcagtttgccggaggcggtgtgctgggttggacgctccgggaaacaaagcaacccaaaacagctcccagttgacgtcaacttatttcc

SEQ ID NO: 114471 - DNA, 30 bp, Homo sapiens; identical to SEQ ID NO: 45370
  chr18:24465773-24465803
  Hypo

SEQ ID NO: 114472 - DNA, 553 bp, Homo sapiens; identical to SEQ ID NO: 81743
  chr18:24764615-24765168
  Hyper

SEQ ID NO: 114473 - DNA, 43 bp, Homo sapiens; identical to SEQ ID NO: 81744
  chr18:24765377-24765420
  Hyper

SEQ ID NO: 114474 - DNA, 36 bp, Homo sapiens; identical to SEQ ID NO: 45371
  chr18:25089977-25090013
  Hypo

SEQ ID NO: 114475 - DNA, 798 bp, Homo sapiens
  chr18:25755242-25756040
  Hyper
tagttctgaaatccccgagtcaggagagagccgagtggcggatggcgagtgggggaagggagaaagaccggtaggagactaaagaacaaaagaagaaatccaagaaagggaaaaggaacgctgggaccctggcctgggaggcaggggtggggagagacaaagtgagagagcacgacccgggaggagagcgtggagccgggcagggacaggcgtgccgcaccatggcgcaccatggacagggctccgcgcggcggcggcccacgaccgtctaggggttgcgggagaaagcgcgagagactgcggaggccagccccgtccagcccctgcccccgccccagcagcactcaccccccggcgggccggagcgcgccaggccctgacccgtgaagaccacggagcggggtaatccacaccacctgtctccacccccggagcaggcacttccgagctgcgtccgcacttttcggggctgccagctggcagtagagcacctctccccttgccccgagggcgacaggcagggggaccctccgtggattttcctgccccgcggcgagggtgggcacgcccctttcccgcaaccttcgagggaccccacggcaggcggagaccgacttgggaccagggcactgcacccgcccagctagagggtcccggccgaggctgtgtgaagtggcctccaggcctgggctggctggtcgggaggagcctgggggcatcctcgggttggaggcggcggaaagttgggctgcccccgggctgggaacccgcagcgtgcagtggcgagggaacctgcgc

SEQ ID NO: 114476 - DNA, 351 bp, Homo sapiens; identical to SEQ ID NO: 81748
  chr18:25756635-25756986
  Hyper

SEQ ID NO: 114477 - DNA, 1234 bp, Homo sapiens
  chr18:25757253-25758487
  Hyper
gagctggggagggggcgggggaacagggagggagagcgtgtgagcgtctgcgagtgtgtggaggcggctgctgtggcagcgcaggcggctcggctccggcccggagcgcagcggaagccgcgagggatgcagcggcggggaccttggccggtggaggatgtggaggtggaagtggagcggatggcgctccccaagagctccgccacgcgaggtttcgggctcgtggttttgcttcctccgggtccccgctccagggccgctcggcgcgacgaagacgccggggacagcgccgcggggagggcgctccgggtcgtgcgtgctgcacccacaaagagcagcagtcccgccactccgcgcctccgctgcgtgggggccgaggggcgcttctcggctcctctttccggtcccccggcgagttggagactgttctccggcctcggccgcaagggggtgaggcgaggggccggcgcggtctctcccgccgcggctccgtcccgcgcagctgctgccgcagccgcccctgctgcccgcgcaccggcacccgcccgccggtcctcgccctgcgccgctcactcgcgcgcgccgccctccgtcgccgaccgcgcaccccgctcggcctccgctgcgcgacctgggcgagccgccgccgctctccccgcgctcgccccacgcgctgcctggctgcgcggcccgctcccctctcctattcctcccgccgccgccgccgccctcgcccccgcctccctcctccgccgagcctccccgcccgcgtcgtggccaatcggaggccaccaagctgcggctgtagccggccggatccgcggcagccgcccgcccccgccccgccgaagcgccccgtattttgctgcagcccgcggggggtcgccggagggaagcctagagtgcgccgagcaccgccccggcaggtggaggggctgcgggaaataaaataacttgggcaggaacttgattggtagcaggttcatctttggtccgcggtagggaatctaatggagatgaagaatggtggggaagggggggcggtgtctccttgggagcctaacgtacgcttctttattttgtcattctttggagatgggtaatctttcctggcaggggcagacacagcaaactaaggacgcaggccaagctcatcctagctattgttgtctgaggcgctcgccgggagccacctgcgggcgggggagggcggaggccgcggctcctctctgga

SEQ ID NO: 114478 - DNA, 345 bp, Homo sapiens
  chr18:28620831-28621176
  Hyper
gttaatttacccatccggtccgaaattgcaagtgtttgtaaactgacaattgcagatgaaatagtcattttctgtgcactttccggtatttaagtctccagatacagcatttaacctaaactcaacggaattattttaaaaaaaaaaaatcttaaacgagtatgtgctagatcaaagctgaagcttcctccgtttagatttacgcgcaccttcttccttgccacagctcgacacccccacccatgccttgccgggaaagctcctggtcttccatggcctctgggagcctcgagcgaatgcgagaaattctgagagcagcacccgtagtttcgttccccatcctca

SEQ ID NO: 114479 - DNA, 655 bp, Homo sapiens
  chr18:28621474-28622129
  Hyper
gaagcagtaagaatccgcgagaccagactcggctcactgccgacgcgggtatagacctcgctcccatcggaccccatgcgcatccatggatgcgggtaagtcgcgggtccgcggctcctttctgggcgtgcggaatgaaactctgttgaagcctgaagcttcgcgtgtaaccgcgccgccagagttccgaacacttcaagtctcccgtgttctcagagcatcgtctctaacttcctctcctagaggatttcgtcctgggcggcaggtttccgtagactcgaaaccccaggctgtgctccggccgcgcagtcctccccggagccggagtaagtacgacgcaaccccaccgcatccatcatcccccaccactgtcaccctctacccgcctccacacctcggcagcatccccaaaacacaacacgaccccaacccccattctggcccggtcttcccacactttcgcgcccccggcacatcccgcccccagctgggtggctggcgggggtggaccgcttgggtgagcttctgaataccctttaggggagataccgagaaacccacttctcaggggcagccccaccaagggacccagggacacagccccggctccactcactaacgaaccaatccgggtcaactgcgacccagagctggg

SEQ ID NO: 114480 - DNA, 455 bp, Homo sapiens; identical to SEQ ID NO: 81760
  chr18:28622419-28622874
  Hyper

SEQ ID NO: 114481 - DNA, 149 bp, Homo sapiens; identical to SEQ ID NO: 81761
  chr18:28681064-28681213
  Hyper

SEQ ID NO: 114482 - DNA, 35 bp, Homo sapiens; identical to SEQ ID NO: 81762
  chr18:28681994-28682029
  Hyper

SEQ ID NO: 114483 - DNA, 124 bp, Homo sapiens; identical to SEQ ID NO: 81766
  chr18:29078131-29078255
  Hyper

SEQ ID NO: 114484 - DNA, 35 bp, Homo sapiens; identical to SEQ ID NO: 81769
  chr18:29521127-29521162
  Hypo

SEQ ID NO: 114485 - DNA, 157 bp, Homo sapiens; identical to SEQ ID NO: 81770
  chr18:29599667-29599824
  Hyper

SEQ ID NO: 114486 - DNA, 58 bp, Homo sapiens; identical to SEQ ID NO: 81771
  chr18:30349723-30349781
  Hyper

SEQ ID NO: 114487 - DNA, 1012 bp, Homo sapiens; identical to SEQ ID NO: 81772
  chr18:30350062-30351074
  Hyper

SEQ ID NO: 114488 - DNA, 43 bp, Homo sapiens; identical to SEQ ID NO: 81773
  chr18:30351356-30351399
  Hyper

SEQ ID NO: 114489 - DNA, 30 bp, Homo sapiens; identical to SEQ ID NO: 81774
  chr18:30351670-30351700
  Hyper

SEQ ID NO: 114490 - DNA, 344 bp, Homo sapiens; identical to SEQ ID NO: 81775
  chr18:30351913-30352257
  Hyper

SEQ ID NO: 114491 - DNA, 30 bp, Homo sapiens; identical to SEQ ID NO: 81776
  chr18:30781529-30781559
  Hyper

SEQ ID NO: 114492 - DNA, 531 bp, Homo sapiens
  chr18:31020324-31020855
  Hyper
tgggaaactggaggacggagaacagggggacaaaacgactgggggactggggaattatgggactggggatttggggaattgttttcaaacgcgcggggcaaggactccccaccgcctctggaaggggtgaagaactagtcgactctaactccctcagggtggccagggaattgcatttggttctcccgcgggagtcgcgcaggcgggcggccagggggagtgggcgccgcccggcagcgccccgcgccgaggcacaagcgcccgcgccgaggcacaagcgcccccgactcaccggctccgcgcgtttccccgcgcgtctcccggacccgcgcctgcccacccctccggctctgctgcggtcgaggccccaagtcggttatcccgtgtccaggcaaccgcgggggcggcggcggcggcgtgaggagcgggcggctgctgctccggggcctcctggctcgagcccttagcccccgactcccggcgtttcggcgcccgatcagcgctccaggccgcccccgctccgccttctcc

SEQ ID NO: 114493 - DNA, 97 bp, Homo sapiens; identical to SEQ ID NO: 81778
  chr18:31157850-31157947
  Hyper

SEQ ID NO: 114494 - DNA, 561 bp, Homo sapiens; identical to SEQ ID NO: 81779
  chr18:31158489-31159050
  Hyper

SEQ ID NO: 114495 - DNA, 632 bp, Homo sapiens
  chr18:31739032-31739664
  Hyper
ctgtttctacttcagcggcggcggctggagcagcgggtacaggtgaggttgccctggcggtgtccatagcaacgctggagggggtggcagggagaaaggcgccctccaccctgtcagcctcctcctcgcctcccccgacctgcaggcgcgctaagcgctccgggcgccgcgctccgcgagggggagcagtgctcccaacccgcgaccctccgcctcagacatcacagttgccgcggcaacggccggaggaggaaggccaaggcttttctcccgctgacgtcccccgccaccagtacccagagtgctggggcctggatgagatctgcgtccgcttcacccgagcatgagcttgggtctctcggaggagcaggagacgcgggctcgaagccgcgggcctgaccctgatccgtggatgccgccgccgccttctcctcccctgggtggtgggggacagggcctgggaggcacggtcacgccgagtttgagcacgtgaccttccaagagcttgagagtcccctagagagcaggccccaccccaatccatcccgcctcgccggaggggtccctctggctttagtccttctcttctaattccctgtatgtcccgacccgaccaacggcagcacactctc

SEQ ID NO: 114496 - DNA, 329 bp, Homo sapiens; identical to SEQ ID NO: 36954
  chr18:31802052-31802381
  Hyper

SEQ ID NO: 114497 - DNA, 427 bp, Homo sapiens; identical to SEQ ID NO: 81784
  chr18:31802675-31803102
  Hyper

SEQ ID NO: 114498 - DNA, 338 bp, Homo sapiens
  chr18:31803302-31803640
  Hyper
cacgttgcagggatgcgaggtcccggccgcagcgggagcctgctttgggtgggggaagggatgggaagaggggaggagggtccggttgggcaccagcaatcaatgccccgtgctaccaagtctggtccattcgtaattgcaacggctgtctcggacgtttttcctgttcccttagcggtcggtctctttaatattttgtgaccaggaccatcccaacaccattctggcccagaggagctgggttttcaataattaaaatcccattccttggtttattaaaaatcccaatattgaattggggtggtccctagacgcctcgcccccgggctgcgtccggg

SEQ ID NO: 114499 - DNA, 30 bp, Homo sapiens; identical to SEQ ID NO: 81787
  chr18:31804123-31804153
  Hyper

SEQ ID NO: 114500 - DNA, 335 bp, Homo sapiens; identical to SEQ ID NO: 81788
  chr18:31804809-31805144
  Hyper

SEQ ID NO: 114501 - DNA, 183 bp, Homo sapiens; identical to SEQ ID NO: 81789
  chr18:31902672-31902855
  Hyper

SEQ ID NO: 114502 - DNA, 1058 bp, Homo sapiens
  chr18:32073235-32074293
  Hyper
cgggggaggcggatgaggaggatgagatcatagtttcaggatcctcaggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaaggtgtgtgcacggcgttttcttctttgacagctccggagtgggggagggcgcgggggtggagggggtccgtgtgccgggcgaggagtgggcgcgaggccgggctgccgcgctgcccccggccgcccggtgcagaggagcccgccgcggggcgggaggtgcacatgacgcgcagccccggctgcgcagggaccgcagccgcccacggcgccggggcgcggacacaggcggctcggcgctggagcaagggcaggcgccgcgcaccgagcaaagtcaagagtggaagcgggcggagagcgccggcgggggcagggattcgcctcaacgcccactcacggggttcccacctgtgcgccggcgccggccgcggctagcgcgaagcatgtgccgggcgccgcagccaggactgcggcgcggcgcctccccgggcggcgggcggcgcctcaggcccgcggggcggcggtagcggctgctgcaggatgtccggcccgggggcgcggggccgcgcaggtaaatctcccccgccctcgaaggccttcgcagcgccgcagcccctgctgctgccgcggcgccgctcggggggtggctatggcagccggctccttcgcgtcgcgggttgagttgttttcgttgtggtcgctgccctcttggtcatcctctcgggctgagctggtgggaggtggagtgtctacctccattagggatgatactcacgtcggggaacagtctgaggggtactgactgggacatccgcgttgggttcctttgcagccagcggcgtcctttcgtgttgcagtgcactgcggtgcccgggccga

SEQ ID NO: 114503 - DNA, 75 bp, Homo sapiens; identical to SEQ ID NO: 81793
  chr18:32557928-32558003
  Hyper

SEQ ID NO: 114504 - DNA, 146 bp, Homo sapiens; identical to SEQ ID NO: 81794
  chr18:32957667-32957813
  Hypo

SEQ ID NO: 114505 - DNA, 30 bp, Homo sapiens; identical to SEQ ID NO: 81795
  chr18:33078363-33078393
  Hypo

SEQ ID NO: 114506 - DNA, 29 bp, Homo sapiens
  chr18:33078633-33078662
  Hypo
ggcgtaagccaccacgcccggccggttct

SEQ ID NO: 114507 - DNA, 140 bp, Homo sapiens
  chr18:33529995-33530135
  Hyper
gcgtctggctctccacgccaacccattctgcccgctgactgcttgagtcctaagcccgacgaccctgccccagaccctggagacgctggacgctggctcacctggatcccactcagacccgggcgcgggctcacctggtc

SEQ ID NO: 114508 - DNA, 487 bp, Homo sapiens; identical to SEQ ID NO: 81799
  chr18:33767425-33767912
  Hyper

SEQ ID NO: 114509 - DNA, 171 bp, Homo sapiens; identical to SEQ ID NO: 81800
  chr18:33876948-33877119
  Hyper

SEQ ID NO: 114510 - DNA, 52 bp, Homo sapiens; identical to SEQ ID NO: 81801
  chr18:33877877-33877929
  Hyper

SEQ ID NO: 114511 - DNA, 260 bp, Homo sapiens; identical to SEQ ID NO: 81802
  chr18:33878296-33878556
  Hyper

SEQ ID NO: 114512 - DNA, 68 bp, Homo sapiens
  chr18:34823783-34823851
  Hyper
agtctctggagcaagcgtggaaggcgagtgaagcggaaggtgagtgaagcgcgcgcagctcccagagg

SEQ ID NO: 114513 - DNA, 991 bp, Homo sapiens
  chr18:34833539-34834530
  Hyper
caggcccatttctgccggggtgacggcagctctgcgcctggcccgaggagcagggcgaggagcaggttgagccgggcgcagcgggtccaaggcaccagtgagggtccggcccacggaggccggaggaggcggcgggtccgtctggttccctcccaacccccgtccccgcgccccggccgcccccggttacctgtgcgagtcctggtctcccccgggggacgctcccgccggcgctcagtacgggcgattggcgtctttgggccgcttcagctgcaccttgagcctcttcatgccgatctggaagccgttcatggcctggatggcggtctgcgcgctggccgggttgtcgaagctcacgaagcctggcgagacacgagggacgagggcctgggtttccacggggccgcccggggcgctgccggcggggaggggtcgggggacaggggggcggggcgggcctgaggctctccccctcgggccccgcccccggccccgccccggtgcccgcccctctccagcccgcgcgcgcgtgctaggcccctccgggggcaggcgctggcggggacccggctcgctgacctgcgcctagtctctggccgcgtcactcgcccggcgcccgctccccaagtggggcccgcggccgggcggcgctgggagaggcgcccgccccccacccccgccggccccggcacctcagccctcgcctcggcgggagagggcggacacacctgcgggtggaggagtttattggacactgtcctccctgacaggagggggcctggcagcgcgcgggcacagggtgccggcctggggagagagacgagtgcgaggggccgggagggaggcgccgccgagaaacttctccaccgccggcccggccgcccccctcgccaccgcaggtgcccggctgtcggaggaggcccagaggctgagccctcgcgggccctccgcccccactcccggcctctgcccgccccgccaggctccgggt

SEQ ID NO: 114514 - DNA, 30 bp, Homo sapiens; identical to SEQ ID NO: 81806
  chr18:34842164-34842194
  Hypo

SEQ ID NO: 114515 - DNA, 38 bp, Homo sapiens; identical to SEQ ID NO: 81807
  chr18:34855289-34855327
  Hyper

SEQ ID NO: 114516 - DNA, 454 bp, Homo sapiens; identical to SEQ ID NO: 81808
  chr18:34973974-34974428
  Hyper

SEQ ID NO: 114517 - DNA, 1007 bp, Homo sapiens
  chr18:35064851-35065858
  Hyper
ctcccccctcaccaccgccccatctctctgaacccacaggagagaccgcgcagacccttgacccgaagaatacttcttattttatggtgatgaactagcctcgataatagccatggctgatatcacacccagttaggggggccataaataattctcttctcccccgcacagaagctataaaccagggccgaggcgcgatagtttatcaaagacgagggctggctccttaaataaaccgcggtgatctcacttgcggcgccccctcccacgccggccccctcctcccccactagagcggcccgcgtcgactcgatgggcggactcgatcgcgcacgcggcccgcgggcccggcggaggcagctcccgctccggggacccgggacgcgccgctcccccgccccaggctgcccgcgcaggaacttcacggccacggccaagtggggcccctgtcccggatcccgttgggcccggacggccgagagcccagggatttgggggggcgcgcgggctcccgagctcaggcggggcggcgggcgccctgccgtcctctccccgcgcgccgcgccgccgcccggcctcccgaagtcgccccctgtcggcgcgtcggccgcttgcgccacggcgggcgccacttaccccgggcagagtcttctgctcgtgcagcgcgctctgggccttcagcgctgactcacgctcgcagtaggtgaggaaggcgcagcctggggaggaaagcaagcgccaagaagggtcagtggggcgcccccgggcccgccgacgcgccctgccgcccgccctccaggctcccgcccctccctgccgctcggtccctgtccccacctctctttctctcccgtgcactgttctcggagcttctctgcctctcggtgttcccggctgtctgcctctcgtacctccctttgcttttctattttgctccctccgcggagtctccccaccctgcatcttccccccaccacacccccctctccttacggttctctccttac

SEQ ID NO: 114518 - DNA, 61 bp, Homo sapiens; identical to SEQ ID NO: 36967
  chr18:35067550-35067611
  Hyper

SEQ ID NO: 114519 - DNA, 527 bp, Homo sapiens
  chr18:35104518-35105045
  Hyper
ccaaaggtaaattttcggccggcggggcagccccggagcgggaagatccacaccgcggagcagccgtaggaaatattgatattagccgacctctggcgccgtccgcccgcggtgaaaataagacgcggggccaatcaattaccgagccattaagggcgggaacgcggagggagcggcccacagcccctgctccccagccgaacatcccccgagccgcaggccgctggggtgcgcagctgcgctctacgccctccgcgccccggccgcggctcccggcagcgaccgcagcgcccagcaggagaatggggcgcagccgggctgggctggggcgcgggggtcgcggcggctgcgccccagtcccgagctcggtttcccgcttcgctctttgagccccgcttcctctccctgaagcgtctcgccctcggccctccctttcttctctctccgcctgccctcctcccttctcctttgttaaccacctctctttcctaggggcctcttgcttggccagccgaccacccttctgg

SEQ ID NO: 114520 - DNA, 989 bp, Homo sapiens
  chr18:35144820-35145809
  Hyper
tctctcccttttagacggctgcgctcctgctactctagcccggagcaaaggatgaggagaccacctcctttagtattttcagcaccacggcgatggacagcaccctcggtcctcggccggccaggagcccgcgagtccgtccgctcagcgtcctgggctcgaccggtgcagccttccccatccccatctttcaggtcgctgtacccaaaaatccaagccccgtctcctcgatcccctctctctttctcttcatcggcgcccgctgctctctccatggcatcgttcctatcagcacctcgcccaaaacccagtcttgccccagcgaacagctccccacgcaccccagctctggtctccgctgcccgagcgcctccctccaccgcgcccgcccgaggcttcctctcgcttagtccgccgctcgtcagtcgccggccggccggtcggcccgccagcccgctcctgctccccggcaaagttgggagggaaaggtgtactcacctttgtgcatgcctgtgaacctgtccttcagaaccgtaagctcgtagattttgccaaactcctcgaagaggggcttgaggtccttctcatccaggttgcgggggatctgcccaatgaacagcttgatggcatcgtggtccttcatgggaatggtcgacgggttccccgggctgtggcttaatccgttcatgtgcccggcactgcccgggctgctgccgagcccgttggtactgaggcttgcgttgtcagcctgtccgtttgctaacgtggccatctttatatacatagagaaaatcttctttccttttattctttctcgctcacactctctcgctcctctctctcgctcgctcgcgctcacacacgcacacgcatacacacactcgggttctctccccctcggtttctctacacctcgctctccgctcgctctctgctctctctctttctcctcttctctcgctcgctcgcgctcgcgctctctctctgct

SEQ ID NO: 114521 - DNA, 139 bp, Homo sapiens; identical to SEQ ID NO: 81817
  chr18:35146102-35146241
  Hyper

SEQ ID NO: 114522 - DNA, 597 bp, Homo sapiens
  chr18:35146652-35147249
  Hyper
agacaagagctctctcgcgcgcgctctctccctgtctctctgtgtgtgtctttctctgtttttttttcctcctcgcacccccaacctgccagagcagccccacatcttcctcccgcccggcatctaccgccacccaagccacctgccaggatggggctgggagctgtcgggccgcgccggggggcagagggacggggagtagagactcggggtccgacccccgccccaacccgcttccgaaggcggaaggtgggggtccccgtcccgggcggcctcccccgccccggagagcgcggctggtcccccggtggctggcgggaggaaggtaggagtcgggcgcccctgcccgctcgcccgccggagggggaggaaggcgctgggcgcggtggccggtgagccagcgcgggggatggcttgatttgccctcgtctgctttacgggttcaaatagaatatatttttttaatcaccatcaaaagaataaagcccctgaatcgctatctgggttgccgccggaccgagactcgcgcggcgtgcgctgcccccgcgggtttcgttttcggcacctacagctcccgaggtgcgaggctgagtcgtt

SEQ ID NO: 114523 - DNA, 419 bp, Homo sapiens
  chr18:35147449-35147868
  Hyper
tatttacctgcaccccgtcctctctcatgtttgctttttcagggcagcctcttcgcttcagaagcctggcaaattgaaataacgcgcccgctcccccgcgggctgcggggctggggagctggggcggcggggctgagcggctggcctaacccccgccggccctcggctagccactttcgggtttcagggtttctcttttcttgccctcggattacattacgttactagaggatatgtctgcaattttaattaaagaaatgagaccccagctgcctgcaaacccaggccaaccccatttggtacaagcacaatacggagctctccagcgccggaggaggcccggaggcccgaggttcgcagccccaggccccgagtccgctcaggacgcctctctctgaggatcccgggcccaaaccaaa

SEQ ID NO: 114524 - DNA, 217 bp, Homo sapiens; identical to SEQ ID NO: 81825
  chr18:37421625-37421842
  Hyper

SEQ ID NO: 114525 - DNA, 30 bp, Homo sapiens; identical to SEQ ID NO: 81827
  chr18:38952391-38952421
  Hypo

SEQ ID NO: 114526 - DNA, 30 bp, Homo sapiens; identical to SEQ ID NO: 36978
  chr18:40857392-40857422
  Hyper

SEQ ID NO: 114527 - DNA, 83 bp, Homo sapiens; identical to SEQ ID NO: 81830
  chr18:42259738-42259821
  Hyper

SEQ ID NO: 114528 - DNA, 142 bp, Homo sapiens; identical to SEQ ID NO: 81831
  chr18:42259941-42260083
  Hyper

SEQ ID NO: 114529 - DNA, 30 bp, Homo sapiens; identical to SEQ ID NO: 45372
  chr18:43254053-43254083
  Hypo

SEQ ID NO: 114530 - DNA, 15 bp, Homo sapiens
  chr18:43325220-43325235
  Hypo
cgactgtaggttgtt

SEQ ID NO: 114531 - DNA, 45 bp, Homo sapiens; identical to SEQ ID NO: 81835
  chr18:43545729-43545774
  Hypo

SEQ ID NO: 114532 - DNA, 30 bp, Homo sapiens; identical to SEQ ID NO: 81836
  chr18:43651623-43651653
  Hyper

SEQ ID NO: 114533 - DNA, 172 bp, Homo sapiens; identical to SEQ ID NO: 81837
  chr18:43651956-43652128
  Hyper

SEQ ID NO: 114534 - DNA, 20 bp, Homo sapiens
  chr18:43779297-43779317
  Hypo
tgagatggaatctctcgctg

SEQ ID NO: 114535 - DNA, 1241 bp, Homo sapiens
  chr18:43913367-43914608
  Hyper
agcctggggagtgtgcgtgtcttacctgtgtctgcatcgtgtgttccctctgtgtgtctctgagaatgcgttcttggcacgcgtcctgcgttaacaaggcgtttggtgtgtgcatgtctgtgtgacagtgcctgggtcctgtttgcggctgcttgttcgcattccagcttcccttgtgcccgcagtcaggctctacacgtgcgccagcctccgagcgcacgtccccgagtgacccgtgcgcggtgtgcagggacctcagggtcgtgtgcactaagggcgctcgtgcccgtctctctgcactaaggaacgcacctccacatgtctgagtgcacgtccctctccatgtgtgcacgttccgtgttcacgccgcccatgtctgtgcaggggcgcttcacgcgcgccctctccggcccgcgggcggccagggacccgcgctgggctccacgcttcccgtggggctgacccctccctcgcgccccgcagcgggccgcagcgattggccgccggcccccttccagccgtcacccctccctccctccgccacccgcgcgcccgcggtccccgctgtcccccgcggttccggcgaggccgcgccgcgctgcgctccgctcccattggctgcgcgcgcctttgtgtggcggcagctgcggccccagcgcctttgaatgtcgagaggggccgggaagggagcctttccatgggccatctgtctccccgccagccgccgccccaccgccgcccgcgccccgcgctccgcctcccgccccggcggctcccgcagccccgccgccgcccgcgcccgcgccccggagccgcgccacaaagggcccgcgcgcagccgccgccgccgccgccgcgcgaggagccaggatggtcctggtccacgtcggctatctcgtgcttccagtgtttggctctgtgcgaaacagaggtatcgctttttcctttcggggtctgcttcggagcgtggatcgccgcaggcaccggggcgggggcgggcgccgcgggcggccgggggctcagggcacacccgcgaggacgcagggcgagcggtggcttccccccaccccattttagggggacccccgagggtgggggcggccgccctcgtgggagcttttgtagtgaagttagggtttggcgaatttgggtcccttcctccccagccccattttttattttttgcggcggacgtggttcccccaaatcacagccccttcccctaatacctagccctgtat

SEQ ID NO: 114536 - DNA, 403 bp, Homo sapiens; identical to SEQ ID NO: 81842
  chr18:43914882-43915285
  Hyper

SEQ ID NO: 114537 - DNA, 30 bp, Homo sapiens; identical to SEQ ID NO: 81844
  chr18:44032745-44032775
  Hypo

SEQ ID NO: 114538 - DNA, 121 bp, Homo sapiens; identical to SEQ ID NO: 81845
  chr18:44140380-44140501
  Hypo

SEQ ID NO: 114539 - DNA, 40 bp, Homo sapiens; identical to SEQ ID NO: 81846
  chr18:44260010-44260050
  Hypo

SEQ ID NO: 114540 - DNA, 1036 bp, Homo sapiens
  chr18:44336102-44337138
  Hyper
cttcatttttcacagcggaacaaagttgtctggaccctccagccagcgctgggcagaagcaagcaaggatgctcttggaaacgcggtggcccaagcctaagcggccatgctcggggctaggagcggaccccacggccactcaccccggggcgctgcgaccgaagctgccgcggccactgccacccgggggctcgccggccggctccgcgcatcccgccctctcaatggactttcttacctcttaatgtagttcctgccatacaggatctgttgcagcaaggtcaccaaggcaaaggcgcagatgaagatgaagagcaaagttcggctccccaacaaatcccggttggccgaggggtccgcgtagcgcatcctggctaccgggcgccgcgggcgcggggtacggggcggccaggcaatgactcgcggggttccggggccccggggggcgcgcggccgacttggcgcctcacggtgcggtcaggcaggcgggggacttcgaggggcaaagtttctggttggcgcggccggagctgggggcatccaagcgtcgcaggcgctggggcggcaagcaggacagggccggtggcagggagctctgccgcggccaggggccttccccacccccgggtacctttacctccaggcgccggtgccgggtagccgccgatttccccgcggaggggagacgccaggtgccacgagccggaggcggcccctcccgccgaggtggcggccaatggggagcaagacccgggctccgtcccctgtgcgccccagcgcgccgcgcatcgacccctccagtccggcgccggatcgcggttgcccagcgcgctgtgccctgccgggggcgggccacgtttgatctccgggcccgcagcaagggatcgcgaaggttggcctccggttctgccgatagggacggggggagggggcgtacaaaacacccgcgcagtctggctaatgataggcgggccgtggggagggggaggggcggagcgcaaaacgccgggtttgaatcttggaattaaaaagaggg

SEQ ID NO: 114541 - DNA, 675 bp, Homo sapiens
  chr18:44337438-44338113
  Hyper
aaaaagaaaaaaaagagggcaggaagaggaaacaacagttgcggagctggacttgatggaagggagcatttgcgtgcggcgcgcagggcactgagtcaccatcgtggccgcgtcctcgcgctctcctagcgatttctccggagaaagcggagcaaggtcagccgggcagcccttcaaggacggcgcgccgctcctgcatgctgatggcctgcggggctgcctgcccgtgccccggcgcccaactcctacaaggaagaaattcaggggctccccgcccccgccacagtcctcttccccctccccagctgcaactcggcagccgttcgtcaaagaccctgttgtcaccgagacactgggaccttgtctcatccttggaaccactcgtaaatcttaggtcaggcagccggcagccttcggggaccacagtccccccaaagctttaggaagccagttactacatccggaaagattcgtgcttcagaacgcaagccagggagaataatcacagaaacgcaatgcgaatgtcgtgcctctcagaaattcttagcctgaaataccgtccccaccccccaacccggccaggcgacagtcctgtcatcctaacaccgcagaggctccaagcgctgggagtcgtgtgcccgcggcgctcgccactgaggccggttggaagattct

SEQ ID NO: 114542 - DNA, 30 bp, Homo sapiens; identical to SEQ ID NO: 81852
  chr18:44448392-44448422
  Hypo

SEQ ID NO: 114543 - DNA, 52 bp, Homo sapiens; identical to SEQ ID NO: 81858
  chr18:44772704-44772756
  Hyper

SEQ ID NO: 114544 - DNA, 1734 bp, Homo sapiens
  chr18:44772977-44774711
  Hyper
gtgaactgggctgcccgggctgctgctgccgccgccactcgccttctggggggccaggggcggcggcgggggcgggggcaggtccgagccggggtccccgagtttcccgtcttcctgcagcagcctggaggagttcaggccgagcgggaacgcgcccgcgacggccggcgcgcggtcccggctgctccccttctccgacggccctcggccctggaggaaccggccgcccccgactaaggggtcgccgagtaggacctccgtctcctcgtcctcttcctcgtcgtcgtcagggtctcgaccttcctcctcttcctcgccctcggggggcttgtggccctccacgtccacctcctgctcttcttcctcgtcgtcctcgtcctcggagctgtcctcgctggggtagcagcagctggttcccccgggagacagaaggcctcggtggtgcgggtgctgggccagagggggcggcgggggcggcggcggcggcggcggcggggccgggtggtggcgctcggaacccggctcgtcgggctgcgggggcagcagcagaagcggcgacggcggctgcggggggtggtggtggtggtggtggtggtgagggtggtgatggtggtggggatgcgtctgggccgagtggggcgcgcccgccgacgccccgtgcagcttggccaggctctccgcgtcgtccttgccgcccactggccggaaggcgctggaatggtggtagctgccaccgcccgctttgcgcccctccagaaggtgcggatggtggggcgccggaacccgggagcccgcggggccagacccggcggccgcggcccctgccccggcagctgccacagagtccgcgggcggcgtggagcccgcgctgcagtccccgccgctgccgcccgggggcgactcgaagagcgcgtcgcgagagccggcgcccccggcaggaggaggtgggccggagcccgggccgttggccactacctgcgggggctgccccggcgggggcgcggcctcggcgctcccagcagcaccgcctggctcagccaggtccaggaaggcctggcgcagcagggccgggctttcgcctagcgcgcagcctagcgccgagggcggctgaggcgggggctgcaggtaggtgggcaccgggagcccgccaggggtccgcggcggccagaacatgcagaagggcggatagaaggcgtccttgcggcccgcgggccagaagaggccggacaagccggccttgggcgccgcgcccgcgccgcctgcgcccgcgccccccagggcctcagcggcggcacccgcatcctctttcttatggcacaagctgaaggcggcggccgcggcagggaaggtgtaggggtgcgggaagagcccgccgcagcccgggaacttctgcaggacgcccccgaacgagcccttgctgggcaccgggatgactgggtagctgcgcgggcctttggcccctgccccggcacccgcccccgcgcccgcgcccacgcccacgccggccacacagccacccccagcgccgcccccaccagtccccgcgccgcccgaagcagcagccacagagaggctggcggctgcggccgagaggctggcggcggccactacggcggcctcctgcaaggagtcgtcgtcgtcgtcgaagcgcggccgcttgtgatgggcgtgcggggcaccagccagctctgccaagggcggcggtggcggcggcggcggcgggggcgcacccag

SEQ ID NO: 114545 - DNA, 205 bp, Homo sapiens; identical to SEQ ID NO: 81862
  chr18:44775385-44775590
  Hyper

SEQ ID NO: 114546 - DNA, 549 bp, Homo sapiens; identical to SEQ ID NO: 81863
  chr18:44776834-44777383
  Hyper

SEQ ID NO: 114547 - DNA, 730 bp, Homo sapiens
  chr18:44777596-44778326
  Hyper
ccaacttagttctcccgactcccaaaccagtcaccacggaagcccaccgctgcccctcaacctaacgcggaaaatcctaccgctggggatctcaaataggtgcccagcaagctgtgtgccggattggggcggccggttccggcaatacctggtaacctctgggtgtctttaggcgtgtggctgccggcccatcttccgagggcgctcggaggcgaagcatccaagcgggtcctcgtatccagcgggcgggactctggcgggctccgcgcgaagatccgggctctggcccgagcgaatggcgctcaaaccccggcctggggagaatgacggcctgaattgcggcggggcgtcccctccaccgcagaaagtgtgggtacgcagaaacccgcggcaggagagccccaagtggagcgcagtctgacagcgtctgtctctgaactcgtgtcggaccgaggggacgccacccagcgggcagggtgacgtcaccgtctccctgacactccacattaaagggctggcatgttacagggagggagggggagagcgaaagccagcgcgagcaacagagagatcctttctcagcaggcacgaaagctaccaacctaaccaactcgcaattgacaacaacctcctcagccccggagtaaactgcagcaatggtgctggagccgcagatctgatttaggagtggaaagcgaacagtctgcctgcatcccgggacctagatcct

SEQ ID NO: 114548 - DNA, 622 bp, Homo sapiens; identical to SEQ ID NO: 81866
  chr18:44780619-44781241
  Hyper

SEQ ID NO: 114549 - DNA, 294 bp, Homo sapiens; identical to SEQ ID NO: 81867
  chr18:44786853-44787147
  Hyper

SEQ ID NO: 114550 - DNA, 359 bp, Homo sapiens; identical to SEQ ID NO: 81868
  chr18:44787492-44787851
  Hyper

SEQ ID NO: 114551 - DNA, 30 bp, Homo sapiens; identical to SEQ ID NO: 36998
  chr18:44788251-44788281
  Hyper

SEQ ID NO: 114552 - DNA, 699 bp, Homo sapiens
  chr18:44789474-44790173
  Hyper
aagaaatggagacagcgttgcagagcgaatcactcatggtctttccatttcataatcgagggagacagcgcaagcaggtcagactcgaccggttcgcttcctcccacccctaacttggcgggatctgagaagaaagttcccgcatgtttgagcgtcctagggcttggataggacagacctcgtaggtccccaagctccagcttggagttcccaaggagaagggaagcgctagtgctatggagcgaggttttggtgaagaaaagggcctcgcgcccccttagtgccgtcgctctggggaatcttctttcgctgggaggatgaatggggcgctcgccgcggctcatggcgccccctaggagcggcaggaaacttctcctgcagggcagcgcgggccgggctccgcctccggaaggcgggcggggagggtagttgctgggggtccctaggccgggccccaggacatctaggacatgccgggggctgtttgctacggcttcatcccggagctcctgctcggggttgccggctgcctctgctggcgtccctcttcccttcctttgcgtaagcggcaactcctccaggaagccaggggaaggacgggatttcctctccacgtagggtagtagatcgcatagcccagccggatcgcccagcaggagtgcagggcgcgcgtcggggtgtctccggcttgtgggtgtg

SEQ ID NO: 114553 - DNA, 380 bp, Homo sapiens; identical to SEQ ID NO: 81872
  chr18:44790571-44790951
  Hyper

SEQ ID NO: 114554 - DNA, 30 bp, Homo sapiens; identical to SEQ ID NO: 81873
  chr18:44852515-44852545
  Hypo

SEQ ID NO: 114555 - DNA, 193 bp, Homo sapiens; identical to SEQ ID NO: 81874
  chr18:44977278-44977471
  Hypo

SEQ ID NO: 114556 - DNA, 371 bp, Homo sapiens
  chr18:45058076-45058447
  Hyper
aatgactccggtctccgcgccgctggtgttgcacaacttgtctgtgctggcttgagaccccggtgatccccttctaattgaaatcactttcccctgacctcccccgtaagcctgggagcttgttgctctctgcgccaacactcgggctgcggaggtcgggggaaatcctggctgggcaccagagctgcacgcacgccgcatccatcttccggccgcccgcgctcttggccgcgccaggtgcccagccagggtgggcgtcggggcagccccctggaaggcggccctgctggatcaccggctgcttggaagctcgcagcggggctgacactgccccctaaggggcattttggacatttcgtgggggggcttgt

SEQ ID NO: 114557 - DNA, 30 bp, Homo sapiens; identical to SEQ ID NO: 81877
  chr18:45120847-45120877
  Hyper

SEQ ID NO: 114558 - DNA, 182 bp, Homo sapiens; identical to SEQ ID NO: 81878
  chr18:45275551-45275733
  Hyper

SEQ ID NO: 114559 - DNA, 41 bp, Homo sapiens; identical to SEQ ID NO: 81879
  chr18:45534935-45534976
  Hyper

SEQ ID NO: 114560 - DNA, 115 bp, Homo sapiens; identical to SEQ ID NO: 81880
  chr18:45662236-45662351
  Hyper

SEQ ID NO: 114561 - DNA, 496 bp, Homo sapiens; identical to SEQ ID NO: 81881
  chr18:45662583-45663079
  Hyper

SEQ ID NO: 114562 - DNA, 267 bp, Homo sapiens; identical to SEQ ID NO: 81882
  chr18:45663337-45663604
  Hyper

SEQ ID NO: 114563 - DNA, 37 bp, Homo sapiens; identical to SEQ ID NO: 81883
  chr18:45934773-45934810
  Hyper

SEQ ID NO: 114564 - DNA, 165 bp, Homo sapiens; identical to SEQ ID NO: 81884
  chr18:45935031-45935196
  Hyper

SEQ ID NO: 114565 - DNA, 30 bp, Homo sapiens; identical to SEQ ID NO: 81885
  chr18:45937081-45937111
  Hyper

SEQ ID NO: 114566 - DNA, 213 bp, Homo sapiens; identical to SEQ ID NO: 81886
  chr18:46142398-46142611
  Hypo

SEQ ID NO: 114567 - DNA, 24 bp, Homo sapiens
  chr18:46713260-46713284
  Hypo
tcatatattcactgccggtacaca

SEQ ID NO: 114568 - DNA, 82 bp, Homo sapiens; identical to SEQ ID NO: 81888
  chr18:47012303-47012385
  Hypo

SEQ ID NO: 114569 - DNA, 86 bp, Homo sapiens; identical to SEQ ID NO: 81889
  chr18:47019807-47019893
  Hypo

SEQ ID NO: 114570 - DNA, 557 bp, Homo sapiens; identical to SEQ ID NO: 81890
  chr18:47087147-47087704
  Hyper

SEQ ID NO: 114571 - DNA, 441 bp, Homo sapiens; identical to SEQ ID NO: 81891
  chr18:47088061-47088502
  Hyper

SEQ ID NO: 114572 - DNA, 152 bp, Homo sapiens; identical to SEQ ID NO: 81892
  chr18:47339606-47339758
  Hyper

SEQ ID NO: 114573 - DNA, 81 bp, Homo sapiens; identical to SEQ ID NO: 45374
  chr18:47344091-47344172
  Hypo

SEQ ID NO: 114574 - DNA, 136 bp, Homo sapiens; identical to SEQ ID NO: 81894
  chr18:47720183-47720319
  Hyper

SEQ ID NO: 114575 - DNA, 107 bp, Homo sapiens; identical to SEQ ID NO: 81895
  chr18:47720801-47720908
  Hyper

SEQ ID NO: 114576 - DNA, 449 bp, Homo sapiens; identical to SEQ ID NO: 81896
  chr18:47792530-47792979
  Hyper

SEQ ID NO: 114577 - DNA, 193 bp, Homo sapiens; identical to SEQ ID NO: 81897
  chr18:48320158-48320351
  Hypo

SEQ ID NO: 114578 - DNA, 215 bp, Homo sapiens; identical to SEQ ID NO: 81898
  chr18:48493710-48493925
  Hypo

SEQ ID NO: 114579 - DNA, 29 bp, Homo sapiens
  chr18:49866392-49866421
  Hyper
cctggaagcctcctcggtccgctcttttt

SEQ ID NO: 114580 - DNA, 216 bp, Homo sapiens; identical to SEQ ID NO: 81899
  chr18:49866847-49867063
  Hyper

SEQ ID NO: 114581 - DNA, 276 bp, Homo sapiens; identical to SEQ ID NO: 81900
  chr18:49867123-49867399
  Hyper

SEQ ID NO: 114582 - DNA, 57 bp, Homo sapiens; identical to SEQ ID NO: 81901
  chr18:49868299-49868356
  Hyper

SEQ ID NO: 114583 - DNA, 96 bp, Homo sapiens; identical to SEQ ID NO: 81902
  chr18:49868671-49868767
  Hyper

SEQ ID NO: 114584 - DNA, 81 bp, Homo sapiens; identical to SEQ ID NO: 81903
  chr18:49945126-49945207
  Hypo

SEQ ID NO: 114585 - DNA, 19 bp, Homo sapiens
  chr18:50382419-50382438
  Hypo
ccaccgcgccccgccatta

SEQ ID NO: 114586 - DNA, 120 bp, Homo sapiens; identical to SEQ ID NO: 81907
  chr18:51209753-51209873
  Hypo

SEQ ID NO: 114587 - DNA, 127 bp, Homo sapiens; identical to SEQ ID NO: 81913
  chr18:52495893-52496020
  Hyper

SEQ ID NO: 114588 - DNA, 92 bp, Homo sapiens; identical to SEQ ID NO: 81914
  chr18:52627015-52627107
  Hypo

SEQ ID NO: 114589 - DNA, 30 bp, Homo sapiens; identical to SEQ ID NO: 81915
  chr18:52946077-52946107
  Hypo

SEQ ID NO: 114590 - DNA, 81 bp, Homo sapiens; identical to SEQ ID NO: 81916
  chr18:52961504-52961585
  Hypo

SEQ ID NO: 114591 - DNA, 103 bp, Homo sapiens; identical to SEQ ID NO: 45377
  chr18:52961793-52961896
  Hypo

SEQ ID NO: 114592 - DNA, 371 bp, Homo sapiens
  chr18:52988920-52989291
  Hyper
acatcaaagagttgccgcccatgcccgggattgtgtatgcgcagtacatggtctcggattcttttttctcctcagtaccactctaacaacttttatttcaaactcgctgtcccttttttcacaacaattccttcagttgcattttcccatatggccgggccaagcgtggtgaatatgcaaagcaggaagagaccattcctggcgggcgggggaggccgcggcgctgctgtcagacgctcaactttgcgcagcggagctggaaggcagcccggccctgatggagctcgaaatcctaatgcatacgcgagatcgattcaacttttccgaggggtttttattagttcctcgaataatgccgattcttacaaatt

SEQ ID NO: 114593 - DNA, 212 bp, Homo sapiens; identical to SEQ ID NO: 81920
  chr18:52989741-52989953
  Hyper

SEQ ID NO: 114594 - DNA, 180 bp, Homo sapiens; identical to SEQ ID NO: 45378
  chr18:53074296-53074476
  Hypo

SEQ ID NO: 114595 - DNA, 82 bp, Homo sapiens; identical to SEQ ID NO: 81922
  chr18:53233489-53233571
  Hypo

SEQ ID NO: 114596 - DNA, 1403 bp, Homo sapiens; identical to SEQ ID NO: 81923
  chr18:53254614-53256017
  Hyper

SEQ ID NO: 114597 - DNA, 380 bp, Homo sapiens; identical to SEQ ID NO: 37017
  chr18:53256942-53257322
  Hyper

SEQ ID NO: 114598 - DNA, 1083 bp, Homo sapiens
  chr18:53446827-53447910
  Hyper
ccccacactcttcttcgctggcacattcactgatgtagaaaatgccaggagccccgggggtgtgatgtttccggtggataatgtctcccgttccctgccccggggcccagacagttggtgcttaagcgtctacaatgtagagtttcctgcattttcctcgggccgccatttgtctacttgtcccatccaggacatctccctaaataatctctaagtggaaaaatcacggtcctctaggagatttatccgggaacgaacgtgcgtggggcagttcaaattcctgagctcagatttcgtttcccgcggtcagatggtgcggtcggtggggcccgagggatgcgcacagctgtgcctgagaggtgctgctctcccgccaccgaagtcgctgggaaattctgctgcactgagacattttaatgtcggatgttctaatcctgcgggcaaaaaaaaaaaaaaagtttgaaccaggtactgggcttttgtcacggtgaaccccacccgcgccccgcgccgtcccttcattcactcaggcgaggtggcttggatttgcacctcgttgaagaagcctcccatgcgacatctccgccagcaccccgcgcggacttggctgggcggcggcggggagtcagcttgtcaccgcacggcggccgggaccgcagcccctgggtgcgcagtgcgcctctcgctgcgccctcctagagcgcgggtcccgtgcctgtgcccggcgcgacgcgatctccctgctagtcgggctccgcgtgctccccgcgcttcccgcagcctccgcgcagcccgcagcgccctccagccccgcctcgcggccgcgggaacccggcgcctgcagccccgcccggaaccgaccgccaggcgctgttgccgccggccacgcaacgcggggcctctgcctggcaccagccccaggtgccttgtctcgggtcgtgctgtcgcgcgacactggggacccaacaggccgccggctactcagctggccccgcagcttccctgcggctcagcggcctcccacccaggagaaaaccacatttgatgagagttttgaatcaagccgagcgttcccccagatgt

SEQ ID NO: 114599 - DNA, 36 bp, Homo sapiens; identical to SEQ ID NO: 81927
  chr18:53960321-53960357
  Hypo

SEQ ID NO: 114600 - DNA, 202 bp, Homo sapiens; identical to SEQ ID NO: 81928
  chr18:53968903-53969105
  Hypo

SEQ ID NO: 114601 - DNA, 50 bp, Homo sapiens; identical to SEQ ID NO: 81929
  chr18:53989683-53989733
  Hypo

SEQ ID NO: 114602 - DNA, 30 bp, Homo sapiens; identical to SEQ ID NO: 81930
  chr18:53989950-53989980
  Hypo

SEQ ID NO: 114603 - DNA, 47 bp, Homo sapiens; identical to SEQ ID NO: 45380
  chr18:54483265-54483312
  Hypo

SEQ ID NO: 114604 - DNA, 275 bp, Homo sapiens; identical to SEQ ID NO: 81932
  chr18:54789012-54789287
  Hyper

SEQ ID NO: 114605 - DNA, 265 bp, Homo sapiens
  chr18:55019653-55019918
  Hyper
atcctgtgcttagatcgaactgtaacattattccaatcacatttatcttgcaggcggcggaggagatggcagcctcgctggaaacgcgcgggggagcctgagccggcggccggggacgcacggcgctgcgcgctccttcgccacgccgccgcgcagcccctccatcttcctgctcggcaccgggccccgcgcgcccctgcctacggggtcccgctgctctccggggctcctgccagccccaacccccggccccggtggcctcccc

SEQ ID NO: 114606 - DNA, 85 bp, Homo sapiens
  chr18:55019978-55020063
  Hyper
acacacacacacacacacacacatatatacacgccagcgagctgctggccgctcaatggaccgatttccccggtttccctgaacc

SEQ ID NO: 114607 - DNA, 991 bp, Homo sapiens
  chr18:55020439-55021430
  Hyper
aaagcccctagaagccgctgtccaaatcgatgtgattgcatttctcgtattcttcctcagcatcccttccctcatttcagaaatgggggttgggggaggctttcaggagggtgagggtggagggaaagacggtgtgtttgttcgggagggggcggcgagcagagatggacaggcgtgaggggagcgccctccccgcgccctgtccgcagactccgcgggccgggcccggggcggtgctggcggtttaatggcgcaggcgccggactcccctcgcgccctcctcctttactcccccacgcctatcaaaggacacgcgggtttattctcaggaagcccctggggcgttctctctcaaccctttcccccgcagccaccgccccccaccagctttccgggatttctgcaattcccccgccccctgcgggaagcgagcctcggaagggccgcccaccctcgccaggtcggagtcaccgctccgcgctgggccggcctgtgaaggctccaggcgcagcttgacgccgctctgcgagagcccccgccccgctctgtgaccccgggaactctcccagcagggcctcctgacgggcaggtggcaactacaaagtgccacctgtggtccaagctgggaccgaggcgaggaacccagaggagcctcgcctggaccgaggagcggagtaggccggcggcccccgggggtccccagccaagttataggaagtgaaatcggacgtgggtttgggaaggaagaggttaaggcaggaaccacccccagactttccctgggtctccggtttcctctgccctttctccaaaaacaattctatggggctgcaaaggcgtagcgggtcaggctggcggggcggccgctgtccgcggtgctgattccctggtcctcgcagcgccgcgggctccagccctgcgcccggcgtgcgccctgctctccgcatgacggccattttatggtctctccggcacccggagggatggacaa

SEQ ID NO: 114608 - DNA, 126 bp, Homo sapiens
  chr18:55095963-55096089
  Hyper
agcggacctagggtacgccgggctccgccgagcgggcaaagggagcggcctgcgccgccaccccgcgcccgcggcctcgacgccgcagccgccacgccaacaccgattcctcgtggccaacaggtt

SEQ ID NO: 114609 - DNA, 117 bp, Homo sapiens
  chr18:55101949-55102066
  Hyper
tgcattactgctgcccgcgccgcccgtgggccgccggccggccgcagctcgctggcgacgagggcactacagttgctctgaccgcgtagattatgcatgtcccggcctcgggaattt

SEQ ID NO: 114610 - DNA, 416 bp, Homo sapiens
  chr18:55103337-55103753
  Hyper
catgagcatgtcctgcgactcgtctccgcctggcatgggcatgagcaacacctacaccacgctgacaccgctccagccgctgccacccatctccaccgtgtctgacaagttccaccaccctcacccgcaccaccatccgcaccaccaccaccaccaccaccaccagcgcctgtccggcaacgtcagcggcagcttcaccctcatgcgcgacgagcgcgggctcccggccatgaacaacctctacagtccctacaaggagatgcccggcatgagccagagcctgtccccgctggccgccacgccgctgggcaacgggctaggcggcctccacaacgcgcagcagagtctgcccaactacggtccgccgggccacgacaaaatgctcagccccaacttcgacgcgcaccacactgcca

SEQ ID NO: 114611 - DNA, 30 bp, Homo sapiens; identical to SEQ ID NO: 81940
  chr18:55104062-55104092
  Hyper

SEQ ID NO: 114612 - DNA, 345 bp, Homo sapiens; identical to SEQ ID NO: 81941
  chr18:55104840-55105185
  Hyper

SEQ ID NO: 114613 - DNA, 626 bp, Homo sapiens; identical to SEQ ID NO: 81942
  chr18:55105464-55106090
  Hyper

SEQ ID NO: 114614 - DNA, 108 bp, Homo sapiens; identical to SEQ ID NO: 81943
  chr18:55114536-55114644
  Hyper

SEQ ID NO: 114615 - DNA, 220 bp, Homo sapiens; identical to SEQ ID NO: 81948
  chr18:55469444-55469664
  Hyper

SEQ ID NO: 114616 - DNA, 30 bp, Homo sapiens; identical to SEQ ID NO: 81949
  chr18:55470924-55470954
  Hyper

SEQ ID NO: 114617 - DNA, 164 bp, Homo sapiens; identical to SEQ ID NO: 81951
  chr18:55850823-55850987
  Hypo

SEQ ID NO: 114618 - DNA, 30 bp, Homo sapiens; identical to SEQ ID NO: 81952
  chr18:55852270-55852300
  Hypo

SEQ ID NO: 114619 - DNA, 71 bp, Homo sapiens; identical to SEQ ID NO: 81953
  chr18:55992525-55992596
  Hypo

SEQ ID NO: 114620 - DNA, 30 bp, Homo sapiens; identical to SEQ ID NO: 81954
  chr18:56022817-56022847
  Hypo

SEQ ID NO: 114621 - DNA, 30 bp, Homo sapiens; identical to SEQ ID NO: 45382
  chr18:56483562-56483592
  Hypo

SEQ ID NO: 114622 - DNA, 25 bp, Homo sapiens
  chr18:56483918-56483943
  Hypo
aagtttgaaattccccggccgggcg

SEQ ID NO: 114623 - DNA, 30 bp, Homo sapiens; identical to SEQ ID NO: 81962
  chr18:56737815-56737845
  Hyper

SEQ ID NO: 114624 - DNA, 24 bp, Homo sapiens
  chr18:56815852-56815876
  Hypo
tttttttttttgagacggagtctc

SEQ ID NO: 114625 - DNA, 24 bp, Homo sapiens
  chr18:56816116-56816140
  Hypo
gattacaggcgtgagccactgtgc

SEQ ID NO: 114626 - DNA, 342 bp, Homo sapiens; identical to SEQ ID NO: 37028
  chr18:56887076-56887418
  Hyper

SEQ ID NO: 114627 - DNA, 990 bp, Homo sapiens
  chr18:56887704-56888694
  Hyper
ctccccatttctttgcgtttccctggcccagctttgggagctgggtttgttgtgacctttctatcggcaaacaccttccccgttctcctaaaactccaccccacctttccccattctagggagcccatgagtccctagtcagccgcaggctggtccgctgatcctttcccgctcgcttccagcctgtcttccccagggcacccgagctcccaacagccaaccccggtgcagatcaccttccctctgcgcccatcctacatctccttttgtccgcctagtctcaacctgtctggcacggtactctcctagaataatcttggggagcgttgtcccttgaaagcatctcagaaccctggtccagctcggtggcctcaacagcgactggcatgggctgaaatctaagctgcgcctatgctccccgcaaagccacaggtgtggggacctagggtgcagcgctcccgccccgggtttcacatctgttcagtgcgcagtgccctgaatcccgcctgtctgtgactctctggagtttcctcagtccttctcttcgctttgcagcgatattcttttccctgcccttttgccctccctctttccagccagcaggctctgagcttggggaatctcgcctgctctccaagctcatcccgatctctctgcccctctgagctccgctctttctccgcccttcttgacccacgacttcgccctttcccctcgctcctttcccattccctctgcaacaggtcctgctctctaggcaccggcttggaggctccctcgccatggcccctagaacccaggcggagaggacggccgcgctgcgggtgcggagggcgcctgcgggtggggtcaggattccgccctgcgcgcactcgctgctttcgctcagctgggaggcaggaagcgcctggcagcctcggctcacccagcatcaccccagggctctcggcgtcgccgagcatagcttccagcaaacgcagagcgtccaac

SEQ ID NO: 114628 - DNA, 17 bp, Homo sapiens
  chr18:56911116-56911133
  Hypo
cccggcctctttgtata

SEQ ID NO: 114629 - DNA, 878 bp, Homo sapiens; identical to SEQ ID NO: 81971
  chr18:56931541-56932419
  Hyper

SEQ ID NO: 114630 - DNA, 457 bp, Homo sapiens; identical to SEQ ID NO: 81972
  chr18:56932659-56933116
  Hyper

SEQ ID NO: 114631 - DNA, 30 bp, Homo sapiens; identical to SEQ ID NO: 81973
  chr18:56933508-56933538
  Hyper

SEQ ID NO: 114632 - DNA, 719 bp, Homo sapiens
  chr18:56934900-56935619
  Hyper
tccaggttctgctggcggtcgcccagcttccagtgtcaacggtggatatcgagcacgctcaggcgggagtccgggactctccttcttcagagagtctcaggagattgtgaagcgggctgagatttcgagattccttcctcgccctagagccggcgccaaagaactgcagatactgtccagggcacgcccgcaagaactagctctcggggcggtggcgtagggcgctccaggacactctccgagcgcggcacctcaccagacgcgccttttaccgaactctgggttggcgagtgtggagcgagttggggaggttagagagtctcgcggctccgaaaaggaaaagcatctctttgcctcagttcttgtaccgctggtgatcaaccttgggtgttagggactggcaccgaaccggagatctgcttggtgaactgagaggagtccttaggagagcggggacgccaggggccgggggacacttcgctctcgccctagggaaggtggtcttgacgctttctattgaagtcaaacttgaaaatatcagctgccgctggactatggggctagcgggggaactgggagcgcgctagcatctgagccttagccccatccactccggaccccaagcgcgcacgccggctccagggaagggcgcctctggtctaggccgccgaagcgttcggaatggggacgattctctgctgcagcgaagtgtccctaga

SEQ ID NO: 114633 - DNA, 1141 bp, Homo sapiens; identical to SEQ ID NO: 81976
  chr18:56935921-56937062
  Hyper

SEQ ID NO: 114634 - DNA, 3137 bp, Homo sapiens
  chr18:56939052-56942189
  Hyper
aaaaggcctttgcagcgagaagtttggttggatgtgcaccagaaaaggaaaagtcagtttcttaaataaatccacccgaagtttcaactgcgaggtgccaggcccttcgcaaggaaacagggttttcgtttccaactcggtattcgcagctagtgacgagggtggcatttggggccccaatcctgtcaccctcgatcactacctgcattccatttccactcagcaacccccaaccccttcctggctatgtctaatgagctgtcggcctcttcatcttgcaagtcattcccatcttctattttgagtttagaagagggaaacccccaaaggggagctcgtactacaaactggaacagactgcttgaagggcgatgcacagggaacatcgaagatctgtgcctctcccttgagactctgggcatgccaagtcgaggaaggacagtaataaatgcatggacacccgtgaattccgagaagcattggctgcaatttgggcctcgggccctcccagatcccagttcctcaacctgggcgctttacctggacccggacctctggtaggttgaccttgccggccagctcctcgcggctgtacacgtccgggtagtgggacttctcgaacgcgcgctccagctcatgcagctggtacgtggtgaaagtcgtgcggttccgccgatgctttttcttgggctgttcctcctctgacagtttcgcttcgccggtggctggcccgacgggcagccctgggctcggccgtgcctccccgggctccttggggcagtagggtcgaggggctggggcgacgaggcccgggagggtcagatgcactccccaaaacacccttgggccgaccccgcctcgctgtgggcactggccagcccgcctgcgggctccgagatggcccggggaggtccgtggtgagggcggcgatgggtcctaagctttctctgaatgcaaattggaagctcccgccatagacggtccccaaccccgcgcccagttgccttaataaaagttaaggaaggggcgctctcgtctggccaactcctaagctcgggcgcccgaacggcctcgcacagccaggggtgcgcactcaccttcgtactcgggggcgggcgccggggctggcggcggggagggctcggagccttcctcgggcgccttggggcaggcgggccgcgcgcccagcctcctatcccgctccttcgcgccccgggcgccccgctccgccgggaaggtgccgaggatcccgtcgtccttggtaaaccccaggatggcctcgatgctgtgaagtcgcgaggtgctcccgcccgggctgcggagcaggtggccggcaagcgagaagctcccgtcggccatggctggcgcgcagcccggcaggtgcatggggagcgccgggaggcgggagggcgctttggagacggagaggagaggctcgaagccgggtcttcccgagtgcggcggtgcaacccgacgggtcccgaccctaggtcaagctccgcgggcgaagcccgcccgggctgcgcacgctgggggtggccgagcgctcagcccgctgccgccttagtcccagaagtcggaagttcgggctcggggtagctggggctctcggcgctaaaggcggggagccaactggccctcggctcctcccctctcgccctggacccagccccttctctcggcccctccctccacagaggggcgtgtcctcacccggcccagccacagggtcctctagtggccacccctgggccggcactaggaatattccccttccacctcttgatccgttttaagctttacaaacacactccggggatccgcggcgggatgcctgatgggctcgggaacctggtcgcggcgcacccctagtcctgcctcagtggggccgacgcccttgggctcatctctccccttgcgtttgtctccctctacttcgggcttaccctctcacttcagactaccccctgggggtcacctccctccttggacgcacccctccccagcttcagactcgcccctctagccccctctggctcacctccgcggggccgccaccctggcctgtgccccctggaagcgccgagacccagccgaaggcttcccagccccgcactcgtcgcagtttgaatttcccctcgctggctcccttttcgggacccactcctttcttggctgggttgtacgaagtcccggacctcgcgtttagtttgtccgtctatatctgttgtaactcctcccagtcccctcggacttgagcgccggcagcctccctccttccccgcagcgcccaccccagggccatttatgtccgcaagtccggtgacctctagcgcccgatcgcccagcaggagactgggagccccgagtcggatgtgctgccgggctcaggtcccgcaggagacccacctggagttcctcgctcccgccccttgtcctgcggggagggcgggctcctttactgatgagcagcggtgtcgcactcccgcctccctccaacactccgggccaaggagatggcccagagctggctggggaaggaccttctcccggggaagaggcctctcgcctccccgagggttcaggagtaattggcttgcagttctttctcctttggaccccctcgaggcttccgtggcccacagtgactgatcggccacttggaaagatgattggatagggtgagtgtgtttcacctccagcagcgcggatggacaatggcgctgtgaacgtctcacccctcaaatctgaggcgagacccgaggcgagcgcttggccttccctgaactggtggcctgaaccgtgaattaaaatgctttcctataaaagctcaaggacctagaggacaatatccctaaaatctccttttcagtaggcgctctgatctccacagcaggggtgtcttctttatcccgcttgcgttcagacaagcgtttgctgcgtccctttagagggcaaggcaaccgtcgagggccacgtcgtgggcatcaaacaaattgggaaaggccagggccgttggcctggtggagtttaacgtccagtctggaagacaagacaaaggaagagggaaaacacacatcctcagatccccaacctttaaattggtgttagaaggatgtttgcggaggacaagtcaa

SEQ ID NO: 114635 - DNA, 75 bp, Homo sapiens; identical to SEQ ID NO: 81981
  chr18:56976125-56976200
  Hyper

SEQ ID NO: 114636 - DNA, 36 bp, Homo sapiens; identical to SEQ ID NO: 81982
  chr18:57061262-57061298
  Hypo

SEQ ID NO: 114637 - DNA, 52 bp, Homo sapiens; identical to SEQ ID NO: 81983
  chr18:57069866-57069918
  Hyper

SEQ ID NO: 114638 - DNA, 30 bp, Homo sapiens; identical to SEQ ID NO: 81984
  chr18:57138384-57138414
  Hypo

SEQ ID NO: 114639 - DNA, 1305 bp, Homo sapiens
  chr18:57363675-57364980
  Hyper
gtgttgctctgactccgatccaaccaaccctcaaagattcgcaccgcgcggcacgcacccagcaggttccagcgtaaaagctgctccggtcccaagcgcgtctccaaacccctcctttacagcgccgcctccccagccagccccggtgcgcagtggcgaacagcccgcagagcccccaggcttacctgtagcatgtggtgagctcgcctgaagacttcagacacgggtatttagtcgtcgcgattttgctctctgagcagatttctctatgaaaaagtgcagaggaaatgttcgattctcagcgggagagcggaggcgggcagcgcgcgctggggaatccctggcgcgtggggatcgccaggctccccgtcccggcgctctgggcaggggctggtccccaaacgcgtacgcggggcagactccggccacagggacgagccacgcgagggtcacgacgaagcgaaccagctccaggagaaaggaagcggggttcacgagctgtgccagccagtgtggcacccggggggaggcaggaacgcggggcgaagggtatccctgacgcgacccacggatggcagggcgcaaaggctgatacccgggagcggagggaagtgtcgcccaggacagctgagcactctccttatccccggagaagtgagggcgtgcggatcgctgtgggagtgggcgccggggaggaccgcccgcaccccgcgagccgggcgcgcatcaagcaggagctcgccctccgctggggcttgcagcgcttacctgtcgccgtcctccggctcctctctgtaggtccacgtgtgtcccaacgccaggagcagcagcagcggacccaggctcctgcccagctggcccctggcagctcctccccggctcggaggcggcggcaccatcagggaagctcccggcttcttcccagcgccgagctccgtccggaccaagcgtcctgctcctccgcggccgccgccgccttccctcttcccggcagggggcgccggagagcaggggcgtttgcaccacctgcacggggagcaggggtccggaatattatggggctggggggaaaatgaggctaggagttggggtatcggatgcaaacccagcagagaagcaggtaaagggggtacctgcggtgtccggctggcgcgagggccctgaggttcaagttgtctcgtcgggacgttcacgtccgattgacagacttgctggactcggcttggggctgcgccctcgcctcttccctctccctcctctgggagaagcgcgcagggtggggaaagcgggcggttgtttgcattt

SEQ ID NO: 114640 - DNA, 183 bp, Homo sapiens; identical to SEQ ID NO: 81987
  chr18:57365455-57365638
  Hyper

SEQ ID NO: 114641 - DNA, 184 bp, Homo sapiens; identical to SEQ ID NO: 81988
  chr18:57652615-57652799
  Hypo

SEQ ID NO: 114642 - DNA, 116 bp, Homo sapiens; identical to SEQ ID NO: 81989
  chr18:57677751-57677867
  Hypo

SEQ ID NO: 114643 - DNA, 30 bp, Homo sapiens; identical to SEQ ID NO: 81990
  chr18:57684712-57684742
  Hypo

SEQ ID NO: 114644 - DNA, 38 bp, Homo sapiens; identical to SEQ ID NO: 81991
  chr18:58330518-58330556
  Hypo

SEQ ID NO: 114645 - DNA, 1214 bp, Homo sapiens
  chr18:59000691-59001905
  Hyper
aggggaagcggaccgcgcgccacgctcgggggacggtgaccgcgaccagggggctcttctcactggacaggccgaacgcggtggccgcgggagggcagggcagggcatcggcggggttggtgcacttggcagtaccccccaactcctggcaaccgcacggagactttgcgaaacatccgaaggcagaaaagctgtgacacttctgacagagggggtaggggggtggggggcggggacagcgccgcgagcaggggtgaagagacccagcggggcaccagccgcccagtgggggaggcagctacgtgagcagaacgcccgccctggagcagttaggaccgaaggtctccggagagtcgccggcggtgccaggtaacgcagagggctcgggtcgggccccgcttctggggcttgggactccgggcgcgcggagccagccctctggggcgaaatccccgggcggcgtgcgcggtccctctccgcgctgtgctctcccagcaactccctgccacctcgacgagcctaccggccgctccgagttcgacttcctcggacttagtgggagaaggggttggaaatgggctgccgggactgggggagctgctctctggaagcagggaagctggggcgcaccggggcaggtggaggacgtggcgcgctgggagcggggactgcgcgcgcctggggatggtgactggggatccaggagcgcggcttgtgggggcgcttggcacggcttcaccctcgctggccccgcaggcggtggcgcctccctccgcctgcagaggggacagggtggccgcgtccctcgcacagagatgtgcgccgggaaggggaccagagagccaggctccggggaggcgcaggcacctacggggccgatccctggtccgtgcctcgcgccgcgcccccgccggagctcggctgtgggaggagaatgtggtgggtactcgagtccccgccacctgccggacttcgccaactccccggatttcctgtcctcgggccctgacactcccaaggaaagctctgaattgcgctcgctgtttggtttttgcttgttgtagttactctgggggaagagccgggggcaagggggtcaaatggggctaaagtttcagatttgcaaagagaacgttaccgaggactctcaacgtgtccttagcaatcggagagactgcagcagcctttgcctagctatccgcctctggggcagc

SEQ ID NO: 114646 - DNA, 30 bp, Homo sapiens; identical to SEQ ID NO: 45386
  chr18:59137607-59137637
  Hypo

SEQ ID NO: 114647 - DNA, 404 bp, Homo sapiens
  chr18:59560168-59560572
  Hyper
aggaagggttagatacgcgccgcggagaaggaaatccaagcgccctcctgggcagacggggctggagcgggtgcactagggaggtggagcaaggcagatgaggtgtggagggctggcggccgagaagggggcgtcacggctcctaattgtctctacaggataaataaccacctcccccctcctccgcagtctcccccgcccacgagttcccctctggtggcagagcgcctactagcaacagtaagccctaggaaagaaagaaatcggagcaggtggggaataacatcttggggcaaagacacactggcaaaatctaccaggtaacccggtcatatgggaatgcggggcgcctagtcagccgcgcagacaggcacacagcgcggcaatcccgagcatctttcttt

SEQ ID NO: 114648 - DNA, 37 bp, Homo sapiens; identical to SEQ ID NO: 82005
  chr18:59992186-59992223
  Hyper

SEQ ID NO: 114649 - DNA, 30 bp, Homo sapiens; identical to SEQ ID NO: 45387
  chr18:60056441-60056471
  Hypo

SEQ ID NO: 114650 - DNA, 848 bp, Homo sapiens
  chr18:60263506-60264354
  Hyper
tcgcgttcagatcctcgaagtggctccctccgggacctcgctggctttcctgttcccgacccctcggccaagccgtgcgaccgggtgggctctgcttccccgggaccccactctgaccccatcccctaagccgctcccgcgagcacctcagctccgctcccgcgcgggtcagcaattcgaagtccgccccagacccctgggccttcgggcgcccccggaagccgcagggactgtcggactgagcggcccccttgcttgggtgggagctggggtgcagagaggggctgttctcgcacccttccgctgcatcggtccccgggccagtgcggagactcctctttgcgtttccaaatcacttttacgaacaaaagaggcgcccagaggatatcaccccgggcgcaccgccctccaggggtgtttgaaacgtgagctgttgtcaggcccagggccaaggatgctaaatgtccgggaaaatgcgcgcggcagccggccacactcaggacgatggtccgtccccgagagccagcagggctgcggagaggaagatccagccgccgagcgcagcgcgcacggagcgggacgcctgcggcgatgcctgcccgggtggccgctgtcctctgcccgggcgccgctggagccgcgcgtccccatcgccgcgccggctagtcccacaggtgcccggagagggaggcacggaggcatacccaaccttgagtgcgtccagcatacgtgggtgtggacgaaggtgagaaagggttctttccaaaggttcaagacagagcttccagtaccttctaaatccccagaaagtagtggtctagaagttgcttctccgcttcccaacgcca

SEQ ID NO: 114651 - DNA, 216 bp, Homo sapiens; identical to SEQ ID NO: 82009
  chr18:60467824-60468040
  Hypo

SEQ ID NO: 114652 - DNA, 94 bp, Homo sapiens; identical to SEQ ID NO: 82010
  chr18:60557763-60557857
  Hypo

SEQ ID NO: 114653 - DNA, 49 bp, Homo sapiens; identical to SEQ ID NO: 82011
  chr18:60730449-60730498
  Hypo

SEQ ID NO: 114654 - DNA, 30 bp, Homo sapiens; identical to SEQ ID NO: 82012
  chr18:60741411-60741441
  Hypo

SEQ ID NO: 114655 - DNA, 30 bp, Homo sapiens; identical to SEQ ID NO: 82013
  chr18:60756521-60756551
  Hypo

SEQ ID NO: 114656 - DNA, 85 bp, Homo sapiens; identical to SEQ ID NO: 82014
  chr18:60759912-60759997
  Hypo

SEQ ID NO: 114657 - DNA, 455 bp, Homo sapiens
  chr18:60985518-60985973
  Hyper
ccgcgcggtgaagggcgtcaggtgcagctggctggacatctcggcgaagtcgcggcggtagcggcgggagaagtcgtcgccggcctggcggagggtcaggtggaccacaggtggcaccgggctgagcgcaggccccgcggcggcgccgggggcagccggggtctgcagcggcgaggtcctggcgaccgggtcccgggatgcggctggatggggcgtgtgcccgggctgggaggagaagatgcccggtgcgggggcggcccccgggggcgcggcgcccacatctcccgcatcccactcgtagcccctctgcgacagcttataatggatgtacttcatcactatctcccggttatcgtaccctgttctcccagcgtgcgccatccttcccagaggaaaagcaacgggggccaacggcacctctcgccccagctcccaccccacggcccccagagaaa

SEQ ID NO: 114658 - DNA, 30 bp, Homo sapiens; identical to SEQ ID NO: 82018
  chr18:61200515-61200545
  Hypo

SEQ ID NO: 114659 - DNA, 217 bp, Homo sapiens; identical to SEQ ID NO: 82019
  chr18:61603484-61603701
  Hyper

SEQ ID NO: 114660 - DNA, 84 bp, Homo sapiens; identical to SEQ ID NO: 82020
  chr18:61603901-61603985
  Hyper

SEQ ID NO: 114661 - DNA, 31 bp, Homo sapiens; identical to SEQ ID NO: 45390
  chr18:62165289-62165320
  Hypo

SEQ ID NO: 114662 - DNA, 19 bp, Homo sapiens
  chr18:63276828-63276847
  Hypo
actccgtctcaaaaaaaaa

SEQ ID NO: 114663 - DNA, 160 bp, Homo sapiens; identical to SEQ ID NO: 82023
  chr18:63417736-63417896
  Hyper

SEQ ID NO: 114664 - DNA, 65 bp, Homo sapiens
  chr18:63418222-63418287
  Hyper
gagcgggtgtcgagccggttcctccagtctgccccgcgcgcggagctgcgcgcactgggtcccca

SEQ ID NO: 114665 - DNA, 30 bp, Homo sapiens; identical to SEQ ID NO: 82024
  chr18:63418956-63418986
  Hyper

SEQ ID NO: 114666 - DNA, 40 bp, Homo sapiens; identical to SEQ ID NO: 82026
  chr18:65085708-65085748
  Hypo

SEQ ID NO: 114667 - DNA, 1848 bp, Homo sapiens
  chr18:67067444-67069292
  Hyper
cattgataacaaccacgttctccattttcccagaagagccaggagccactttcagtcctagttaacgaaaacgcatgcataaatcaaccactcgggtcggtcggtcttctccactccttcagcagaggacgtcggcgcccggctgcctcgcccgcctgcctgtctctaggctgcgggaggattagacacatgcgcacgattggtctctttgtgtgcaccaggaagggtctggcgtcgatttacacttcctaacggggcagagacctggaacggccgcgagtgcttgggaataaaaatgtactgtaaacaaggccaatgaaataagtgtctcgctcccgctggccttccgcgttggaagtgtccccactgccctttccccgctgcacagcttgcgagtggagatttagagcccgggaatgaggcgccgtgtccttaggaatctcgcgcccggggagcgctgagggaccggggagccgggtggggagcgggcctcggggcgcccggcggcggaggcgctcccacccgcgcggagagggatggagcgcgtcttgcgagcgtctccgagcccagccaccccacgggccagggggagggagcggggccggcgcatcagcccgccccccccggcccgccccctccccccgcgccggggagccgcggtggtgcgctccggccagctgtgcgccgccgagcgaggcgccagcccgtgggtgctgccgggggcggcggcgcggtgggggctcccgcagctggcggaggcgcgggccgcggcgctgggctcgcggcggggagcgaaggtgagcgccagaacgcggagggctggcgcggctcgcggcgccgggccccgttccccgtccgcggcggccctgcaggcgaccccgcgtccccaccggcgggagctcggggaagagcgggcggcggcgctgctgctggcggcggccggctggatgcgagacccgcgcagacccggcggcggacggcggctctcgactccggagagcggatcgcggggcgcaggagcccgatcgcgctggccatggcctccaactttaacgacatagtcaagcagggctacgtgaaaatccgcagcaggaagcttggggtgagtggctcgctcggcttgctccttccccggcgctcgttcggcccggctggctgcctggggggggggcagggagaggtgacccgtgcgggtacagggcagagagggacccggcccttaggcggatggcccgcttgttgcttggccaggtgggggcccacacctgccggggggctccgcagacggacctggggactccaggagcgcctgagtccccatcctcgagtgcaccgggctgtcttcgaccgtgcggggaagtcagtagacgaaaggggttgtcagttccaacgaggaacgtgccttggaggaggtttctttgcggtgctatccacgatggtctgttctcaaaagtgtgcgcctttcgggtggaactgctgtgtgtggcgacgctcgcgtgtgtttagaatcaccattttctggtctccgcttcccaagctcaattcgaaattcccgtctgatgccctcccagcgccgcgcgtccctgccggctgtagtttagggcgccttcgccgtggccgagggcggctcccgcgccccgcaagtgctcccctacccggggacccgcgcccgcgtgcaggcaggtgtgtgccccgcgcccgcccgcggtcactgctccgtgacggcaaagttgatggagacctttccctattcttgagagatgcgctgcctggcttgggagggaaaccgtgtagaacccaagggttcaaaactattctagtgaccagacgaggcggtaggagggactc

SEQ ID NO: 114668 - DNA, 48 bp, Homo sapiens; identical to SEQ ID NO: 82031
  chr18:67163583-67163631
  Hypo

SEQ ID NO: 114669 - DNA, 30 bp, Homo sapiens; identical to SEQ ID NO: 82032
  chr18:67266861-67266891
  Hypo

SEQ ID NO: 114670 - DNA, 172 bp, Homo sapiens; identical to SEQ ID NO: 82035
  chr18:67592818-67592990
  Hypo

SEQ ID NO: 114671 - DNA, 93 bp, Homo sapiens; identical to SEQ ID NO: 82036
  chr18:67918076-67918169
  Hypo

SEQ ID NO: 114672 - DNA, 35 bp, Homo sapiens; identical to SEQ ID NO: 45391
  chr18:68051409-68051444
  Hypo

SEQ ID NO: 114673 - DNA, 34 bp, Homo sapiens; identical to SEQ ID NO: 82038
  chr18:68180996-68181030
  Hypo

SEQ ID NO: 114674 - DNA, 44 bp, Homo sapiens; identical to SEQ ID NO: 82039
  chr18:68206456-68206500
  Hypo

SEQ ID NO: 114675 - DNA, 24 bp, Homo sapiens
  chr18:68699229-68699253
  Hypo
ctcccagtgcggggcccgccaacc

SEQ ID NO: 114676 - DNA, 842 bp, Homo sapiens
  chr18:70209091-70209933
  Hyper
tggtgctccgcgtggcggagaaggccaccttggcgctgccggagcgcacggagatgcctagggaggaggtgacggcgccgtccgccgacgggctggagtcgcacaccaccaggcacttgccctccagcacgatgggctccgtgtcgttctgcgcccgcacggggcagcaggcgggcagtagcagcaacagcagggccagcgccacccccaggcaggatccgcagccgcccggctcgcgcagcgccccccggcgcccgggcatcatcagccgcagcccgagtggcccccggccgggcgcctgcatcgggactggtgggaggcggcgcgcgggggtggaggccggcgccggcgcgagcggcgcggaagggcgcgaaggaacgcgcggagctcgcagcagcctccgggggccttcgtccccggctctgacgttcaaggccagggtcgttctcagaagaaaggcgcctgtgaacctgtcagggcacagaacccaaagccttacaccgggaggtggagccaccgggaagaagggggactgggagcaggtgcctgcggctcgggggttctccccgaaggccacccccttggtcccgcgcacagccaacccgctttccgatctggcacaacaggtccggagaaacgcccgggcgcagctggcagcgcatccctgaaggctcccgagcagcgcgcggggctgcgacgagggagggggccgcgcttctgcaggtcctcgtcgctaagacgggccccgagaccctcagaaggcgtcaccgccaccccgcccattcaccagcgcggagggggctaagacgcaggcaaagaaaaacctacgaatgcttgccttc

SEQ ID NO: 114677 - DNA, 1164 bp, Homo sapiens
  chr18:70210560-70211724
  Hyper
ctcttgataaatatccgctgtccgcagccccgatcctacatgatttcccttctctctctccacctcctccacccctcgatctggaccagggagagtcttcgttaaaatccacgcagaaggcgcttgcatgcggaggggagggcaggtcgggggtggttacctggaacatccatgctgggcgagctccgctgtccgcgaagttgctctgcttagagaaaatgaggcgagtgggagctgtcgggaggaggacacggagcgcgaccctgctcccagcgcgtggccaataaccgcgccgccccgccctgccgctttcccgcgccagcctgcgccgcttcaggggtgcaccacgccccgcgcgcccgcttaggcgccgcgcccgggaccgggaaccccgcgtctcgcccggctcagcgccccgcgctgtgcgcccaggtgcctccaacccctgggcttcgcgcccgcaccgctgcctggggcccctcgagctcccgcgctcagcgcgtccgcagcgcggctccctcgcgggtcccctcggccccgcagccccgccagtctccagagggcatagccgagcgctgccgcctccctaggactcggaaccttccctgctcccaagcccgccgcaccctccaacgccccggtcctgctcacccaaacgcccagagcaaaatactcccagacgtctcttttgaaaattagacacccttaaaagcaccggtcgcttctcttcttttagattctttcttttctttccccaattccctccaagtcttaatattgaatggcgtgaccactttcataatgacaggagcgaaaaaaacaataagttaaaaaaaaaaaaaagaagaagaagactgggatggctgggacgaagagagggaaaaaaaaagcttgagaatttgatgatttaggagctgtggttccagagtcccagttggggaactgtccggttcccgcagggctagaagaggggcctccggcccgggtctgtgtgtctgctcctctggacctcggactggtggagcggctggcgcttgcgcttatttattaaattgcggtgtccgcgctcgctcaaaggacccggggagacgcgctgggtttcccagctgcgcctggagctcggctgagggcgcaaacacggacgtggggcgccacctgcgggtg

SEQ ID NO: 114678 - DNA, 627 bp, Homo sapiens
  chr18:70533982-70534609
  Hyper
ataaagcgacatcagcggtctccagggcggaaaggggtggaagctgaccctcgcccttccctccagcgctggcttcaggtgtgccttctgctacctcctgtactgcgaacaggggcccgccgagctccgggagcccctagaagaggaagactcctctggccccactaggtatcatccgcgctctcccgctttccacctgcgccctcgcttgggccaatctctgccgcacgtgtccatccctgaactgcacgctatcctccacccccggggggttcctgcgcactgaaagaccgttctccggcaggttttgggatccggcgacggctgaccgcgcgccgcccccacgcccggttccacgatgctgcaatacagaaagtttacgtcggccccgacccgcgcgggactgcagggtccgccggagcgcggcgcagaggcttttcctgcgcgttcggccccgggaaaggggcgggagggctggctccgggagcgcacgggcgcggcggggagggtactcactgtgaagcacgctgcgcccatggatcatgtctgtgcgttacaccagaggctccgggctccactaattccatttagagacgggaagacttccagtggcggggggaggacagg

SEQ ID NO: 114679 - DNA, 2175 bp, Homo sapiens
  chr18:70534850-70537025
  Hyper
cctcctcccgggcatcgtcgccgccgcggggtcgggaggacgcggcgcgcgggaggcggcggtcgcagggcgagccccgggacgccccgagccggggccggggccggggagagggcgcagcgaggtgggggccagtccagaccgacggcagcgacggagcgggcggcggcggcggcgccggcggcggcggggtggctcagtccccagtctcagacgcgccgcgcagcaggtcggagcagcctccccgggaggatgtccagcggcagcgctcctcgctccagcccttggggatcttccgctgaggcattgaaggcaggaagaaggggtccgtcatcggctcgccgggctgcgcgccacctctgctatcttgcggaaagaggagcgggtgggtgggcgtctgggaggcgggctggagggcggtgcaggggagcggggcggccggggggggggccggggggcggggaagggagggaggagaaaggagccggaagagggcagagttaccaaatgggctccttagtcatggcttggggctccacgaccctcctggaagcccggagcctgggtgggatagcgaggctgcgcgcggccggcgccccggggctggtgcgcggcagaatggggccgcggcggcggcagcaaggacatcccagccgcgcggatctgggggaggggcggggagggggtgaggacccggctgggatccgcggctcggcccgccagggcgcagagagaggatgcagccgcaaatcccgagccggatcctcgtgccggacggaaggcgtggaagcgggaggggccttcgtgtgaaaatcccttgtggggtttggtgtttcactttttaaaggttagaccttgcgggctctctgcctcccaccccttcttttccatccgcgtaaaggaactgggcgccccctctccctccctccctggggcgcaggtttcgccgcggactccgcgctcagcttgggagacacggcaggggcgcgccccagggaaaggcggccgtaaaagtttcgcggttgagcactgggcctgatgtccagtccccccaccaaattactcctgcaaagacgcgggcttcttgcaattgagccccccacctcgaggtatttaaaaccaccccaaggcacacacggacccccgttcccccgcgccacttcctcctacaggctcgcgcggcgcgttaaagtctgggagacacgagttgcggggaaacagcaccggaagagcccgggcttgtaaaatgcgaatcaatgaatacgaaataagggcaaccgcgaggcagcgccgggaagggctggagcgcgcgggggtgcagggagtccctccctgggcgccgcaacggcacctcctccctttcccggctccgtcccgccctccctcggcctctgcggacgcgacccacgcagaccacagccgagcccgccggaccccgggactacggaagccatcccgtccggccacccacacccgcgccgcggctggggcttgggttggggactgtggcggcgaagaagccggggtaggaagagctaatggcaatggcggggtcgccggggggcggggggtcagcagcagacgctgagctgtgaagactagggtggccccgaaaggccgaggaaaggagaaagggccatgagaagagtctggcgagcgctcgaggccggggggctgcctcccggctctggcccggcctccgcttcccggcacctgctgctggggcgcccacgtgcgcgcggggctgcgcggggcgttgggtgctcgtcgcagtcctgcccacgcctagcgcagcggctgtgagtgggtggaggtctcctgccagtaagttgggatgagggacgatgaggtgacccccaagtctggaagggattcagagtctcacacgcgcccccaagcctcctaccaccacaccaaagtgctggttcctcgatttccagggtggggtaaagtgaccgagcaaaggggatggtgtgtttgtgtgtgcgcgcgcatatacgcgcgcgcgtgttgtgcatccgtgtaatgaaagttgggtcatgggtcaacccgggagtagagcgagatggagacctaaagagagaaagctgagagaagggggaagacatggacagggtaagagagagagaaaggagagagagaagaaagggaaaagaggagcggggagagaaaaga

SEQ ID NO: 114680 - DNA, 33 bp, Homo sapiens; identical to SEQ ID NO: 13107
  chr18:70537332-70537365
  Hyper

SEQ ID NO: 114681 - DNA, 27 bp, Homo sapiens
  chr18:70711868-70711895
  Hypo
taaaacacatagtttcggccgggcgcg

SEQ ID NO: 114682 - DNA, 53 bp, Homo sapiens; identical to SEQ ID NO: 82061
  chr18:71840738-71840791
  Hypo

SEQ ID NO: 114683 - DNA, 30 bp, Homo sapiens; identical to SEQ ID NO: 82062
  chr18:71844331-71844361
  Hypo

SEQ ID NO: 114684 - DNA, 56 bp, Homo sapiens; identical to SEQ ID NO: 82063
  chr18:71983677-71983733
  Hypo

SEQ ID NO: 114685 - DNA, 168 bp, Homo sapiens; identical to SEQ ID NO: 82064
  chr18:71989323-71989491
  Hypo

SEQ ID NO: 114686 - DNA, 845 bp, Homo sapiens
  chr18:72123440-72124285
  Hyper
ctgaagtctcctttgcgcctgaaagaacggctagccaagtttccaatcaactaaaggtgggcgtttcattcatatgatgtgagcccagcgtacgcagcagtctgcaaaatgcgaaatgtttctttctctccctaattctctggctcagctgaggagctgctgggtgcgagctttcgggccctcccaggttaggaggcgcctgtcgaggaccgggacccgggatcctcccggtcccagccgcctccgcagcgctctctgctcgcccgagcgcacactgcgtcggttcccacagaccgcgaccgcggagagcctgggctctggagcgcaggggggccggggtcagaccagccctccgcatgggctcggtgagatagggggtgacctggcagctcagggtggaatcacagaacgcgggctgggctggagcgctgcggacccgagagacagaggcgtggcaccccggatcccgaaccccgcactggcttgcgccccgagcccggcggcctgacaccggacgcggcacctccctggacactcggatcagacccgcaaactttcttccggagctcgggctcaggggtggcgagggtaggacggagaggctgtctggggacaaagggcgaattctggcgaaaaggggagagacacccccagcgcgcccacagagcactgccggctgcgtccccattcgggggaccggggcgtgcgcctctggcactccacgcaggtgtcgggaacccatgtccccggcgggtgccaccgccacccaagtccccgggaaggctggggaccgggagcgggtgtgatcccccctccccggacgcgcggcgcggggcagagcggcg

SEQ ID NO: 114687 - DNA, 93 bp, Homo sapiens; identical to SEQ ID NO: 82067
  chr18:72220044-72220137
  Hypo

SEQ ID NO: 114688 - DNA, 23 bp, Homo sapiens
  chr18:72263664-72263687
  Hypo
atgatttttttgagacggaatct

SEQ ID NO: 114689 - DNA, 23 bp, Homo sapiens
  chr18:72263927-72263950
  Hypo
agccaccccgcctggccagtgat

SEQ ID NO: 114690 - DNA, 42 bp, Homo sapiens; identical to SEQ ID NO: 82070
  chr18:72335160-72335202
  Hypo

SEQ ID NO: 114691 - DNA, 77 bp, Homo sapiens; identical to SEQ ID NO: 82071
  chr18:72347499-72347576
  Hypo

SEQ ID NO: 114692 - DNA, 30 bp, Homo sapiens; identical to SEQ ID NO: 82072
  chr18:72592835-72592865
  Hypo

SEQ ID NO: 114693 - DNA, 30 bp, Homo sapiens; identical to SEQ ID NO: 82073
  chr18:72647545-72647575
  Hypo

SEQ ID NO: 114694 - DNA, 30 bp, Homo sapiens; identical to SEQ ID NO: 82074
  chr18:72827696-72827726
  Hypo

SEQ ID NO: 114695 - DNA, 45 bp, Homo sapiens; identical to SEQ ID NO: 82075
  chr18:72844763-72844808
  Hypo

SEQ ID NO: 114696 - DNA, 45 bp, Homo sapiens; identical to SEQ ID NO: 45396
  chr18:72896219-72896264
  Hypo

SEQ ID NO: 114697 - DNA, 609 bp, Homo sapiens
  chr18:73167406-73168015
  Hyper
gcgactgttgaaagtcggacagcacccgccttgtgctcaccccgccgggatacacggggacggttcctttccaaggaggcccggggccgcctctgcgccgggacagcctgggaagccgcgcaggcctggccgacttccccttcccagccccgctgcgccctgcggggccctgtcggcggtgggggctgcggacccgggagcgcgcggccgcgctgcacgtgcagggaccggtaggcgccggggtcagcgccagcgtttgatgtgcggcggggagcgggccgagccccgggaggccgcttcgcacctcccagtgtgtccgggttgagcgcgaggtcaggaggggacgcagagttcacggcgaagacggatcgcgggggctcgtcccgcccgggttgcgcgcagcgggggccgcgtgatggatgggccgggccgggcacccgggaacccgcgagcgcggggctgggctctgggctgcgtccgggggccccgacttggttattgatcggcccaagcgcaggagaactgactctataatgcatcgcctgaccaggaaaagtgtttgcttttgtgggagcaaaagacaactttctgccccgccagagcgttgct

SEQ ID NO: 114698 - DNA, 174 bp, Homo sapiens; identical to SEQ ID NO: 82078
  chr18:73438900-73439074
  Hypo

SEQ ID NO: 114699 - DNA, 32 bp, Homo sapiens; identical to SEQ ID NO: 37074
  chr18:73628017-73628049
  Hyper

SEQ ID NO: 114700 - DNA, 370 bp, Homo sapiens
  chr18:73628259-73628629
  Hyper
gcccgcagcgcggcgcggcgtggggggctaagtcactgcgaaccctcgcccggagctggggttcggggtcccactccatttcggcaggagcggggcgcgagggtggcgcgggtagtggcgaccgggactgccaggggctccggcaaaggaggccgcgggttgggaggggctcccgacgtggcgcgcacgttaccatggcgacgcgtttccctggttacctgcggggccgcgtcccggaggagcctgagggccaagagggccggcgcgcggtgggcgcggcctgcggggatgccgggctctacggagcagcgcggggtcccgaagccccctaccgcgaggcctcagaaggggatggcgacctcttgcagcg

SEQ ID NO: 114701 - DNA, 39 bp, Homo sapiens; identical to SEQ ID NO: 82081
  chr18:73769111-73769150
  Hypo

SEQ ID NO: 114702 - DNA, 30 bp, Homo sapiens; identical to SEQ ID NO: 82082
  chr18:73843051-73843081
  Hypo

SEQ ID NO: 114703 - DNA, 30 bp, Homo sapiens; identical to SEQ ID NO: 82083
  chr18:73885138-73885168
  Hypo

SEQ ID NO: 114704 - DNA, 30 bp, Homo sapiens; identical to SEQ ID NO: 82084
  chr18:74023665-74023695
  Hypo

SEQ ID NO: 114705 - DNA, 135 bp, Homo sapiens; identical to SEQ ID NO: 82085
  chr18:74062180-74062315
  Hypo

SEQ ID NO: 114706 - DNA, 39 bp, Homo sapiens; identical to SEQ ID NO: 82086
  chr18:74062539-74062578
  Hypo

SEQ ID NO: 114707 - DNA, 30 bp, Homo sapiens; identical to SEQ ID NO: 82087
  chr18:74063052-74063082
  Hypo

SEQ ID NO: 114708 - DNA, 88 bp, Homo sapiens; identical to SEQ ID NO: 45398
  chr18:74107215-74107303
  Hypo

SEQ ID NO: 114709 - DNA, 30 bp, Homo sapiens; identical to SEQ ID NO: 82089
  chr18:74113912-74113942
  Hypo

SEQ ID NO: 114710 - DNA, 210 bp, Homo sapiens; identical to SEQ ID NO: 82090
  chr18:74114002-74114212
  Hypo

SEQ ID NO: 114711 - DNA, 30 bp, Homo sapiens; identical to SEQ ID NO: 82091
  chr18:74195561-74195591
  Hypo

SEQ ID NO: 114712 - DNA, 30 bp, Homo sapiens; identical to SEQ ID NO: 82092
  chr18:74196348-74196378
  Hypo

SEQ ID NO: 114713 - DNA, 77 bp, Homo sapiens; identical to SEQ ID NO: 82093
  chr18:74206606-74206683
  Hyper

SEQ ID NO: 114714 - DNA, 285 bp, Homo sapiens; identical to SEQ ID NO: 82094
  chr18:74207730-74208015
  Hyper

SEQ ID NO: 114715 - DNA, 107 bp, Homo sapiens; identical to SEQ ID NO: 82095
  chr18:74208293-74208400
  Hyper

SEQ ID NO: 114716 - DNA, 30 bp, Homo sapiens; identical to SEQ ID NO: 82096
  chr18:74313492-74313522
  Hypo

SEQ ID NO: 114717 - DNA, 190 bp, Homo sapiens; identical to SEQ ID NO: 82097
  chr18:74325748-74325938
  Hypo

SEQ ID NO: 114718 - DNA, 46 bp, Homo sapiens; identical to SEQ ID NO: 82098
  chr18:74396499-74396545
  Hypo

SEQ ID NO: 114719 - DNA, 30 bp, Homo sapiens; identical to SEQ ID NO: 82099
  chr18:74399925-74399955
  Hypo

SEQ ID NO: 114720 - DNA, 30 bp, Homo sapiens; identical to SEQ ID NO: 82100
  chr18:74405452-74405482
  Hypo

SEQ ID NO: 114721 - DNA, 166 bp, Homo sapiens; identical to SEQ ID NO: 82102
  chr18:74495900-74496066
  Hypo

SEQ ID NO: 114722 - DNA, 30 bp, Homo sapiens; identical to SEQ ID NO: 45402
  chr18:74497491-74497521
  Hypo

SEQ ID NO: 114723 - DNA, 222 bp, Homo sapiens; identical to SEQ ID NO: 82104
  chr18:74501045-74501267
  Hypo

SEQ ID NO: 114724 - DNA, 654 bp, Homo sapiens; identical to SEQ ID NO: 82105
  chr18:74503878-74504532
  Hypo

SEQ ID NO: 114725 - DNA, 35 bp, Homo sapiens; identical to SEQ ID NO: 82106
  chr18:74553356-74553391
  Hypo

SEQ ID NO: 114726 - DNA, 30 bp, Homo sapiens; identical to SEQ ID NO: 82107
  chr18:74606649-74606679
  Hypo

SEQ ID NO: 114727 - DNA, 30 bp, Homo sapiens; identical to SEQ ID NO: 45405
  chr18:74695927-74695957
  Hypo

SEQ ID NO: 114728 - DNA, 38 bp, Homo sapiens; identical to SEQ ID NO: 82109
  chr18:74710319-74710357
  Hypo

SEQ ID NO: 114729 - DNA, 30 bp, Homo sapiens; identical to SEQ ID NO: 82110
  chr18:74721760-74721790
  Hypo

SEQ ID NO: 114730 - DNA, 30 bp, Homo sapiens; identical to SEQ ID NO: 45406
  chr18:74755472-74755502
  Hypo

SEQ ID NO: 114731 - DNA, 30 bp, Homo sapiens; identical to SEQ ID NO: 82112
  chr18:74756555-74756585
  Hypo

SEQ ID NO: 114732 - DNA, 30 bp, Homo sapiens; identical to SEQ ID NO: 82113
  chr18:74857784-74857814
  Hypo

SEQ ID NO: 114733 - DNA, 30 bp, Homo sapiens; identical to SEQ ID NO: 82114
  chr18:74867247-74867277
  Hypo

SEQ ID NO: 114734 - DNA, 120 bp, Homo sapiens; identical to SEQ ID NO: 82115
  chr18:74870956-74871076
  Hypo

SEQ ID NO: 114735 - DNA, 43 bp, Homo sapiens; identical to SEQ ID NO: 82116
  chr18:74877173-74877216
  Hypo

SEQ ID NO: 114736 - DNA, 84 bp, Homo sapiens; identical to SEQ ID NO: 82117
  chr18:74884614-74884698
  Hypo

SEQ ID NO: 114737 - DNA, 17 bp, Homo sapiens
  chr18:74895202-74895219
  Hypo
atcgagttctacacttc

SEQ ID NO: 114738 - DNA, 34 bp, Homo sapiens; identical to SEQ ID NO: 82119
  chr18:74906008-74906042
  Hypo

SEQ ID NO: 114739 - DNA, 2598 bp, Homo sapiens
  chr18:74961344-74963942
  Hyper
ctatagagaagctcacgcggccctttccctttgcacttctctcctctgtagcaggccgcggggtgagggtgggattaggcggccaattttacaaaactccagggagcgtcgccagcctcgatttcctggggttattcctgggagagaggcgttctcacggacagccaccctggggaggaggaggaggaaaggcactaatggatgaggaggcccgcgcacccctccgcctcccaccccggcgcgccctggaacgccctggagcgcgcccggcttccctcgcccgcctggcccgcggcatccggcagccccgccttcagcccgccgggcaggtccgcactccgcagaggcgagcgcgctccggttccagccgggaggtgggcggcgacccatcccgctagaatccgtccagtctctgctcgcgcaccgtgacttctaaggggcgcggatttcagccgagctgttttcgcctctcagttgcagcagagaagcccctggcacccgactctatccaccaccaggaagcctcccaaaagagctctcgccctgtggacgactcggaatccctggaaaagccgggagggagtcggaggcgccagcccactggggaggtggcgctgggcgcgcgggatgcgcggggagccttctctgcaggagccgcacagtgcactgctgcgcgctgggcagtgcggggaagcgccgcgggaaggagcggctccgagcaacaggtgcagcacgcagcccctccgggagccagggaaaaccgccggcgaagatctggagcggtaaggcggagagaagggtctttccacctgcgcggctgcagccggcggatccctcttcccaggctccgtggtcgcgcagcgggcggaggcgcccgggaaggggaccccagtgctctcgagatcaccgtcccttcccgagaaggtccagctccgggctcccgaacccaccctctctcagaaggtcccggcgcaaagacggtgccaccaggcacggccaccggatccccgctcccgctggctcgcgcctcgggggaagctcagactcctaaactcgcactctccgtgctttgcgccgggacccctggccacccccggcgcctactatcccgccctccctccccgcgcgccccgccgctcgccgggacagccccgcgggccatggagctggcggtcgggaacctcagcgagggcaacgcgagctggccggagccccccgccccggagcccgggccgctgttcggcatcggcgtggagaacttcgtcacgctggtggtgttcggcctgatcttcgcgctgggtgtgctgggcaacagcctagtgatcaccgtgctggcgcgcagcaagccgggcaagccgcggagcaccaccaacctgttcatcctcaacctgagcatcgccgacctggcctacctgctcttctgcatccccttccaggccaccgtgtacgcgctgcccacctgggtgctgggcgccttcatctgcaagttcatccactacttcttcaccgtgtccatgctggtgagcatcttcaccctggccgcgatgtccgtggaccgctacgtggccatcgtgcactcgcggcgctcctcctccctcagggtgtcccgcaacgcgctgctgggcgtgggctgcatctgggcgctgtccattgccatggcctcgcccgtggcctaccaccagggcctcttccacccgcgcgccagcaaccagaccttctgctgggagcagtggcccgaccctcgccacaagaaggcctacgtggtgtgcaccttcgtcttcggctacctgctgccgctcctgctcatctgcttctgctatgccaaggtgcacgccggtcgcggggccgagacgcgcgagggagggcggagggccggtgggggccctggggtctcagtgtcccgcggccctgccggagccttggcggcagcctggccccggtggtccccactctggcggcgctggtacggatctgtgcagagaggcttcctggccgctgctggagcgtgccattggcttgcgcaagaaagttacttggagtctgagagatgctggggaaagtttgcagttcacttcgcatggtccagtagaaccagtttctcctcccctccccttcctcggccctgcggcccttcaacgcccccaggttgcctgggcggtaggtaggcgggcgctgccgcatccttcccggtacagcaaaccccgctcggttccagcaactcttcaaccagatcagctgcgcggggaggttaccgccgcggcgctgtgggacctgaggagagctctggtggtcaccagagcgcggaccttttgcgagggtgacgggtccccacagctccctcccgggctctcagctggccgtggcgggggggactcgcggggcggcccctctcccccggggtgcgcagtttgccctcgctccgaaggctttgcgcacaccgggctctgtgaagccgctgctcccggggacagagcctcgaattttattttattctgaagcttagctttgtaaacccaagtgcaaaagggtgtttctttacagagtcttgaccgcaggctccaggaacttggaatggaatggactcgagctttcggcttc

SEQ ID NO: 114740 - DNA, 168 bp, Homo sapiens; identical to SEQ ID NO: 82126
  chr18:75088086-75088254
  Hypo

SEQ ID NO: 114741 - DNA, 253 bp, Homo sapiens; identical to SEQ ID NO: 82127
  chr18:75229713-75229966
  Hypo

SEQ ID NO: 114742 - DNA, 810 bp, Homo sapiens; identical to SEQ ID NO: 82128
  chr18:75230170-75230980
  Hypo

SEQ ID NO: 114743 - DNA, 168 bp, Homo sapiens; identical to SEQ ID NO: 82129
  chr18:75339191-75339359
  Hypo

SEQ ID NO: 114744 - DNA, 312 bp, Homo sapiens; identical to SEQ ID NO: 82130
  chr18:75362784-75363096
  Hyper

SEQ ID NO: 114745 - DNA, 30 bp, Homo sapiens; identical to SEQ ID NO: 82131
  chr18:75363596-75363626
  Hypo

SEQ ID NO: 114746 - DNA, 42 bp, Homo sapiens; identical to SEQ ID NO: 82132
  chr18:75369603-75369645
  Hypo

SEQ ID NO: 114747 - DNA, 115 bp, Homo sapiens; identical to SEQ ID NO: 82133
  chr18:75455894-75456009
  Hypo

SEQ ID NO: 114748 - DNA, 30 bp, Homo sapiens; identical to SEQ ID NO: 82134
  chr18:75551271-75551301
  Hypo

SEQ ID NO: 114749 - DNA, 684 bp, Homo sapiens; identical to SEQ ID NO: 82135
  chr18:75611969-75612653
  Hyper

SEQ ID NO: 114750 - DNA, 46 bp, Homo sapiens; identical to SEQ ID NO: 45410
  chr18:75617810-75617856
  Hypo

SEQ ID NO: 114751 - DNA, 30 bp, Homo sapiens; identical to SEQ ID NO: 45411
  chr18:75631688-75631718
  Hypo

SEQ ID NO: 114752 - DNA, 111 bp, Homo sapiens; identical to SEQ ID NO: 82143
  chr18:75685755-75685866
  Hypo

SEQ ID NO: 114753 - DNA, 48 bp, Homo sapiens; identical to SEQ ID NO: 82145
  chr18:75688179-75688227
  Hypo

SEQ ID NO: 114754 - DNA, 30 bp, Homo sapiens; identical to SEQ ID NO: 82146
  chr18:75690504-75690534
  Hypo

SEQ ID NO: 114755 - DNA, 30 bp, Homo sapiens; identical to SEQ ID NO: 82147
  chr18:75696322-75696352
  Hypo

SEQ ID NO: 114756 - DNA, 37 bp, Homo sapiens; identical to SEQ ID NO: 82148
  chr18:75845486-75845523
  Hypo

SEQ ID NO: 114757 - DNA, 163 bp, Homo sapiens; identical to SEQ ID NO: 82149
  chr18:75845747-75845910
  Hypo

SEQ ID NO: 114758 - DNA, 52 bp, Homo sapiens; identical to SEQ ID NO: 82150
  chr18:75886360-75886412
  Hypo

SEQ ID NO: 114759 - DNA, 30 bp, Homo sapiens; identical to SEQ ID NO: 82151
  chr18:75901015-75901045
  Hypo

SEQ ID NO: 114760 - DNA, 812 bp, Homo sapiens; identical to SEQ ID NO: 82152
  chr18:75998622-75999434
  Hypo

SEQ ID NO: 114761 - DNA, 321 bp, Homo sapiens; identical to SEQ ID NO: 82153
  chr18:76073199-76073520
  Hypo

SEQ ID NO: 114762 - DNA, 200 bp, Homo sapiens; identical to SEQ ID NO: 82154
  chr18:76123694-76123894
  Hypo

SEQ ID NO: 114763 - DNA, 30 bp, Homo sapiens; identical to SEQ ID NO: 82155
  chr18:76129420-76129450
  Hypo

SEQ ID NO: 114764 - DNA, 183 bp, Homo sapiens; identical to SEQ ID NO: 82156
  chr18:76161397-76161580
  Hypo

SEQ ID NO: 114765 - DNA, 79 bp, Homo sapiens; identical to SEQ ID NO: 82157
  chr18:76189793-76189872
  Hypo

SEQ ID NO: 114766 - DNA, 63 bp, Homo sapiens; identical to SEQ ID NO: 82158
  chr18:76190665-76190728
  Hypo

SEQ ID NO: 114767 - DNA, 30 bp, Homo sapiens; identical to SEQ ID NO: 82159
  chr18:76206022-76206052
  Hypo

SEQ ID NO: 114768 - DNA, 150 bp, Homo sapiens; identical to SEQ ID NO: 82160
  chr18:76210870-76211020
  Hypo

SEQ ID NO: 114769 - DNA, 277 bp, Homo sapiens; identical to SEQ ID NO: 82161
  chr18:76239446-76239723
  Hypo

SEQ ID NO: 114770 - DNA, 159 bp, Homo sapiens; identical to SEQ ID NO: 82162
  chr18:76412599-76412758
  Hypo

SEQ ID NO: 114771 - DNA, 98 bp, Homo sapiens; identical to SEQ ID NO: 82163
  chr18:76415368-76415466
  Hypo

SEQ ID NO: 114772 - DNA, 32 bp, Homo sapiens; identical to SEQ ID NO: 82164
  chr18:76436423-76436455
  Hypo

SEQ ID NO: 114773 - DNA, 30 bp, Homo sapiens; identical to SEQ ID NO: 82165
  chr18:76463445-76463475
  Hypo

SEQ ID NO: 114774 - DNA, 158 bp, Homo sapiens; identical to SEQ ID NO: 45420
  chr18:76477472-76477630
  Hypo

SEQ ID NO: 114775 - DNA, 74 bp, Homo sapiens; identical to SEQ ID NO: 45421
  chr18:76486799-76486873
  Hypo

SEQ ID NO: 114776 - DNA, 215 bp, Homo sapiens; identical to SEQ ID NO: 45422
  chr18:76501459-76501674
  Hypo

SEQ ID NO: 114777 - DNA, 30 bp, Homo sapiens; identical to SEQ ID NO: 82169
  chr18:76513376-76513406
  Hypo

SEQ ID NO: 114778 - DNA, 30 bp, Homo sapiens; identical to SEQ ID NO: 82170
  chr18:76514550-76514580
  Hypo

SEQ ID NO: 114779 - DNA, 52 bp, Homo sapiens; identical to SEQ ID NO: 82171
  chr18:76540366-76540418
  Hypo

SEQ ID NO: 114780 - DNA, 36 bp, Homo sapiens; identical to SEQ ID NO: 45424
  chr18:76541554-76541590
  Hypo

SEQ ID NO: 114781 - DNA, 39 bp, Homo sapiens; identical to SEQ ID NO: 82173
  chr18:76557065-76557104
  Hypo

SEQ ID NO: 114782 - DNA, 143 bp, Homo sapiens; identical to SEQ ID NO: 82174
  chr18:76564557-76564700
  Hypo

SEQ ID NO: 114783 - DNA, 16 bp, Homo sapiens
  chr18:76571588-76571604
  Hypo
ccgctcatctcctgct

SEQ ID NO: 114784 - DNA, 143 bp, Homo sapiens; identical to SEQ ID NO: 82176
  chr18:76589501-76589644
  Hypo

SEQ ID NO: 114785 - DNA, 159 bp, Homo sapiens; identical to SEQ ID NO: 45427
  chr18:76626246-76626405
  Hypo

SEQ ID NO: 114786 - DNA, 248 bp, Homo sapiens; identical to SEQ ID NO: 82178
  chr18:76653442-76653690
  Hypo

SEQ ID NO: 114787 - DNA, 346 bp, Homo sapiens; identical to SEQ ID NO: 82179
  chr18:76685490-76685836
  Hypo

SEQ ID NO: 114788 - DNA, 145 bp, Homo sapiens; identical to SEQ ID NO: 82180
  chr18:76686134-76686279
  Hypo

SEQ ID NO: 114789 - DNA, 41 bp, Homo sapiens; identical to SEQ ID NO: 82181
  chr18:76693984-76694025
  Hypo

SEQ ID NO: 114790 - DNA, 173 bp, Homo sapiens; identical to SEQ ID NO: 82182
  chr18:77043590-77043763
  Hypo

SEQ ID NO: 114791 - DNA, 51 bp, Homo sapiens; identical to SEQ ID NO: 82183
  chr18:77143458-77143509
  Hypo

SEQ ID NO: 114792 - DNA, 332 bp, Homo sapiens; identical to SEQ ID NO: 37085
  chr18:77153184-77153516
  Hyper

SEQ ID NO: 114793 - DNA, 66 bp, Homo sapiens; identical to SEQ ID NO: 82185
  chr18:77156762-77156828
  Hyper

SEQ ID NO: 114794 - DNA, 199 bp, Homo sapiens; identical to SEQ ID NO: 82186
  chr18:77159823-77160022
  Hyper

SEQ ID NO: 114795 - DNA, 56 bp, Homo sapiens; identical to SEQ ID NO: 82187
  chr18:77160605-77160661
  Hyper

SEQ ID NO: 114796 - DNA, 103 bp, Homo sapiens; identical to SEQ ID NO: 82188
  chr18:77167751-77167854
  Hypo

SEQ ID NO: 114797 - DNA, 167 bp, Homo sapiens; identical to SEQ ID NO: 82189
  chr18:77176557-77176724
  Hypo

SEQ ID NO: 114798 - DNA, 157 bp, Homo sapiens; identical to SEQ ID NO: 45431
  chr18:77181269-77181426
  Hypo

SEQ ID NO: 114799 - DNA, 79 bp, Homo sapiens; identical to SEQ ID NO: 82191
  chr18:77181779-77181858
  Hypo

SEQ ID NO: 114800 - DNA, 112 bp, Homo sapiens; identical to SEQ ID NO: 82192
  chr18:77185612-77185724
  Hypo

SEQ ID NO: 114801 - DNA, 22 bp, Homo sapiens
  chr18:77185948-77185970
  Hypo
cacctggaatcccagcgctttg

SEQ ID NO: 114802 - DNA, 35 bp, Homo sapiens; identical to SEQ ID NO: 82194
  chr18:77186431-77186466
  Hypo

SEQ ID NO: 114803 - DNA, 30 bp, Homo sapiens; identical to SEQ ID NO: 82195
  chr18:77187147-77187177
  Hypo

SEQ ID NO: 114804 - DNA, 50 bp, Homo sapiens; identical to SEQ ID NO: 82196
  chr18:77193378-77193428
  Hypo

SEQ ID NO: 114805 - DNA, 42 bp, Homo sapiens; identical to SEQ ID NO: 82197
  chr18:77194936-77194978
  Hypo

SEQ ID NO: 114806 - DNA, 567 bp, Homo sapiens; identical to SEQ ID NO: 82198
  chr18:77201923-77202490
  Hypo

SEQ ID NO: 114807 - DNA, 74 bp, Homo sapiens; identical to SEQ ID NO: 82199
  chr18:77203641-77203715
  Hypo

SEQ ID NO: 114808 - DNA, 284 bp, Homo sapiens; identical to SEQ ID NO: 82200
  chr18:77205447-77205731
  Hypo

SEQ ID NO: 114809 - DNA, 205 bp, Homo sapiens; identical to SEQ ID NO: 82201
  chr18:77209940-77210145
  Hypo

SEQ ID NO: 114810 - DNA, 41 bp, Homo sapiens; identical to SEQ ID NO: 82202
  chr18:77216863-77216904
  Hypo

SEQ ID NO: 114811 - DNA, 57 bp, Homo sapiens; identical to SEQ ID NO: 82203
  chr18:77221921-77221978
  Hypo

SEQ ID NO: 114812 - DNA, 135 bp, Homo sapiens; identical to SEQ ID NO: 82204
  chr18:77227605-77227740
  Hypo

SEQ ID NO: 114813 - DNA, 30 bp, Homo sapiens; identical to SEQ ID NO: 82205
  chr18:77228944-77228974
  Hypo

SEQ ID NO: 114814 - DNA, 76 bp, Homo sapiens; identical to SEQ ID NO: 82206
  chr18:77229422-77229498
  Hypo

SEQ ID NO: 114815 - DNA, 56 bp, Homo sapiens; identical to SEQ ID NO: 82207
  chr18:77230030-77230086
  Hypo

SEQ ID NO: 114816 - DNA, 631 bp, Homo sapiens; identical to SEQ ID NO: 82208
  chr18:77236039-77236670
  Hypo

SEQ ID NO: 114817 - DNA, 156 bp, Homo sapiens; identical to SEQ ID NO: 82209
  chr18:77239886-77240042
  Hypo

SEQ ID NO: 114818 - DNA, 43 bp, Homo sapiens; identical to SEQ ID NO: 82210
  chr18:77240573-77240616
  Hypo

SEQ ID NO: 114819 - DNA, 519 bp, Homo sapiens; identical to SEQ ID NO: 82211
  chr18:77246353-77246872
  Hypo

SEQ ID NO: 114820 - DNA, 58 bp, Homo sapiens; identical to SEQ ID NO: 82212
  chr18:77247301-77247359
  Hypo

SEQ ID NO: 114821 - DNA, 43 bp, Homo sapiens; identical to SEQ ID NO: 82213
  chr18:77250896-77250939
  Hypo

SEQ ID NO: 114822 - DNA, 36 bp, Homo sapiens; identical to SEQ ID NO: 82214
  chr18:77255748-77255784
  Hypo

SEQ ID NO: 114823 - DNA, 89 bp, Homo sapiens; identical to SEQ ID NO: 82215
  chr18:77271000-77271089
  Hypo

SEQ ID NO: 114824 - DNA, 448 bp, Homo sapiens; identical to SEQ ID NO: 82216
  chr18:77271863-77272311
  Hypo

SEQ ID NO: 114825 - DNA, 325 bp, Homo sapiens; identical to SEQ ID NO: 82217
  chr18:77272937-77273262
  Hypo

SEQ ID NO: 114826 - DNA, 244 bp, Homo sapiens; identical to SEQ ID NO: 45446
  chr18:77285870-77286114
  Hypo

SEQ ID NO: 114827 - DNA, 202 bp, Homo sapiens; identical to SEQ ID NO: 82219
  chr18:77288237-77288439
  Hypo

SEQ ID NO: 114828 - DNA, 30 bp, Homo sapiens; identical to SEQ ID NO: 82220
  chr18:77289162-77289192
  Hypo

SEQ ID NO: 114829 - DNA, 212 bp, Homo sapiens; identical to SEQ ID NO: 82221
  chr18:77290787-77290999
  Hypo

SEQ ID NO: 114830 - DNA, 30 bp, Homo sapiens; identical to SEQ ID NO: 82222
  chr18:77305341-77305371
  Hypo

SEQ ID NO: 114831 - DNA, 207 bp, Homo sapiens; identical to SEQ ID NO: 82223
  chr18:77307603-77307810
  Hypo

SEQ ID NO: 114832 - DNA, 241 bp, Homo sapiens; identical to SEQ ID NO: 82224
  chr18:77308327-77308568
  Hypo

SEQ ID NO: 114833 - DNA, 201 bp, Homo sapiens; identical to SEQ ID NO: 82225
  chr18:77309533-77309734
  Hypo

SEQ ID NO: 114834 - DNA, 136 bp, Homo sapiens; identical to SEQ ID NO: 82226
  chr18:77312103-77312239
  Hypo

SEQ ID NO: 114835 - DNA, 49 bp, Homo sapiens; identical to SEQ ID NO: 82227
  chr18:77312878-77312927
  Hypo

SEQ ID NO: 114836 - DNA, 149 bp, Homo sapiens; identical to SEQ ID NO: 82228
  chr18:77313872-77314021
  Hypo

SEQ ID NO: 114837 - DNA, 32 bp, Homo sapiens; identical to SEQ ID NO: 82229
  chr18:77315506-77315538
  Hypo

SEQ ID NO: 114838 - DNA, 30 bp, Homo sapiens; identical to SEQ ID NO: 82230
  chr18:77315989-77316019
  Hypo

SEQ ID NO: 114839 - DNA, 212 bp, Homo sapiens; identical to SEQ ID NO: 82231
  chr18:77320311-77320523
  Hypo

SEQ ID NO: 114840 - DNA, 373 bp, Homo sapiens; identical to SEQ ID NO: 82232
  chr18:77329644-77330017
  Hypo

SEQ ID NO: 114841 - DNA, 30 bp, Homo sapiens; identical to SEQ ID NO: 82233
  chr18:77331718-77331748
  Hypo

SEQ ID NO: 114842 - DNA, 30 bp, Homo sapiens; identical to SEQ ID NO: 82234
  chr18:77339091-77339121
  Hypo

SEQ ID NO: 114843 - DNA, 30 bp, Homo sapiens; identical to SEQ ID NO: 82235
  chr18:77345226-77345256
  Hypo

SEQ ID NO: 114844 - DNA, 34 bp, Homo sapiens; identical to SEQ ID NO: 82236
  chr18:77346594-77346628
  Hypo

SEQ ID NO: 114845 - DNA, 139 bp, Homo sapiens; identical to SEQ ID NO: 82237
  chr18:77357869-77358008
  Hypo

SEQ ID NO: 114846 - DNA, 30 bp, Homo sapiens; identical to SEQ ID NO: 82238
  chr18:77363914-77363944
  Hypo

SEQ ID NO: 114847 - DNA, 261 bp, Homo sapiens; identical to SEQ ID NO: 45454
  chr18:77364366-77364627
  Hypo

SEQ ID NO: 114848 - DNA, 35 bp, Homo sapiens; identical to SEQ ID NO: 82240
  chr18:77364942-77364977
  Hypo

SEQ ID NO: 114849 - DNA, 35 bp, Homo sapiens; identical to SEQ ID NO: 82241
  chr18:77365157-77365192
  Hypo

SEQ ID NO: 114850 - DNA, 154 bp, Homo sapiens; identical to SEQ ID NO: 82242
  chr18:77365670-77365824
  Hypo

SEQ ID NO: 114851 - DNA, 78 bp, Homo sapiens; identical to SEQ ID NO: 82243
  chr18:77371430-77371508
  Hypo

SEQ ID NO: 114852 - DNA, 30 bp, Homo sapiens; identical to SEQ ID NO: 82244
  chr18:77393026-77393056
  Hypo

SEQ ID NO: 114853 - DNA, 178 bp, Homo sapiens; identical to SEQ ID NO: 82245
  chr18:77410020-77410198
  Hypo

SEQ ID NO: 114854 - DNA, 32 bp, Homo sapiens; identical to SEQ ID NO: 82246
  chr18:77417240-77417272
  Hypo

SEQ ID NO: 114855 - DNA, 30 bp, Homo sapiens; identical to SEQ ID NO: 82247
  chr18:77502354-77502384
  Hypo

SEQ ID NO: 114856 - DNA, 47 bp, Homo sapiens; identical to SEQ ID NO: 82248
  chr18:77508899-77508946
  Hypo

SEQ ID NO: 114857 - DNA, 335 bp, Homo sapiens; identical to SEQ ID NO: 82249
  chr18:77509344-77509679
  Hypo

SEQ ID NO: 114858 - DNA, 58 bp, Homo sapiens; identical to SEQ ID NO: 82250
  chr18:77531551-77531609
  Hypo

SEQ ID NO: 114859 - DNA, 48 bp, Homo sapiens; identical to SEQ ID NO: 82251
  chr18:77532151-77532199
  Hypo

SEQ ID NO: 114860 - DNA, 77 bp, Homo sapiens; identical to SEQ ID NO: 82252
  chr18:77533370-77533447
  Hypo

SEQ ID NO: 114861 - DNA, 71 bp, Homo sapiens; identical to SEQ ID NO: 82253
  chr18:77534949-77535020
  Hypo

SEQ ID NO: 114862 - DNA, 46 bp, Homo sapiens; identical to SEQ ID NO: 45460
  chr18:77542905-77542951
  Hypo

SEQ ID NO: 114863 - DNA, 155 bp, Homo sapiens; identical to SEQ ID NO: 82255
  chr18:77543221-77543376
  Hypo

SEQ ID NO: 114864 - DNA, 124 bp, Homo sapiens; identical to SEQ ID NO: 82256
  chr18:77543700-77543824
  Hypo

SEQ ID NO: 114865 - DNA, 147 bp, Homo sapiens; identical to SEQ ID NO: 82257
  chr18:77544654-77544801
  Hypo

SEQ ID NO: 114866 - DNA, 778 bp, Homo sapiens
  chr18:77547831-77548609
  Hyper
tttattttagtcctccgcgaaggagcctctcaaatattcccggagcacaggctaatttagaacgtgttatcctgacaaggcggcccagccagggaggagacgccggggtccgcgccgcggggcgggcgcttccccggacccgggggaggcgggacgcaggcgaaggccgccccgggagagcggggtcccgggagagcggggtcccggctgtgggggacgcgggccgaggctgtcgcgaagccgctgacggccgaggcgctcccggttttcgcggcgcacaagggttgcccgagcgctcagagcaggggccgccacgcgggcgcccggtccaacccgcggcctcccgggtccctcctagcggggccgcagacgcccgcgagccgcgtccccggagcgcagaagatccccgcgcacagcgcaggccccgccggcccggtggacccgcttgaggacgcggagggggcgcgtttcctctgcggcgcccgcacggcctctgcccgcctgtcccgcgctcccgcccggcaggcccagctcggacgaggctcagctgccgcccccgttgcctttgtgggtttttctgcggaagccccttttcctcgggtggatgggaccctgcgcgtggaaccccgcacagcccccgctccgccgcgggccgcaggacccattccttctccacggtggcgctggggaggggctgcttccacccaggagattcgcgagggagagaaaacatgcggctcacatccggacggcagccccgccccgcttagaaacaata

SEQ ID NO: 114867 - DNA, 470 bp, Homo sapiens; identical to SEQ ID NO: 82260
  chr18:77549960-77550430
  Hypo

SEQ ID NO: 114868 - DNA, 1441 bp, Homo sapiens
  chr18:77557808-77559249
  Hyper
ggctccaaacccagccgagggtcggctcgctcctggggacccgcggatgtcgcgagggggcgccgcgccactgaaggctgggacgggggcggtgcgcggggcggcgccggagtccgggatgccggctccagagacgccgcgctccgccccgaggaggccgccggccgggtaagcggagcccggagctcgcggagtctggaccgcaggtaaagttgagcgcgccgtggggccgggggtggggggtccgcggcgaaggagccggggccgcagtgggcggtggggcggggggcgcgggctcctgtctgatggttccgcgcgcagcttcttctccgggtgcgcggtgcgcgcgggcgcgggagggtcgaaggggaccttggaatccccctgttcgggccaagggggcgggggcggctcggggccgggcggggctggtgcctccccctcccgctcagcgcccagagtccgggagtcgaggggggcgtcgggccggaggcgctcgccggtctggccgcgccgcgcgcgtggatggaggtctcggccgcggatcgccccgtctattcgcgctggtcctgcgggagcccgggtgagccgaaggcgaggaaggggcgcgggtctcgggaaaacccgactctcccggcgcccgccccggttcggttgggggcgcacccggctcgcgcggagagcgggcggggtgtgggcgaatgctcggcgcgctgcgcctttcccggtcccccttctccccggagatgaacgccccactcccgctcggacacacggccgcacccctactctgcctcctccgaccagccggggcgcggcccgaattgggggagagaagacccagctcccgcagccgcgaattctgcaaacccggagcccatgcgccccgtcctccggcccggggagctcccagccttgcccgccgagcgcagcccgggtccggactgtggtcactggggacgagaagggtccctcctgcggggctcccgggttcggatggacggagggggcgtccggcaggtgaactgggcccgctccgcgtcccgaacgttcccctaaacccacaagtcccggagaccctggggcattctgcgatttcggagtgaccggtggagcccccgcccgcgcgcctggctcccggggtctccccacacagcaggggctgcggggaccccctctgtcacctcctccaaagggtctgggagcaattcgacctgcctggagaattccaggaagtcctttccctgcgggagcctcatgggtccccccttctctgcctgcagagacctctggcttccgcgtgcgctcaaagtgagcgccgggcagattgtaaataatggattttgacccagctgggagatctcagagtgattaagtggagaggctgttccaccctcagccctgcccaggcagctgggtgaccccgcgggccacatgccac

SEQ ID NO: 114869 - DNA, 25 bp, Homo sapiens
  chr18:77569611-77569636
  Hypo
ccagagtcctcgccctgaggagctg

SEQ ID NO: 114870 - DNA, 256 bp, Homo sapiens; identical to SEQ ID NO: 82265
  chr18:77576934-77577190
  Hypo

SEQ ID NO: 114871 - DNA, 47 bp, Homo sapiens; identical to SEQ ID NO: 82266
  chr18:77578855-77578902
  Hypo

SEQ ID NO: 114872 - DNA, 30 bp, Homo sapiens; identical to SEQ ID NO: 82267
  chr18:77582757-77582787
  Hypo

SEQ ID NO: 114873 - DNA, 30 bp, Homo sapiens; identical to SEQ ID NO: 82268
  chr18:77605211-77605241
  Hypo

SEQ ID NO: 114874 - DNA, 92 bp, Homo sapiens; identical to SEQ ID NO: 82269
  chr18:77609586-77609678
  Hypo

SEQ ID NO: 114875 - DNA, 40 bp, Homo sapiens; identical to SEQ ID NO: 45467
  chr18:77612204-77612244
  Hypo

SEQ ID NO: 114876 - DNA, 30 bp, Homo sapiens; identical to SEQ ID NO: 82271
  chr18:77612868-77612898
  Hypo

SEQ ID NO: 114877 - DNA, 222 bp, Homo sapiens; identical to SEQ ID NO: 82272
  chr18:77622385-77622607
  Hypo

SEQ ID NO: 114878 - DNA, 52 bp, Homo sapiens; identical to SEQ ID NO: 82273
  chr18:77627776-77627828
  Hypo

SEQ ID NO: 114879 - DNA, 136 bp, Homo sapiens; identical to SEQ ID NO: 82274
  chr18:77628334-77628470
  Hypo

SEQ ID NO: 114880 - DNA, 124 bp, Homo sapiens; identical to SEQ ID NO: 82275
  chr18:77628901-77629025
  Hypo

SEQ ID NO: 114881 - DNA, 56 bp, Homo sapiens; identical to SEQ ID NO: 82276
  chr18:77631027-77631083
  Hypo

SEQ ID NO: 114882 - DNA, 218 bp, Homo sapiens; identical to SEQ ID NO: 82277
  chr18:77631760-77631978
  Hypo

SEQ ID NO: 114883 - DNA, 44 bp, Homo sapiens; identical to SEQ ID NO: 82278
  chr18:77635572-77635616
  Hypo

SEQ ID NO: 114884 - DNA, 30 bp, Homo sapiens; identical to SEQ ID NO: 82279
  chr18:77635848-77635878
  Hypo

SEQ ID NO: 114885 - DNA, 40 bp, Homo sapiens; identical to SEQ ID NO: 45473
  chr18:77636150-77636190
  Hypo

SEQ ID NO: 114886 - DNA, 265 bp, Homo sapiens; identical to SEQ ID NO: 82281
  chr18:77636534-77636799
  Hypo

SEQ ID NO: 114887 - DNA, 217 bp, Homo sapiens; identical to SEQ ID NO: 82282
  chr18:77644664-77644881
  Hypo

SEQ ID NO: 114888 - DNA, 36 bp, Homo sapiens; identical to SEQ ID NO: 82283
  chr18:77664997-77665033
  Hypo

SEQ ID NO: 114889 - DNA, 30 bp, Homo sapiens; identical to SEQ ID NO: 82284
  chr18:77685415-77685445
  Hypo

SEQ ID NO: 114890 - DNA, 32 bp, Homo sapiens; identical to SEQ ID NO: 82285
  chr18:77713122-77713154
  Hypo

SEQ ID NO: 114891 - DNA, 16 bp, Homo sapiens
  chr18:77718382-77718398
  Hypo
gcgcccggccaacctc

SEQ ID NO: 114892 - DNA, 24 bp, Homo sapiens
  chr18:77725938-77725962
  Hypo
ttttattttttgagacggagtgtc

SEQ ID NO: 114893 - DNA, 16 bp, Homo sapiens
  chr18:77728894-77728910
  Hypo
gattcagaagccaggc

SEQ ID NO: 114894 - DNA, 30 bp, Homo sapiens; identical to SEQ ID NO: 82289
  chr18:77795658-77795688
  Hypo

SEQ ID NO: 114895 - DNA, 30 bp, Homo sapiens; identical to SEQ ID NO: 82290
  chr18:77809156-77809186
  Hypo

SEQ ID NO: 114896 - DNA, 171 bp, Homo sapiens; identical to SEQ ID NO: 82291
  chr18:78004571-78004742
  Hyper

SEQ ID NO: 114897 - DNA, 78 bp, Homo sapiens; identical to SEQ ID NO: 82292
  chr18:78005084-78005162
  Hyper

SEQ ID NO: 114898 - DNA, 98 bp, Homo sapiens; identical to SEQ ID NO: 82293
  chr18:78005567-78005665
  Hyper

SEQ ID NO: 114899 - DNA, 76 bp, Homo sapiens
  chr19:267161-267237
  Hyper
gcgttgctcctttctcggcgccaggatctctccccaggaaccagcgcagatccggaggccacgctgcgctgcgctg

SEQ ID NO: 114900 - DNA, 90 bp, Homo sapiens; identical to SEQ ID NO: 83022
  chr19:267567-267657
  Hyper

SEQ ID NO: 114901 - DNA, 87 bp, Homo sapiens; identical to SEQ ID NO: 83038
  chr19:290965-291052
  Hyper

SEQ ID NO: 114902 - DNA, 231 bp, Homo sapiens; identical to SEQ ID NO: 83040
  chr19:292054-292285
  Hypo

SEQ ID NO: 114903 - DNA, 33 bp, Homo sapiens; identical to SEQ ID NO: 83047
  chr19:295054-295087
  Hyper

SEQ ID NO: 114904 - DNA, 30 bp, Homo sapiens; identical to SEQ ID NO: 83101
  chr19:307368-307398
  Hypo

SEQ ID NO: 114905 - DNA, 30 bp, Homo sapiens; identical to SEQ ID NO: 83217
  chr19:347146-347176
  Hypo

SEQ ID NO: 114906 - DNA, 120 bp, Homo sapiens; identical to SEQ ID NO: 83219
  chr19:349135-349255
  Hypo

SEQ ID NO: 114907 - DNA, 118 bp, Homo sapiens; identical to SEQ ID NO: 45479
  chr19:400972-401090
  Hypo

SEQ ID NO: 114908 - DNA, 52 bp, Homo sapiens; identical to SEQ ID NO: 83523
  chr19:401481-401533
  Hypo

SEQ ID NO: 114909 - DNA, 442 bp, Homo sapiens; identical to SEQ ID NO: 45481
  chr19:403367-403809
  Hypo

SEQ ID NO: 114910 - DNA, 708 bp, Homo sapiens; identical to SEQ ID NO: 83539
  chr19:407124-407832
  Hypo

SEQ ID NO: 114911 - DNA, 51 bp, Homo sapiens; identical to SEQ ID NO: 83578
  chr19:413211-413262
  Hypo

SEQ ID NO: 114912 - DNA, 30 bp, Homo sapiens; identical to SEQ ID NO: 83607
  chr19:422922-422952
  Hypo

SEQ ID NO: 114913 - DNA, 186 bp, Homo sapiens; identical to SEQ ID NO: 83628
  chr19:426825-427011
  Hypo

SEQ ID NO: 114914 - DNA, 34 bp, Homo sapiens; identical to SEQ ID NO: 83659
  chr19:436312-436346
  Hypo

SEQ ID NO: 114915 - DNA, 30 bp, Homo sapiens; identical to SEQ ID NO: 83661
  chr19:436614-436644
  Hypo

SEQ ID NO: 114916 - DNA, 94 bp, Homo sapiens; identical to SEQ ID NO: 83759
  chr19:460027-460121
  Hyper

SEQ ID NO: 114917 - DNA, 51 bp, Homo sapiens; identical to SEQ ID NO: 83761
  chr19:460675-460726
  Hyper

SEQ ID NO: 114918 - DNA, 56 bp, Homo sapiens; identical to SEQ ID NO: 83764
  chr19:461131-461187
  Hyper

SEQ ID NO: 114919 - DNA, 58 bp, Homo sapiens; identical to SEQ ID NO: 83770
  chr19:461788-461846
  Hyper

SEQ ID NO: 114920 - DNA, 30 bp, Homo sapiens; identical to SEQ ID NO: 83772
  chr19:462130-462160
  Hyper

SEQ ID NO: 114921 - DNA, 84 bp, Homo sapiens; identical to SEQ ID NO: 83798
  chr19:468719-468803
  Hypo

SEQ ID NO: 114922 - DNA, 318 bp, Homo sapiens; identical to SEQ ID NO: 83817
  chr19:470831-471149
  Hypo

SEQ ID NO: 114923 - DNA, 30 bp, Homo sapiens; identical to SEQ ID NO: 83885
  chr19:484049-484079
  Hypo

SEQ ID NO: 114924 - DNA, 275 bp, Homo sapiens; identical to SEQ ID NO: 83887
  chr19:485119-485394
  Hypo

SEQ ID NO: 114925 - DNA, 229 bp, Homo sapiens; identical to SEQ ID NO: 83923
  chr19:491311-491540
  Hypo

SEQ ID NO: 114926 - DNA, 78 bp, Homo sapiens; identical to SEQ ID NO: 37093
  chr19:496464-496542
  Hyper

SEQ ID NO: 114927 - DNA, 49 bp, Homo sapiens; identical to SEQ ID NO: 83953
  chr19:497872-497921
  Hyper

SEQ ID NO: 114928 - DNA, 79 bp, Homo sapiens; identical to SEQ ID NO: 83968
  chr19:499757-499836
  Hypo

SEQ ID NO: 114929 - DNA, 83 bp, Homo sapiens; identical to SEQ ID NO: 84030
  chr19:508329-508412
  Hypo

SEQ ID NO: 114930 - DNA, 16 bp, Homo sapiens
  chr19:520802-520818
  Hypo
ccgtctcaaaaaaata

SEQ ID NO: 114931 - DNA, 45 bp, Homo sapiens; identical to SEQ ID NO: 84127
  chr19:522927-522972
  Hypo

SEQ ID NO: 114932 - DNA, 274 bp, Homo sapiens; identical to SEQ ID NO: 84129
  chr19:524057-524331
  Hypo

SEQ ID NO: 114933 - DNA, 261 bp, Homo sapiens; identical to SEQ ID NO: 84169
  chr19:530219-530480
  Hypo

SEQ ID NO: 114934 - DNA, 30 bp, Homo sapiens; identical to SEQ ID NO: 84315
  chr19:547205-547235
  Hypo

SEQ ID NO: 114935 - DNA, 49 bp, Homo sapiens; identical to SEQ ID NO: 84316
  chr19:547453-547502
  Hypo

SEQ ID NO: 114936 - DNA, 230 bp, Homo sapiens; identical to SEQ ID NO: 84317
  chr19:548473-548703
  Hypo

SEQ ID NO: 114937 - DNA, 737 bp, Homo sapiens; identical to SEQ ID NO: 84318
  chr19:549291-550028
  Hypo

SEQ ID NO: 114938 - DNA, 134 bp, Homo sapiens; identical to SEQ ID NO: 84319
  chr19:550388-550522
  Hypo

SEQ ID NO: 114939 - DNA, 42 bp, Homo sapiens; identical to SEQ ID NO: 84320
  chr19:550909-550951
  Hypo

SEQ ID NO: 114940 - DNA, 105 bp, Homo sapiens; identical to SEQ ID NO: 84321
  chr19:553021-553126
  Hypo

SEQ ID NO: 114941 - DNA, 20 bp, Homo sapiens
  chr19:555505-555525
  Hypo
gccaccgtacccagcggaag

SEQ ID NO: 114942 - DNA, 296 bp, Homo sapiens; identical to SEQ ID NO: 84333
  chr19:557059-557355
  Hypo

SEQ ID NO: 114943 - DNA, 24 bp, Homo sapiens
  chr19:558037-558061
  Hypo
gatgccaaggtcaggcgccgtcgc

SEQ ID NO: 114944 - DNA, 30 bp, Homo sapiens; identical to SEQ ID NO: 84351
  chr19:559290-559320
  Hypo

SEQ ID NO: 114945 - DNA, 77 bp, Homo sapiens; identical to SEQ ID NO: 84360
  chr19:559731-559808
  Hypo

SEQ ID NO: 114946 - DNA, 45 bp, Homo sapiens; identical to SEQ ID NO: 84515
  chr19:582760-582805
  Hypo

SEQ ID NO: 114947 - DNA, 343 bp, Homo sapiens; identical to SEQ ID NO: 84592
  chr19:591245-591588
  Hyper

SEQ ID NO: 114948 - DNA, 192 bp, Homo sapiens; identical to SEQ ID NO: 84596
  chr19:592378-592570
  Hypo

SEQ ID NO: 114949 - DNA, 201 bp, Homo sapiens; identical to SEQ ID NO: 84597
  chr19:593124-593325
  Hypo

SEQ ID NO: 114950 - DNA, 267 bp, Homo sapiens; identical to SEQ ID NO: 84601
  chr19:599192-599459
  Hypo

SEQ ID NO: 114951 - DNA, 72 bp, Homo sapiens; identical to SEQ ID NO: 84603
  chr19:601680-601752
  Hypo

SEQ ID NO: 114952 - DNA, 61 bp, Homo sapiens; identical to SEQ ID NO: 84607
  chr19:602546-602607
  Hypo

SEQ ID NO: 114953 - DNA, 30 bp, Homo sapiens; identical to SEQ ID NO: 84608
  chr19:603816-603846
  Hypo

SEQ ID NO: 114954 - DNA, 30 bp, Homo sapiens; identical to SEQ ID NO: 84611
  chr19:617617-617647
  Hypo

SEQ ID NO: 114955 - DNA, 52 bp, Homo sapiens; identical to SEQ ID NO: 84614
  chr19:623973-624025
  Hypo

SEQ ID NO: 114956 - DNA, 62 bp, Homo sapiens; identical to SEQ ID NO: 84616
  chr19:629547-629609
  Hypo

SEQ ID NO: 114957 - DNA, 84 bp, Homo sapiens; identical to SEQ ID NO: 45504
  chr19:634304-634388
  Hypo

SEQ ID NO: 114958 - DNA, 30 bp, Homo sapiens; identical to SEQ ID NO: 84621
  chr19:635350-635380
  Hypo

SEQ ID NO: 114959 - DNA, 94 bp, Homo sapiens; identical to SEQ ID NO: 84623
  chr19:638382-638476
  Hypo

SEQ ID NO: 114960 - DNA, 241 bp, Homo sapiens; identical to SEQ ID NO: 84625
  chr19:639897-640138
  Hyper

SEQ ID NO: 114961 - DNA, 94 bp, Homo sapiens; identical to SEQ ID NO: 84626
  chr19:640913-641007
  Hypo

SEQ ID NO: 114962 - DNA, 103 bp, Homo sapiens; identical to SEQ ID NO: 37096
  chr19:661158-661261
  Hyper

SEQ ID NO: 114963 - DNA, 134 bp, Homo sapiens; identical to SEQ ID NO: 84635
  chr19:661586-661720
  Hyper

SEQ ID NO: 114964 - DNA, 35 bp, Homo sapiens; identical to SEQ ID NO: 84638
  chr19:676411-676446
  Hyper

SEQ ID NO: 114965 - DNA, 48 bp, Homo sapiens; identical to SEQ ID NO: 84642
  chr19:689360-689408
  Hypo

SEQ ID NO: 114966 - DNA, 180 bp, Homo sapiens; identical to SEQ ID NO: 84643
  chr19:696811-696991
  Hypo

SEQ ID NO: 114967 - DNA, 76 bp, Homo sapiens; identical to SEQ ID NO: 84647
  chr19:704330-704406
  Hyper

SEQ ID NO: 114968 - DNA, 191 bp, Homo sapiens; identical to SEQ ID NO: 84648
  chr19:709228-709419
  Hyper

SEQ ID NO: 114969 - DNA, 94 bp, Homo sapiens; identical to SEQ ID NO: 84649
  chr19:709624-709718
  Hyper

SEQ ID NO: 114970 - DNA, 30 bp, Homo sapiens; identical to SEQ ID NO: 84654
  chr19:724198-724228
  Hypo

SEQ ID NO: 114971 - DNA, 50 bp, Homo sapiens; identical to SEQ ID NO: 84656
  chr19:727011-727061
  Hypo

SEQ ID NO: 114972 - DNA, 30 bp, Homo sapiens; identical to SEQ ID NO: 84658
  chr19:743036-743066
  Hypo

SEQ ID NO: 114973 - DNA, 309 bp, Homo sapiens; identical to SEQ ID NO: 84659
  chr19:748300-748609
  Hypo

SEQ ID NO: 114974 - DNA, 36 bp, Homo sapiens; identical to SEQ ID NO: 84660
  chr19:750921-750957
  Hypo

SEQ ID NO: 114975 - DNA, 278 bp, Homo sapiens; identical to SEQ ID NO: 84661
  chr19:752081-752359
  Hypo

SEQ ID NO: 114976 - DNA, 98 bp, Homo sapiens; identical to SEQ ID NO: 84662
  chr19:752539-752637
  Hypo

SEQ ID NO: 114977 - DNA, 122 bp, Homo sapiens; identical to SEQ ID NO: 84688
  chr19:793725-793847
  Hypo

SEQ ID NO: 114978 - DNA, 30 bp, Homo sapiens; identical to SEQ ID NO: 84699
  chr19:803736-803766
  Hypo

SEQ ID NO: 114979 - DNA, 82 bp, Homo sapiens; identical to SEQ ID NO: 84703
  chr19:807376-807458
  Hypo

SEQ ID NO: 114980 - DNA, 38 bp, Homo sapiens; identical to SEQ ID NO: 84707
  chr19:811976-812014
  Hypo

SEQ ID NO: 114981 - DNA, 134 bp, Homo sapiens; identical to SEQ ID NO: 84709
  chr19:813696-813830
  Hypo

SEQ ID NO: 114982 - DNA, 312 bp, Homo sapiens; identical to SEQ ID NO: 84710
  chr19:814429-814741
  Hypo

SEQ ID NO: 114983 - DNA, 89 bp, Homo sapiens; identical to SEQ ID NO: 84713
  chr19:815479-815568
  Hypo

SEQ ID NO: 114984 - DNA, 32 bp, Homo sapiens; identical to SEQ ID NO: 84718
  chr19:821453-821485
  Hyper

SEQ ID NO: 114985 - DNA, 214 bp, Homo sapiens; identical to SEQ ID NO: 84719
  chr19:821728-821942
  Hyper

SEQ ID NO: 114986 - DNA, 401 bp, Homo sapiens; identical to SEQ ID NO: 84720
  chr19:822301-822702
  Hyper

SEQ ID NO: 114987 - DNA, 37 bp, Homo sapiens; identical to SEQ ID NO: 84727
  chr19:850004-850041
  Hypo

SEQ ID NO: 114988 - DNA, 30 bp, Homo sapiens; identical to SEQ ID NO: 84728
  chr19:851519-851549
  Hypo

SEQ ID NO: 114989 - DNA, 46 bp, Homo sapiens; identical to SEQ ID NO: 84732
  chr19:869220-869266
  Hypo

SEQ ID NO: 114990 - DNA, 51 bp, Homo sapiens; identical to SEQ ID NO: 84733
  chr19:870952-871003
  Hypo

SEQ ID NO: 114991 - DNA, 30 bp, Homo sapiens; identical to SEQ ID NO: 84734
  chr19:877065-877095
  Hypo

SEQ ID NO: 114992 - DNA, 729 bp, Homo sapiens; identical to SEQ ID NO: 84735
  chr19:883582-884311
  Hypo

SEQ ID NO: 114993 - DNA, 60 bp, Homo sapiens; identical to SEQ ID NO: 84736
  chr19:885052-885112
  Hypo

SEQ ID NO: 114994 - DNA, 100 bp, Homo sapiens; identical to SEQ ID NO: 84737
  chr19:891516-891616
  Hypo

SEQ ID NO: 114995 - DNA, 30 bp, Homo sapiens; identical to SEQ ID NO: 84738
  chr19:892049-892079
  Hypo

SEQ ID NO: 114996 - DNA, 41 bp, Homo sapiens; identical to SEQ ID NO: 45518
  chr19:893910-893951
  Hypo

SEQ ID NO: 114997 - DNA, 258 bp, Homo sapiens; identical to SEQ ID NO: 84740
  chr19:900808-901066
  Hypo

SEQ ID NO: 114998 - DNA, 30 bp, Homo sapiens; identical to SEQ ID NO: 84741
  chr19:911544-911574
  Hypo

SEQ ID NO: 114999 - DNA, 30 bp, Homo sapiens; identical to SEQ ID NO: 84743
  chr19:919561-919591
  Hyper

SEQ ID NO: 115000 - DNA, 30 bp, Homo sapiens; identical to SEQ ID NO: 84744
  chr19:920788-920818
  Hyper

SEQ ID NO: 115001 - DNA, 22 bp, Homo sapiens
  chr19:939412-939434
  Hypo
ggcctctcgatacacttttggt

SEQ ID NO: 115002 - DNA, 113 bp, Homo sapiens; identical to SEQ ID NO: 45520
  chr19:945999-946112
  Hypo

SEQ ID NO: 115003 - DNA, 919 bp, Homo sapiens; identical to SEQ ID NO: 84754
  chr19:955719-956638
  Hypo

SEQ ID NO: 115004 - DNA, 30 bp, Homo sapiens; identical to SEQ ID NO: 84755
  chr19:956878-956908
  Hypo

SEQ ID NO: 115005 - DNA, 235 bp, Homo sapiens; identical to SEQ ID NO: 84756
  chr19:957166-957401
  Hypo

SEQ ID NO: 115006 - DNA, 215 bp, Homo sapiens; identical to SEQ ID NO: 84757
  chr19:959587-959802
  Hypo

SEQ ID NO: 115007 - DNA, 131 bp, Homo sapiens; identical to SEQ ID NO: 84759
  chr19:963944-964075
  Hypo

SEQ ID NO: 115008 - DNA, 67 bp, Homo sapiens; identical to SEQ ID NO: 84761
  chr19:977345-977412
  Hypo

SEQ ID NO: 115009 - DNA, 30 bp, Homo sapiens; identical to SEQ ID NO: 84764
  chr19:991396-991426
  Hypo

SEQ ID NO: 115010 - DNA, 51 bp, Homo sapiens; identical to SEQ ID NO: 84767
  chr19:996004-996055
  Hypo

SEQ ID NO: 115011 - DNA, 133 bp, Homo sapiens; identical to SEQ ID NO: 82334
  chr19:1000497-1000630
  Hyper

SEQ ID NO: 115012 - DNA, 681 bp, Homo sapiens; identical to SEQ ID NO: 82337
  chr19:1003156-1003837
  Hypo

SEQ ID NO: 115013 - DNA, 666 bp, Homo sapiens; identical to SEQ ID NO: 45526
  chr19:1004775-1005441
  Hypo

SEQ ID NO: 115014 - DNA, 61 bp, Homo sapiens; identical to SEQ ID NO: 82339
  chr19:1007604-1007665
  Hypo

SEQ ID NO: 115015 - DNA, 33 bp, Homo sapiens; identical to SEQ ID NO: 82340
  chr19:1007908-1007941
  Hypo

SEQ ID NO: 115016 - DNA, 193 bp, Homo sapiens; identical to SEQ ID NO: 82350
  chr19:1030032-1030225
  Hypo

SEQ ID NO: 115017 - DNA, 30 bp, Homo sapiens; identical to SEQ ID NO: 82368
  chr19:1041553-1041583
  Hypo

SEQ ID NO: 115018 - DNA, 73 bp, Homo sapiens; identical to SEQ ID NO: 82369
  chr19:1041801-1041874
  Hypo

SEQ ID NO: 115019 - DNA, 56 bp, Homo sapiens; identical to SEQ ID NO: 45528
  chr19:1042258-1042314
  Hypo

SEQ ID NO: 115020 - DNA, 92 bp, Homo sapiens; identical to SEQ ID NO: 82371
  chr19:1047836-1047928
  Hypo

SEQ ID NO: 115021 - DNA, 386 bp, Homo sapiens; identical to SEQ ID NO: 82373
  chr19:1051207-1051593
  Hypo

SEQ ID NO: 115022 - DNA, 138 bp, Homo sapiens; identical to SEQ ID NO: 82374
  chr19:1051881-1052019
  Hypo

SEQ ID NO: 115023 - DNA, 36 bp, Homo sapiens; identical to SEQ ID NO: 82398
  chr19:1080710-1080746
  Hypo

SEQ ID NO: 115024 - DNA, 36 bp, Homo sapiens; identical to SEQ ID NO: 82400
  chr19:1082973-1083009
  Hypo

SEQ ID NO: 115025 - DNA, 30 bp, Homo sapiens; identical to SEQ ID NO: 82401
  chr19:1083466-1083496
  Hypo

SEQ ID NO: 115026 - DNA, 30 bp, Homo sapiens; identical to SEQ ID NO: 82402
  chr19:1083719-1083749
  Hypo

SEQ ID NO: 115027 - DNA, 185 bp, Homo sapiens; identical to SEQ ID NO: 82404
  chr19:1085976-1086161
  Hypo

SEQ ID NO: 115028 - DNA, 186 bp, Homo sapiens; identical to SEQ ID NO: 45533
  chr19:1105541-1105727
  Hypo

SEQ ID NO: 115029 - DNA, 508 bp, Homo sapiens; identical to SEQ ID NO: 82421
  chr19:1112253-1112761
  Hypo

SEQ ID NO: 115030 - DNA, 405 bp, Homo sapiens; identical to SEQ ID NO: 82424
  chr19:1113252-1113657
  Hyper

SEQ ID NO: 115031 - DNA, 82 bp, Homo sapiens; identical to SEQ ID NO: 82426
  chr19:1123343-1123425
  Hypo

SEQ ID NO: 115032 - DNA, 69 bp, Homo sapiens; identical to SEQ ID NO: 82438
  chr19:1156214-1156283
  Hypo

SEQ ID NO: 115033 - DNA, 104 bp, Homo sapiens; identical to SEQ ID NO: 82439
  chr19:1156524-1156628
  Hypo

SEQ ID NO: 115034 - DNA, 42 bp, Homo sapiens; identical to SEQ ID NO: 82441
  chr19:1157959-1158001
  Hypo

SEQ ID NO: 115035 - DNA, 117 bp, Homo sapiens; identical to SEQ ID NO: 82449
  chr19:1167208-1167325
  Hypo

SEQ ID NO: 115036 - DNA, 45 bp, Homo sapiens; identical to SEQ ID NO: 82451
  chr19:1170185-1170230
  Hypo

SEQ ID NO: 115037 - DNA, 142 bp, Homo sapiens; identical to SEQ ID NO: 82452
  chr19:1170687-1170829
  Hypo

SEQ ID NO: 115038 - DNA, 354 bp, Homo sapiens; identical to SEQ ID NO: 45539
  chr19:1171068-1171422
  Hypo

SEQ ID NO: 115039 - DNA, 99 bp, Homo sapiens; identical to SEQ ID NO: 82456
  chr19:1181413-1181512
  Hypo

SEQ ID NO: 115040 - DNA, 30 bp, Homo sapiens; identical to SEQ ID NO: 45540
  chr19:1208940-1208970
  Hypo

SEQ ID NO: 115041 - DNA, 322 bp, Homo sapiens; identical to SEQ ID NO: 82478
  chr19:1220427-1220749
  Hypo

SEQ ID NO: 115042 - DNA, 30 bp, Homo sapiens; identical to SEQ ID NO: 82479
  chr19:1221029-1221059
  Hypo

SEQ ID NO: 115043 - DNA, 141 bp, Homo sapiens; identical to SEQ ID NO: 82482
  chr19:1226687-1226828
  Hypo

SEQ ID NO: 115044 - DNA, 190 bp, Homo sapiens; identical to SEQ ID NO: 82485
  chr19:1227469-1227659
  Hypo

SEQ ID NO: 115045 - DNA, 281 bp, Homo sapiens; identical to SEQ ID NO: 82486
  chr19:1227891-1228172
  Hypo

SEQ ID NO: 115046 - DNA, 106 bp, Homo sapiens; identical to SEQ ID NO: 82490
  chr19:1231206-1231312
  Hypo

SEQ ID NO: 115047 - DNA, 30 bp, Homo sapiens; identical to SEQ ID NO: 82491
  chr19:1234436-1234466
  Hypo

SEQ ID NO: 115048 - DNA, 484 bp, Homo sapiens; identical to SEQ ID NO: 82492
  chr19:1234905-1235389
  Hypo

SEQ ID NO: 115049 - DNA, 306 bp, Homo sapiens; identical to SEQ ID NO: 82493
  chr19:1236238-1236544
  Hypo

SEQ ID NO: 115050 - DNA, 104 bp, Homo sapiens; identical to SEQ ID NO: 82496
  chr19:1257622-1257726
  Hypo

SEQ ID NO: 115051 - DNA, 30 bp, Homo sapiens; identical to SEQ ID NO: 82499
  chr19:1268427-1268457
  Hypo

SEQ ID NO: 115052 - DNA, 30 bp, Homo sapiens; identical to SEQ ID NO: 82500
  chr19:1271429-1271459
  Hypo

SEQ ID NO: 115053 - DNA, 83 bp, Homo sapiens; identical to SEQ ID NO: 82501
  chr19:1274044-1274127
  Hypo

SEQ ID NO: 115054 - DNA, 250 bp, Homo sapiens; identical to SEQ ID NO: 82502
  chr19:1274641-1274891
  Hypo

SEQ ID NO: 115055 - DNA, 30 bp, Homo sapiens; identical to SEQ ID NO: 82509
  chr19:1288467-1288497
  Hypo

SEQ ID NO: 115056 - DNA, 398 bp, Homo sapiens; identical to SEQ ID NO: 82510
  chr19:1289167-1289565
  Hypo

SEQ ID NO: 115057 - DNA, 108 bp, Homo sapiens; identical to SEQ ID NO: 82511
  chr19:1290482-1290590
  Hypo

SEQ ID NO: 115058 - DNA, 30 bp, Homo sapiens; identical to SEQ ID NO: 82513
  chr19:1291641-1291671
  Hypo

SEQ ID NO: 115059 - DNA, 101 bp, Homo sapiens; identical to SEQ ID NO: 82515
  chr19:1293979-1294080
  Hypo

SEQ ID NO: 115060 - DNA, 30 bp, Homo sapiens; identical to SEQ ID NO: 82519
  chr19:1294903-1294933
  Hypo

SEQ ID NO: 115061 - DNA, 30 bp, Homo sapiens
  chr19:1295767-1295797
  Hyper
ggccgctcaagttctcggagaagttccagc

SEQ ID NO: 115062 - DNA, 45 bp, Homo sapiens; identical to SEQ ID NO: 82530
  chr19:1301300-1301345
  Hypo

SEQ ID NO: 115063 - DNA, 30 bp, Homo sapiens; identical to SEQ ID NO: 82532
  chr19:1306675-1306705
  Hypo

SEQ ID NO: 115064 - DNA, 200 bp, Homo sapiens; identical to SEQ ID NO: 82534
  chr19:1308145-1308345
  Hypo

SEQ ID NO: 115065 - DNA, 30 bp, Homo sapiens; identical to SEQ ID NO: 82536
  chr19:1310520-1310550
  Hypo

SEQ ID NO: 115066 - DNA, 140 bp, Homo sapiens; identical to SEQ ID NO: 82539
  chr19:1311273-1311413
  Hypo

SEQ ID NO: 115067 - DNA, 209 bp, Homo sapiens; identical to SEQ ID NO: 82549
  chr19:1325788-1325997
  Hypo

SEQ ID NO: 115068 - DNA, 148 bp, Homo sapiens; identical to SEQ ID NO: 82550
  chr19:1329407-1329555
  Hypo

SEQ ID NO: 115069 - DNA, 109 bp, Homo sapiens; identical to SEQ ID NO: 82553
  chr19:1339058-1339167
  Hypo

SEQ ID NO: 115070 - DNA, 85 bp, Homo sapiens; identical to SEQ ID NO: 82555
  chr19:1340897-1340982
  Hypo

SEQ ID NO: 115071 - DNA, 115 bp, Homo sapiens; identical to SEQ ID NO: 82556
  chr19:1357669-1357784
  Hypo

SEQ ID NO: 115072 - DNA, 30 bp, Homo sapiens; identical to SEQ ID NO: 82562
  chr19:1379073-1379103
  Hypo

SEQ ID NO: 115073 - DNA, 30 bp, Homo sapiens; identical to SEQ ID NO: 82563
  chr19:1379390-1379420
  Hypo

SEQ ID NO: 115074 - DNA, 124 bp, Homo sapiens; identical to SEQ ID NO: 82571
  chr19:1401700-1401824
  Hyper

SEQ ID NO: 115075 - DNA, 20 bp, Homo sapiens
  chr19:1403814-1403834
  Hypo
gaacccgggaggcggaggtt

SEQ ID NO: 115076 - DNA, 40 bp, Homo sapiens; identical to SEQ ID NO: 45555
  chr19:1409921-1409961
  Hypo

SEQ ID NO: 115077 - DNA, 39 bp, Homo sapiens; identical to SEQ ID NO: 45556
  chr19:1424255-1424294
  Hypo

SEQ ID NO: 115078 - DNA, 30 bp, Homo sapiens; identical to SEQ ID NO: 45557
  chr19:1437261-1437291
  Hypo

SEQ ID NO: 115079 - DNA, 91 bp, Homo sapiens; identical to SEQ ID NO: 82586
  chr19:1440112-1440203
  Hypo

SEQ ID NO: 115080 - DNA, 30 bp, Homo sapiens; identical to SEQ ID NO: 82587
  chr19:1440545-1440575
  Hypo

SEQ ID NO: 115081 - DNA, 30 bp, Homo sapiens; identical to SEQ ID NO: 82588
  chr19:1442939-1442969
  Hypo

SEQ ID NO: 115082 - DNA, 44 bp, Homo sapiens; identical to SEQ ID NO: 82589
  chr19:1445113-1445157
  Hyper

SEQ ID NO: 115083 - DNA, 648 bp, Homo sapiens; identical to SEQ ID NO: 82590
  chr19:1446431-1447079
  Hyper

SEQ ID NO: 115084 - DNA, 454 bp, Homo sapiens; identical to SEQ ID NO: 82591
  chr19:1450041-1450495
  Hyper

SEQ ID NO: 115085 - DNA, 281 bp, Homo sapiens
  chr19:1455211-1455492
  Hyper
cagggcctgtccaagcgcctggacgagctgccgcacgtggagacggtgagccggccggggagccagggggcagcgcgcccgccccactcagggtgcgggaagcggcgtgggggaggaacggggcctggcccgggcgcccctcaccgtggcccgcccgcctgcctttgccagcagttctcgatgcagatggacctgatccggcagcagcttgagttcgaggcccagcacatccgctcgctgatggaggagcgcttcggcacctcggacgagatggtgcagcg

SEQ ID NO: 115086 - DNA, 30 bp, Homo sapiens; identical to SEQ ID NO: 82599
  chr19:1461213-1461243
  Hypo

SEQ ID NO: 115087 - DNA, 1179 bp, Homo sapiens
  chr19:1467196-1468375
  Hyper
ggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaacagagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggaggg

SEQ ID NO: 115088 - DNA, 1090 bp, Homo sapiens
  chr19:1468649-1469739
  Hyper
gtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggc

SEQ ID NO: 115089 - DNA, 46 bp, Homo sapiens; identical to SEQ ID NO: 82607
  chr19:1471164-1471210
  Hyper

SEQ ID NO: 115090 - DNA, 841 bp, Homo sapiens; identical to SEQ ID NO: 82609
  chr19:1481985-1482826
  Hypo

SEQ ID NO: 115091 - DNA, 49 bp, Homo sapiens; identical to SEQ ID NO: 82615
  chr19:1491380-1491429
  Hyper

SEQ ID NO: 115092 - DNA, 399 bp, Homo sapiens; identical to SEQ ID NO: 82616
  chr19:1495001-1495400
  Hypo

SEQ ID NO: 115093 - DNA, 30 bp, Homo sapiens; identical to SEQ ID NO: 82617
  chr19:1495607-1495637
  Hypo

SEQ ID NO: 115094 - DNA, 332 bp, Homo sapiens; identical to SEQ ID NO: 82618
  chr19:1496340-1496672
  Hypo

SEQ ID NO: 115095 - DNA, 152 bp, Homo sapiens; identical to SEQ ID NO: 82619
  chr19:1496732-1496884
  Hypo

SEQ ID NO: 115096 - DNA, 73 bp, Homo sapiens; identical to SEQ ID NO: 82625
  chr19:1516288-1516361
  Hypo

SEQ ID NO: 115097 - DNA, 30 bp, Homo sapiens; identical to SEQ ID NO: 82628
  chr19:1522696-1522726
  Hypo

SEQ ID NO: 115098 - DNA, 256 bp, Homo sapiens
  chr19:1523753-1524009
  Hyper
gcccccaaccccccacgcgcgagagagcctcagtttcccgctcggtaaagcgggcgtatcagcggttcccagccagcccgggtgtgcagggtcggaggagctcgcgggctgagcgcggcccctggcgcccggttggcgtgcgggactcgggcgcgctctggtccgtggaacttccccagccgcggcgtccccgccgctcacgcgccccccactccacggccgggcacctcccgcccctccccgggctggacctgcg

SEQ ID NO: 115099 - DNA, 345 bp, Homo sapiens
  chr19:1524223-1524568
  Hyper
gcgcgggaagctgatcggcaaggtgggaggcccgcgccccgagtccgcgacggggccggaccgggctgggctggggtcccggggcgcgcgggcgatcctgcgcggtctacgcggcgcgtccctgcgagcgcggggtctggagcgggcgcgcgtccggagccgcggggcctcccgtgcggggtttcgcatggcgggaaccgtgttgagcgcgctgtgcgtcgtgtccgtgggttgcgtgtccggggtgtgggcgtgcggctcggcctcgggatgcgacgctgtgttgcccctgggtgtgtgtgcgagcctggcgagggtctgagtgtgccgcgtctgtgcccgctg

SEQ ID NO: 115100 - DNA, 32 bp, Homo sapiens; identical to SEQ ID NO: 82632
  chr19:1525191-1525223
  Hypo

SEQ ID NO: 115101 - DNA, 364 bp, Homo sapiens; identical to SEQ ID NO: 82633
  chr19:1525617-1525981
  Hypo

SEQ ID NO: 115102 - DNA, 305 bp, Homo sapiens; identical to SEQ ID NO: 82634
  chr19:1526247-1526552
  Hypo

SEQ ID NO: 115103 - DNA, 147 bp, Homo sapiens; identical to SEQ ID NO: 82635
  chr19:1527160-1527307
  Hypo

SEQ ID NO: 115104 - DNA, 115 bp, Homo sapiens; identical to SEQ ID NO: 82637
  chr19:1528065-1528180
  Hypo

SEQ ID NO: 115105 - DNA, 48 bp, Homo sapiens; identical to SEQ ID NO: 82647
  chr19:1533726-1533774
  Hypo

SEQ ID NO: 115106 - DNA, 33 bp, Homo sapiens; identical to SEQ ID NO: 82653
  chr19:1546860-1546893
  Hypo

SEQ ID NO: 115107 - DNA, 62 bp, Homo sapiens; identical to SEQ ID NO: 82662
  chr19:1565891-1565953
  Hypo

SEQ ID NO: 115108 - DNA, 30 bp, Homo sapiens; identical to SEQ ID NO: 82663
  chr19:1567524-1567554
  Hyper

SEQ ID NO: 115109 - DNA, 45 bp, Homo sapiens; identical to SEQ ID NO: 82664
  chr19:1569221-1569266
  Hypo

SEQ ID NO: 115110 - DNA, 33 bp, Homo sapiens; identical to SEQ ID NO: 82666
  chr19:1577654-1577687
  Hypo

SEQ ID NO: 115111 - DNA, 269 bp, Homo sapiens; identical to SEQ ID NO: 82667
  chr19:1578234-1578503
  Hypo

SEQ ID NO: 115112 - DNA, 49 bp, Homo sapiens; identical to SEQ ID NO: 45568
  chr19:1654563-1654612
  Hypo

SEQ ID NO: 115113 - DNA, 40 bp, Homo sapiens; identical to SEQ ID NO: 82677
  chr19:1657945-1657985
  Hypo

SEQ ID NO: 115114 - DNA, 135 bp, Homo sapiens; identical to SEQ ID NO: 82683
  chr19:1667706-1667841
  Hyper

SEQ ID NO: 115115 - DNA, 201 bp, Homo sapiens; identical to SEQ ID NO: 82686
  chr19:1672902-1673103
  Hypo

SEQ ID NO: 115116 - DNA, 84 bp, Homo sapiens; identical to SEQ ID NO: 82687
  chr19:1676120-1676204
  Hyper

SEQ ID NO: 115117 - DNA, 48 bp, Homo sapiens; identical to SEQ ID NO: 82689
  chr19:1699130-1699178
  Hypo

SEQ ID NO: 115118 - DNA, 96 bp, Homo sapiens; identical to SEQ ID NO: 82690
  chr19:1699504-1699600
  Hypo

SEQ ID NO: 115119 - DNA, 90 bp, Homo sapiens; identical to SEQ ID NO: 82700
  chr19:1718840-1718930
  Hyper

SEQ ID NO: 115120 - DNA, 32 bp, Homo sapiens; identical to SEQ ID NO: 82701
  chr19:1719135-1719167
  Hyper

SEQ ID NO: 115121 - DNA, 682 bp, Homo sapiens
  chr19:1725526-1726208
  Hyper
ggaggctccgcggcgcggtcccgcaggcgggaggcgatgctgccgacgctattgctgccattactattacggagagatggggcggggcgggagcaccgggcccttcccggaagcccttcctgagcttattcagtgcctggggccgcggcgatcgatgacagctgggcgccggccgagccccctccgggccgcgcgggggcgcatgcgcggggccgcgggatcgatcggccgcgctcgggcctccccgcacccgcccgaccccgcccccccggctcgttgcccggcaacctctgcccggcgcgctcccattggctggcggcggcccgggccccggccgcgcgtggtcacttggtcagcgcgggctcggcgtggccgggggcctggctccgggcgcgggtcgatgccgcctcgcatctgacctttcccggcgcggggagggggcccgagaggatggagagagctggaccatcttggaagaaaactttattgacccgtctcttatcttggggacgcacggttccagcggcggggggcgagggtacggctgggtgggggcaggggcggccaggaccttcctcccggacatgcacggaccccctgaccgccgccccggccatctccctgggcgggctgctctccattccctagacaggaaaattgaggctcacgagggcccggggat

SEQ ID NO: 115122 - DNA, 86 bp, Homo sapiens; identical to SEQ ID NO: 82705
  chr19:1729190-1729276
  Hypo

SEQ ID NO: 115123 - DNA, 65 bp, Homo sapiens; identical to SEQ ID NO: 82718
  chr19:1746791-1746856
  Hyper

SEQ ID NO: 115124 - DNA, 60 bp, Homo sapiens; identical to SEQ ID NO: 82719
  chr19:1748879-1748939
  Hyper

SEQ ID NO: 115125 - DNA, 30 bp, Homo sapiens; identical to SEQ ID NO: 82720
  chr19:1749288-1749318
  Hyper

SEQ ID NO: 115126 - DNA, 38 bp, Homo sapiens; identical to SEQ ID NO: 82721
  chr19:1749518-1749556
  Hyper

SEQ ID NO: 115127 - DNA, 415 bp, Homo sapiens; identical to SEQ ID NO: 37107
  chr19:1749776-1750191
  Hyper

SEQ ID NO: 115128 - DNA, 88 bp, Homo sapiens; identical to SEQ ID NO: 82724
  chr19:1751409-1751497
  Hyper

SEQ ID NO: 115129 - DNA, 36 bp, Homo sapiens; identical to SEQ ID NO: 37108
  chr19:1752836-1752872
  Hyper

SEQ ID NO: 115130 - DNA, 1448 bp, Homo sapiens
  chr19:1753502-1754950
  Hyper
ccacatcctggtggccgcgctcgcagccgggccgggccgtgcgccgcgcagcctggcagcctcgcgcgcagccaccggggagcgggcgggagtcatgcagcggccttgagcactaggggccggcgctgaggagcgcgcgcggcgggagggcagccgagcatggagctgagcctggagagcctggggggcctgcacagcgtggcccacgcgcaggcgggcgagctgctgagcccgggccacgcgcgctcggcggcggcgcagcaccgcggcctggtggcgcccgggcgcccgggcctggtggccggcatggcgagcctgctggacggcggcggcggcggcggcggtgggggcgccgggggcgcgggcggcgcgggcagcgcgggcggcggcgcggacttccgcggggaactggcgggcccgctgcacccggcaatgggcatggcctgcgaggcgccgggcctgggcggcacctacacgacgctcacgcccctgcagcacctgccgccgctcgcggccgtggccgacaagttccaccagcacgcggcggccgcggccgtggccggggcgcacggcggccatccccacgcgcacccgcacccggcggccgcgccgcccccgccacccccgccgcagcgtctggcggccagcgtgagcggcagcttcaccctcatgcgcgacgagcgggcggcgctcgcctccgtgggccacctctacggaccctacggcaaggagctgcccgccatggggtcgccgctgtcgccgctgcccaacgcgctgccgcccgcgctgcacggcgccccgcagcccccgccgccgccaccacccccgccgctggccgcctacggcccgccaggccacctggctggggacaagctgctgccgcccgccgccttcgagccgcacgccgcgctgctgggacgcgcggaggacgcactggcccgcgggctgcccggaggcggcggcggcacaggcagcggcggagcgggcagcgggagcgccgcggggctgctggcgccgctgggcgggctggcggcggccggggcgcacgggccgcacgggggaggcggcggccccggcgggagcggcggcggccccagcgcgggcgcagcggccgaggagatcaacaccaaggaggtggcgcagcgcatcacggcggagctgaagcgctacagcatcccgcaggcaatcttcgcgcagcggatcctgtgtcgctctcagggcacgctctccgacctgctgcgcaaccccaagccgtggagcaagctcaaatccggccgcgagaccttccgcaggatgtggaagtggctgcaggagccagagttccagcgcatgtcggcgctgcgcttggcaggtaggagcgtggcgcgcagggccagaccctgggggcgccggctctggactcccgagcacctagcggggcggcggccgatgcccggggccagcgcccc

SEQ ID NO: 115131 - DNA, 50 bp, Homo sapiens; identical to SEQ ID NO: 82729
  chr19:1755177-1755227
  Hyper

SEQ ID NO: 115132 - DNA, 62 bp, Homo sapiens; identical to SEQ ID NO: 82731
  chr19:1755964-1756026
  Hyper

SEQ ID NO: 115133 - DNA, 840 bp, Homo sapiens; identical to SEQ ID NO: 82732
  chr19:1757222-1758062
  Hyper

SEQ ID NO: 115134 - DNA, 87 bp, Homo sapiens; identical to SEQ ID NO: 82733
  chr19:1758717-1758804
  Hyper

SEQ ID NO: 115135 - DNA, 648 bp, Homo sapiens
  chr19:1762172-1762820
  Hyper
ccatctggagaccctcgtgctggctgctgggggtcctgcgtgccttccgcgcgcccccagctgcgcccgccagccctccaaccctcctgccctcctgccctcctgccctcctctctgggagtcgggacagaagctgctgggctctcctccctggagctggggctttgggaaggtcgagtagaccctcagtgagtgggatgcgcgagttggggacgctagttgcggggcagcaggggtccacgcatttccaagcgccctttcccgtccaaggacctgctggggggatgactgtgcctcagtttccatcacccagcaaacgccgtcccgcagcacccgggaagctgcggagtcgggctggggccgccgcgttgcgcacatcggtccttggcgggtgtgtggatcccagagcgcgcccggcccccaacagcctgacaggacctggacgcacgtgccccggcgccaggagacccgggacccgggaccacgcgcccgcggccttggagcctcagggtcactggtgcgggctccgcaggaaagcgcagcccccagcaggcacccaccatcccacccccgcatcccaccccaggggaaaccgcgccgcaccaggcgcgagtgttcttcttccttgtctggcgccccagaaccgcg

SEQ ID NO: 115136 - DNA, 30 bp, Homo sapiens; identical to SEQ ID NO: 37115
  chr19:1764269-1764299
  Hyper

SEQ ID NO: 115137 - DNA, 391 bp, Homo sapiens; identical to SEQ ID NO: 82740
  chr19:1765633-1766024
  Hyper

SEQ ID NO: 115138 - DNA, 30 bp, Homo sapiens; identical to SEQ ID NO: 37117
  chr19:1768342-1768372
  Hyper

SEQ ID NO: 115139 - DNA, 230 bp, Homo sapiens; identical to SEQ ID NO: 37118
  chr19:1769737-1769967
  Hyper

SEQ ID NO: 115140 - DNA, 320 bp, Homo sapiens; identical to SEQ ID NO: 82747
  chr19:1775116-1775436
  Hyper

SEQ ID NO: 115141 - DNA, 575 bp, Homo sapiens
  chr19:1776168-1776743
  Hyper
caccccatcccaggccgcaggggacggggggctcccacgtgcgggtaaattccagacgcccccgccccgccccgtctgttgagttcactttacctttaggcaccttcgtggagcgcaaggaaggacgcagctccggacacgggagaccacgcccaggctcccaggagaaggggacccggccggagaaggcgccgctggggccgcccggaggagcccctctgcacgggcccgtggagacgcttcctgcgtggaaccttctggaatccaccgcccccctttccgcccgcgtcagggtctgaactgggcttgcaggggggcagcggggttgaacgtggtgttggtttccactctcgccaaagagagaagacgccgaggaaggtggattccgcttgctccattttttgccaaaaatatttacaaatgggaagggtcggaaatgaagatgagcgcccccctcccaccccgcgctctcccccgctcctctcatctggtctgggtgacctccgagactggccggccgcgggatcccaggagcccgcctcctccgggggttcaagatccgagtctagaaggaa

SEQ ID NO: 115142 - DNA, 66 bp, Homo sapiens; identical to SEQ ID NO: 82753
  chr19:1776966-1777032
  Hyper

SEQ ID NO: 115143 - DNA, 629 bp, Homo sapiens
  chr19:1799741-1800370
  Hypo
agacagagtgagactctgcctcaaaaaaaaaaaaaaattttcctggccccctccaaaggaaaccaggccatctggctacggttccctggttcagattcgggcggaggtgctgggcatggggccagacgtggctctggttctcaggcaccctgagccccttgaagatcgaggacccagctgggagctcaggtgtcggggccgcaccatagacgcggccgctgatgcagcacttgttgaaggtcaagatgttctgcgtgagcgtgcccgtcttgtccgagaagatgtattccacctggcccaggtggtcgttgaggctggtgctgcgggccttggcaggcacgtcctgcggcttgtagtacatctgcacgtcccagtcgatgaagacgctgttccccaggtagatgaactcggacctgcagaggcactcagggtcacggtcagccccgcctgctgtgtgccatccccatgcctccccgttccgcgtttgcaccggggacgcagccggcggagactcacaggatgaacatggacatcgggatggtgacgctgagcaggatgaggaagctccagaagacgaagaaggactctgcggccacgctgctcccatgcacccccgagaggtagtagtg

SEQ ID NO: 115144 - DNA, 279 bp, Homo sapiens; identical to SEQ ID NO: 82766
  chr19:1802465-1802744
  Hypo

SEQ ID NO: 115145 - DNA, 65 bp, Homo sapiens; identical to SEQ ID NO: 82769
  chr19:1805963-1806028
  Hypo

SEQ ID NO: 115146 - DNA, 30 bp, Homo sapiens; identical to SEQ ID NO: 82773
  chr19:1806293-1806323
  Hypo

SEQ ID NO: 115147 - DNA, 53 bp, Homo sapiens; identical to SEQ ID NO: 82775
  chr19:1807156-1807209
  Hypo

SEQ ID NO: 115148 - DNA, 535 bp, Homo sapiens; identical to SEQ ID NO: 82777
  chr19:1807905-1808440
  Hypo

SEQ ID NO: 115149 - DNA, 403 bp, Homo sapiens; identical to SEQ ID NO: 82780
  chr19:1809486-1809889
  Hypo

SEQ ID NO: 115150 - DNA, 139 bp, Homo sapiens; identical to SEQ ID NO: 82784
  chr19:1810577-1810716
  Hypo

SEQ ID NO: 115151 - DNA, 30 bp, Homo sapiens; identical to SEQ ID NO: 82785
  chr19:1811141-1811171
  Hypo

SEQ ID NO: 115152 - DNA, 494 bp, Homo sapiens; identical to SEQ ID NO: 82820
  chr19:1856962-1857456
  Hyper

SEQ ID NO: 115153 - DNA, 30 bp, Homo sapiens
  chr19:1876491-1876521
  Hyper
ccaagcacctgccaccgccctctgctggac

SEQ ID NO: 115154 - DNA, 148 bp, Homo sapiens; identical to SEQ ID NO: 82856
  chr19:1896290-1896438
  Hypo

SEQ ID NO: 115155 - DNA, 63 bp, Homo sapiens; identical to SEQ ID NO: 82867
  chr19:1908377-1908440
  Hypo

SEQ ID NO: 115156 - DNA, 359 bp, Homo sapiens; identical to SEQ ID NO: 82869
  chr19:1912087-1912446
  Hypo

SEQ ID NO: 115157 - DNA, 30 bp, Homo sapiens; identical to SEQ ID NO: 82870
  chr19:1914573-1914603
  Hypo

SEQ ID NO: 115158 - DNA, 195 bp, Homo sapiens; identical to SEQ ID NO: 82894
  chr19:1969911-1970106
  Hypo

SEQ ID NO: 115159 - DNA, 345 bp, Homo sapiens; identical to SEQ ID NO: 82895
  chr19:1970425-1970770
  Hypo

SEQ ID NO: 115160 - DNA, 763 bp, Homo sapiens; identical to SEQ ID NO: 82898
  chr19:1978255-1979018
  Hypo

SEQ ID NO: 115161 - DNA, 441 bp, Homo sapiens; identical to SEQ ID NO: 82902
  chr19:1992845-1993286
  Hypo

SEQ ID NO: 115162 - DNA, 30 bp, Homo sapiens; identical to SEQ ID NO: 82914
  chr19:2097733-2097763
  Hypo

SEQ ID NO: 115163 - DNA, 33 bp, Homo sapiens; identical to SEQ ID NO: 82915
  chr19:2098275-2098308
  Hypo

SEQ ID NO: 115164 - DNA, 30 bp, Homo sapiens; identical to SEQ ID NO: 82917
  chr19:2154551-2154581
  Hypo

SEQ ID NO: 115165 - DNA, 100 bp, Homo sapiens; identical to SEQ ID NO: 82929
  chr19:2191591-2191691
  Hypo

SEQ ID NO: 115166 - DNA, 30 bp, Homo sapiens; identical to SEQ ID NO: 82943
  chr19:2213530-2213560
  Hypo

SEQ ID NO: 115167 - DNA, 63 bp, Homo sapiens; identical to SEQ ID NO: 82944
  chr19:2214092-2214155
  Hypo

SEQ ID NO: 115168 - DNA, 56 bp, Homo sapiens; identical to SEQ ID NO: 45588
  chr19:2243515-2243571
  Hypo

SEQ ID NO: 115169 - DNA, 30 bp, Homo sapiens; identical to SEQ ID NO: 82947
  chr19:2244206-2244236
  Hypo

SEQ ID NO: 115170 - DNA, 45 bp, Homo sapiens
  chr19:2250675-2250720
  Hyper
gctacctggtgttagcggtggaccgccctgcgggggcctggcgcg

SEQ ID NO: 115171 - DNA, 2764 bp, Homo sapiens
  chr19:2251088-2253852
  Hyper
gggttccaggccatccgcggaactcgaggagtcgccacccagcgcagaccccttcctggagacgctcacgcgcctggtgcgggcgctgcgggtccccccggcccgggcctccgcgccgcgcctggccctggatccggacgcgctggccggcttcccgcagggcctagtcaacctgtcggaccccgcggcgctggagcgcctactcgacggcgaggagccgctgctgctgctgctgaggcccactgcggccaccaccggggatcctgcgcccctgcacgaccccacgtcggcgccgtgggccacggccctggcgcgccgcgtggctgctgaactgcaagcggcggctgccgagctgcgaagcctcccgggtctgcctccggccacagccccgctgctggcgcgcctgctcgcgctctgcccaggtggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatgcaggtccgtggggccgccctggcgcgcccaccctgctgcgtgcccaccgcctacgcgggcaagctgctcatcagcctgtcggaggagcgcatcagcgcgcaccacgtgcccaacatggtggccaccgagtgtggctgccggtgacccctgcgccgcgcggactcctgccccgagggtccggacgcgccccagctcgcgccccttcccatatttattcggaccccaagcatcgccccaataaagaccagcaagcaaccggctggggtgtccgtgcgtgttagggggcccgtgggacctcccttgccgtctctcctcgcgcacggcccgggtccgccctgtagcgctcgctgtctctcccctgcctgaagcgccccaccaccgtctttcaggccccggacttggtgccgggtccaggcgtaaaggagcaggtgactctgcggccgcagcactcgctttatttcgccagagtcgcggggcgtccagaaggggcccctggactccggcgcggggccggctcagtcccgccccttgcctgcgcggagcttctggcgactcccaggccgctgctcctcgtcgggacgcctcggggacacccaggcctgcttcttcctgggctcggcgtccctggagtcccgtgcccacggccggtggcccccttcgcgtgactcccagcgctggggtagggcttcccggggctccctggcggcccgtggcctctcctctttccgcggcctctctttcttaggtctctcctccttccgcggcttctccttccgcggcttcccctctctccgaggcctctccttgggtccccggtctgcgagggtcacacggtcctcccggacggcctctccggtggcctcgccgggctcctcttcgtcgttctctgcagcctcccgactcccgggaatcttgggtctgacctctgcctcggcccggggcgcaggcggcgctgatggaggcgcctgggcctcgaacttaggctgcaagacagagtggggtcctggggtaagcgcccaccttccccccggcccgggctccttctttccttggggatgaaggtcccaatgcccgcggtcagtggaaggaagctcttaccaggggcgacgatggctccctcggggctgagcttggcgggacccagggctcgggcacacgtgcttggagtgctgcctccccagggacggcgtctgcagcgacagggtcgggacccgagtcagctgggccgaggcacggtccacactgtccatccctccctcacccctagagcccccctccctggacagttggagtggggctcccccggtacggctgagactaaggatgcccccgagccgtgggaagggactccgggactccgctgccgcggcgccccttctccgaacctcgctctttcaattggtcattcttccccccgaccacgggctgtaggaggcccctagcaagggaggggtcgcaggagtgcccccggggggcgctcacgagctgagcggtccccagagagggcgcaggggaaaggcggcagaacgctacgaggcaggaggggttgcacaaggttcatccggaagccagaacctactcgcggcgaggggaatgggccccgcaaaaggtccacaccgggtgagaggggcgcgcaaggcccgtcacttaaggggagatgcacaaaccaactttgggggcgtgcaagacccagccctggagaggaggctcccagaccccaccctggcggcacagcgcctttccttggaggaataggcgcacaggtggaccccagcctcgccccacctctggggagcctgcgctcaccgcggcacagctggaaagccgagcccagcagcgccaccagcgaggcgagcaccaggcacttgttgagcgacaggtctccccagggcagctcctcgctcagggccgggggcggcggcggcggctgcaggggcggcgcggtctgcgccttcttgcgcgcggggacgctccgagggcctgcgggggcaagtgcgcgctgcgctgtggtcactggctctgtgccgcccccttccccgg

SEQ ID NO: 115172 - DNA, 21 bp, Homo sapiens
  chr19:2268114-2268135
  Hypo
cgaaagacaggcaggcgcggt

SEQ ID NO: 115173 - DNA, 39 bp, Homo sapiens; identical to SEQ ID NO: 82959
  chr19:2273981-2274020
  Hyper

SEQ ID NO: 115174 - DNA, 92 bp, Homo sapiens; identical to SEQ ID NO: 82960
  chr19:2274600-2274692
  Hypo

SEQ ID NO: 115175 - DNA, 262 bp, Homo sapiens; identical to SEQ ID NO: 82961
  chr19:2275678-2275940
  Hypo

SEQ ID NO: 115176 - DNA, 153 bp, Homo sapiens; identical to SEQ ID NO: 82962
  chr19:2276337-2276490
  Hypo

SEQ ID NO: 115177 - DNA, 30 bp, Homo sapiens
  chr19:2282682-2282712
  Hyper
ctcgctgtgtgactgcgggcaaatccccac

SEQ ID NO: 115178 - DNA, 1366 bp, Homo sapiens
  chr19:2289693-2291059
  Hyper
ccccgggttggtagacgggagcccatccccccatccttgcagcccgcacccccaccccccagctcagccaccatagcagggacaggaagacgggttgaaatctttagaaaacgcttgagaaactgcaaaaaagacgcatgctgatgaaaaacagtcctgcggttgggcgtctacaaaaaaaggggaagttctgcctggggagcgccgtgcagccgtccccttcccctccgggaaatgcataggtggacacgcgagcggccggcccgcgggggaggggaggggagggtccgccctggggacccctcagatcatcttcatgttgaacttgcgcgcgcctccctggcccgccgcggcggccggcccatccaccttgcggaaggagtactccaccgagaagttgtttttgtgctgcccgcggccgcggctccacacgaacagcagcacgaagcagaagaggaccacgcccaggaaggtgatgcagcccatggcggtggacaccaggatggtggtgaggtcgagcggcgcgcgcagggccgccagcgtctcgttgtgggcctcgcccggggtccggttggcggccggctcggggcgcacggtcagcgtggcgaagtaggtgtcgttgccgcccgcgttgctggccacgcacgtgtaggtgccgctgtcctgcggccgcgcgtcctggatctccagcgtccccccggggagcacgcgcgcccggcccgcgctggtggccgtcaccggccggtgctggggggtcacccaggccacggtgggcgccggctcgccctcggcgcggcagaggaagcggacgtcttcgcccgcggtggccgtgacgcgctgcagccgccgctcccggatcttgggtttgcggcacacgaagtactcgaacagcacggagtccggcaggtttcgcagcgcgtcgccgcgcacctcggccggggtggcgcaggccggcagccgcccgtcgaagttgagggtcttgcgacgctgcacgatccacagcaggcgacagtcgcaggccagcgggttcccgtccacgcgcagcgtctctagcgtgttcaccgagtggaaggtgctctcctccaacgtggagagcaggttgttggagaggttgagcaggcggatctggcgcaggcccaggaaggcctgcggctccaccacagccagcagggccccggccaggtgcagctcgcgcaggcggaccaggtcccggaacgacccccgcggcaccgtgctgatggggttgtgcgacagattgaggcaggtgaggtgcgcctggtgccgcagcgcggcggccggcacggcggtgatgttggtgtgggtgaccgacagcgaggtcaggttcaggccccgcaggctgcccgcc

SEQ ID NO: 115179 - DNA, 392 bp, Homo sapiens; identical to SEQ ID NO: 37129
  chr19:2302559-2302951
  Hyper

SEQ ID NO: 115180 - DNA, 36 bp, Homo sapiens; identical to SEQ ID NO: 82972
  chr19:2308140-2308176
  Hyper

SEQ ID NO: 115181 - DNA, 30 bp, Homo sapiens; identical to SEQ ID NO: 82975
  chr19:2324322-2324352
  Hypo

SEQ ID NO: 115182 - DNA, 27 bp, Homo sapiens
  chr19:2330114-2330141
  Hypo
tttttttttttgagacggagtctcgct

SEQ ID NO: 115183 - DNA, 26 bp, Homo sapiens
  chr19:2330381-2330407
  Hypo
gggatgacaggcgtgagccaccgtgc

SEQ ID NO: 115184 - DNA, 170 bp, Homo sapiens; identical to SEQ ID NO: 45591
  chr19:2331273-2331443
  Hypo

SEQ ID NO: 115185 - DNA, 131 bp, Homo sapiens; identical to SEQ ID NO: 82987
  chr19:2331903-2332034
  Hypo

SEQ ID NO: 115186 - DNA, 74 bp, Homo sapiens; identical to SEQ ID NO: 82988
  chr19:2337296-2337370
  Hypo

SEQ ID NO: 115187 - DNA, 99 bp, Homo sapiens; identical to SEQ ID NO: 82990
  chr19:2339493-2339592
  Hypo

SEQ ID NO: 115188 - DNA, 249 bp, Homo sapiens; identical to SEQ ID NO: 82994
  chr19:2358937-2359186
  Hypo

SEQ ID NO: 115189 - DNA, 118 bp, Homo sapiens; identical to SEQ ID NO: 82996
  chr19:2360226-2360344
  Hyper

SEQ ID NO: 115190 - DNA, 108 bp, Homo sapiens
  chr19:2360711-2360819
  Hypo
cgggggttatgtggacgcaggtgtggcgtgtggatgcggccggggttgtgtggactcaggtgtggtgtgtagatgcacgtagggttgtgtggacgcagccgggattgt

SEQ ID NO: 115191 - DNA, 185 bp, Homo sapiens; identical to SEQ ID NO: 82998
  chr19:2363009-2363194
  Hypo

SEQ ID NO: 115192 - DNA, 41 bp, Homo sapiens; identical to SEQ ID NO: 83000
  chr19:2377007-2377048
  Hypo

SEQ ID NO: 115193 - DNA, 71 bp, Homo sapiens; identical to SEQ ID NO: 83001
  chr19:2389713-2389784
  Hypo

SEQ ID NO: 115194 - DNA, 30 bp, Homo sapiens; identical to SEQ ID NO: 83003
  chr19:2410895-2410925
  Hypo

SEQ ID NO: 115195 - DNA, 30 bp, Homo sapiens; identical to SEQ ID NO: 83004
  chr19:2415373-2415403
  Hypo

SEQ ID NO: 115196 - DNA, 30 bp, Homo sapiens; identical to SEQ ID NO: 83009
  chr19:2452047-2452077
  Hypo

SEQ ID NO: 115197 - DNA, 42 bp, Homo sapiens; identical to SEQ ID NO: 45596
  chr19:2471261-2471303
  Hypo

SEQ ID NO: 115198 - DNA, 23 bp, Homo sapiens
  chr19:2471700-2471723
  Hypo
aaatacggtgactcacgcctgta

SEQ ID NO: 115199 - DNA, 130 bp, Homo sapiens; identical to SEQ ID NO: 83012
  chr19:2478809-2478939
  Hyper

SEQ ID NO: 115200 - DNA, 241 bp, Homo sapiens; identical to SEQ ID NO: 83013
  chr19:2488448-2488689
  Hyper

SEQ ID NO: 115201 - DNA, 30 bp, Homo sapiens; identical to SEQ ID NO: 83014
  chr19:2512801-2512831
  Hypo

SEQ ID NO: 115202 - DNA, 427 bp, Homo sapiens; identical to SEQ ID NO: 83015
  chr19:2513079-2513506
  Hypo

SEQ ID NO: 115203 - DNA, 95 bp, Homo sapiens; identical to SEQ ID NO: 83016
  chr19:2518480-2518575
  Hypo

SEQ ID NO: 115204 - DNA, 196 bp, Homo sapiens; identical to SEQ ID NO: 83017
  chr19:2524739-2524935
  Hypo

SEQ ID NO: 115205 - DNA, 49 bp, Homo sapiens; identical to SEQ ID NO: 83018
  chr19:2573995-2574044
  Hypo

SEQ ID NO: 115206 - DNA, 70 bp, Homo sapiens; identical to SEQ ID NO: 83019
  chr19:2665387-2665457
  Hypo

SEQ ID NO: 115207 - DNA, 59 bp, Homo sapiens; identical to SEQ ID NO: 83020
  chr19:2671304-2671363
  Hypo

SEQ ID NO: 115208 - DNA, 30 bp, Homo sapiens; identical to SEQ ID NO: 83023
  chr19:2683414-2683444
  Hypo

SEQ ID NO: 115209 - DNA, 155 bp, Homo sapiens; identical to SEQ ID NO: 83024
  chr19:2683891-2684046
  Hypo

SEQ ID NO: 115210 - DNA, 36 bp, Homo sapiens; identical to SEQ ID NO: 83025
  chr19:2702517-2702553
  Hyper

SEQ ID NO: 115211 - DNA, 42 bp, Homo sapiens; identical to SEQ ID NO: 83026
  chr19:2703070-2703112
  Hyper

SEQ ID NO: 115212 - DNA, 30 bp, Homo sapiens; identical to SEQ ID NO: 83027
  chr19:2716528-2716558
  Hypo

SEQ ID NO: 115213 - DNA, 30 bp, Homo sapiens; identical to SEQ ID NO: 83028
  chr19:2721203-2721233
  Hyper

SEQ ID NO: 115214 - DNA, 30 bp, Homo sapiens; identical to SEQ ID NO: 83029
  chr19:2721705-2721735
  Hyper

SEQ ID NO: 115215 - DNA, 100 bp, Homo sapiens; identical to SEQ ID NO: 83032
  chr19:2867431-2867531
  Hypo

SEQ ID NO: 115216 - DNA, 16 bp, Homo sapiens
  chr19:2895805-2895821
  Hypo
acgttgacatgggaaa

SEQ ID NO: 115217 - DNA, 22 bp, Homo sapiens
  chr19:2899962-2899984
  Hypo
caggaggctgggaaacgtttgg

SEQ ID NO: 115218 - DNA, 30 bp, Homo sapiens; identical to SEQ ID NO: 83048
  chr19:2961218-2961248
  Hypo

SEQ ID NO: 115219 - DNA, 183 bp, Homo sapiens; identical to SEQ ID NO: 83077
  chr19:3039729-3039912
  Hypo

SEQ ID NO: 115220 - DNA, 30 bp, Homo sapiens; identical to SEQ ID NO: 83079
  chr19:3041560-3041590
  Hypo

SEQ ID NO: 115221 - DNA, 22 bp, Homo sapiens
  chr19:3050735-3050757
  Hypo
gggcgcggtggctcacgcctgt

SEQ ID NO: 115222 - DNA, 30 bp, Homo sapiens; identical to SEQ ID NO: 83117
  chr19:3131559-3131589
  Hypo

SEQ ID NO: 115223 - DNA, 30 bp, Homo sapiens; identical to SEQ ID NO: 83120
  chr19:3170304-3170334
  Hypo

SEQ ID NO: 115224 - DNA, 30 bp, Homo sapiens; identical to SEQ ID NO: 83131
  chr19:3187545-3187575
  Hypo

SEQ ID NO: 115225 - DNA, 30 bp, Homo sapiens; identical to SEQ ID NO: 83132
  chr19:3187952-3187982
  Hypo

SEQ ID NO: 115226 - DNA, 85 bp, Homo sapiens; identical to SEQ ID NO: 83138
  chr19:3218818-3218903
  Hypo

SEQ ID NO: 115227 - DNA, 100 bp, Homo sapiens; identical to SEQ ID NO: 83139
  chr19:3219554-3219654
  Hypo

SEQ ID NO: 115228 - DNA, 84 bp, Homo sapiens; identical to SEQ ID NO: 83141
  chr19:3223661-3223745
  Hypo

SEQ ID NO: 115229 - DNA, 59 bp, Homo sapiens; identical to SEQ ID NO: 83142
  chr19:3225545-3225604
  Hyper

SEQ ID NO: 115230 - DNA, 18 bp, Homo sapiens
  chr19:3241370-3241388
  Hypo
gcccggcctaaagatcag

SEQ ID NO: 115231 - DNA, 30 bp, Homo sapiens; identical to SEQ ID NO: 37133
  chr19:3244155-3244185
  Hyper

SEQ ID NO: 115232 - DNA, 249 bp, Homo sapiens; identical to SEQ ID NO: 83155
  chr19:3270483-3270732
  Hyper

SEQ ID NO: 115233 - DNA, 41 bp, Homo sapiens; identical to SEQ ID NO: 83164
  chr19:3286043-3286084
  Hyper

SEQ ID NO: 115234 - DNA, 167 bp, Homo sapiens; identical to SEQ ID NO: 83166
  chr19:3296598-3296765
  Hypo

SEQ ID NO: 115235 - DNA, 87 bp, Homo sapiens; identical to SEQ ID NO: 83167
  chr19:3308060-3308147
  Hypo

SEQ ID NO: 115236 - DNA, 145 bp, Homo sapiens; identical to SEQ ID NO: 83176
  chr19:3344915-3345060
  Hypo

SEQ ID NO: 115237 - DNA, 546 bp, Homo sapiens
  chr19:3360952-3361498
  Hyper
tctgccttccactcccggcctcgcctcccccagttccttttttcctgtaactggggactgcctgggcggcggaggaagagcgctccctccaccttttcaaaactctgtccctttatctttcccctacgtcccctccacttcccccagccttcggggtcccccatccgcttggcccgagggggtcctggctggaggttcgggcgcgaggtggcgccgggacgcgatcactcggcacgcagacgtcgctcgccaggggttgcgcttgcgcggggacctgccccgagaggggcggggcggcaggggttccccctccctgagaggccgtggaagtcccgaggggtgggtggttacagcagcacaggggttaggacgggcccgggaggtggctaaggagacccctattatcctatgctggggagagcgtaggggcaccgggactggtcccgcagtcccgcctccagcacttgcccccaatggaccagaggccgtgggcacagagagctgttttgtcacctccagggaaatccccgccgctctccaccccca

SEQ ID NO: 115238 - DNA, 30 bp, Homo sapiens; identical to SEQ ID NO: 83213
  chr19:3455766-3455796
  Hypo

SEQ ID NO: 115239 - DNA, 34 bp, Homo sapiens; identical to SEQ ID NO: 83215
  chr19:3456167-3456201
  Hypo

SEQ ID NO: 115240 - DNA, 140 bp, Homo sapiens; identical to SEQ ID NO: 83216
  chr19:3456440-3456580
  Hypo

SEQ ID NO: 115241 - DNA, 30 bp, Homo sapiens; identical to SEQ ID NO: 83227
  chr19:3516425-3516455
  Hypo

SEQ ID NO: 115242 - DNA, 36 bp, Homo sapiens; identical to SEQ ID NO: 83236
  chr19:3544842-3544878
  Hypo

SEQ ID NO: 115243 - DNA, 360 bp, Homo sapiens; identical to SEQ ID NO: 45610
  chr19:3562248-3562608
  Hypo

SEQ ID NO: 115244 - DNA, 30 bp, Homo sapiens; identical to SEQ ID NO: 83253
  chr19:3565540-3565570
  Hypo

SEQ ID NO: 115245 - DNA, 32 bp, Homo sapiens; identical to SEQ ID NO: 45611
  chr19:3570187-3570219
  Hypo

SEQ ID NO: 115246 - DNA, 28 bp, Homo sapiens
  chr19:3571493-3571521
  Hypo
acgcttgtgtacacgcttttgtttgaac

SEQ ID NO: 115247 - DNA, 128 bp, Homo sapiens; identical to SEQ ID NO: 83256
  chr19:3576034-3576162
  Hypo

SEQ ID NO: 115248 - DNA, 106 bp, Homo sapiens; identical to SEQ ID NO: 83257
  chr19:3577705-3577811
  Hypo

SEQ ID NO: 115249 - DNA, 99 bp, Homo sapiens; identical to SEQ ID NO: 83259
  chr19:3578124-3578223
  Hypo

SEQ ID NO: 115250 - DNA, 361 bp, Homo sapiens
  chr19:3585697-3586058
  Hyper
ccgcgcctcgtcttccgcacgcagctggcgcacgggagccccacgggcaagatcgagggcttcaccaacgtccgcgagctgtacgccaagatcgccgaagccttcgggatcgcgcccaccgaggtaaggagcccggacaccggcgcccaagaccacccgcctgatggggtgaggggtagggagcttggaccctggacgggagaccccagatccccggatcccagacgtcggggtggccgcctaatcgccggatctcagagacccagccctcagatcccggggtgccacactcccaggggccccctttgcacgctctgcgcaaaagatgggcaggtcttaggactagcggacccctagatat

SEQ ID NO: 115251 - DNA, 118 bp, Homo sapiens; identical to SEQ ID NO: 83294
  chr19:3649925-3650043
  Hypo

SEQ ID NO: 115252 - DNA, 93 bp, Homo sapiens; identical to SEQ ID NO: 83324
  chr19:3716365-3716458
  Hypo

SEQ ID NO: 115253 - DNA, 128 bp, Homo sapiens; identical to SEQ ID NO: 83347
  chr19:3747892-3748020
  Hypo

SEQ ID NO: 115254 - DNA, 84 bp, Homo sapiens; identical to SEQ ID NO: 83354
  chr19:3760214-3760298
  Hypo

SEQ ID NO: 115255 - DNA, 20 bp, Homo sapiens
  chr19:3773897-3773917
  Hypo
ccagtcgggttgctatgtta

SEQ ID NO: 115256 - DNA, 343 bp, Homo sapiens; identical to SEQ ID NO: 83359
  chr19:3778074-3778417
  Hypo

SEQ ID NO: 115257 - DNA, 496 bp, Homo sapiens; identical to SEQ ID NO: 83360
  chr19:3778991-3779487
  Hypo

SEQ ID NO: 115258 - DNA, 1129 bp, Homo sapiens
  chr19:3785557-3786686
  Hyper
ggcccctccaagatgcgcctcccatgaaatcctccagtcccacgtgtactcacacgcatacggatgcatgcacacgcacagaaacacacagggctcggacacagctgcgcgcagacaagcaaaggaccacgtccacgtggaaacaggtgtgcgcacacgtccccgcgcatccgcgcgcacaagcgctccacacctgggaacgtgcgcacctgtcccccgcccccggcacacacacagccgccccacactggaacacctgggcgccagcgccgggccactcgggcacgcagggcgctacgcagggccgcgcacacgcttttcggccacacgcgcacagccctccacgtggacgcgcgggtacacacgcccggggctcgtagccgcgcacacccgcacccaggaaaccccagccaccaccacgcggggtccgatcgcctctgagcaccctccgccccagccgcgcacccgctgcgcgcccgggacgcgcacactcgcgcacacaccggcccttcctgcgcacgtcccgggcccacccccgcctagagccctcggggtttccccccaccccggcctcggggtctctccacgtctccccgccgacgtgctcacctgctcagggggcgcccccgagccgcgccccgcgcccgcccccaggagggcctccgcgagccggctgcacaccccgaggcggtcccggctgcacaacttggagcgagttgctccgtttcctcattttgggggcgaagaagggtcggggagtgggggaaagcgggaggcgccgcggcctgggaggcccccgcgggtcctagcgccggccgcactgcggtctcctccgcgcgccgccgccgccgccggcccctccccgccccgcctccgcggcccccggcgcctcccgcgcgccccgggcggggtcccggggcgcacgcgggctccacgcctggccctgacctggccctgtcgggcgtgcaccccccacccaccctgggaagcggggttcttggagcgtggaacgggcgccgccagtgcgcgcggcggggaccgggggtgagggagagtgagctgcccgtccggggagataagcaaggcgccaagcccggactcccagaggacacttcgtactctgcaattc

SEQ ID NO: 115259 - DNA, 274 bp, Homo sapiens
  chr19:3801434-3801708
  Hyper
gacagcctgcccttccgtttttgtctttccagtcccgcctgccggattgggttccagccctgcccacacgcccggtacatcccgcctacactcaccgatgtcgcctagcaacccggctcgcagctagcatccgcaaccgaggtccccgcgctccagttctctggcggggagggagaggggtgttgcttctccagccccctgcagcctggtgtcttcctgccacccgccggcctgctccgggaaccgcggcctggtgggacgagggttgcggagg

SEQ ID NO: 115260 - DNA, 30 bp, Homo sapiens; identical to SEQ ID NO: 83386
  chr19:3817232-3817262
  Hypo

SEQ ID NO: 115261 - DNA, 250 bp, Homo sapiens; identical to SEQ ID NO: 83392
  chr19:3821004-3821254
  Hypo

SEQ ID NO: 115262 - DNA, 320 bp, Homo sapiens
  chr19:3821971-3822291
  Hyper
gttcgtcggatcacacgcgcggaagaggcccgaccacaggcctcccagcgcccgccgggccctagcacagcccggacgggtgtcggagctccccctgctggacgcacccggtactgcagccggtgccgccgccccctcacgtgcaggtccttcgcgttaaggtcgttgaaactgcactcgcacagcttgcagtggaagcgaagcactcgcccttcgtcgctgaacacctgagacacagaacagccgcacgcgcaccaggcacgaggcggggtgggatgtgagatgctaccgctgccaggtcgcggcggagccttcctcct

SEQ ID NO: 115263 - DNA, 47 bp, Homo sapiens; identical to SEQ ID NO: 83397
  chr19:3827483-3827530
  Hypo

SEQ ID NO: 115264 - DNA, 297 bp, Homo sapiens; identical to SEQ ID NO: 83403
  chr19:3855407-3855704
  Hypo

SEQ ID NO: 115265 - DNA, 32 bp, Homo sapiens; identical to SEQ ID NO: 83405
  chr19:3856184-3856216
  Hypo

SEQ ID NO: 115266 - DNA, 37 bp, Homo sapiens; identical to SEQ ID NO: 83406
  chr19:3859512-3859549
  Hypo

SEQ ID NO: 115267 - DNA, 352 bp, Homo sapiens
  chr19:3868851-3869203
  Hyper
ggctgggactggggccgggccgggcgcacgcggcgggagaaggggtaggcggggtcccggccaggctgcaggggccgggactggcgggggctggcgcggcggggcagttacctgtactgcgggccgccgccctgcgcgaagtcgaaatactgactcgtcgccatcttggcgtcttccccgagcctggcggacccgcgacgtcacccgccccgcccccgagccgcgtgccgctcgcgcctggccacgcgccccaagctccgccccctgcgcgaagccctcaccttctcgcttccttctcttaggctagggagacaccgccccgcgaccacacctgccccgaggccccgcctcc

SEQ ID NO: 115268 - DNA, 404 bp, Homo sapiens; identical to SEQ ID NO: 83424
  chr19:3880457-3880861
  Hyper

SEQ ID NO: 115269 - DNA, 512 bp, Homo sapiens; identical to SEQ ID NO: 83425
  chr19:3881335-3881847
  Hyper

SEQ ID NO: 115270 - DNA, 230 bp, Homo sapiens; identical to SEQ ID NO: 83457
  chr19:3907717-3907947
  Hypo

SEQ ID NO: 115271 - DNA, 162 bp, Homo sapiens; identical to SEQ ID NO: 83475
  chr19:3933098-3933260
  Hyper

SEQ ID NO: 115272 - DNA, 318 bp, Homo sapiens; identical to SEQ ID NO: 83476
  chr19:3933461-3933779
  Hyper

SEQ ID NO: 115273 - DNA, 182 bp, Homo sapiens; identical to SEQ ID NO: 83477
  chr19:3936566-3936748
  Hypo

SEQ ID NO: 115274 - DNA, 59 bp, Homo sapiens; identical to SEQ ID NO: 83481
  chr19:3946634-3946693
  Hypo

SEQ ID NO: 115275 - DNA, 86 bp, Homo sapiens; identical to SEQ ID NO: 83497
  chr19:3972561-3972647
  Hypo

SEQ ID NO: 115276 - DNA, 30 bp, Homo sapiens; identical to SEQ ID NO: 83500
  chr19:3976461-3976491
  Hypo

SEQ ID NO: 115277 - DNA, 30 bp, Homo sapiens; identical to SEQ ID NO: 83501
  chr19:3979506-3979536
  Hypo

SEQ ID NO: 115278 - DNA, 44 bp, Homo sapiens; identical to SEQ ID NO: 83506
  chr19:3981879-3981923
  Hypo

SEQ ID NO: 115279 - DNA, 30 bp, Homo sapiens; identical to SEQ ID NO: 83507
  chr19:3982143-3982173
  Hypo

SEQ ID NO: 115280 - DNA, 362 bp, Homo sapiens; identical to SEQ ID NO: 83509
  chr19:3982733-3983095
  Hypo

SEQ ID NO: 115281 - DNA, 30 bp, Homo sapiens; identical to SEQ ID NO: 83522
  chr19:4010876-4010906
  Hypo

SEQ ID NO: 115282 - DNA, 108 bp, Homo sapiens; identical to SEQ ID NO: 83529
  chr19:4043222-4043330
  Hypo

SEQ ID NO: 115283 - DNA, 30 bp, Homo sapiens; identical to SEQ ID NO: 83530
  chr19:4044591-4044621
  Hypo

SEQ ID NO: 115284 - DNA, 30 bp, Homo sapiens; identical to SEQ ID NO: 83531
  chr19:4044972-4045002
  Hypo

SEQ ID NO: 115285 - DNA, 30 bp, Homo sapiens; identical to SEQ ID NO: 83534
  chr19:4050407-4050437
  Hypo

SEQ ID NO: 115286 - DNA, 206 bp, Homo sapiens; identical to SEQ ID NO: 45623
  chr19:4053834-4054040
  Hypo

SEQ ID NO: 115287 - DNA, 75 bp, Homo sapiens; identical to SEQ ID NO: 83536
  chr19:4054305-4054380
  Hypo

SEQ ID NO: 115288 - DNA, 276 bp, Homo sapiens; identical to SEQ ID NO: 83537
  chr19:4054641-4054917
  Hypo

SEQ ID NO: 115289 - DNA, 81 bp, Homo sapiens; identical to SEQ ID NO: 37148
  chr19:4077899-4077980
  Hyper

SEQ ID NO: 115290 - DNA, 30 bp, Homo sapiens; identical to SEQ ID NO: 83546
  chr19:4086323-4086353
  Hypo

SEQ ID NO: 115291 - DNA, 109 bp, Homo sapiens; identical to SEQ ID NO: 83555
  chr19:4096416-4096525
  Hypo

SEQ ID NO: 115292 - DNA, 45 bp, Homo sapiens; identical to SEQ ID NO: 83577
  chr19:4131483-4131528
  Hypo

SEQ ID NO: 115293 - DNA, 80 bp, Homo sapiens; identical to SEQ ID NO: 83586
  chr19:4163466-4163546
  Hypo

SEQ ID NO: 115294 - DNA, 206 bp, Homo sapiens; identical to SEQ ID NO: 83600
  chr19:4197993-4198199
  Hyper

SEQ ID NO: 115295 - DNA, 197 bp, Homo sapiens; identical to SEQ ID NO: 83603
  chr19:4212352-4212549
  Hypo

SEQ ID NO: 115296 - DNA, 77 bp, Homo sapiens; identical to SEQ ID NO: 83633
  chr19:4278832-4278909
  Hyper

SEQ ID NO: 115297 - DNA, 469 bp, Homo sapiens
  chr19:4279316-4279785
  Hyper
cgcccccctccccagcgtcccacctcccggcggcggcggggaaagtctctccgaaagcgtgaagggggattggaggaggtttttatttccctttgtgcgggtggctggggccggatcgaggcggcgggggccgcgggactgggggctccccgctgagccgagaggagcgcgacaaaggatgcgtcccgccggggtcacagtctccgcggcccaactttgcgcgcggcgcccgcgcccctggggagcccgcccgctgcgctgagaacccaggcgtccgggctgggagaggggccgggagcgtccgcaggtggcgctggcccggatctcccgaccccaggaagggatcccggagcttcctggaggcggcgggcggccgtgtcgctccagggaaccgcgctgcccgcggaaactccgcgcgcctccgcggatgcccctcgccctagcccccagcgcgcggggttcggggccc

SEQ ID NO: 115298 - DNA, 40 bp, Homo sapiens
  chr19:4280188-4280228
  Hyper
ggacccctatgaggacgcggagagccgcttggagccggac

SEQ ID NO: 115299 - DNA, 20 bp, Homo sapiens
  chr19:4280809-4280829
  Hypo
cactgcgcccggtggatatc

SEQ ID NO: 115300 - DNA, 40 bp, Homo sapiens; identical to SEQ ID NO: 83642
  chr19:4290546-4290586
  Hypo

SEQ ID NO: 115301 - DNA, 26 bp, Homo sapiens
  chr19:4292523-4292549
  Hypo
gtgtctggcctcgatccccccttttt

SEQ ID NO: 115302 - DNA, 270 bp, Homo sapiens; identical to SEQ ID NO: 83650
  chr19:4304414-4304684
  Hyper

SEQ ID NO: 115303 - DNA, 30 bp, Homo sapiens; identical to SEQ ID NO: 83652
  chr19:4305492-4305522
  Hypo

SEQ ID NO: 115304 - DNA, 42 bp, Homo sapiens; identical to SEQ ID NO: 83653
  chr19:4305764-4305806
  Hypo

SEQ ID NO: 115305 - DNA, 36 bp, Homo sapiens; identical to SEQ ID NO: 83654
  chr19:4311212-4311248
  Hypo

SEQ ID NO: 115306 - DNA, 76 bp, Homo sapiens; identical to SEQ ID NO: 83657
  chr19:4361174-4361250
  Hypo

SEQ ID NO: 115307 - DNA, 161 bp, Homo sapiens; identical to SEQ ID NO: 83658
  chr19:4361539-4361700
  Hypo

SEQ ID NO: 115308 - DNA, 52 bp, Homo sapiens; identical to SEQ ID NO: 83660
  chr19:4363354-4363406
  Hypo

SEQ ID NO: 115309 - DNA, 78 bp, Homo sapiens; identical to SEQ ID NO: 83663
  chr19:4378773-4378851
  Hypo

SEQ ID NO: 115310 - DNA, 35 bp, Homo sapiens; identical to SEQ ID NO: 37152
  chr19:4380549-4380584
  Hyper

SEQ ID NO: 115311 - DNA, 48 bp, Homo sapiens; identical to SEQ ID NO: 45632
  chr19:4512122-4512170
  Hypo

SEQ ID NO: 115312 - DNA, 30 bp, Homo sapiens; identical to SEQ ID NO: 83696
  chr19:4513397-4513427
  Hypo

SEQ ID NO: 115313 - DNA, 30 bp, Homo sapiens; identical to SEQ ID NO: 83700
  chr19:4523538-4523568
  Hypo

SEQ ID NO: 115314 - DNA, 21 bp, Homo sapiens
  chr19:4524273-4524294
  Hypo
cacaatggggccggtcgcggt

SEQ ID NO: 115315 - DNA, 398 bp, Homo sapiens; identical to SEQ ID NO: 83712
  chr19:4547992-4548390
  Hypo

SEQ ID NO: 115316 - DNA, 108 bp, Homo sapiens; identical to SEQ ID NO: 83713
  chr19:4550222-4550330
  Hypo

SEQ ID NO: 115317 - DNA, 237 bp, Homo sapiens; identical to SEQ ID NO: 83714
  chr19:4550864-4551101
  Hypo

SEQ ID NO: 115318 - DNA, 166 bp, Homo sapiens; identical to SEQ ID NO: 45635
  chr19:4554076-4554242
  Hypo

SEQ ID NO: 115319 - DNA, 62 bp, Homo sapiens; identical to SEQ ID NO: 45636
  chr19:4554999-4555061
  Hypo

SEQ ID NO: 115320 - DNA, 312 bp, Homo sapiens; identical to SEQ ID NO: 83718
  chr19:4555896-4556208
  Hypo

SEQ ID NO: 115321 - DNA, 449 bp, Homo sapiens; identical to SEQ ID NO: 83719
  chr19:4556922-4557371
  Hypo

SEQ ID NO: 115322 - DNA, 42 bp, Homo sapiens; identical to SEQ ID NO: 45639
  chr19:4572555-4572597
  Hypo

SEQ ID NO: 115323 - DNA, 74 bp, Homo sapiens; identical to SEQ ID NO: 83754
  chr19:4597429-4597503
  Hyper

SEQ ID NO: 115324 - DNA, 142 bp, Homo sapiens; identical to SEQ ID NO: 45640
  chr19:4670725-4670867
  Hypo

SEQ ID NO: 115325 - DNA, 50 bp, Homo sapiens; identical to SEQ ID NO: 45641
  chr19:4672854-4672904
  Hypo

SEQ ID NO: 115326 - DNA, 57 bp, Homo sapiens; identical to SEQ ID NO: 83794
  chr19:4679562-4679619
  Hypo

SEQ ID NO: 115327 - DNA, 30 bp, Homo sapiens; identical to SEQ ID NO: 83815
  chr19:4700942-4700972
  Hypo

SEQ ID NO: 115328 - DNA, 30 bp, Homo sapiens; identical to SEQ ID NO: 83821
  chr19:4714199-4714229
  Hypo

SEQ ID NO: 115329 - DNA, 120 bp, Homo sapiens; identical to SEQ ID NO: 83825
  chr19:4725471-4725591
  Hypo

SEQ ID NO: 115330 - DNA, 24 bp, Homo sapiens
  chr19:4725831-4725855
  Hypo
gtgccaccacgccaggcctcttta

SEQ ID NO: 115331 - DNA, 96 bp, Homo sapiens; identical to SEQ ID NO: 83839
  chr19:4769594-4769690
  Hyper

SEQ ID NO: 115332 - DNA, 120 bp, Homo sapiens; identical to SEQ ID NO: 83848
  chr19:4790000-4790120
  Hypo

SEQ ID NO: 115333 - DNA, 363 bp, Homo sapiens; identical to SEQ ID NO: 83855
  chr19:4792849-4793212
  Hypo

SEQ ID NO: 115334 - DNA, 38 bp, Homo sapiens; identical to SEQ ID NO: 83857
  chr19:4794081-4794119
  Hypo

SEQ ID NO: 115335 - DNA, 201 bp, Homo sapiens; identical to SEQ ID NO: 83860
  chr19:4795123-4795324
  Hypo

SEQ ID NO: 115336 - DNA, 137 bp, Homo sapiens; identical to SEQ ID NO: 83864
  chr19:4798614-4798751
  Hypo

SEQ ID NO: 115337 - DNA, 109 bp, Homo sapiens; identical to SEQ ID NO: 83868
  chr19:4800481-4800590
  Hypo

SEQ ID NO: 115338 - DNA, 85 bp, Homo sapiens; identical to SEQ ID NO: 83874
  chr19:4815691-4815776
  Hyper

SEQ ID NO: 115339 - DNA, 79 bp, Homo sapiens; identical to SEQ ID NO: 83875
  chr19:4816471-4816550
  Hypo

SEQ ID NO: 115340 - DNA, 53 bp, Homo sapiens; identical to SEQ ID NO: 83884
  chr19:4835677-4835730
  Hypo

SEQ ID NO: 115341 - DNA, 30 bp, Homo sapiens; identical to SEQ ID NO: 83946
  chr19:4962354-4962384
  Hypo

SEQ ID NO: 115342 - DNA, 120 bp, Homo sapiens; identical to SEQ ID NO: 83954
  chr19:4986513-4986633
  Hypo

SEQ ID NO: 115343 - DNA, 30 bp, Homo sapiens; identical to SEQ ID NO: 83981
  chr19:5023215-5023245
  Hypo

SEQ ID NO: 115344 - DNA, 63 bp, Homo sapiens; identical to SEQ ID NO: 84001
  chr19:5037561-5037624
  Hypo

SEQ ID NO: 115345 - DNA, 30 bp, Homo sapiens; identical to SEQ ID NO: 84002
  chr19:5038391-5038421
  Hypo

SEQ ID NO: 115346 - DNA, 142 bp, Homo sapiens; identical to SEQ ID NO: 84008
  chr19:5041033-5041175
  Hypo

SEQ ID NO: 115347 - DNA, 200 bp, Homo sapiens; identical to SEQ ID NO: 45651
  chr19:5046161-5046361
  Hypo

SEQ ID NO: 115348 - DNA, 30 bp, Homo sapiens; identical to SEQ ID NO: 84016
  chr19:5058670-5058700
  Hypo

SEQ ID NO: 115349 - DNA, 30 bp, Homo sapiens; identical to SEQ ID NO: 84017
  chr19:5064302-5064332
  Hypo

SEQ ID NO: 115350 - DNA, 30 bp, Homo sapiens; identical to SEQ ID NO: 84043
  chr19:5102740-5102770
  Hypo

SEQ ID NO: 115351 - DNA, 30 bp, Homo sapiens; identical to SEQ ID NO: 84081
  chr19:5142538-5142568
  Hypo

SEQ ID NO: 115352 - DNA, 30 bp, Homo sapiens; identical to SEQ ID NO: 84083
  chr19:5148235-5148265
  Hypo

SEQ ID NO: 115353 - DNA, 296 bp, Homo sapiens; identical to SEQ ID NO: 84090
  chr19:5155117-5155413
  Hypo

SEQ ID NO: 115354 - DNA, 30 bp, Homo sapiens; identical to SEQ ID NO: 84143
  chr19:5269609-5269639
  Hypo

SEQ ID NO: 115355 - DNA, 1060 bp, Homo sapiens
  chr19:5292613-5293673
  Hyper
aaagcacagaggcaacgtggggtccacaggcccgagaggagcggaaacaaatggatggaggtaaacttcctgcgattttcgggggtggctaagagcagggattcctgccatgcaccccccaccgctacctgccccctctgcggtcctgttgcctcctccgccttctgcgaagtccccagtcacagctcccccgggctggcagcgaaggctgccccgcgcctggctccgcccccgggaggtgggggaggagagggggtggggggaggaggtcgggctgggggccaggcgggggaggggaccctgcggagcataacggtctggagttttccaaagtgcaagcgacgggcctgaatgggggggcgccaggcagcagcaggcccaagctggccctggagggcggccggcacggtcaggcccgcgctgggctgtggggacccccgtggtccccagcctcggagcctggagggggcgcgacaagagagacaaagcccggggcggcccgggcctcggggtggaagggggtcccgggcgcactcaccccgcggctcggagatcgggcccaggccccgcgaggcctccacagggcccgccgcagccgctccccgcgtccctcggtccgcccggagcgcggcgcgcagcgaagactcgggagaggcctcggcctggggagctcggcctgggggcggggcaaggggcggggctgtagggggcggggttgcagtgggcggggctgcaggggacgggccccgaggagggggattggggggcagggcggggccccggccggaagtggggcggggggaccagaggggagccccatctggaggcgcggagagcctccgcaggagtccatgaaacactgagcgaaggggcgccccagggagggcacgacccaagacccctccctcccgaagacgtctcacggggagcctctacactgctcctcgcttccccagctctgatcgtagccatggcaacgcatgaggaggctggatgccggacagggcggcggagggctccccaaacacacccaactacaggaggtcggagaaggggcaga

SEQ ID NO: 115356 - DNA, 222 bp, Homo sapiens
  chr19:5293976-5294198
  Hyper
gccaatccgagccagcgttgcgcccggggtgcgggtttgaaaactccaccggaggggcccggaatgtagaagcccagcgggacctgggggtctggggacgggacaggggcagaggccgggatggagacccaagggctcccgcgtctgctcccatccctggaaaaaacgcctctcttcccagcattcgcgctgaggacgaagcccgaacgccaacgccaacgg

SEQ ID NO: 115357 - DNA, 53 bp, Homo sapiens; identical to SEQ ID NO: 84190
  chr19:5319680-5319733
  Hypo

SEQ ID NO: 115358 - DNA, 30 bp, Homo sapiens; identical to SEQ ID NO: 84203
  chr19:5336366-5336396
  Hyper

SEQ ID NO: 115359 - DNA, 418 bp, Homo sapiens
  chr19:5338746-5339164
  Hyper
tgcaaatggcagattcgaccaagtccctgggccattaataaacgctccagcagctgccgctggtatcgcaggagcagaggagcgggatggcttccttctcccgggcgaaaggcggcagaaagagggaagaagggcgccccagacaaagaggcgccgtcaccctctgcaccccaaggacagcagcgatagggggccacccagaggaggccagaatcccagcagccaaagtccgggtggtggcggacgggagcccggagcgtgtgggtccctgtccttgggaccctaggggtctcttcctgcctcctccggcttctaggtatcatccctgctgctcagccgggactccgacacctcggacacccgcttcactagccgcggctgccgggatgtgtttttagggtctcggccagaggcagga

SEQ ID NO: 115360 - DNA, 30 bp, Homo sapiens; identical to SEQ ID NO: 37161
  chr19:5339394-5339424
  Hyper

SEQ ID NO: 115361 - DNA, 41 bp, Homo sapiens; identical to SEQ ID NO: 84208
  chr19:5339625-5339666
  Hyper

SEQ ID NO: 115362 - DNA, 681 bp, Homo sapiens; identical to SEQ ID NO: 84210
  chr19:5340438-5341119
  Hyper

SEQ ID NO: 115363 - DNA, 45 bp, Homo sapiens; identical to SEQ ID NO: 84276
  chr19:5436734-5436779
  Hyper

SEQ ID NO: 115364 - DNA, 284 bp, Homo sapiens; identical to SEQ ID NO: 84277
  chr19:5437029-5437313
  Hyper

SEQ ID NO: 115365 - DNA, 53 bp, Homo sapiens; identical to SEQ ID NO: 84293
  chr19:5441350-5441403
  Hypo

SEQ ID NO: 115366 - DNA, 30 bp, Homo sapiens; identical to SEQ ID NO: 84314
  chr19:5456281-5456311
  Hypo

SEQ ID NO: 115367 - DNA, 219 bp, Homo sapiens; identical to SEQ ID NO: 84329
  chr19:5567484-5567703
  Hyper

SEQ ID NO: 115368 - DNA, 918 bp, Homo sapiens; identical to SEQ ID NO: 84346
  chr19:5587305-5588223
  Hypo

SEQ ID NO: 115369 - DNA, 30 bp, Homo sapiens; identical to SEQ ID NO: 84354
  chr19:5595231-5595261
  Hypo

SEQ ID NO: 115370 - DNA, 30 bp, Homo sapiens; identical to SEQ ID NO: 84396
  chr19:5668242-5668272
  Hypo

SEQ ID NO: 115371 - DNA, 124 bp, Homo sapiens; identical to SEQ ID NO: 84404
  chr19:5676787-5676911
  Hypo

SEQ ID NO: 115372 - DNA, 30 bp, Homo sapiens; identical to SEQ ID NO: 84406
  chr19:5681360-5681390
  Hyper

SEQ ID NO: 115373 - DNA, 30 bp, Homo sapiens; identical to SEQ ID NO: 45656
  chr19:5688079-5688109
  Hypo

SEQ ID NO: 115374 - DNA, 35 bp, Homo sapiens; identical to SEQ ID NO: 84442
  chr19:5721426-5721461
  Hypo

SEQ ID NO: 115375 - DNA, 34 bp, Homo sapiens; identical to SEQ ID NO: 84448
  chr19:5746446-5746480
  Hypo

SEQ ID NO: 115376 - DNA, 180 bp, Homo sapiens; identical to SEQ ID NO: 84451
  chr19:5759631-5759811
  Hypo

SEQ ID NO: 115377 - DNA, 23 bp, Homo sapiens
  chr19:5774263-5774286
  Hypo
actgcgcccggtcggctctgttg

SEQ ID NO: 115378 - DNA, 237 bp, Homo sapiens; identical to SEQ ID NO: 84476
  chr19:5789690-5789927
  Hypo

SEQ ID NO: 115379 - DNA, 45 bp, Homo sapiens; identical to SEQ ID NO: 84478
  chr19:5790168-5790213
  Hypo

SEQ ID NO: 115380 - DNA, 70 bp, Homo sapiens; identical to SEQ ID NO: 84479
  chr19:5792712-5792782
  Hypo

SEQ ID NO: 115381 - DNA, 48 bp, Homo sapiens; identical to SEQ ID NO: 84513
  chr19:5825314-5825362
  Hypo

SEQ ID NO: 115382 - DNA, 35 bp, Homo sapiens; identical to SEQ ID NO: 84514
  chr19:5826174-5826209
  Hypo

SEQ ID NO: 115383 - DNA, 520 bp, Homo sapiens; identical to SEQ ID NO: 84516
  chr19:5827795-5828315
  Hyper

SEQ ID NO: 115384 - DNA, 30 bp, Homo sapiens; identical to SEQ ID NO: 84518
  chr19:5829268-5829298
  Hyper

SEQ ID NO: 115385 - DNA, 21 bp, Homo sapiens
  chr19:5857651-5857672
  Hypo
gacgtgcgtgacacaatgttt

SEQ ID NO: 115386 - DNA, 74 bp, Homo sapiens; identical to SEQ ID NO: 84582
  chr19:5896952-5897026
  Hypo

SEQ ID NO: 115387 - DNA, 181 bp, Homo sapiens; identical to SEQ ID NO: 84583
  chr19:5897577-5897758
  Hypo

SEQ ID NO: 115388 - DNA, 16 bp, Homo sapiens
  chr19:5902541-5902557
  Hypo
ccggattacaggtgtg

SEQ ID NO: 115389 - DNA, 33 bp, Homo sapiens; identical to SEQ ID NO: 45663
  chr19:5905436-5905469
  Hypo

SEQ ID NO: 115390 - DNA, 90 bp, Homo sapiens; identical to SEQ ID NO: 84591
  chr19:5910339-5910429
  Hypo

SEQ ID NO: 115391 - DNA, 406 bp, Homo sapiens; identical to SEQ ID NO: 84593
  chr19:5914724-5915130
  Hypo

SEQ ID NO: 115392 - DNA, 99 bp, Homo sapiens; identical to SEQ ID NO: 84594
  chr19:5915421-5915520
  Hypo

SEQ ID NO: 115393 - DNA, 44 bp, Homo sapiens; identical to SEQ ID NO: 84595
  chr19:5915925-5915969
  Hypo

SEQ ID NO: 115394 - DNA, 54 bp, Homo sapiens; identical to SEQ ID NO: 84598
  chr19:5957003-5957057
  Hypo

SEQ ID NO: 115395 - DNA, 229 bp, Homo sapiens; identical to SEQ ID NO: 84599
  chr19:5960625-5960854
  Hypo

SEQ ID NO: 115396 - DNA, 218 bp, Homo sapiens; identical to SEQ ID NO: 84600
  chr19:5962237-5962455
  Hyper

SEQ ID NO: 115397 - DNA, 98 bp, Homo sapiens; identical to SEQ ID NO: 84602
  chr19:6007814-6007912
  Hypo

SEQ ID NO: 115398 - DNA, 30 bp, Homo sapiens; identical to SEQ ID NO: 84604
  chr19:6017660-6017690
  Hypo

SEQ ID NO: 115399 - DNA, 237 bp, Homo sapiens; identical to SEQ ID NO: 84605
  chr19:6020825-6021062
  Hypo

SEQ ID NO: 115400 - DNA, 30 bp, Homo sapiens; identical to SEQ ID NO: 84606
  chr19:6023009-6023039
  Hypo

SEQ ID NO: 115401 - DNA, 30 bp, Homo sapiens; identical to SEQ ID NO: 84609
  chr19:6042332-6042362
  Hypo

SEQ ID NO: 115402 - DNA, 185 bp, Homo sapiens; identical to SEQ ID NO: 84610
  chr19:6145786-6145971
  Hypo

SEQ ID NO: 115403 - DNA, 30 bp, Homo sapiens; identical to SEQ ID NO: 84612
  chr19:6198569-6198599
  Hypo

SEQ ID NO: 115404 - DNA, 30 bp, Homo sapiens; identical to SEQ ID NO: 84613
  chr19:6237402-6237432
  Hypo

SEQ ID NO: 115405 - DNA, 30 bp, Homo sapiens; identical to SEQ ID NO: 84615
  chr19:6280926-6280956
  Hypo

SEQ ID NO: 115406 - DNA, 321 bp, Homo sapiens; identical to SEQ ID NO: 84617
  chr19:6333454-6333775
  Hypo

SEQ ID NO: 115407 - DNA, 18 bp, Homo sapiens
  chr19:6345197-6345215
  Hypo
gcccggcctccgtgtgtt

SEQ ID NO: 115408 - DNA, 22 bp, Homo sapiens
  chr19:6351083-6351105
  Hypo
atatgagttataggccgggtgt

SEQ ID NO: 115409 - DNA, 215 bp, Homo sapiens; identical to SEQ ID NO: 45670
  chr19:6358251-6358466
  Hypo

SEQ ID NO: 115410 - DNA, 101 bp, Homo sapiens; identical to SEQ ID NO: 84624
  chr19:6393986-6394087
  Hyper

SEQ ID NO: 115411 - DNA, 30 bp, Homo sapiens; identical to SEQ ID NO: 84627
  chr19:6436032-6436062
  Hypo

SEQ ID NO: 115412 - DNA, 15 bp, Homo sapiens
  chr19:6463907-6463922
  Hypo
cgtgagccattgcgc

SEQ ID NO: 115413 - DNA, 145 bp, Homo sapiens; identical to SEQ ID NO: 84629
  chr19:6464334-6464479
  Hyper

SEQ ID NO: 115414 - DNA, 87 bp, Homo sapiens; identical to SEQ ID NO: 84630
  chr19:6501827-6501914
  Hyper

SEQ ID NO: 115415 - DNA, 93 bp, Homo sapiens; identical to SEQ ID NO: 84631
  chr19:6502684-6502777
  Hyper

SEQ ID NO: 115416 - DNA, 231 bp, Homo sapiens; identical to SEQ ID NO: 84632
  chr19:6531064-6531295
  Hyper

SEQ ID NO: 115417 - DNA, 556 bp, Homo sapiens; identical to SEQ ID NO: 84633
  chr19:6590325-6590881
  Hyper

SEQ ID NO: 115418 - DNA, 21 bp, Homo sapiens
  chr19:6623980-6624001
  Hypo
accctaagggccaggcgtggt

SEQ ID NO: 115419 - DNA, 30 bp, Homo sapiens; identical to SEQ ID NO: 84637
  chr19:6664938-6664968
  Hypo

SEQ ID NO: 115420 - DNA, 111 bp, Homo sapiens; identical to SEQ ID NO: 84639
  chr19:6822252-6822363
  Hypo

SEQ ID NO: 115421 - DNA, 21 bp, Homo sapiens
  chr19:6846939-6846960
  Hypo
ttggagacagagtttcgcact

SEQ ID NO: 115422 - DNA, 71 bp, Homo sapiens; identical to SEQ ID NO: 84641
  chr19:6862981-6863052
  Hyper

SEQ ID NO: 115423 - DNA, 30 bp, Homo sapiens; identical to SEQ ID NO: 84644
  chr19:6985326-6985356
  Hypo

SEQ ID NO: 115424 - DNA, 401 bp, Homo sapiens; identical to SEQ ID NO: 84645
  chr19:6986177-6986578
  Hypo

SEQ ID NO: 115425 - DNA, 30 bp, Homo sapiens; identical to SEQ ID NO: 84646
  chr19:7005228-7005258
  Hypo

SEQ ID NO: 115426 - DNA, 76 bp, Homo sapiens; identical to SEQ ID NO: 84650
  chr19:7116391-7116467
  Hypo

SEQ ID NO: 115427 - DNA, 38 bp, Homo sapiens; identical to SEQ ID NO: 45673
  chr19:7168432-7168470
  Hypo

SEQ ID NO: 115428 - DNA, 396 bp, Homo sapiens; identical to SEQ ID NO: 84652
  chr19:7184240-7184636
  Hypo

SEQ ID NO: 115429 - DNA, 329 bp, Homo sapiens; identical to SEQ ID NO: 84653
  chr19:7197100-7197429
  Hyper

SEQ ID NO: 115430 - DNA, 44 bp, Homo sapiens; identical to SEQ ID NO: 84655
  chr19:7267703-7267747
  Hypo

SEQ ID NO: 115431 - DNA, 219 bp, Homo sapiens; identical to SEQ ID NO: 84657
  chr19:7293527-7293746
  Hyper

SEQ ID NO: 115432 - DNA, 104 bp, Homo sapiens; identical to SEQ ID NO: 45675
  chr19:7542252-7542356
  Hypo

SEQ ID NO: 115433 - DNA, 48 bp, Homo sapiens; identical to SEQ ID NO: 84664
  chr19:7543263-7543311
  Hypo

SEQ ID NO: 115434 - DNA, 30 bp, Homo sapiens; identical to SEQ ID NO: 45676
  chr19:7543713-7543743
  Hypo

SEQ ID NO: 115435 - DNA, 279 bp, Homo sapiens; identical to SEQ ID NO: 84666
  chr19:7565964-7566243
  Hyper

SEQ ID NO: 115436 - DNA, 165 bp, Homo sapiens; identical to SEQ ID NO: 84667
  chr19:7572022-7572187
  Hypo

SEQ ID NO: 115437 - DNA, 202 bp, Homo sapiens; identical to SEQ ID NO: 84668
  chr19:7627647-7627849
  Hypo

SEQ ID NO: 115438 - DNA, 30 bp, Homo sapiens; identical to SEQ ID NO: 84669
  chr19:7655702-7655732
  Hypo

SEQ ID NO: 115439 - DNA, 30 bp, Homo sapiens; identical to SEQ ID NO: 84670
  chr19:7657876-7657906
  Hypo

SEQ ID NO: 115440 - DNA, 391 bp, Homo sapiens; identical to SEQ ID NO: 84671
  chr19:7706453-7706844
  Hypo

SEQ ID NO: 115441 - DNA, 127 bp, Homo sapiens; identical to SEQ ID NO: 45679
  chr19:7727784-7727911
  Hypo

SEQ ID NO: 115442 - DNA, 340 bp, Homo sapiens; identical to SEQ ID NO: 84673
  chr19:7752247-7752587
  Hypo

SEQ ID NO: 115443 - DNA, 30 bp, Homo sapiens; identical to SEQ ID NO: 84674
  chr19:7755197-7755227
  Hypo

SEQ ID NO: 115444 - DNA, 556 bp, Homo sapiens; identical to SEQ ID NO: 84675
  chr19:7794710-7795266
  Hyper

SEQ ID NO: 115445 - DNA, 299 bp, Homo sapiens
  chr19:7795513-7795812
  Hyper
aaggtcagagtgcagcgtcagggtcaggacggggtgcatgatcggggtcgggggtcagcactcaggacggggtcggggtcgggggacgcggccagggctcagggccggggtcgcgtcgggccctcaccgcgctcacgcagttcccgcagggcgctctcctgctccatcagcttcgcctgcgcctccccaagctccgcgcgcgtggtctgcagctgcgcctgcgtccccgagcctgggagccgcagggtgagaggggcgagggcggcgaggatggggcgggacttcggagaccagccccc

SEQ ID NO: 115446 - DNA, 30 bp, Homo sapiens; identical to SEQ ID NO: 84678
  chr19:7815355-7815385
  Hypo

SEQ ID NO: 115447 - DNA, 1028 bp, Homo sapiens
  chr19:7852955-7853983
  Hyper
ttgctcgcgtctgagcgtgagcagagtgtgtgtacatctttgggccgtttgcagtcacgcgtgtgcacatggcgtgcacgtatgtgtgcgagtccccacgcgtttgtctcccatcggcgtgtgtgcacatagtgtgcgctatatgcctgcctgcccgcccgctctgtggtcccgagtcgggggaccccgcaccccccgggcaagggaaggatttccgagtccctggccttgcctgcaggagcctctctccgcagcctccacggagcgcgcggcgctgctcggctgccaggacctgctgaggacaaacggtgtgtgcagagccgggcgcctgggcgcccggggcgtgtgcggcgggagcgtctgagaccccagagatggagtcctgggtgcgtgggggccctgtggtccctgagtctggccacggggtgtggaagggagtcccctgagtcctcccaagtgacccggcgggcatgcgttttgggatgggggtcgttccagcctcgaagcagacggcggcgctgggtgccctggaggaggaggtgggagcctgccacagctgctgtgagggggcgcggcccagactatgggcgcaagggtggggtcttgtggccgggatgggaggggggccggaggcgaggcctgcggcgagtggggcggcggggggctggtctccgaagtcccgccccatcctcgcctccctcgcccctctcaccccgcggctcccaggctcggggacgcaggcgctgctgcagaccacgagcgcggagcttggggaggcgcaggcgaagctgatggagcaggagagagccctgcgggaactgcgtgagcgcggtgagggcccgacgcgaccccagccctgagccctggccgcgtcccccgaccccgaccccgaccccgtcctgagtgctgacccctgacactgatcatgcaccccgtcctgaccctgacgctgcactctgaccttgactgccactcctagcgccggccacacccggaccctgcccaggtgtaaccgtccttgaccctgt

SEQ ID NO: 115448 - DNA, 281 bp, Homo sapiens
  chr19:7854218-7854499
  Hyper
taagtggaccctgcccgtgtgcgtcgccggaccccctctttgaccttggcctggtcctgtggctccacccctgagcccgtggggccaaacccctaccccctgcatcctcttggtgcgctctccctggaagcactcgacctctctgacccttgccaccctacaggttcctgtgagccgtgccctacgtcgtggctgcccttcgggggctcctgctactatttctctgtgccgaagaccacgtgggcagaggcgcagggccactgcgccgatgccagcgcaca

SEQ ID NO: 115449 - DNA, 232 bp, Homo sapiens; identical to SEQ ID NO: 84684
  chr19:7914950-7915182
  Hypo

SEQ ID NO: 115450 - DNA, 74 bp, Homo sapiens; identical to SEQ ID NO: 84685
  chr19:7926897-7926971
  Hyper

SEQ ID NO: 115451 - DNA, 120 bp, Homo sapiens; identical to SEQ ID NO: 84686
  chr19:7927433-7927553
  Hyper

SEQ ID NO: 115452 - DNA, 82 bp, Homo sapiens; identical to SEQ ID NO: 84687
  chr19:7934175-7934257
  Hyper

SEQ ID NO: 115453 - DNA, 45 bp, Homo sapiens
  chr19:7938775-7938820
  Hyper
agtcccaccccccaccgcttttccctaaagcgaagaggccctgcc

SEQ ID NO: 115454 - DNA, 79 bp, Homo sapiens; identical to SEQ ID NO: 84689
  chr19:7939141-7939220
  Hyper

SEQ ID NO: 115455 - DNA, 35 bp, Homo sapiens; identical to SEQ ID NO: 84690
  chr19:7939421-7939456
  Hyper

SEQ ID NO: 115456 - DNA, 114 bp, Homo sapiens; identical to SEQ ID NO: 84691
  chr19:7953384-7953498
  Hyper

SEQ ID NO: 115457 - DNA, 30 bp, Homo sapiens; identical to SEQ ID NO: 84692
  chr19:7969667-7969697
  Hypo

SEQ ID NO: 115458 - DNA, 30 bp, Homo sapiens; identical to SEQ ID NO: 84693
  chr19:7969931-7969961
  Hypo

SEQ ID NO: 115459 - DNA, 48 bp, Homo sapiens; identical to SEQ ID NO: 45682
  chr19:7970450-7970498
  Hypo

SEQ ID NO: 115460 - DNA, 64 bp, Homo sapiens; identical to SEQ ID NO: 84695
  chr19:7981019-7981083
  Hyper

SEQ ID NO: 115461 - DNA, 30 bp, Homo sapiens; identical to SEQ ID NO: 84696
  chr19:7982356-7982386
  Hyper

SEQ ID NO: 115462 - DNA, 184 bp, Homo sapiens; identical to SEQ ID NO: 84697
  chr19:7982589-7982773
  Hyper

SEQ ID NO: 115463 - DNA, 144 bp, Homo sapiens; identical to SEQ ID NO: 84698
  chr19:8009493-8009637
  Hypo

SEQ ID NO: 115464 - DNA, 75 bp, Homo sapiens; identical to SEQ ID NO: 84700
  chr19:8053017-8053092
  Hypo

SEQ ID NO: 115465 - DNA, 99 bp, Homo sapiens; identical to SEQ ID NO: 84701
  chr19:8057697-8057796
  Hypo

SEQ ID NO: 115466 - DNA, 30 bp, Homo sapiens; identical to SEQ ID NO: 84702
  chr19:8067340-8067370
  Hyper

SEQ ID NO: 115467 - DNA, 42 bp, Homo sapiens; identical to SEQ ID NO: 84704
  chr19:8082518-8082560
  Hypo

SEQ ID NO: 115468 - DNA, 46 bp, Homo sapiens; identical to SEQ ID NO: 84705
  chr19:8091663-8091709
  Hypo

SEQ ID NO: 115469 - DNA, 366 bp, Homo sapiens; identical to SEQ ID NO: 84706
  chr19:8115235-8115601
  Hyper

SEQ ID NO: 115470 - DNA, 60 bp, Homo sapiens; identical to SEQ ID NO: 84708
  chr19:8124525-8124585
  Hypo

SEQ ID NO: 115471 - DNA, 98 bp, Homo sapiens; identical to SEQ ID NO: 84711
  chr19:8148225-8148323
  Hypo

SEQ ID NO: 115472 - DNA, 120 bp, Homo sapiens; identical to SEQ ID NO: 84712
  chr19:8151687-8151807
  Hypo

SEQ ID NO: 115473 - DNA, 30 bp, Homo sapiens; identical to SEQ ID NO: 84714
  chr19:8191057-8191087
  Hypo

SEQ ID NO: 115474 - DNA, 34 bp, Homo sapiens; identical to SEQ ID NO: 45686
  chr19:8194085-8194119
  Hypo

SEQ ID NO: 115475 - DNA, 70 bp, Homo sapiens; identical to SEQ ID NO: 84716
  chr19:8196678-8196748
  Hypo

SEQ ID NO: 115476 - DNA, 71 bp, Homo sapiens; identical to SEQ ID NO: 84717
  chr19:8214391-8214462
  Hyper

SEQ ID NO: 115477 - DNA, 180 bp, Homo sapiens; identical to SEQ ID NO: 84721
  chr19:8253645-8253825
  Hypo

SEQ ID NO: 115478 - DNA, 30 bp, Homo sapiens; identical to SEQ ID NO: 84722
  chr19:8407763-8407793
  Hyper

SEQ ID NO: 115479 - DNA, 644 bp, Homo sapiens; identical to SEQ ID NO: 84723
  chr19:8428713-8429357
  Hyper

SEQ ID NO: 115480 - DNA, 32 bp, Homo sapiens; identical to SEQ ID NO: 84724
  chr19:8432333-8432365
  Hyper

SEQ ID NO: 115481 - DNA, 30 bp, Homo sapiens; identical to SEQ ID NO: 84725
  chr19:8461662-8461692
  Hyper

SEQ ID NO: 115482 - DNA, 83 bp, Homo sapiens; identical to SEQ ID NO: 84726
  chr19:8475442-8475525
  Hypo

SEQ ID NO: 115483 - DNA, 30 bp, Homo sapiens; identical to SEQ ID NO: 84729
  chr19:8528381-8528411
  Hypo

SEQ ID NO: 115484 - DNA, 341 bp, Homo sapiens; identical to SEQ ID NO: 84730
  chr19:8576789-8577130
  Hypo

SEQ ID NO: 115485 - DNA, 30 bp, Homo sapiens; identical to SEQ ID NO: 84731
  chr19:8601272-8601302
  Hypo

SEQ ID NO: 115486 - DNA, 116 bp, Homo sapiens; identical to SEQ ID NO: 84742
  chr19:9129113-9129229
  Hypo

SEQ ID NO: 115487 - DNA, 111 bp, Homo sapiens; identical to SEQ ID NO: 84745
  chr19:9261611-9261722
  Hypo

SEQ ID NO: 115488 - DNA, 158 bp, Homo sapiens; identical to SEQ ID NO: 84747
  chr19:9434811-9434969
  Hyper

SEQ ID NO: 115489 - DNA, 30 bp, Homo sapiens; identical to SEQ ID NO: 84748
  chr19:9435206-9435236
  Hyper

SEQ ID NO: 115490 - DNA, 404 bp, Homo sapiens
  chr19:9473652-9474056
  Hyper
ctttcagctgctggccggaagcggaagtgggcgtccgtcgcctcgccatctcccatagctgtcgcctgcagctgagaaagggttgctgtcccagcaggccaggtccaggtgcgccccactagtgaggccggcggaatcgggagggaaggggtcaagggcacagtgcgcagccccggctgctccagaccttgcctgcagcttcccgccccagcctccggctatcgcggcgtttcttctcagaggccgccggctttggttcctcccggcactgctgggcttggggctgccattccgggcattggttcccgggaggaggcaagtgggttcatgtggtcagagtgcgtcggcggggccttttctccactttctgtacccttctctttaaacgtcgtccccagtaggag

SEQ ID NO: 115491 - DNA, 422 bp, Homo sapiens
  chr19:9517563-9517985
  Hyper
gaagaagtgcggtgtcggcaggaagtcccagcgcgacgtccgggaaagccacaggaggaggcgacctgcaggaggctaccctttgaccccaaccctactctccagtcctcctagtctggtgggagcaaccttagactggttgatgtggaaggaggcgggcctgcacgcggagtacggcattcacttccgtttccgggagcgcacttccgtttccaggcatgagggcaacgggggaggggggggaggtgacctggaatgggctgagaaacaggagccacgagagccgcgtggtgacgttagaagggcgctacagccgcgactttccaaagctagtagagagatcccagcgtcccccgggaaaggcagaaggggcggggcgataccaagacggagacaatggggcggggcgatgccctggaggc

SEQ ID NO: 115492 - DNA, 30 bp, Homo sapiens; identical to SEQ ID NO: 84753
  chr19:9545256-9545286
  Hypo

SEQ ID NO: 115493 - DNA, 585 bp, Homo sapiens; identical to SEQ ID NO: 84758
  chr19:9608851-9609436
  Hyper

SEQ ID NO: 115494 - DNA, 259 bp, Homo sapiens; identical to SEQ ID NO: 84760
  chr19:9649131-9649390
  Hyper

SEQ ID NO: 115495 - DNA, 92 bp, Homo sapiens; identical to SEQ ID NO: 84762
  chr19:9786287-9786379
  Hypo

SEQ ID NO: 115496 - DNA, 429 bp, Homo sapiens; identical to SEQ ID NO: 84763
  chr19:9903599-9904028
  Hyper

SEQ ID NO: 115497 - DNA, 158 bp, Homo sapiens; identical to SEQ ID NO: 45692
  chr19:9937353-9937511
  Hypo

SEQ ID NO: 115498 - DNA, 35 bp, Homo sapiens; identical to SEQ ID NO: 84766
  chr19:9957583-9957618
  Hypo

SEQ ID NO: 115499 - DNA, 252 bp, Homo sapiens; identical to SEQ ID NO: 82335
  chr19:10024331-10024583
  Hyper

SEQ ID NO: 115500 - DNA, 195 bp, Homo sapiens; identical to SEQ ID NO: 82336
  chr19:10024804-10024999
  Hyper

SEQ ID NO: 115501 - DNA, 30 bp, Homo sapiens; identical to SEQ ID NO: 82341
  chr19:10120011-10120041
  Hyper

SEQ ID NO: 115502 - DNA, 184 bp, Homo sapiens; identical to SEQ ID NO: 82342
  chr19:10121048-10121232
  Hyper

SEQ ID NO: 115503 - DNA, 30 bp, Homo sapiens; identical to SEQ ID NO: 82343
  chr19:10142022-10142052
  Hypo

SEQ ID NO: 115504 - DNA, 147 bp, Homo sapiens; identical to SEQ ID NO: 82344
  chr19:10197672-10197819
  Hyper

SEQ ID NO: 115505 - DNA, 214 bp, Homo sapiens; identical to SEQ ID NO: 82345
  chr19:10207229-10207443
  Hyper

SEQ ID NO: 115506 - DNA, 145 bp, Homo sapiens; identical to SEQ ID NO: 82346
  chr19:10229584-10229729
  Hypo

SEQ ID NO: 115507 - DNA, 31 bp, Homo sapiens; identical to SEQ ID NO: 82347
  chr19:10231211-10231242
  Hypo

SEQ ID NO: 115508 - DNA, 30 bp, Homo sapiens; identical to SEQ ID NO: 16430
  chr19:10231504-10231534
  Hypo

SEQ ID NO: 115509 - DNA, 42 bp, Homo sapiens; identical to SEQ ID NO: 82349
  chr19:10246211-10246253
  Hypo

SEQ ID NO: 115510 - DNA, 125 bp, Homo sapiens; identical to SEQ ID NO: 82351
  chr19:10347133-10347258
  Hyper

SEQ ID NO: 115511 - DNA, 31 bp, Homo sapiens; identical to SEQ ID NO: 45695
  chr19:10362045-10362076
  Hypo

SEQ ID NO: 115512 - DNA, 265 bp, Homo sapiens; identical to SEQ ID NO: 82353
  chr19:10370310-10370575
  Hypo

SEQ ID NO: 115513 - DNA, 39 bp, Homo sapiens; identical to SEQ ID NO: 82354
  chr19:10371536-10371575
  Hypo

SEQ ID NO: 115514 - DNA, 70 bp, Homo sapiens; identical to SEQ ID NO: 82355
  chr19:10394284-10394354
  Hypo

SEQ ID NO: 115515 - DNA, 842 bp, Homo sapiens
  chr19:10397626-10398468
  Hyper
ccttatctctagagccggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgac

SEQ ID NO: 115516 - DNA, 469 bp, Homo sapiens; identical to SEQ ID NO: 82359
  chr19:10400292-10400761
  Hyper

SEQ ID NO: 115517 - DNA, 233 bp, Homo sapiens; identical to SEQ ID NO: 82360
  chr19:10400975-10401208
  Hyper

SEQ ID NO: 115518 - DNA, 1118 bp, Homo sapiens; identical to SEQ ID NO: 82361
  chr19:10401486-10402604
  Hyper

SEQ ID NO: 115519 - DNA, 66 bp, Homo sapiens; identical to SEQ ID NO: 82362
  chr19:10402894-10402960
  Hyper

SEQ ID NO: 115520 - DNA, 30 bp, Homo sapiens; identical to SEQ ID NO: 82363
  chr19:10403300-10403330
  Hyper

SEQ ID NO: 115521 - DNA, 472 bp, Homo sapiens
  chr19:10405939-10406411
  Hyper
tcgatcgttgtgggccggagcagggcatttgatcagtggctgggccggcgctaagccccacttcaccttctgtgcccttcagaccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacatcggcctgtcgagcaacaacagcacactgagcgtggcaggcgccatgggaagccacggcggcgagtacgagtgcgcagccaccaacgcgcacgggcgccacgcgcggcgcatcacggtgcgcgtggccggtaagtggcagctggggagaggcggggcgaggtatctgagagggggcgtgacctgggtcttggggcggccggccccgcctgcctccctctcggtcccggtagactagacggaagtgggacaga

SEQ ID NO: 115522 - DNA, 275 bp, Homo sapiens
  chr19:10406899-10407174
  Hyper
agacagtgagctccccggggcatgaggactgacttcgtgcctgtgggagtgcggggggcggtgggagaagccccccggagcttggccaccctccgcgagggtctccaccccgcaggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctgaacgg

SEQ ID NO: 115523 - DNA, 47 bp, Homo sapiens; identical to SEQ ID NO: 82372
  chr19:10495335-10495382
  Hypo

SEQ ID NO: 115524 - DNA, 205 bp, Homo sapiens; identical to SEQ ID NO: 82375
  chr19:10526999-10527204
  Hyper

SEQ ID NO: 115525 - DNA, 393 bp, Homo sapiens; identical to SEQ ID NO: 82376
  chr19:10530133-10530526
  Hyper

SEQ ID NO: 115526 - DNA, 862 bp, Homo sapiens; identical to SEQ ID NO: 82377
  chr19:10531284-10532146
  Hyper

SEQ ID NO: 115527 - DNA, 199 bp, Homo sapiens; identical to SEQ ID NO: 82378
  chr19:10562105-10562304
  Hypo

SEQ ID NO: 115528 - DNA, 30 bp, Homo sapiens; identical to SEQ ID NO: 82379
  chr19:10570048-10570078
  Hypo

SEQ ID NO: 115529 - DNA, 79 bp, Homo sapiens; identical to SEQ ID NO: 82380
  chr19:10570316-10570395
  Hypo

SEQ ID NO: 115530 - DNA, 30 bp, Homo sapiens; identical to SEQ ID NO: 82381
  chr19:10589751-10589781
  Hyper

SEQ ID NO: 115531 - DNA, 274 bp, Homo sapiens; identical to SEQ ID NO: 82382
  chr19:10616258-10616532
  Hyper

SEQ ID NO: 115532 - DNA, 1113 bp, Homo sapiens
  chr19:10624676-10625789
  Hyper
ctgctgggagccactcgggtctctgccgcaggagtggcgtccgcagcagaccaggcgcaggagcgcgtggcgcaggtcgcggttggtgagcgtgtagatgatggggttcagaagtgagttggccatggccagtcccaggaagggatcggcctgcaggagtacaggacaggtgcgcgccgggcacgccacgtcgagcaacagcagcaggaagagggggccccaacatgccacaaaggccaggagcaccacgctgagcgtgcgcagcaaggccagcgagcgcggcttgcgacgcgcccgggtcgaggtggtccccgcagtcccgggccgtgccggcaggcgccgcgcgttggcgcgtacctggcagtagatgcgcgcgtagagtgcacagatagcggccaggatgcccacgaaggcgagcacgcagaagagcacgtaggccttggcgtagagcggcaagacagtggagcaagcgtccaggcgacccaggcaattccagcccagcgctggcaggagcccgaggagcagcgacacgccccaggccgcggctgccatcgccagcgtgcgcccccgactggagacgggcgcgggccccctgcgcgccatggtgaggctgcgctccagcgcgatggccaggaggctcagcacggacgcagtgagtgccacgaagacgcctccctcccgtgcgaaccagagcgcgggggacagtttcagcgtgagcggccccgacagtaggatgttggcggcgtaggcggcgcctgccagcagatccgacaacgtgaggctgcccaggagcaggaacatgggagcgtggaagcgcgggtggcgtccgagcaccaacaacacggctagattctctagcacgatgaaggcgcacaccgccaggcacaccacggcgtcggcgcgcaggccggcacccggctggtagcgcgcaccgcggagcttgccggtgtagttgtaatgcaggacgatgacctcgctcaccggcgccggccgcagcagccccgactccatgggccgcgcgccccaaggctgttggagaggcaagatacggtgtcaggccgcggtccccgtaagcacgctcgcagcagccggctaagtcgtgggaaaggggcc

SEQ ID NO: 115533 - DNA, 249 bp, Homo sapiens; identical to SEQ ID NO: 82386
  chr19:10627965-10628214
  Hyper

SEQ ID NO: 115534 - DNA, 96 bp, Homo sapiens; identical to SEQ ID NO: 82387
  chr19:10628453-10628549
  Hyper

SEQ ID NO: 115535 - DNA, 637 bp, Homo sapiens; identical to SEQ ID NO: 82388
  chr19:10629012-10629649
  Hyper

SEQ ID NO: 115536 - DNA, 30 bp, Homo sapiens; identical to SEQ ID NO: 82389
  chr19:10665777-10665807
  Hypo

SEQ ID NO: 115537 - DNA, 185 bp, Homo sapiens; identical to SEQ ID NO: 82390
  chr19:10691879-10692064
  Hyper

SEQ ID NO: 115538 - DNA, 30 bp, Homo sapiens; identical to SEQ ID NO: 82392
  chr19:10692126-10692156
  Hypo

SEQ ID NO: 115539 - DNA, 139 bp, Homo sapiens; identical to SEQ ID NO: 45700
  chr19:10711944-10712083
  Hypo

SEQ ID NO: 115540 - DNA, 65 bp, Homo sapiens; identical to SEQ ID NO: 82395
  chr19:10738627-10738692
  Hypo

SEQ ID NO: 115541 - DNA, 162 bp, Homo sapiens; identical to SEQ ID NO: 82396
  chr19:10762073-10762235
  Hypo

SEQ ID NO: 115542 - DNA, 30 bp, Homo sapiens; identical to SEQ ID NO: 37216
  chr19:10806164-10806194
  Hyper

SEQ ID NO: 115543 - DNA, 30 bp, Homo sapiens; identical to SEQ ID NO: 82399
  chr19:10823603-10823633
  Hypo

SEQ ID NO: 115544 - DNA, 150 bp, Homo sapiens; identical to SEQ ID NO: 82403
  chr19:10859213-10859363
  Hypo

SEQ ID NO: 115545 - DNA, 75 bp, Homo sapiens; identical to SEQ ID NO: 45702
  chr19:10872535-10872610
  Hypo

SEQ ID NO: 115546 - DNA, 154 bp, Homo sapiens; identical to SEQ ID NO: 82406
  chr19:10875953-10876107
  Hypo

SEQ ID NO: 115547 - DNA, 30 bp, Homo sapiens; identical to SEQ ID NO: 82407
  chr19:10949173-10949203
  Hypo

SEQ ID NO: 115548 - DNA, 72 bp, Homo sapiens; identical to SEQ ID NO: 82408
  chr19:10954418-10954490
  Hypo

SEQ ID NO: 115549 - DNA, 43 bp, Homo sapiens; identical to SEQ ID NO: 82409
  chr19:11002349-11002392
  Hypo

SEQ ID NO: 115550 - DNA, 95 bp, Homo sapiens; identical to SEQ ID NO: 45706
  chr19:11002992-11003087
  Hypo

SEQ ID NO: 115551 - DNA, 30 bp, Homo sapiens; identical to SEQ ID NO: 16438
  chr19:11005335-11005365
  Hypo

SEQ ID NO: 115552 - DNA, 25 bp, Homo sapiens
  chr19:11008369-11008394
  Hypo
atgctagctctgggccgggcacggt

SEQ ID NO: 115553 - DNA, 30 bp, Homo sapiens; identical to SEQ ID NO: 82413
  chr19:11009412-11009442
  Hypo

SEQ ID NO: 115554 - DNA, 30 bp, Homo sapiens; identical to SEQ ID NO: 82414
  chr19:11029618-11029648
  Hypo

SEQ ID NO: 115555 - DNA, 288 bp, Homo sapiens; identical to SEQ ID NO: 82415
  chr19:11029961-11030249
  Hypo

SEQ ID NO: 115556 - DNA, 45 bp, Homo sapiens; identical to SEQ ID NO: 82416
  chr19:11049756-11049801
  Hypo

SEQ ID NO: 115557 - DNA, 93 bp, Homo sapiens; identical to SEQ ID NO: 82417
  chr19:11052037-11052130
  Hypo

SEQ ID NO: 115558 - DNA, 38 bp, Homo sapiens; identical to SEQ ID NO: 82418
  chr19:11053258-11053296
  Hypo

SEQ ID NO: 115559 - DNA, 35 bp, Homo sapiens; identical to SEQ ID NO: 82420
  chr19:11063746-11063781
  Hypo

SEQ ID NO: 115560 - DNA, 342 bp, Homo sapiens; identical to SEQ ID NO: 82422
  chr19:11128983-11129325
  Hypo

SEQ ID NO: 115561 - DNA, 107 bp, Homo sapiens; identical to SEQ ID NO: 82423
  chr19:11129719-11129826
  Hypo

SEQ ID NO: 115562 - DNA, 30 bp, Homo sapiens; identical to SEQ ID NO: 82425
  chr19:11145922-11145952
  Hypo

SEQ ID NO: 115563 - DNA, 165 bp, Homo sapiens; identical to SEQ ID NO: 82427
  chr19:11252652-11252817
  Hypo

SEQ ID NO: 115564 - DNA, 61 bp, Homo sapiens; identical to SEQ ID NO: 82428
  chr19:11285211-11285272
  Hypo

SEQ ID NO: 115565 - DNA, 30 bp, Homo sapiens; identical to SEQ ID NO: 45714
  chr19:11406534-11406564
  Hypo

SEQ ID NO: 115566 - DNA, 23 bp, Homo sapiens
  chr19:11490382-11490405
  Hypo
tttttttttttgagacggagttt

SEQ ID NO: 115567 - DNA, 111 bp, Homo sapiens
  chr19:11492742-11492853
  Hyper
ggagcctggtgcaggcgacacagcttccatggctcatccctatgcgcccagggaagggagcaggttgggaggggggaccggggagttggcattgcccggcctgtggggggc

SEQ ID NO: 115568 - DNA, 767 bp, Homo sapiens; identical to SEQ ID NO: 82432
  chr19:11529414-11530181
  Hyper

SEQ ID NO: 115569 - DNA, 560 bp, Homo sapiens; identical to SEQ ID NO: 82433
  chr19:11531328-11531888
  Hyper

SEQ ID NO: 115570 - DNA, 323 bp, Homo sapiens
  chr19:11532331-11532654
  Hyper
ggctgcagggcacctcgcggttagcgatgtggcacagcatctcctgcacgtcgtggccctggagctgcgcctgcagtttcagcagcttttcctccacgaggcccagcaggtttggcacatagttatctgcctggggatccagctcctttcccgcgaagcggccgtcctcctgcggccagggtagagccgggtcagccgagaggggtggggcctcttggaaggctccacccaggggcggggcttttctttcgggggcggggcctaggaggtaagggcccacctgcagggtcgatcctagccattgggggcggggacttaggtca

SEQ ID NO: 115571 - DNA, 609 bp, Homo sapiens; identical to SEQ ID NO: 82435
  chr19:11533023-11533632
  Hyper

SEQ ID NO: 115572 - DNA, 30 bp, Homo sapiens; identical to SEQ ID NO: 82436
  chr19:11537793-11537823
  Hypo

SEQ ID NO: 115573 - DNA, 30 bp, Homo sapiens; identical to SEQ ID NO: 82437
  chr19:11547189-11547219
  Hypo

SEQ ID NO: 115574 - DNA, 30 bp, Homo sapiens; identical to SEQ ID NO: 82440
  chr19:11569191-11569221
  Hypo

SEQ ID NO: 115575 - DNA, 512 bp, Homo sapiens; identical to SEQ ID NO: 82442
  chr19:11590692-11591204
  Hyper

SEQ ID NO: 115576 - DNA, 475 bp, Homo sapiens
  chr19:11591537-11592012
  Hyper
ccgctgcagatgtggcgatgaaggcggcggctccctcgagggccagggacgggcccgaacccggggatgcgcgcgcggatggccgggccccggggtggcctgcgggcggcaggggatggaaagagggagcgggcgcggggttgaggacgccccctgcgcggccccgcggggcccggggaggttgcgcttcccgacagagatcgcggcgctctgcctttcgccgccgcccctcggtcggtcctgtccggtcccgtgtgttcaagtcctctcccctcgcccaccctccctccctccctccggcccgcgctgcgcgctccgcgctctggaccgcgccgccgccgcccccagccctttatagcagcagctgccagcgccggcgtcgctcattggctgcggcgaccgagctccgcctcctcgcggctcccgacggcgcggcaggtggaagtgagcgcgcactggtcgggactctgaatcc

SEQ ID NO: 115577 - DNA, 782 bp, Homo sapiens; identical to SEQ ID NO: 82445
  chr19:11592671-11593453
  Hyper

SEQ ID NO: 115578 - DNA, 213 bp, Homo sapiens; identical to SEQ ID NO: 82446
  chr19:11594589-11594802
  Hypo

SEQ ID NO: 115579 - DNA, 177 bp, Homo sapiens; identical to SEQ ID NO: 82447
  chr19:11650656-11650833
  Hyper

SEQ ID NO: 115580 - DNA, 135 bp, Homo sapiens; identical to SEQ ID NO: 82448
  chr19:11658622-11658757
  Hypo

SEQ ID NO: 115581 - DNA, 362 bp, Homo sapiens; identical to SEQ ID NO: 82450
  chr19:11689266-11689628
  Hyper

SEQ ID NO: 115582 - DNA, 30 bp, Homo sapiens; identical to SEQ ID NO: 82454
  chr19:11788723-11788753
  Hypo

SEQ ID NO: 115583 - DNA, 171 bp, Homo sapiens; identical to SEQ ID NO: 37228
  chr19:11805426-11805597
  Hyper

SEQ ID NO: 115584 - DNA, 73 bp, Homo sapiens; identical to SEQ ID NO: 82457
  chr19:11878759-11878832
  Hyper

SEQ ID NO: 115585 - DNA, 399 bp, Homo sapiens; identical to SEQ ID NO: 82458
  chr19:11909333-11909732
  Hyper

SEQ ID NO: 115586 - DNA, 159 bp, Homo sapiens; identical to SEQ ID NO: 82459
  chr19:11909792-11909951
  Hyper

SEQ ID NO: 115587 - DNA, 30 bp, Homo sapiens; identical to SEQ ID NO: 82460
  chr19:11925559-11925589
  Hyper

SEQ ID NO: 115588 - DNA, 202 bp, Homo sapiens; identical to SEQ ID NO: 82461
  chr19:11926261-11926463
  Hypo

SEQ ID NO: 115589 - DNA, 82 bp, Homo sapiens; identical to SEQ ID NO: 82462
  chr19:11926703-11926785
  Hypo

SEQ ID NO: 115590 - DNA, 906 bp, Homo sapiens
  chr19:11959427-11960333
  Hyper
ctgtcagtctggctccgcagggcctgatacccagggcttccgctgtcacttagacgtggggggcggggccgaacattccatccaatcagaggcactggctcggggccctgcccactgtgcatccaggcacggaggatgttgcattcctgccgtcacctttgtcgctgcgagggcggcggttgggatctggcctttccagccccgagagggacctagtgcctctacccagatttctgtcgctctgtcacctgcgctatgccctgctttactcacaggagctgtagagaggaccccggtacatctgaaagccgggaaatggtgcgtgtgctggccgggagtggtgcgatgggggaggggctgcctggaactggcgggacccgggcctccctgtgggcgactccggggtctgggaccgagtcctcctagagctgctcggccctcggtccccgcggccgctggatgtgggtgggccggcagccgggactccgggcgtcctgtcccgtccctgcccgtcgactgcggccttggccccgaagcccttttgtgcagctccgcgcccgcagcccgacgccccagcttgtgcgggggccacgggagggtcatgcgcggatttcgactcgggtgtggatttcgtccgtaggaggagcagcggtctgtggggcccacagcctccactttctcctgttaaaaattatactgaggtacgttaacaaaaagttcatttgaggaaacagccattcacgaatgagaaacacccggtcctggcttgtggtttgtcaacggaaaaaaaacagactatgtaaaatacagaagtgtattcagagccgagtaggagagaccttggccgagggaaacacaaccccaagcagcctggagtaagtggtccggaggcggctcaggacagtt

SEQ ID NO: 115591 - DNA, 80 bp, Homo sapiens; identical to SEQ ID NO: 82465
  chr19:11980787-11980867
  Hypo

SEQ ID NO: 115592 - DNA, 750 bp, Homo sapiens; identical to SEQ ID NO: 82466
  chr19:11998469-11999219
  Hyper

SEQ ID NO: 115593 - DNA, 85 bp, Homo sapiens; identical to SEQ ID NO: 82467
  chr19:12075733-12075818
  Hyper

SEQ ID NO: 115594 - DNA, 307 bp, Homo sapiens; identical to SEQ ID NO: 82468
  chr19:12076072-12076379
  Hyper

SEQ ID NO: 115595 - DNA, 458 bp, Homo sapiens; identical to SEQ ID NO: 82470
  chr19:12098632-12099090
  Hyper

SEQ ID NO: 115596 - DNA, 487 bp, Homo sapiens; identical to SEQ ID NO: 82471
  chr19:12146544-12147031
  Hyper

SEQ ID NO: 115597 - DNA, 29 bp, Homo sapiens
  chr19:12147710-12147739
  Hypo
cccccgcacccggccgaggctagggtttt

SEQ ID NO: 115598 - DNA, 276 bp, Homo sapiens; identical to SEQ ID NO: 82473
  chr19:12163055-12163331
  Hyper

SEQ ID NO: 115599 - DNA, 576 bp, Homo sapiens; identical to SEQ ID NO: 82474
  chr19:12163451-12164027
  Hyper

SEQ ID NO: 115600 - DNA, 718 bp, Homo sapiens; identical to SEQ ID NO: 82475
  chr19:12175445-12176163
  Hyper

SEQ ID NO: 115601 - DNA, 625 bp, Homo sapiens
  chr19:12203013-12203638
  Hyper
tcagggctctgaaggcgaggcggggagcacggtccaatcaggagcgccggggcggggccctgccaacttttttcggggaaggagacggctgcaagcccgcggtctcttgttgctgtgctaacgaccgttggaaccctctttctggctcttggaacgctcggctctgagaggctccaggtttctccgccagagctcctgtcgctctgtcagttgcgctgtgttcctctctagtcacaagagccttggggaagacagttggaagctcagacatggtgagtgtgtggggccaggcgtcctgagacgggggcgaagggcttcttagaacctgctggaaccggctgtggcgggacccgggcctccccgcggcgactccggggtctgtggggctgggccggcagccgggacccggggcatcctgtctcgtcccttcgcagcgaccgcggccccggacccggagccctctttgggcagctccgcgtcttcagccgcgggtctcctcagattgtgctgggccatgaggaggatcatggggggaatcccgtctcgggtgtagggttcttgcgtcagaaaagcggtggtctgtggagtccccagtcgtcttttctcctcttaaaagttaaaatgg

SEQ ID NO: 115602 - DNA, 101 bp, Homo sapiens; identical to SEQ ID NO: 45716
  chr19:12220383-12220484
  Hypo

SEQ ID NO: 115603 - DNA, 132 bp, Homo sapiens; identical to SEQ ID NO: 45717
  chr19:12222626-12222758
  Hypo

SEQ ID NO: 115604 - DNA, 917 bp, Homo sapiens
  chr19:12266893-12267810
  Hyper
aatttctgggctgaagcaatccccccgcctcaacctgccaggcgtgacccactgcgcctggccttcaatttagtttttcaggaaaaaaggggggactggggaccccgcagcccaccgctcctcccacacgaaccacacacccgaggcaggattgcctccatgaccctcccgtggtctccgcacaatctggggagacgcgggactacgggcgcggagctccccagagagggctccggggccggggccagggccggggtcgcagtcgcagcgcagagacgggacaggacgcctggggtcccggctgccggcccaaccccaccctgcggccgaagggaccgagggccgagctacgccagggggactccgctctgcagacccgaagtcgctgcaggaaggcctgggtcctgctagagccggttcgagccggttcctcccggcccctcccccgtctcgggacccccggccccgcacactcaccatttcccggcttccaggtgtcctggcctcctctccacggatccctctaacagtccagtcacagtgcgggcgatggagcgacagaagctatggcggaggcacctggtccctctcggggccggaaaaccgagatcccgacctccctttggtgcaagacgcctgggagtcaggaaagcgggaatgcggcctccccttccccggatggacagttggcaggaccccgccccagcgcccctgattggatgaggctccagtccccgtcccatcggtcctgagtgacagcggaagccctgggtaacaaggcccggcagaaccgaaatgacctgttccaaccacagattatctaagcgagctccctccctgcgtcttgctctttgggtatttgcatttcagccaaatttgctccgaattgctagagggggtaccgttgtcttcctcac

SEQ ID NO: 115605 - DNA, 460 bp, Homo sapiens
  chr19:12305853-12306313
  Hyper
cgactatcacctgaccgtagtaatatctcccgctacgcgcgttgtgaccaatgctgcatacaggagatgagggaggacggccagacacctggaagccggaaaatggtgagtgtgcggggccggtgtcccgagacctgaggagggacaggttggaaccggccggaaccggctgtggcgggacccggggctcccctcggcgactctggggtctgggacccgggtccctctggcgcagctgggccctcagtgccctcggccgcagagtggggctgggctggcatccgggaccccgggcatcctgtcccgttcctgcgcgacgcctgcggccccggcctcagcctcggcgccctctctgggcagctgcacgccgcagcctcgtgtctccccagattgcacgggagccccgggagggtcatggggaggattccgactcgtgtgtggggttcgtgcgtgggaggag

SEQ ID NO: 115606 - DNA, 586 bp, Homo sapiens; identical to SEQ ID NO: 82494
  chr19:12475782-12476368
  Hyper

SEQ ID NO: 115607 - DNA, 95 bp, Homo sapiens; identical to SEQ ID NO: 82495
  chr19:12476602-12476697
  Hyper

SEQ ID NO: 115608 - DNA, 298 bp, Homo sapiens; identical to SEQ ID NO: 82497
  chr19:12606167-12606465
  Hyper

SEQ ID NO: 115609 - DNA, 40 bp, Homo sapiens; identical to SEQ ID NO: 45718
  chr19:12675871-12675911
  Hypo

SEQ ID NO: 115610 - DNA, 50 bp, Homo sapiens; identical to SEQ ID NO: 82503
  chr19:12747555-12747605
  Hypo

SEQ ID NO: 115611 - DNA, 384 bp, Homo sapiens; identical to SEQ ID NO: 82504
  chr19:12750831-12751215
  Hyper

SEQ ID NO: 115612 - DNA, 16 bp, Homo sapiens
  chr19:12835315-12835331
  Hypo
gttttgtttttgagac

SEQ ID NO: 115613 - DNA, 39 bp, Homo sapiens; identical to SEQ ID NO: 82506
  chr19:12846163-12846202
  Hypo

SEQ ID NO: 115614 - DNA, 23 bp, Homo sapiens
  chr19:12846825-12846848
  Hypo
tggagctgaagtccccgtctgag

SEQ ID NO: 115615 - DNA, 192 bp, Homo sapiens; identical to SEQ ID NO: 45720
  chr19:12863412-12863604
  Hypo

SEQ ID NO: 115616 - DNA, 23 bp, Homo sapiens
  chr19:12906634-12906657
  Hypo
actgcgcccggccttgggagcag

SEQ ID NO: 115617 - DNA, 211 bp, Homo sapiens; identical to SEQ ID NO: 82514
  chr19:12936426-12936637
  Hyper

SEQ ID NO: 115618 - DNA, 101 bp, Homo sapiens; identical to SEQ ID NO: 37253
  chr19:12945480-12945581
  Hyper

SEQ ID NO: 115619 - DNA, 45 bp, Homo sapiens; identical to SEQ ID NO: 82517
  chr19:12946269-12946314
  Hyper

SEQ ID NO: 115620 - DNA, 64 bp, Homo sapiens; identical to SEQ ID NO: 82518
  chr19:12947063-12947127
  Hyper

SEQ ID NO: 115621 - DNA, 76 bp, Homo sapiens; identical to SEQ ID NO: 82520
  chr19:12949855-12949931
  Hyper

SEQ ID NO: 115622 - DNA, 603 bp, Homo sapiens
  chr19:12951676-12952279
  Hyper
ccacaggcgaaggggcgtggtctccccataataggcgggactagactaaagacaggacatgctgctgtttgcacgccgctttagggaacgagagacctgacaggatttgccccctctttctctcataggcagcagtcccctggacagcccccgaaacttctcccccaacacccccgcccacttctcgtttgcctcctcccgaaggtgagtccctcccctccagggccccagaaccctgggcagaccctccccaaccactgtctgggccgccatctgttctcctcctaattgcacccgagctggggcctgaggggaccagcgagtgccccaaggtctcagcgggaaggagcgcctagccttcggggcggggcctataagaaggcggggtccaatcgccgatctggaacggggaaggcggtggggctccctttgcggcaggtcgaaagcgcgtgcgccctgggcgcggggtcttagtctctccgagccttgctctcctggccaggtgtttccatagcaacaggacggggcagccaagatgacgtgcgcaagcgcagattgcgcgatgcctatcgagggactcttggtccccgaggtgggggagga

SEQ ID NO: 115623 - DNA, 30 bp, Homo sapiens; identical to SEQ ID NO: 82523
  chr19:12963030-12963060
  Hypo

SEQ ID NO: 115624 - DNA, 62 bp, Homo sapiens; identical to SEQ ID NO: 82524
  chr19:12969408-12969470
  Hypo

SEQ ID NO: 115625 - DNA, 30 bp, Homo sapiens; identical to SEQ ID NO: 82525
  chr19:12976945-12976975
  Hypo

SEQ ID NO: 115626 - DNA, 106 bp, Homo sapiens; identical to SEQ ID NO: 82526
  chr19:12977473-12977579
  Hypo

SEQ ID NO: 115627 - DNA, 160 bp, Homo sapiens; identical to SEQ ID NO: 82527
  chr19:12978416-12978576
  Hyper

SEQ ID NO: 115628 - DNA, 42 bp, Homo sapiens; identical to SEQ ID NO: 82528
  chr19:12985184-12985226
  Hypo

SEQ ID NO: 115629 - DNA, 809 bp, Homo sapiens; identical to SEQ ID NO: 82529
  chr19:12996071-12996880
  Hyper

SEQ ID NO: 115630 - DNA, 443 bp, Homo sapiens; identical to SEQ ID NO: 82531
  chr19:13029873-13030316
  Hyper

SEQ ID NO: 115631 - DNA, 20 bp, Homo sapiens
  chr19:13071955-13071975
  Hypo
tttttttttttgagacggat

SEQ ID NO: 115632 - DNA, 90 bp, Homo sapiens; identical to SEQ ID NO: 82535
  chr19:13084316-13084406
  Hypo

SEQ ID NO: 115633 - DNA, 24 bp, Homo sapiens
  chr19:13107011-13107035
  Hyper
gcgggactccggctgacctgtggg

SEQ ID NO: 115634 - DNA, 173 bp, Homo sapiens; identical to SEQ ID NO: 82538
  chr19:13112120-13112293
  Hypo

SEQ ID NO: 115635 - DNA, 46 bp, Homo sapiens; identical to SEQ ID NO: 82540
  chr19:13113959-13114005
  Hypo

SEQ ID NO: 115636 - DNA, 92 bp, Homo sapiens; identical to SEQ ID NO: 82541
  chr19:13119930-13120022
  Hypo

SEQ ID NO: 115637 - DNA, 36 bp, Homo sapiens
  chr19:13124045-13124081
  Hyper
aaagtgaaaaaagaacgtgtgcgcccagcggacccg

SEQ ID NO: 115638 - DNA, 35 bp, Homo sapiens; identical to SEQ ID NO: 82542
  chr19:13201150-13201185
  Hypo

SEQ ID NO: 115639 - DNA, 48 bp, Homo sapiens; identical to SEQ ID NO: 82543
  chr19:13208430-13208478
  Hyper

SEQ ID NO: 115640 - DNA, 262 bp, Homo sapiens; identical to SEQ ID NO: 82544
  chr19:13208683-13208945
  Hyper

SEQ ID NO: 115641 - DNA, 30 bp, Homo sapiens; identical to SEQ ID NO: 82545
  chr19:13209229-13209259
  Hyper

SEQ ID NO: 115642 - DNA, 360 bp, Homo sapiens
  chr19:13210062-13210422
  Hyper
ctgccctttccttgacggccctgggccgagtccctggtgccctccggctcagaggtgctgccgcgtgcggtcaccgcacctctgggctcaaagcggtttgctccatcttgatgggccgggccgctccaccggggctgccgtcggggtcggccgggggcgcgggctgcgagcgcgctgccgcctcggccctgcgtccggatccccggcgggcgccgtcgtctgggacccggtgcaccggccgtttgcgaggcccgggaggggtggggcctgcggccagagctgcggcttggtcgcgcagcagccgcaccaggaagccgatgtacttcatggctaggcggagcacctcgttcttgctcagct

SEQ ID NO: 115643 - DNA, 218 bp, Homo sapiens
  chr19:13213616-13213834
  Hyper
ccctctcacccctggcggcgcagcggccggaggatgctggcccagtgcagataagggccaggctgcctggccgcgcctgataaggagcctggctgaccccggaggaaaccagcgggcggggacctagcagcgcgggcctcccggccccgcccccagccggcgctggcaggactcggtccgccacccctcagggcttcgccttccgctcccccagccac

SEQ ID NO: 115644 - DNA, 30 bp, Homo sapiens; identical to SEQ ID NO: 82548
  chr19:13226114-13226144
  Hypo

SEQ ID NO: 115645 - DNA, 30 bp, Homo sapiens; identical to SEQ ID NO: 16444
  chr19:13335742-13335772
  Hypo

SEQ ID NO: 115646 - DNA, 45 bp, Homo sapiens; identical to SEQ ID NO: 82552
  chr19:13365938-13365983
  Hypo

SEQ ID NO: 115647 - DNA, 78 bp, Homo sapiens; identical to SEQ ID NO: 82554
  chr19:13397451-13397529
  Hypo

SEQ ID NO: 115648 - DNA, 1836 bp, Homo sapiens
  chr19:13616677-13618513
  Hyper
ctggaagaggggaggcggagggaggagggggaggcgcagctgctgctggggttcgggcaaaaggatatggccattcggtgatctttttggcgtattttctcaccacgttgtcttcgctgaagaggaagagagaccggttaaccgtgaggcagttctgtcggacggggatggggttgtagagtgccatggtccgcgctctctgcgccattgactgcttgtacatcctttgcgccccgggctgcccgccctgccggctgcccccggctcctcgcccgcctccgctgcccacgaccaccccggcggctgccccggagcctcctcccccgtagcgggccggcatctcgtctccgaagcgggccattctgcaaagagcaaagggctccgggttacgctgcggcgaacgatgcggaagacgccgccgccgccgccgccgccgctgatgctgaggctgccggggctgggagcgcggcggctggagctacgactgcggagacgctccacggcccagcccatcgggcggcggcggctcggcgcctcgggtcgggggctcagaaggcggctgcccgggccgagccggggatagcagctcgggacatcttcctggctgaccccggagaaggaggggcgggaggagggtgcgggggcggggcgcgggggcccggggaggaggggggaggggagagagaagcgaggcaaaaaataaccgaggaaggaatccaggcaatccccagtccacccactccggaaaaaaaaaaaaagagacagttaaaaaaaaaaaatccacccaacgcacaccccctttaagacgcgaacggtttgcaaaggacgccccccccgggacgcagtggaagcttcaaattcctccgaggtccgggtcaggctggcatcttgcaaaaggagtgcgctcggcccattaaaaaaaaataaaaaataaaaaataaaaaaatatatatatatttaaaaataaagaaagacgaaacccaggtctgggtggggagggcaaaaaaaaaaaaaaaaaaaattaagtgcccttctgttttgctggagttcctagaccttaaaaatgctgaaagatctgtagctccaaaaataaaataaaataaaaacaaagaagatgaaagggaagggaaagaggagggaaggggagtaagacgctccagagggttcctaaggagtcttcacaccgcagggtccaggtttaaaaaaaaaaaaaaaaattttttttcttcctgaatcaccaacggctgcctcttctgctcccggaggaagtgtgagtgtgtatgtgcgcacagcgtttcgctcaatggtgcctcatcttggggttaaattgcagcagtgaaatcctgaaaattcccaacagggggaaaagagagagagagagaggtatgcgccctccgcttagccactcaatagctgcccctggatgcggcaatgcctctccaccctccaaatccctccacctcctccttctctaggttttgctaaaataagactggtgtggagggttgcgggtagaagaaggtaaagaggaaaaaaaaatgggcgcaaaggtctgaaccactggccagcaaacggaaaaggggagcaattgatgagtttaacagtagaaggacccacccagagtgtcgacacatgagggcccgcgaccaatcgtggaggctcgtggaggcgcgggggtaccgggctcagcggagtttgtgggggagagaggggagcgtcgcatggttgggaggcagggaggggggaattggggtgcttcctcctcccctgggaggaaagcctgttttccaccccgttccatttcggttgcagacagccggacgctccccagcatct

SEQ ID NO: 115649 - DNA, 163 bp, Homo sapiens; identical to SEQ ID NO: 45723
  chr19:13781908-13782071
  Hypo

SEQ ID NO: 115650 - DNA, 32 bp, Homo sapiens; identical to SEQ ID NO: 82564
  chr19:13915613-13915645
  Hypo

SEQ ID NO: 115651 - DNA, 135 bp, Homo sapiens; identical to SEQ ID NO: 82565
  chr19:13936577-13936712
  Hypo

SEQ ID NO: 115652 - DNA, 28 bp, Homo sapiens
  chr19:13943608-13943636
  Hypo
agaaagggcacccagcggccgggcgcgg

SEQ ID NO: 115653 - DNA, 120 bp, Homo sapiens; identical to SEQ ID NO: 82567
  chr19:13965902-13966022
  Hypo

SEQ ID NO: 115654 - DNA, 83 bp, Homo sapiens; identical to SEQ ID NO: 82568
  chr19:13975708-13975791
  Hyper

SEQ ID NO: 115655 - DNA, 30 bp, Homo sapiens; identical to SEQ ID NO: 82569
  chr19:13983835-13983865
  Hyper

SEQ ID NO: 115656 - DNA, 458 bp, Homo sapiens; identical to SEQ ID NO: 82570
  chr19:13988269-13988727
  Hypo

SEQ ID NO: 115657 - DNA, 35 bp, Homo sapiens; identical to SEQ ID NO: 82572
  chr19:14029963-14029998
  Hypo

SEQ ID NO: 115658 - DNA, 141 bp, Homo sapiens; identical to SEQ ID NO: 82574
  chr19:14042824-14042965
  Hypo

SEQ ID NO: 115659 - DNA, 184 bp, Homo sapiens; identical to SEQ ID NO: 82575
  chr19:14044040-14044224
  Hypo

SEQ ID NO: 115660 - DNA, 30 bp, Homo sapiens; identical to SEQ ID NO: 82577
  chr19:14116323-14116353
  Hyper

SEQ ID NO: 115661 - DNA, 274 bp, Homo sapiens; identical to SEQ ID NO: 45727
  chr19:14181305-14181579
  Hypo

SEQ ID NO: 115662 - DNA, 44 bp, Homo sapiens; identical to SEQ ID NO: 82579
  chr19:14199744-14199788
  Hypo

SEQ ID NO: 115663 - DNA, 79 bp, Homo sapiens; identical to SEQ ID NO: 45728
  chr19:14209036-14209115
  Hypo

SEQ ID NO: 115664 - DNA, 104 bp, Homo sapiens; identical to SEQ ID NO: 82582
  chr19:14244886-14244990
  Hypo

SEQ ID NO: 115665 - DNA, 370 bp, Homo sapiens; identical to SEQ ID NO: 82583
  chr19:14320287-14320657
  Hyper

SEQ ID NO: 115666 - DNA, 30 bp, Homo sapiens; identical to SEQ ID NO: 82584
  chr19:14327424-14327454
  Hypo

SEQ ID NO: 115667 - DNA, 60 bp, Homo sapiens; identical to SEQ ID NO: 82592
  chr19:14508107-14508167
  Hypo

SEQ ID NO: 115668 - DNA, 635 bp, Homo sapiens
  chr19:14583085-14583720
  Hyper
ctcctgcggctctggcgcccacgggcccggcaccctcgaacctcctagaaccgcgcccccgtgtctccgcgccctcttctggtaggccccggaactgcatccaccctggaggcgcacgcggcgtccctgcagccccccgcgcggccccagtggatgccgaagccccgacgggacacacggtcctgcctgggctcgcagaatggctttttattcccaaaggctctgcgccgcgcacctgggcccagcccagggtgggctggcttagtcgttgggcctctggttgtgcttagaagtggctgaggccgctgtgccgggagctgcgcagcgagctggcctcccaggcgctcggtgttaggcccagccccgcggggccgcccttggctccggccctcgggggcaagaggcgaagcagttggcgcagcacggcctggcgcagtaggatgtacacccaagggtccaggatctggttccaggaggcaaggcgcacggccaggaacagtggccgctgcagggaggtagagctccagccgccgacggccagcgccaccaacacctgcgggggaagccggtgtgagctatagagcaggcgcgggcgcaggggggcgcagggatggtgggggcgtggctggaaggta

SEQ ID NO: 115669 - DNA, 683 bp, Homo sapiens
  chr19:14584199-14584882
  Hyper
gctccagcagatgcacgacaccaccatgataccgacaagctggcccaccatctccacgtcgtgggcgcgagctctgcgtgccgagccgctgctccgagagccgccaaagaaggtggaggccgaagcgatggacgaggcggacgaggcggaggccgagcggggtccgtgcgccccccagcgacgccggctgtcggggcctgaggccgggggaggccgtcgggagcggcgtcgccagcgggcgcgtagcagggccaggccgctgagcgtgttgcacaccagcgcggcgaggagcgcgaccaggccgaggctggcgaagaggccagcaagcagtgcctggcgccagccgcccgggggacccaggccgatgaagcaccacgtgcccgggtactgcagctcatagcggcccacgcgcgccagcggcagcagcgccacggccaaggccaccgcggccaccgcggccagcgccaggcgcgcgcgggcgaccgagacccgcgcggcgtggagcagcggccgcgtgacgcccacgcagcgctccacggccatgccacagcccagcagcagcgggcacaggccgaagaagaccatgcagccgcccaggaagtggcaggccccgccggccggagcgcgccccgcagtgtacagacgcagcaccagcgcgcccgggatcacgtggcccgccaggt

SEQ ID NO: 115670 - DNA, 30 bp, Homo sapiens; identical to SEQ ID NO: 82598
  chr19:14586108-14586138
  Hyper

SEQ ID NO: 115671 - DNA, 30 bp, Homo sapiens; identical to SEQ ID NO: 45730
  chr19:14616913-14616943
  Hypo

SEQ ID NO: 115672 - DNA, 134 bp, Homo sapiens; identical to SEQ ID NO: 82601
  chr19:14630529-14630663
  Hypo

SEQ ID NO: 115673 - DNA, 19 bp, Homo sapiens
  chr19:14648564-14648583
  Hypo
tttttttttttgagacgaa

SEQ ID NO: 115674 - DNA, 30 bp, Homo sapiens; identical to SEQ ID NO: 82603
  chr19:14660906-14660936
  Hypo

SEQ ID NO: 115675 - DNA, 317 bp, Homo sapiens; identical to SEQ ID NO: 82604
  chr19:14667536-14667853
  Hyper

SEQ ID NO: 115676 - DNA, 57 bp, Homo sapiens; identical to SEQ ID NO: 82605
  chr19:14675015-14675072
  Hypo

SEQ ID NO: 115677 - DNA, 30 bp, Homo sapiens; identical to SEQ ID NO: 82606
  chr19:14711331-14711361
  Hypo

SEQ ID NO: 115678 - DNA, 16 bp, Homo sapiens
  chr19:14797872-14797888
  Hypo
aacaatggaaaacagc

SEQ ID NO: 115679 - DNA, 30 bp, Homo sapiens; identical to SEQ ID NO: 82610
  chr19:14839808-14839838
  Hypo

SEQ ID NO: 115680 - DNA, 30 bp, Homo sapiens; identical to SEQ ID NO: 82611
  chr19:14863133-14863163
  Hypo

SEQ ID NO: 115681 - DNA, 89 bp, Homo sapiens; identical to SEQ ID NO: 82612
  chr19:14877970-14878059
  Hypo

SEQ ID NO: 115682 - DNA, 88 bp, Homo sapiens
  chr19:14886807-14886895
  Hyper
ggtgatatttcaccccgggcgcccctcccacaggaaaacgctgtggccgcctgttggggtgcatgtggcgctgcggttcccagcactc

SEQ ID NO: 115683 - DNA, 146 bp, Homo sapiens; identical to SEQ ID NO: 82614
  chr19:14887415-14887561
  Hyper

SEQ ID NO: 115684 - DNA, 32 bp, Homo sapiens; identical to SEQ ID NO: 82620
  chr19:15079221-15079253
  Hypo

SEQ ID NO: 115685 - DNA, 1013 bp, Homo sapiens
  chr19:15090040-15091053
  Hyper
tgtgtgcggaggccacgggttggggaggtggggagacgggcagggagacccggggataactaaggggataggaaactcaccagaacgaccaggagaaaagcggtggcaacggctctaaggggcaagcaggagctcagagacaaagggcggcggagaagtggggacgtgggcgcagggagcgccccacacgcctgaccccagcgcctcggatcccccacctgcccgcaacctccgcgccgcagccacaccgagtccccgcgccgagccgcggagtccccactcaccggcgtccggagcggcgggggcggcctgcccgcgcctcggcctgcgcgctgcgcccggatgcaggagccggagcccggcgaagcgcccggccggggccgcggggacccgccagggactgtgcagcaccggcgcggggaccggaccgtggaggcaccggcgcggagccgggacgcgctatgctgcgggagggatccgggccggccctgcgctcacgtgggtgtgggggcaccgagcggccgggggagggggcgggatcccctccgcgatgccctccgcctcccccgcgcccagcccaggctccgcagccgtgtgggagaagggggacagcgtgcttgcgaagggagggggactgggggtgggcgggggtgagtggcctctccggcatccagcccccgccccctgctcggagccgcgcctccgcgcccccgccccctaaaccgcctccggagccctcggaggccccagcatccctggcggagcgcggggaacaggccctggcaccgcgggacccgctccagcagcctcggcggaggcctggggaaggcgcggctctagtgtcccagtaacaacagccagggagagggctccgctgcccccttctccttgcgggtgcaccttccggccttggccacttggctgctgtgtgcccttgggccaactcctctccctctctgagcctggcttcctccgctaaacaaggaagatggcttggccgaccccacagaaaa

SEQ ID NO: 115686 - DNA, 657 bp, Homo sapiens; identical to SEQ ID NO: 82624
  chr19:15121625-15122282
  Hyper

SEQ ID NO: 115687 - DNA, 370 bp, Homo sapiens; identical to SEQ ID NO: 82626
  chr19:15217949-15218319
  Hyper

SEQ ID NO: 115688 - DNA, 164 bp, Homo sapiens; identical to SEQ ID NO: 82627
  chr19:15220615-15220779
  Hypo

SEQ ID NO: 115689 - DNA, 266 bp, Homo sapiens; identical to SEQ ID NO: 82636
  chr19:15272249-15272515
  Hypo

SEQ ID NO: 115690 - DNA, 739 bp, Homo sapiens; identical to SEQ ID NO: 82638
  chr19:15288174-15288913
  Hyper

SEQ ID NO: 115691 - DNA, 357 bp, Homo sapiens; identical to SEQ ID NO: 82639
  chr19:15292255-15292612
  Hypo

SEQ ID NO: 115692 - DNA, 132 bp, Homo sapiens; identical to SEQ ID NO: 82640
  chr19:15298622-15298754
  Hypo

SEQ ID NO: 115693 - DNA, 96 bp, Homo sapiens; identical to SEQ ID NO: 82641
  chr19:15300050-15300146
  Hypo

SEQ ID NO: 115694 - DNA, 30 bp, Homo sapiens; identical to SEQ ID NO: 82642
  chr19:15306935-15306965
  Hyper

SEQ ID NO: 115695 - DNA, 30 bp, Homo sapiens; identical to SEQ ID NO: 82643
  chr19:15311325-15311355
  Hyper

SEQ ID NO: 115696 - DNA, 361 bp, Homo sapiens; identical to SEQ ID NO: 82644
  chr19:15311593-15311954
  Hyper

SEQ ID NO: 115697 - DNA, 298 bp, Homo sapiens; identical to SEQ ID NO: 82645
  chr19:15333522-15333820
  Hyper

SEQ ID NO: 115698 - DNA, 140 bp, Homo sapiens; identical to SEQ ID NO: 82646
  chr19:15334711-15334851
  Hyper

SEQ ID NO: 115699 - DNA, 824 bp, Homo sapiens; identical to SEQ ID NO: 82648
  chr19:15342587-15343411
  Hyper

SEQ ID NO: 115700 - DNA, 495 bp, Homo sapiens
  chr19:15343929-15344424
  Hyper
gggccaatgagctgacggtaggccggggagggggcggtggggtggggtgggcaatgggcaatgagacggagggcggggccgggacctaatatggcgggtcaggagggtctggaagacgaagaagagggacaggcaatgccaggtctaggactaggagggaggcgcgggcggtattagcggctggaggaggcttcgggaggcccggccgacggccgccgcctggtgctacccacccaggggcgcgcgaccctcccttcggtctggctccaaagacctagcagcactgacttcacccagctgtggttccaacggcgggtccagcggcctcggcccggcgccgtcctcctgctggcccaacaggcccgccagcccgcccctgtacgtctgtgattggacggcggcggccactgatgttcaagcgacaggtcctggcccgggagccaatctgcaggtgttgaggcccaggctccgagagcgggccgaggaggcgtggat

SEQ ID NO: 115701 - DNA, 30 bp, Homo sapiens; identical to SEQ ID NO: 82651
  chr19:15364996-15365026
  Hypo

SEQ ID NO: 115702 - DNA, 94 bp, Homo sapiens; identical to SEQ ID NO: 82652
  chr19:15370805-15370899
  Hypo

SEQ ID NO: 115703 - DNA, 40 bp, Homo sapiens; identical to SEQ ID NO: 82654
  chr19:15488544-15488584
  Hypo

SEQ ID NO: 115704 - DNA, 30 bp, Homo sapiens; identical to SEQ ID NO: 45739
  chr19:15547714-15547744
  Hypo

SEQ ID NO: 115705 - DNA, 30 bp, Homo sapiens; identical to SEQ ID NO: 82656
  chr19:15551609-15551639
  Hypo

SEQ ID NO: 115706 - DNA, 174 bp, Homo sapiens; identical to SEQ ID NO: 45740
  chr19:15558347-15558521
  Hypo

SEQ ID NO: 115707 - DNA, 30 bp, Homo sapiens; identical to SEQ ID NO: 82658
  chr19:15558960-15558990
  Hypo

SEQ ID NO: 115708 - DNA, 385 bp, Homo sapiens; identical to SEQ ID NO: 82659
  chr19:15619208-15619593
  Hyper

SEQ ID NO: 115709 - DNA, 30 bp, Homo sapiens; identical to SEQ ID NO: 82660
  chr19:15622487-15622517
  Hypo

SEQ ID NO: 115710 - DNA, 31 bp, Homo sapiens; identical to SEQ ID NO: 82661
  chr19:15630862-15630893
  Hypo

SEQ ID NO: 115711 - DNA, 386 bp, Homo sapiens; identical to SEQ ID NO: 82665
  chr19:15695283-15695669
  Hyper

SEQ ID NO: 115712 - DNA, 16 bp, Homo sapiens
  chr19:15968359-15968375
  Hypo
gcgacagagtgagact

SEQ ID NO: 115713 - DNA, 79 bp, Homo sapiens; identical to SEQ ID NO: 82669
  chr19:16013614-16013693
  Hypo

SEQ ID NO: 115714 - DNA, 32 bp, Homo sapiens; identical to SEQ ID NO: 82670
  chr19:16130658-16130690
  Hypo

SEQ ID NO: 115715 - DNA, 37 bp, Homo sapiens; identical to SEQ ID NO: 82671
  chr19:16186963-16187000
  Hyper

SEQ ID NO: 115716 - DNA, 51 bp, Homo sapiens; identical to SEQ ID NO: 82672
  chr19:16232444-16232495
  Hypo

SEQ ID NO: 115717 - DNA, 143 bp, Homo sapiens; identical to SEQ ID NO: 82673
  chr19:16275680-16275823
  Hypo

SEQ ID NO: 115718 - DNA, 167 bp, Homo sapiens
  chr19:16436279-16436446
  Hyper
gccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggc

SEQ ID NO: 115719 - DNA, 119 bp, Homo sapiens; identical to SEQ ID NO: 82675
  chr19:16472658-16472777
  Hypo

SEQ ID NO: 115720 - DNA, 35 bp, Homo sapiens; identical to SEQ ID NO: 82678
  chr19:16585115-16585150
  Hypo

SEQ ID NO: 115721 - DNA, 40 bp, Homo sapiens; identical to SEQ ID NO: 82679
  chr19:16608429-16608469
  Hypo

SEQ ID NO: 115722 - DNA, 58 bp, Homo sapiens; identical to SEQ ID NO: 82680
  chr19:16620382-16620440
  Hypo

SEQ ID NO: 115723 - DNA, 54 bp, Homo sapiens; identical to SEQ ID NO: 82681
  chr19:16638261-16638315
  Hypo

SEQ ID NO: 115724 - DNA, 68 bp, Homo sapiens; identical to SEQ ID NO: 45744
  chr19:16638668-16638736
  Hypo

SEQ ID NO: 115725 - DNA, 31 bp, Homo sapiens; identical to SEQ ID NO: 82684
  chr19:16684446-16684477
  Hypo

SEQ ID NO: 115726 - DNA, 30 bp, Homo sapiens; identical to SEQ ID NO: 82685
  chr19:16693656-16693686
  Hypo

SEQ ID NO: 115727 - DNA, 226 bp, Homo sapiens; identical to SEQ ID NO: 82688
  chr19:16939668-16939894
  Hypo

SEQ ID NO: 115728 - DNA, 707 bp, Homo sapiens
  chr19:17007086-17007793
  Hyper
aagccaggtcatccccgtaggtggaggacgacgaggccggcagccgctgctctggaaggaagggggcctcggtcgggagggcgtggcggggaggggacccaagggccgaggggaggagatccgtggcccagagcagcagcgatggtgtccccgaggctaggcggggggtagggtcctcaccgagggcgcagcagctgggaggcgcgggctccaggggcgcggcctggcggcaggcggcctcccgcaggcggcaggcgctggcgtagaccaccccgtcggagccgcacaccgggttcccctgggcgccgcagtcgtggtcgcagccgcatcgcgcgatcgccgccccctcctcaggggccacggcagggcccgactcgccggggaaccagcctgggggacgaggcaggctcgacagaccccccaccctgaaccttgcccgcgcccccacagaacctgggggtggggaagatgtccctgggtcccgggcccactaccccctcggtgggtcttggggcgcgacagttaatgggaggtcctgagccctggccttatggaatttcacgcaggtatttgcctaatacttacaaaaacagaaacagacttttaaaaagcggttgtaggagagaaaggagacagggcgtcctgtctgggccgccctgcaacaacagccccgtcccctgccgcgcctcctccgcactgaccacacc

SEQ ID NO: 115729 - DNA, 450 bp, Homo sapiens
  chr19:17008359-17008809
  Hyper
cccacctctatgctgcgttctcctgactttacgttggcccctcctctgccaagcccccaggggagccctccctggcgtccgagggtgggagtcggggtgtggcaggccgcggtggggggcggcagtggctccgcgcactcacccgggccccgggcaggggcgcgctccacttcgttgcacgcgggtccggcgcacagttcccgggcgagtgggctgtgggtgctgacgttgtagaagcgagtggcctcgaaggctacgggacgagggtggcgggtgaccaagtgcaggcgcgacgggtcagggaccgggccgggccgggggtgcgggcgcgcgggcctaccgggttcgtagtagtcgtacacggagactggcagcgccgacgtcctgcccaccacgcactcccggagagcacggaaccgcacgcacgtcaggcaccggctggggatctgt

SEQ ID NO: 115730 - DNA, 32 bp, Homo sapiens; identical to SEQ ID NO: 82695
  chr19:17048874-17048906
  Hypo

SEQ ID NO: 115731 - DNA, 48 bp, Homo sapiens; identical to SEQ ID NO: 82696
  chr19:17049220-17049268
  Hypo

SEQ ID NO: 115732 - DNA, 445 bp, Homo sapiens
  chr19:17137026-17137471
  Hyper
acttctcagccaagacgctcctcttaccttcataccttggacaactggaaatcgccacccatgatgacagcccgggtcacacgaagggggcgaggtggggcggggggagctgacctcagcacctttagcttttgggagtccctgtacctccacagagccacttcggaaactttagggcgccccctcctcaagacgattcgggaacaagaggccaggtccagcccagcgcggaggctgtgtggccttgggcaggtcgctgcaacactctgagccagtacccgcgacccccaccccagaaggcgaccgacctcctctgtcgccggaggatactcacggggcctgaggctgcgcggcgcgcacgccgtcccgcgccgacagcagcaggagcaggagcgggagcaacggccagagcagggcgccgctcatttttcggctcctggggggc

SEQ ID NO: 115733 - DNA, 50 bp, Homo sapiens; identical to SEQ ID NO: 82699
  chr19:17137729-17137779
  Hyper

SEQ ID NO: 115734 - DNA, 137 bp, Homo sapiens; identical to SEQ ID NO: 82704
  chr19:17264960-17265097
  Hypo

SEQ ID NO: 115735 - DNA, 30 bp, Homo sapiens; identical to SEQ ID NO: 82706
  chr19:17321616-17321646
  Hypo

SEQ ID NO: 115736 - DNA, 53 bp, Homo sapiens; identical to SEQ ID NO: 82707
  chr19:17362406-17362459
  Hypo

SEQ ID NO: 115737 - DNA, 62 bp, Homo sapiens; identical to SEQ ID NO: 45748
  chr19:17365683-17365745
  Hypo

SEQ ID NO: 115738 - DNA, 19 bp, Homo sapiens
  chr19:17379193-17379212
  Hypo
cagtaagcggctcatcgcc

SEQ ID NO: 115739 - DNA, 628 bp, Homo sapiens; identical to SEQ ID NO: 82710
  chr19:17392502-17393130
  Hyper

SEQ ID NO: 115740 - DNA, 21 bp, Homo sapiens
  chr19:17398566-17398587
  Hypo
atggagcctgccaggcgcggt

SEQ ID NO: 115741 - DNA, 104 bp, Homo sapiens; identical to SEQ ID NO: 82712
  chr19:17399513-17399617
  Hypo

SEQ ID NO: 115742 - DNA, 821 bp, Homo sapiens; identical to SEQ ID NO: 82713
  chr19:17404590-17405411
  Hypo

SEQ ID NO: 115743 - DNA, 30 bp, Homo sapiens; identical to SEQ ID NO: 82714
  chr19:17415369-17415399
  Hypo

SEQ ID NO: 115744 - DNA, 490 bp, Homo sapiens; identical to SEQ ID NO: 82715
  chr19:17438072-17438562
  Hypo

SEQ ID NO: 115745 - DNA, 246 bp, Homo sapiens; identical to SEQ ID NO: 82716
  chr19:17449212-17449458
  Hypo

SEQ ID NO: 115746 - DNA, 76 bp, Homo sapiens; identical to SEQ ID NO: 82717
  chr19:17462843-17462919
  Hypo

SEQ ID NO: 115747 - DNA, 618 bp, Homo sapiens; identical to SEQ ID NO: 82723
  chr19:17501171-17501789
  Hyper

SEQ ID NO: 115748 - DNA, 42 bp, Homo sapiens; identical to SEQ ID NO: 82726
  chr19:17531354-17531396
  Hyper

SEQ ID NO: 115749 - DNA, 171 bp, Homo sapiens; identical to SEQ ID NO: 82730
  chr19:17559117-17559288
  Hyper

SEQ ID NO: 115750 - DNA, 93 bp, Homo sapiens; identical to SEQ ID NO: 82734
  chr19:17605703-17605796
  Hypo

SEQ ID NO: 115751 - DNA, 30 bp, Homo sapiens; identical to SEQ ID NO: 82737
  chr19:17627117-17627147
  Hypo

SEQ ID NO: 115752 - DNA, 30 bp, Homo sapiens; identical to SEQ ID NO: 45752
  chr19:17644708-17644738
  Hypo

SEQ ID NO: 115753 - DNA, 130 bp, Homo sapiens; identical to SEQ ID NO: 82742
  chr19:17687961-17688091
  Hypo

SEQ ID NO: 115754 - DNA, 30 bp, Homo sapiens; identical to SEQ ID NO: 82744
  chr19:17716509-17716539
  Hyper

SEQ ID NO: 115755 - DNA, 746 bp, Homo sapiens; identical to SEQ ID NO: 82745
  chr19:17716778-17717524
  Hyper

SEQ ID NO: 115756 - DNA, 250 bp, Homo sapiens; identical to SEQ ID NO: 82746
  chr19:17734046-17734296
  Hypo

SEQ ID NO: 115757 - DNA, 62 bp, Homo sapiens; identical to SEQ ID NO: 82748
  chr19:17756536-17756598
  Hypo

SEQ ID NO: 115758 - DNA, 57 bp, Homo sapiens; identical to SEQ ID NO: 82749
  chr19:17758076-17758133
  Hypo

SEQ ID NO: 115759 - DNA, 695 bp, Homo sapiens; identical to SEQ ID NO: 82750
  chr19:17759137-17759832
  Hypo

SEQ ID NO: 115760 - DNA, 41 bp, Homo sapiens; identical to SEQ ID NO: 82752
  chr19:17767174-17767215
  Hypo

SEQ ID NO: 115761 - DNA, 530 bp, Homo sapiens; identical to SEQ ID NO: 82754
  chr19:17790905-17791435
  Hyper

SEQ ID NO: 115762 - DNA, 30 bp, Homo sapiens; identical to SEQ ID NO: 82755
  chr19:17792484-17792514
  Hyper

SEQ ID NO: 115763 - DNA, 563 bp, Homo sapiens
  chr19:17798506-17799069
  Hyper
ggagaaccctcccaccgcactctccttcgaatttccagccgggtccgcgtccatgaggacccgtaacccagcccacaacaccagaccccttccaagcacccctgcaggcttcaatcaaactaccgagcccagactcttcctcactgaccctctaaaaacctggtctacacagacgccccagtctagatcgtttccgggtagaaccccggatacccgtccacgtccacacgggcctccgcgttcagccgcgtccacacgacccctccagcagcggccaccaggacccccgagagccctgccgcgtctacacggatcaccccctccggggcccagctgcgtcgacaagggctacccctctcaaaagtccagccacctggactcgggtcaccccccaggaaccccctgggagccgcatccacgcggaccccgaccccagcccgcgtccacacgggtcccccgacccccagcctcgcctcctacctccaacgcaaagcagagacatgtctccgagctcgcaggtgggccggaggcggccgggccggctctgtcgggtcgggctcagc

SEQ ID NO: 115764 - DNA, 140 bp, Homo sapiens; identical to SEQ ID NO: 82758
  chr19:17808966-17809106
  Hypo

SEQ ID NO: 115765 - DNA, 104 bp, Homo sapiens; identical to SEQ ID NO: 82759
  chr19:17836551-17836655
  Hypo

SEQ ID NO: 115766 - DNA, 397 bp, Homo sapiens; identical to SEQ ID NO: 82760
  chr19:17905846-17906243
  Hyper

SEQ ID NO: 115767 - DNA, 495 bp, Homo sapiens; identical to SEQ ID NO: 82761
  chr19:17958475-17958970
  Hyper

SEQ ID NO: 115768 - DNA, 1048 bp, Homo sapiens
  chr19:17982786-17983834
  Hyper
cagcgctgagcacagcgcccagggagagggacagacagccggctgcatgggacagcggaacccagagtgagaggggaggtggcaggacagacagacagcaggggcggacgcagagacagacagcggggacagggaggccgacacggacatcgacagcccatagattcctaacccagggagccccggcccctctcgccgcttcccaccccagacggagcggggacaggctgccgagcatcctcccacccgccctccccgtcctgcctcctcggcccctgccagcttcccccgcttgagcacgcagggcgtccgaggacgcgctgggcctccgcacccgccctcatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgaggtaccggacagaggcccgggggtaggacctgccccactggcagtgctgggaccccgtgtgggggaggcgctggggctttgggccgctgtacaggaggacgcggatggcacctcggtgctttaacggaaggggcccctaggcagacacgtggggagggttctaggaagaggccccaggcgcccggcgaggggcaggaaggaggaagagagagcctggcgtcctgctccttcggtggaagcgcgcgcggggcggggcccggctcgaccaggtgtgtcctcacgggtggacacacacctgccccccacctgcccgggcgtgcagacccacgtgtgcgcgctagaggggactg

SEQ ID NO: 115769 - DNA, 324 bp, Homo sapiens; identical to SEQ ID NO: 82763
  chr19:17984588-17984912
  Hyper

SEQ ID NO: 115770 - DNA, 51 bp, Homo sapiens; identical to SEQ ID NO: 82764
  chr19:17994699-17994750
  Hypo

SEQ ID NO: 115771 - DNA, 96 bp, Homo sapiens; identical to SEQ ID NO: 16462
  chr19:18041146-18041242
  Hypo

SEQ ID NO: 115772 - DNA, 783 bp, Homo sapiens; identical to SEQ ID NO: 82768
  chr19:18054252-18055035
  Hypo

SEQ ID NO: 115773 - DNA, 30 bp, Homo sapiens; identical to SEQ ID NO: 82770
  chr19:18060062-18060092
  Hyper

SEQ ID NO: 115774 - DNA, 47 bp, Homo sapiens; identical to SEQ ID NO: 82771
  chr19:18062162-18062209
  Hyper

SEQ ID NO: 115775 - DNA, 179 bp, Homo sapiens; identical to SEQ ID NO: 82772
  chr19:18062412-18062591
  Hyper

SEQ ID NO: 115776 - DNA, 135 bp, Homo sapiens; identical to SEQ ID NO: 82774
  chr19:18063960-18064095
  Hyper

SEQ ID NO: 115777 - DNA, 535 bp, Homo sapiens; identical to SEQ ID NO: 82776
  chr19:18077737-18078272
  Hyper

SEQ ID NO: 115778 - DNA, 106 bp, Homo sapiens; identical to SEQ ID NO: 82778
  chr19:18084912-18085018
  Hypo

SEQ ID NO: 115779 - DNA, 395 bp, Homo sapiens; identical to SEQ ID NO: 82779
  chr19:18092490-18092885
  Hypo

SEQ ID NO: 115780 - DNA, 224 bp, Homo sapiens; identical to SEQ ID NO: 82781
  chr19:18103700-18103924
  Hypo

SEQ ID NO: 115781 - DNA, 94 bp, Homo sapiens; identical to SEQ ID NO: 82782
  chr19:18104399-18104493
  Hypo

SEQ ID NO: 115782 - DNA, 19 bp, Homo sapiens
  chr19:18105637-18105656
  Hypo
ccaccgtgcccagcccatt

SEQ ID NO: 115783 - DNA, 161 bp, Homo sapiens; identical to SEQ ID NO: 82786
  chr19:18118157-18118318
  Hyper

SEQ ID NO: 115784 - DNA, 470 bp, Homo sapiens
  chr19:18118573-18119043
  Hyper
ggccctcaactggggcgagagtcccccgccccaaatcgggctggacatgcctcgagtcacgtcaacgaggggcggctggtgagtgattaagccgagaggctgaaggctctgctaggtgacctcaggcctgggccctgcctctgcacctctttttttcctctttacccccggggtccgcgagagaccagctctggcagcctaagggcttcagtttctccccggggtccgcgagggaagggggcagccggcggtgagcaggggcgtttgttattttgctccacgcctgggcagagccacgccccttgtcgcgctattggtggagtcccttcccggggcggggaagagacggtgaccccacccccccccgccctgccgtataaaagcggcgccgacgcacggcgcggggattttctgctccggttggtgagcgcgcctgcgcgttgacggcgattttgcgttctgaggctgca

SEQ ID NO: 115785 - DNA, 30 bp, Homo sapiens; identical to SEQ ID NO: 82790
  chr19:18126576-18126606
  Hypo

SEQ ID NO: 115786 - DNA, 21 bp, Homo sapiens
  chr19:18173288-18173309
  Hypo
tctgtaattccaggccgggca

SEQ ID NO: 115787 - DNA, 120 bp, Homo sapiens; identical to SEQ ID NO: 82792
  chr19:18175554-18175674
  Hypo

SEQ ID NO: 115788 - DNA, 35 bp, Homo sapiens; identical to SEQ ID NO: 82793
  chr19:18175734-18175769
  Hypo

SEQ ID NO: 115789 - DNA, 70 bp, Homo sapiens; identical to SEQ ID NO: 82794
  chr19:18193110-18193180
  Hypo

SEQ ID NO: 115790 - DNA, 86 bp, Homo sapiens; identical to SEQ ID NO: 82795
  chr19:18207919-18208005
  Hypo

SEQ ID NO: 115791 - DNA, 51 bp, Homo sapiens; identical to SEQ ID NO: 82796
  chr19:18241304-18241355
  Hypo

SEQ ID NO: 115792 - DNA, 30 bp, Homo sapiens; identical to SEQ ID NO: 82797
  chr19:18262269-18262299
  Hypo

SEQ ID NO: 115793 - DNA, 30 bp, Homo sapiens; identical to SEQ ID NO: 82798
  chr19:18271945-18271975
  Hyper

SEQ ID NO: 115794 - DNA, 199 bp, Homo sapiens; identical to SEQ ID NO: 82799
  chr19:18272708-18272907
  Hypo

SEQ ID NO: 115795 - DNA, 18 bp, Homo sapiens
  chr19:18298268-18298286
  Hypo
acaggcataagccaccga

SEQ ID NO: 115796 - DNA, 23 bp, Homo sapiens
  chr19:18325046-18325069
  Hypo
caagactccgtctcaaaaaaaaa

SEQ ID NO: 115797 - DNA, 218 bp, Homo sapiens; identical to SEQ ID NO: 45769
  chr19:18330991-18331209
  Hypo

SEQ ID NO: 115798 - DNA, 130 bp, Homo sapiens; identical to SEQ ID NO: 82803
  chr19:18335243-18335373
  Hyper

SEQ ID NO: 115799 - DNA, 135 bp, Homo sapiens; identical to SEQ ID NO: 82804
  chr19:18336370-18336505
  Hyper

SEQ ID NO: 115800 - DNA, 400 bp, Homo sapiens; identical to SEQ ID NO: 82805
  chr19:18336730-18337130
  Hyper

SEQ ID NO: 115801 - DNA, 578 bp, Homo sapiens
  chr19:18343439-18344017
  Hyper
atacccaagcatgaacgtacaggagcaccccaaacacatctggtcaccccagtctcacgcgcgcgcgcgcacacacacacacactctttcagtcccaaccgcacgtgggcacacccggtcacacagacccacaagccatgatgacaccagcaccctcagctccacccctacgtagaaatagctttttccttccaggcgccagcctcaaccaagcagcagagacccccgccccctggagaagcaaggaccctcccccactcccgccaggccccgcgcgcccctcccccgcgctgcaggaggcccctgccccggccacctaccgcctgcaggaggaaacgggccaggagagccgcgacttcctgagctccggccgcgggctcaggtccctctcgcggcagcccgcggacttgtccggatccgaatagaagcgctgttggatgcggatggggcgccggggttgccgccacaggtgcttcggggctctggtcatgctgtggcggccgcgagagcgactcaacctgctgcaagcctctgccccttcgccgacccccaggttctccatgcgccagagaaagggg

SEQ ID NO: 115802 - DNA, 48 bp, Homo sapiens; identical to SEQ ID NO: 45770
  chr19:18383303-18383351
  Hypo

SEQ ID NO: 115803 - DNA, 30 bp, Homo sapiens; identical to SEQ ID NO: 82809
  chr19:18410211-18410241
  Hypo

SEQ ID NO: 115804 - DNA, 40 bp, Homo sapiens; identical to SEQ ID NO: 82810
  chr19:18413086-18413126
  Hypo

SEQ ID NO: 115805 - DNA, 30 bp, Homo sapiens; identical to SEQ ID NO: 82811
  chr19:18456915-18456945
  Hypo

SEQ ID NO: 115806 - DNA, 55 bp, Homo sapiens; identical to SEQ ID NO: 82812
  chr19:18459164-18459219
  Hypo

SEQ ID NO: 115807 - DNA, 95 bp, Homo sapiens; identical to SEQ ID NO: 82813
  chr19:18483800-18483895
  Hypo

SEQ ID NO: 115808 - DNA, 117 bp, Homo sapiens; identical to SEQ ID NO: 82814
  chr19:18485487-18485604
  Hyper

SEQ ID NO: 115809 - DNA, 240 bp, Homo sapiens; identical to SEQ ID NO: 82815
  chr19:18523277-18523517
  Hypo

SEQ ID NO: 115810 - DNA, 77 bp, Homo sapiens; identical to SEQ ID NO: 82816
  chr19:18523577-18523654
  Hypo

SEQ ID NO: 115811 - DNA, 153 bp, Homo sapiens; identical to SEQ ID NO: 82817
  chr19:18528822-18528975
  Hyper

SEQ ID NO: 115812 - DNA, 61 bp, Homo sapiens; identical to SEQ ID NO: 82818
  chr19:18544595-18544656
  Hyper

SEQ ID NO: 115813 - DNA, 30 bp, Homo sapiens; identical to SEQ ID NO: 82819
  chr19:18547884-18547914
  Hyper

SEQ ID NO: 115814 - DNA, 30 bp, Homo sapiens; identical to SEQ ID NO: 82821
  chr19:18572176-18572206
  Hypo

SEQ ID NO: 115815 - DNA, 79 bp, Homo sapiens; identical to SEQ ID NO: 82822
  chr19:18600734-18600813
  Hypo

SEQ ID NO: 115816 - DNA, 30 bp, Homo sapiens; identical to SEQ ID NO: 82823
  chr19:18627227-18627257
  Hypo

SEQ ID NO: 115817 - DNA, 120 bp, Homo sapiens; identical to SEQ ID NO: 45772
  chr19:18681763-18681883
  Hypo

SEQ ID NO: 115818 - DNA, 142 bp, Homo sapiens; identical to SEQ ID NO: 82825
  chr19:18707322-18707464
  Hypo

SEQ ID NO: 115819 - DNA, 680 bp, Homo sapiens
  chr19:18714455-18715135
  Hyper
ccccctgaatgccagcgctgccctgcacttgccctcactgccccagatgggcgaggtggggtggacacggttcttgggccggccctgatgattttccggggcaaacttggctcgagggctctgtctcgctggagcctggaatcgcagttgcgcttggggcttggcccagggctcgccggaggtctccgcgtccgtgcgaaggagccggctgagcgggccagagccgaggaggcgggggcggccgaggggggcggggggctgggggccaggggaccgccctggaggtcccaggcagccagccgcccgctaattcggaattccttttgcatgaactcgggtgtgccagcgtctctgccccggcccacccaccgcttcctgcctgggcccccccaacagagtgggaggcacggccaggcctgcccagaccccaggcccctctcagcccttctagagtgggtctcactcctcctgcccccaccacccgccagcttggcctgggcaggaaggggctctctggggggtcctggctggggggcgctgcccctctgccacacccgcctggcctgggccggcgtggctcacttgccagcagctgcagctgccctcccggggctgggcgggggacaccgggcggcgacgggttgtagggggaaggcaaggccaggcgggcctggacagac

SEQ ID NO: 115820 - DNA, 45 bp, Homo sapiens; identical to SEQ ID NO: 82829
  chr19:18716238-18716283
  Hyper

SEQ ID NO: 115821 - DNA, 112 bp, Homo sapiens; identical to SEQ ID NO: 82830
  chr19:18716735-18716847
  Hyper

SEQ ID NO: 115822 - DNA, 255 bp, Homo sapiens; identical to SEQ ID NO: 82831
  chr19:18718127-18718382
  Hyper

SEQ ID NO: 115823 - DNA, 162 bp, Homo sapiens
  chr19:18722263-18722425
  Hyper
tcctgactttgccaacgcgtcccggagcctaagtttcccacctgtgaaatgggggacagtattggtcataacgcacagggctgtttcccaaggtgcgggcctggcgcgcgggtgggttagaagcggaattctcctgctggattctggcgcaaactgcgggct

SEQ ID NO: 115824 - DNA, 93 bp, Homo sapiens; identical to SEQ ID NO: 82834
  chr19:18722675-18722768
  Hyper

SEQ ID NO: 115825 - DNA, 598 bp, Homo sapiens
  chr19:18723362-18723960
  Hyper
ctttctcctctctcccgcgtggtcggctcacacgtcgcctcctccgccaagctctccgctctcctcgacacccctggggaatagtcccctccatcccatccccctatatatttccttttggccccaagcgccagcagagatcccccgcccgtgggcaccagggaggtgtcctgggacccccgcgatgggatagacggtgggggccgcgatgcacctgccccgcccgacccgcacgcctcgggtgccgcagcgcagctaccccgcccgctctccgcatctcccaccccccgcttcccaggctgcctcgctcgggtgacgtcagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggtgaggcgcgtgcggtgccag

SEQ ID NO: 115826 - DNA, 99 bp, Homo sapiens; identical to SEQ ID NO: 82837
  chr19:18788365-18788464
  Hypo

SEQ ID NO: 115827 - DNA, 75 bp, Homo sapiens; identical to SEQ ID NO: 82838
  chr19:18807949-18808024
  Hypo

SEQ ID NO: 115828 - DNA, 183 bp, Homo sapiens; identical to SEQ ID NO: 82839
  chr19:18811499-18811682
  Hyper

SEQ ID NO: 115829 - DNA, 175 bp, Homo sapiens; identical to SEQ ID NO: 82840
  chr19:18819701-18819876
  Hypo

SEQ ID NO: 115830 - DNA, 134 bp, Homo sapiens; identical to SEQ ID NO: 82841
  chr19:18870877-18871011
  Hypo

SEQ ID NO: 115831 - DNA, 30 bp, Homo sapiens; identical to SEQ ID NO: 82842
  chr19:18872102-18872132
  Hypo

SEQ ID NO: 115832 - DNA, 35 bp, Homo sapiens; identical to SEQ ID NO: 82843
  chr19:18878375-18878410
  Hypo

SEQ ID NO: 115833 - DNA, 51 bp, Homo sapiens; identical to SEQ ID NO: 82844
  chr19:18879358-18879409
  Hypo

SEQ ID NO: 115834 - DNA, 194 bp, Homo sapiens; identical to SEQ ID NO: 82845
  chr19:18880005-18880199
  Hypo

SEQ ID NO: 115835 - DNA, 30 bp, Homo sapiens; identical to SEQ ID NO: 82846
  chr19:18882043-18882073
  Hypo

SEQ ID NO: 115836 - DNA, 575 bp, Homo sapiens; identical to SEQ ID NO: 82847
  chr19:18883509-18884084
  Hypo

SEQ ID NO: 115837 - DNA, 82 bp, Homo sapiens; identical to SEQ ID NO: 82848
  chr19:18895721-18895803
  Hypo

SEQ ID NO: 115838 - DNA, 86 bp, Homo sapiens; identical to SEQ ID NO: 82849
  chr19:18896272-18896358
  Hyper

SEQ ID NO: 115839 - DNA, 59 bp, Homo sapiens; identical to SEQ ID NO: 82850
  chr19:18896736-18896795
  Hyper

SEQ ID NO: 115840 - DNA, 92 bp, Homo sapiens
  chr19:18898213-18898305
  Hyper
aaaccagccaagccccgccccggagccgaatcccgcccttcggtgcccgccgcctctcctcgccccccaacccccatcgagctcacggtcgc

SEQ ID NO: 115841 - DNA, 579 bp, Homo sapiens; identical to SEQ ID NO: 82852
  chr19:18899038-18899617
  Hyper

SEQ ID NO: 115842 - DNA, 2391 bp, Homo sapiens; identical to SEQ ID NO: 82853
  chr19:18899906-18902297
  Hyper

SEQ ID NO: 115843 - DNA, 30 bp, Homo sapiens; identical to SEQ ID NO: 82854
  chr19:18956799-18956829
  Hypo

SEQ ID NO: 115844 - DNA, 16 bp, Homo sapiens
  chr19:18957788-18957804
  Hypo
acggcaggtttgggcc

SEQ ID NO: 115845 - DNA, 30 bp, Homo sapiens; identical to SEQ ID NO: 45780
  chr19:18975090-18975120
  Hypo

SEQ ID NO: 115846 - DNA, 757 bp, Homo sapiens
  chr19:18980703-18981460
  Hyper
ctgctcgggcatccccgggccactctcgaggctcgccctgcgaggtctggcctccaggaccagtgtccccagcgaaagccccactcaccgcggtccgggatgtggcgcacgatgtttccggcgacccccagctcctccacgtggcacggttgcagggtgacccctggggacgtccgccgcgagccagacctggtctcctgggggtcccggcgtcgaaacaggcgccacatgaccgggggaaccggccggagcctgggggcaccctggggctcatcgcgcagtcctagagcctggagcagggcggcggctgggcctgggggcacgggggcgcgggtcaggggcagcgagggcagcagcagggccaggaggaggaggaggtggtggccgcagggaccttgctgcggcggtggcatcttcctcccaggcgatgaccagagagtgcgcagggtccgcggcggcccgggaccagtgggctgagggcggggccggtgtccccggaggggcaggggtcctggggggcgtggccgggaactggaggcaggatgagggggcggggtcccaggggaggtggcggcggccctagaggagcagagttggagggggtggaggggcggccaaggacggggagcgtggccggggtattcggggtggggccgggtccacgggggcggggccgaggggttcagaagcgcttgtccttcaccaggccgttcctcagtggcttcctgggggtcagaaccggcgcaggttagcctgg

SEQ ID NO: 115847 - DNA, 167 bp, Homo sapiens; identical to SEQ ID NO: 82861
  chr19:18988902-18989069
  Hypo

SEQ ID NO: 115848 - DNA, 622 bp, Homo sapiens; identical to SEQ ID NO: 82862
  chr19:18989659-18990281
  Hypo

SEQ ID NO: 115849 - DNA, 581 bp, Homo sapiens; identical to SEQ ID NO: 82863
  chr19:18994680-18995261
  Hypo

SEQ ID NO: 115850 - DNA, 1401 bp, Homo sapiens; identical to SEQ ID NO: 82864
  chr19:19006016-19007417
  Hyper

SEQ ID NO: 115851 - DNA, 30 bp, Homo sapiens; identical to SEQ ID NO: 82865
  chr19:19007899-19007929
  Hypo

SEQ ID NO: 115852 - DNA, 163 bp, Homo sapiens; identical to SEQ ID NO: 82866
  chr19:19042704-19042867
  Hypo

SEQ ID NO: 115853 - DNA, 30 bp, Homo sapiens; identical to SEQ ID NO: 82868
  chr19:19100115-19100145
  Hypo

SEQ ID NO: 115854 - DNA, 35 bp, Homo sapiens; identical to SEQ ID NO: 82871
  chr19:19214212-19214247
  Hypo

SEQ ID NO: 115855 - DNA, 221 bp, Homo sapiens; identical to SEQ ID NO: 82872
  chr19:19218598-19218819
  Hypo

SEQ ID NO: 115856 - DNA, 70 bp, Homo sapiens; identical to SEQ ID NO: 82873
  chr19:19221225-19221295
  Hyper

SEQ ID NO: 115857 - DNA, 41 bp, Homo sapiens; identical to SEQ ID NO: 82874
  chr19:19256265-19256306
  Hypo

SEQ ID NO: 115858 - DNA, 418 bp, Homo sapiens; identical to SEQ ID NO: 82875
  chr19:19322511-19322929
  Hyper

SEQ ID NO: 115859 - DNA, 443 bp, Homo sapiens; identical to SEQ ID NO: 82876
  chr19:19334846-19335289
  Hypo

SEQ ID NO: 115860 - DNA, 94 bp, Homo sapiens
  chr19:19335756-19335850
  Hyper
cccctgacctccacccgcccctcccgcaggcgaggtcttctacgtgggcccggcccgccgcctgacactggccggcgcgcgtgcacagtgccgc

SEQ ID NO: 115861 - DNA, 283 bp, Homo sapiens; identical to SEQ ID NO: 82878
  chr19:19373486-19373769
  Hyper

SEQ ID NO: 115862 - DNA, 35 bp, Homo sapiens; identical to SEQ ID NO: 37328
  chr19:19383770-19383805
  Hyper

SEQ ID NO: 115863 - DNA, 151 bp, Homo sapiens; identical to SEQ ID NO: 82880
  chr19:19384011-19384162
  Hyper

SEQ ID NO: 115864 - DNA, 200 bp, Homo sapiens; identical to SEQ ID NO: 82881
  chr19:19391386-19391586
  Hypo

SEQ ID NO: 115865 - DNA, 39 bp, Homo sapiens; identical to SEQ ID NO: 45790
  chr19:19391907-19391946
  Hypo

SEQ ID NO: 115866 - DNA, 86 bp, Homo sapiens; identical to SEQ ID NO: 82883
  chr19:19447944-19448030
  Hypo

SEQ ID NO: 115867 - DNA, 57 bp, Homo sapiens; identical to SEQ ID NO: 82884
  chr19:19540245-19540302
  Hypo

SEQ ID NO: 115868 - DNA, 80 bp, Homo sapiens; identical to SEQ ID NO: 82885
  chr19:19542144-19542224
  Hypo

SEQ ID NO: 115869 - DNA, 68 bp, Homo sapiens; identical to SEQ ID NO: 82886
  chr19:19613872-19613940
  Hypo

SEQ ID NO: 115870 - DNA, 61 bp, Homo sapiens; identical to SEQ ID NO: 82887
  chr19:19645864-19645925
  Hypo

SEQ ID NO: 115871 - DNA, 401 bp, Homo sapiens; identical to SEQ ID NO: 82888
  chr19:19649034-19649435
  Hyper

SEQ ID NO: 115872 - DNA, 1037 bp, Homo sapiens
  chr19:19651126-19652163
  Hyper
cgctggcgctggaagcgcgcaccacggactgggccctgccgtccgccgtcggcgagcgcgtgcacttgaaccccacgcgcggcttctggtgcctcaaccgcgagcaaccgcgtggccgccgctgctccaactaccacgtgcgcttccgctgcccactaggtgagggcggggctggatgacgggggcggggctttgaatgggcggggctggcgaacgccgggaagagtcgtggtgggtggggctgggaggggcaggaccgtgtgggtgtgggcgtggctgggaagagccgggggacccttaggcgtaggacgacgtcagggggcggggccaggcagggcggggcttttgaagagaggcgctgggaacagcgcggggcccaagtgcaccgtcaggaggcccagcgggtcaggacccatgtccggccccctggaacgcatctccctcccgctgccctcatttgagcatctgtaagagctcagttctgtggagtgtcttgagcccaaatgcgtgcaggatgcagggagaaaagcaggactgatccccgggaccttatgcgggggtggggaggtgggtcggtacctaaactatgtcttcgacaggcgcgcctaggggagcatgggtgggggcgatggcagatctgctctctggagtgtccgcccttggatgcacatatgtgagggggttggggaagaagggtcctttagtcccaggttacccggaggcgcagttcctggggagggcggccacctgatctccgtccctgccttccgcagaagcctcgtggggcgcgtggggcccgtggggtccctgctcggggagctgtgggccaggccgtcgcttgcgccgccgccactgcccaagccccgctggggatgcgtgtcccgggcgtcctctggaggcgcagaagtgcgtgcggcctcggtgtccaggtaggaggggcggggtctggaggctgggacctgtacagaggggaggaaggggaggttaggggctgagcctgggagagagggtggagttagaggcggtgcctggatgta

SEQ ID NO: 115873 - DNA, 30 bp, Homo sapiens; identical to SEQ ID NO: 82892
  chr19:19652530-19652560
  Hypo

SEQ ID NO: 115874 - DNA, 62 bp, Homo sapiens; identical to SEQ ID NO: 82893
  chr19:19680975-19681037
  Hypo

SEQ ID NO: 115875 - DNA, 84 bp, Homo sapiens; identical to SEQ ID NO: 82896
  chr19:19737618-19737702
  Hypo

SEQ ID NO: 115876 - DNA, 46 bp, Homo sapiens; identical to SEQ ID NO: 82897
  chr19:19738622-19738668
  Hyper

SEQ ID NO: 115877 - DNA, 30 bp, Homo sapiens; identical to SEQ ID NO: 82899
  chr19:19843300-19843330
  Hyper

SEQ ID NO: 115878 - DNA, 453 bp, Homo sapiens; identical to SEQ ID NO: 82900
  chr19:19843591-19844044
  Hyper

SEQ ID NO: 115879 - DNA, 18 bp, Homo sapiens
  chr19:19882729-19882747
  Hypo
ttagaaaaggctggtcgg

SEQ ID NO: 115880 - DNA, 205 bp, Homo sapiens; identical to SEQ ID NO: 82903
  chr19:19932180-19932385
  Hyper

SEQ ID NO: 115881 - DNA, 204 bp, Homo sapiens; identical to SEQ ID NO: 82904
  chr19:19932505-19932709
  Hyper

SEQ ID NO: 115882 - DNA, 45 bp, Homo sapiens; identical to SEQ ID NO: 82905
  chr19:19977249-19977294
  Hyper

SEQ ID NO: 115883 - DNA, 30 bp, Homo sapiens; identical to SEQ ID NO: 82906
  chr19:19977542-19977572
  Hyper

SEQ ID NO: 115884 - DNA, 300 bp, Homo sapiens; identical to SEQ ID NO: 82907
  chr19:20011907-20012207
  Hyper

SEQ ID NO: 115885 - DNA, 874 bp, Homo sapiens; identical to SEQ ID NO: 82908
  chr19:20149645-20150519
  Hyper

SEQ ID NO: 115886 - DNA, 910 bp, Homo sapiens
  chr19:20162654-20163564
  Hyper
gtcaggaaaccagcacgttgggggaggcgggatcacagttacttgctgagacaagctgccctggctacgttcactcccgtcaggtaggagaggttaaagaacaggaaggctccccctccgcagggcggaactgctctgaaggcatggaggagcgacgctgaaggtggaggcttcgcccaccatgccgggagctaaaatttcttaaccaatgccggccagcgatggcagggctgcgggactacaatcccagcgcgcacagggatcagggactgtgcgcatcactggaagaagcggcagaacggcgcgcgcctcgctgagctttctgggagatgtagtctcatggcaactcccagccttttggccacaaggctacgggacctacaatcccagcctgtaccaggatcgggagcagttcgcagcactagaggaaggggcagggcggtgcgcgccgcgcctgatatgctgggagctgtagtctcttcacggtttttagccaatgagtaggtagcttcagaactacaatcccagtatgcatgggggcggtgcgtagtcctggaggtaggggctgagaggtgtggacttaccggtgtccaaagcattgctagcagccaattccatgccgccccgttgccagggagagtgaatacagctagggacgtgaagggtaggtctgggctgggcattgaggagggtattaggctaggaagtatacctcacctttgtccaaatcgggtggttcggcctcctctcattggccctatgcagctgggttgcctctctcacccgcacccaagggtctttccagagtgttgcgtcatttccagcccagggagctgccttctttcctaaactgcaatggaaactgtcctgatgtctgagacaatgtccgttgtgccgcagccctctgcct

SEQ ID NO: 115887 - DNA, 23 bp, Homo sapiens
  chr19:20188602-20188625
  Hyper
ctcaaggaggaagcccggcctga

SEQ ID NO: 115888 - DNA, 120 bp, Homo sapiens; identical to SEQ ID NO: 82912
  chr19:20188745-20188865
  Hyper

SEQ ID NO: 115889 - DNA, 180 bp, Homo sapiens; identical to SEQ ID NO: 82913
  chr19:20189405-20189585
  Hyper

SEQ ID NO: 115890 - DNA, 20 bp, Homo sapiens
  chr19:21265857-21265877
  Hypo
tttaagatggagtttcgctc

SEQ ID NO: 115891 - DNA, 30 bp, Homo sapiens; identical to SEQ ID NO: 82918
  chr19:21578373-21578403
  Hypo

SEQ ID NO: 115892 - DNA, 30 bp, Homo sapiens; identical to SEQ ID NO: 82919
  chr19:21589791-21589821
  Hypo

SEQ ID NO: 115893 - DNA, 202 bp, Homo sapiens; identical to SEQ ID NO: 82920
  chr19:21646235-21646437
  Hyper

SEQ ID NO: 115894 - DNA, 16 bp, Homo sapiens
  chr19:21647196-21647212
  Hypo
tcacgcctgtaattcc

SEQ ID NO: 115895 - DNA, 36 bp, Homo sapiens; identical to SEQ ID NO: 82922
  chr19:21657554-21657590
  Hyper

SEQ ID NO: 115896 - DNA, 87 bp, Homo sapiens; identical to SEQ ID NO: 82923
  chr19:21659146-21659233
  Hypo

SEQ ID NO: 115897 - DNA, 17 bp, Homo sapiens
  chr19:21726603-21726620
  Hypo
agcactttgggaggccg

SEQ ID NO: 115898 - DNA, 30 bp, Homo sapiens; identical to SEQ ID NO: 45793
  chr19:21727297-21727327
  Hypo

SEQ ID NO: 115899 - DNA, 30 bp, Homo sapiens; identical to SEQ ID NO: 82926
  chr19:21750501-21750531
  Hypo

SEQ ID NO: 115900 - DNA, 311 bp, Homo sapiens
  chr19:21769289-21769600
  Hyper
cggcacctggagtctcggtggaacccggcagcggtgggcgcggaccccggagaggctgccccgagcccgagcaccccctgaccgggcgctcaccacgggtgttgggacaagcagcggagcctgcgggctggagccaggctcggaccctccgcgccggggcgggcggccgagcggacgcagctggcagtggcggcgggagagcgccccggatccgcccggagcccaaccccgtggcacttcggctggctgggcagcggcgctggggacaacgcggggccttctgcaacgagcgcctgcgtgggactccaggg

SEQ ID NO: 115901 - DNA, 75 bp, Homo sapiens; identical to SEQ ID NO: 82930
  chr19:22005601-22005676
  Hypo

SEQ ID NO: 115902 - DNA, 35 bp, Homo sapiens; identical to SEQ ID NO: 82931
  chr19:22016818-22016853
  Hypo

SEQ ID NO: 115903 - DNA, 41 bp, Homo sapiens; identical to SEQ ID NO: 82932
  chr19:22017749-22017790
  Hypo

SEQ ID NO: 115904 - DNA, 300 bp, Homo sapiens; identical to SEQ ID NO: 82933
  chr19:22018428-22018728
  Hyper

SEQ ID NO: 115905 - DNA, 120 bp, Homo sapiens
  chr19:22018908-22019028
  Hyper
cagaggctggacctctagcagcagaggacacagaagaacgaagacgagacgcagagctccaactgcagccagagacaaaggccccgccacatcccggaagccgccctgtcctctcctgcc

SEQ ID NO: 115906 - DNA, 89 bp, Homo sapiens; identical to SEQ ID NO: 82936
  chr19:22019088-22019177
  Hyper

SEQ ID NO: 115907 - DNA, 101 bp, Homo sapiens; identical to SEQ ID NO: 82937
  chr19:22030099-22030200
  Hypo

SEQ ID NO: 115908 - DNA, 30 bp, Homo sapiens; identical to SEQ ID NO: 82938
  chr19:22031956-22031986
  Hypo

SEQ ID NO: 115909 - DNA, 637 bp, Homo sapiens
  chr19:22034401-22035038
  Hyper
cctcctgcgcacacaccgagtcgggattctgccccgatcatccgccgggcatccctgaacaatctgggaaatactcggggctgctggtgcagagctgaccagagagctccagacagggtaccgcgcaggaatggggcgggacgcgggaggctcggctgcgggcccagccgccatcttgcggccagaggggcctggggcggagctgcgccagcgaccaggactcaggagcggactgtgaggaggccggtcccgccactttcacagcctgctctcccctctcgggatgcctaaccccgcacactcaccatttcccagcttccaggatgtccgggcatcttagctgtgcgtctcccaggacttgcagatcacagggtaacggaggctgcgacaaagtcaccggggattcccgagttggagaacgcggaaaagcagaggcgggtcccaaggtctagcgggagctggagacaaaggccccgccaaaagccggaagccacggccccctctccaactgcgcgtctgattgggtggttcccacgccagcgccactgattggataaagctccaggacccaccctccctagcgtttgcgcattttatggacagggaaacaggctcaagtaggcggggcacatgccca

SEQ ID NO: 115910 - DNA, 20 bp, Homo sapiens
  chr19:22037958-22037978
  Hypo
gccaccgcacctggccccct

SEQ ID NO: 115911 - DNA, 26 bp, Homo sapiens
  chr19:22238973-22238999
  Hypo
gggggagcactgtctcgtgcctgtaa

SEQ ID NO: 115912 - DNA, 120 bp, Homo sapiens; identical to SEQ ID NO: 82953
  chr19:22606117-22606237
  Hypo

SEQ ID NO: 115913 - DNA, 261 bp, Homo sapiens
  chr19:22610486-22610747
  Hyper
tgtctgtgcttccctcgcccaatctgagagtggcctgttccagggggcgggcttcctctttgtttggcagccaggagtctggagcgcaggtgccgggcaggcagcactgggagcgctcggcgacttggctggaggccgaaggtgccgcccctggggaaccagagcgcctttgcaaggtgggctcggcgtacactcccctatccttctgtggcccccgggcccctcctagaagaccgtcctcatctccgaggaccttgaccg

SEQ ID NO: 115914 - DNA, 30 bp, Homo sapiens; identical to SEQ ID NO: 82955
  chr19:22610975-22611005
  Hyper

SEQ ID NO: 115915 - DNA, 30 bp, Homo sapiens; identical to SEQ ID NO: 82956
  chr19:22611307-22611337
  Hyper

SEQ ID NO: 115916 - DNA, 878 bp, Homo sapiens; identical to SEQ ID NO: 82958
  chr19:22715140-22716018
  Hyper

SEQ ID NO: 115917 - DNA, 406 bp, Homo sapiens
  chr19:22806000-22806406
  Hyper
tctccctgccagttgcggtcgtgggcggcctcgccttggagccctggccacggagccgcacggggcggtagagaggctggtggggagggaccagcgggcggtggaggggcggccctgcaggcgacgcggggactggaaagggcgcctgggtgggaagaggcgctggcgggtgatcgtccccaccgggccagtccccgggatctgctgccgcccctctccgaaattcacagccagagcgggcgcactggtgtgtgtggcgcctggagcgctagggtccccacccaagtgcgaggcccccgcggggagcccagcccaggggcgtccacagtccaggccccagaccccaggtcctggctagattcgccaaagtcagaggctggaatctggagggcggatgtgagggtgc

SEQ ID NO: 115918 - DNA, 30 bp, Homo sapiens; identical to SEQ ID NO: 82965
  chr19:22815493-22815523
  Hypo

SEQ ID NO: 115919 - DNA, 84 bp, Homo sapiens; identical to SEQ ID NO: 82966
  chr19:22817001-22817085
  Hyper

SEQ ID NO: 115920 - DNA, 120 bp, Homo sapiens; identical to SEQ ID NO: 82967
  chr19:22817385-22817505
  Hyper

SEQ ID NO: 115921 - DNA, 109 bp, Homo sapiens; identical to SEQ ID NO: 82971
  chr19:23077136-23077245
  Hypo

SEQ ID NO: 115922 - DNA, 36 bp, Homo sapiens; identical to SEQ ID NO: 82973
  chr19:23083160-23083196
  Hypo

SEQ ID NO: 115923 - DNA, 37 bp, Homo sapiens
  chr19:23185625-23185662
  Hyper
aaaagacaggacgcccggggaccgggtgtcagcgcag

SEQ ID NO: 115924 - DNA, 633 bp, Homo sapiens
  chr19:23253781-23254414
  Hyper
ccaaggcacccaccacgcagcacgccgtccctttcggcgctcggaaagccctcgggcgaacccctcccgagcccacccctcccgggacctcagaagatggctcaggacggcccctgactctccatggggacttgggaataaactcggcaggcgcctcagacagtcgggaccagcgtgggcgtccctggccccctgcgtcaggcctggtgggtcctgcgggtcgggcctcggcagttgcagtgcgcttgggatcagccggggcagccccacactcggctcgggctgggagcgcggggacagcctcccaagccacagccctgcgcgcccgacctccgactcacaagggacgcgccagagctctggtcccattgagacagttcagctgaaggctgcgggccttcccgagctccgcccagctcacagcggggacggtccctccctcggcagctgccgctggagctccggaggacaagagaacttagagaggtggcctcagtggagcccgacaaccagcgcgaacgtcaacaagacagatcgagatggcaagggcagctcgtgggcgaaatggatccacccgaccccagaaatgatccccgatacgtggctctgcatagaccacgacagagtccagtc

SEQ ID NO: 115925 - DNA, 840 bp, Homo sapiens
  chr19:23257752-23258592
  Hyper
gcctctcaaagtgctgggatcacaggcgtgagccaccgccccccgacgcctcagctcatttgttaattagcagtaattgcccgggtcagtgacacctcctacttgagcctctttccctgtccataaaatgcactaatactggggtgggtgggattgggaggtgggtcctggagctccatccaatcagtggcactggtgtaggaaccgcccgatcaggcgcgcagttggagaggagggcgtggcttccggcatttggcggggtctttgtctctcgctcccgccagagcttgggatcggtcttcactgttccgcgtcctctacctgggaaccaccgacccccgcccggcgactttgtcacagactctgttgccctgtgatctgcaggtcctgggagacgcacagccaagatgccagggcaccctggaagctgtgaagtggtgcgtatgcggggttgggcatcccttgaggcgagagcgggctgtgaaacctgcaggaccggcctccccacagtccgctcccgggtccgccgacctcagtcctctctggcgcagctcggccccaggcgtctctggccgcaagatggcggctgggcccgcggccgggacccccagcgtctcgccgcgtccctgctgggcgccctgtctggacctccctgggcagctctgcgcccgcagccccgagtatttcccagagtgcttagggatgccaggcgggtcatcagggtagaatcccgactaggtgtgtgcgtgggaggagctgcgacccgtggggttcccaagctttcctgttattttttttttcttttctttttagacagtctcgctctgtcgctaaggtaaa

SEQ ID NO: 115926 - DNA, 79 bp, Homo sapiens; identical to SEQ ID NO: 1366
  chr19:23258652-23258731
  Hyper

SEQ ID NO: 115927 - DNA, 20 bp, Homo sapiens
  chr19:23295513-23295533
  Hypo
gacttcgtctcaaaaaaata

SEQ ID NO: 115928 - DNA, 151 bp, Homo sapiens; identical to SEQ ID NO: 37365
  chr19:23299633-23299784
  Hyper

SEQ ID NO: 115929 - DNA, 30 bp, Homo sapiens; identical to SEQ ID NO: 37366
  chr19:23300324-23300354
  Hyper

SEQ ID NO: 115930 - DNA, 293 bp, Homo sapiens
  chr19:23386702-23386995
  Hyper
aggccggagtctgcccggcccagcccctcctcactcccttggactcttcacggtgtctccgggcccctgcacaatcctgagcgtccctcacatggaagccgaggtggtagcaggaagctggtggaaggaactggctccgcaggcagggaggtctcgcccaggaaatgctctgttggcctcggcttcctgcgcacgcagctgggcccggacccagggttggagtcgagacgtacccgggctggacgaccccgggcgttggcgcgcccgctgctgcggttcgtgctgtgctcggc

SEQ ID NO: 115931 - DNA, 40 bp, Homo sapiens; identical to SEQ ID NO: 82991
  chr19:23433143-23433183
  Hyper

SEQ ID NO: 115932 - DNA, 97 bp, Homo sapiens; identical to SEQ ID NO: 82992
  chr19:23577749-23577846
  Hyper

SEQ ID NO: 115933 - DNA, 157 bp, Homo sapiens; identical to SEQ ID NO: 82993
  chr19:23577966-23578123
  Hyper

SEQ ID NO: 115934 - DNA, 511 bp, Homo sapiens; identical to SEQ ID NO: 82995
  chr19:23598357-23598868
  Hyper

SEQ ID NO: 115935 - DNA, 230 bp, Homo sapiens
  chr19:23654082-23654312
  Hyper
gcgcgttttctgggccgagggcgcatcgaggatgtgacccattccctggccaagggtgtgggtggggaacggcaaccgatctcactgcctggcggggcagcttcctttccaggcaaggcggagacctgcagggcgtggagaccccgcccggcgcagaacgcgctggccagtgggcagcttgacagggtccccgtgtgcctagcgaccctcttcagcgctgcatccatgag

SEQ ID NO: 115936 - DNA, 21 bp, Homo sapiens
  chr19:24099415-24099436
  Hypo
agctaccgtgcctggtgaatt

SEQ ID NO: 115937 - DNA, 386 bp, Homo sapiens; identical to SEQ ID NO: 83005
  chr19:24154442-24154828
  Hyper

SEQ ID NO: 115938 - DNA, 62 bp, Homo sapiens; identical to SEQ ID NO: 83006
  chr19:24215463-24215525
  Hypo

SEQ ID NO: 115939 - DNA, 163 bp, Homo sapiens; identical to SEQ ID NO: 83007
  chr19:24216917-24217080
  Hyper

SEQ ID NO: 115940 - DNA, 87 bp, Homo sapiens; identical to SEQ ID NO: 83008
  chr19:24305345-24305432
  Hypo

SEQ ID NO: 115941 - DNA, 78 bp, Homo sapiens; identical to SEQ ID NO: 83030
  chr19:28342286-28342364
  Hypo

SEQ ID NO: 115942 - DNA, 174 bp, Homo sapiens; identical to SEQ ID NO: 83031
  chr19:28402175-28402349
  Hypo

SEQ ID NO: 115943 - DNA, 71 bp, Homo sapiens; identical to SEQ ID NO: 83033
  chr19:28715584-28715655
  Hypo

SEQ ID NO: 115944 - DNA, 30 bp, Homo sapiens; identical to SEQ ID NO: 83034
  chr19:28918665-28918695
  Hypo

SEQ ID NO: 115945 - DNA, 24 bp, Homo sapiens
  chr19:29024540-29024564
  Hypo
gtgagactccgtttcaaaaaaaaa

SEQ ID NO: 115946 - DNA, 231 bp, Homo sapiens; identical to SEQ ID NO: 83039
  chr19:29145837-29146068
  Hypo

SEQ ID NO: 115947 - DNA, 584 bp, Homo sapiens
  chr19:29284242-29284826
  Hyper
agggaggaaggtttccggcctcccggaggccaaggcagaggcgctgggggaaggagcaagaagggaccagccgcccgcgcttcccgacgctgccaggcaggctcccgggacgggcagagctccgaggctgcctccgggcagtcacgtccaacgtacctgagcccggccagccgctgtcgctgtcgccgccgcactcgcctgtccggacgcaccttcctcctcctccgcggcccccgagaagctgggcgcgcaggcaagggaggcgcggcggcccctgcggctggtcagttcaccaggtgcctgctcccgagcgagttgccaccgaccccgccgcgcccggccgagccccgcgctccgcagcgtgggaaggagccgagcagagacccttgctccgagagcccggggtcggcgcctgctcattcctcgcgcagccgtggggcagcgggtggccccgggcgcgcgcgagcagcctcttctctggcacgcagaggccggctccgtgtcctcggccagccgccgtgggggcctcctccgcgctgcctcgcgtggtgcccggctcggcctagatgcggctgctgagagat

SEQ ID NO: 115948 - DNA, 86 bp, Homo sapiens; identical to SEQ ID NO: 83043
  chr19:29302897-29302983
  Hypo

SEQ ID NO: 115949 - DNA, 104 bp, Homo sapiens; identical to SEQ ID NO: 83044
  chr19:29425113-29425217
  Hypo

SEQ ID NO: 115950 - DNA, 43 bp, Homo sapiens; identical to SEQ ID NO: 83045
  chr19:29425457-29425500
  Hypo

SEQ ID NO: 115951 - DNA, 34 bp, Homo sapiens; identical to SEQ ID NO: 83046
  chr19:29505183-29505217
  Hypo

SEQ ID NO: 115952 - DNA, 30 bp, Homo sapiens; identical to SEQ ID NO: 83049
  chr19:29680159-29680189
  Hypo

SEQ ID NO: 115953 - DNA, 82 bp, Homo sapiens; identical to SEQ ID NO: 83050
  chr19:29716608-29716690
  Hypo

SEQ ID NO: 115954 - DNA, 30 bp, Homo sapiens; identical to SEQ ID NO: 45800
  chr19:29920756-29920786
  Hypo

SEQ ID NO: 115955 - DNA, 79 bp, Homo sapiens; identical to SEQ ID NO: 83052
  chr19:29930911-29930990
  Hypo

SEQ ID NO: 115956 - DNA, 30 bp, Homo sapiens; identical to SEQ ID NO: 83053
  chr19:29933086-29933116
  Hypo

SEQ ID NO: 115957 - DNA, 30 bp, Homo sapiens; identical to SEQ ID NO: 83054
  chr19:29969803-29969833
  Hyper

SEQ ID NO: 115958 - DNA, 3175 bp, Homo sapiens
  chr19:30015572-30018747
  Hyper
ctcctgggccatagacgaggaaactgaaaggcaggcactggaggcaagaagggctggccccgggcacccgctggcgaggacagccttggagagggcctgcagctcctcccctctgagctgtgctgcgctggccgcctggaccagggtggctgctggagagtgttttccctctgggtttccttctccttggctcccagggaatcctctggcggtgcctccgggaggctggtagccggggaagcaggcacgtgaatccaccgggctgccccaccccaacctgaggtcagagctgaggcgtaggggccggggtaggggcagaggtgccgaaacgcactagctggggactcccgggggaaggagataggagagacccaaggcgagccttaggactcgcccctatgactatgactacgcgctgcgtccgaaccacatgtccaccccgcatttgccttcggggaccagaccgcgctccctcagatggctggggagggagcagactccgggtgaaggctgggggaggtaccgggatgccgagtacgccagagcaggcgggggatgggttccggcttcctgccgcctcggcatctcgctttgcaccgggcaaagaaggggccacgaccggcgaagagcgcgtggagacacagggacccgcgatccaggggcaggaaccccgccccctcccggaaacctcccgggccctgagtcgtgcccggcgctccccaccccaccccacccccgccgcccctgccgtcactcacggccgctgcgggctggctagcgtgtgcgctctccgcgccgcaggcacctgctcgctgggcgctgtgcgctcacttctccctcgcgcactgcagactcccggcgctgccgccgccacccagcgtagtctccggctgggcacagcgttccgcccttctcgcggccccgggcgcccacccatccgtcatggcccaggcctgggccaaacagcggggcagctggttgcccaaactggggtaaggagttgagggctgggagctgcagagaggaccgagggacacacggggagcagggatgagcggccgtctcgagccgtgcagactgggaagaagccagggagagtttgggtgggaggactcccaacccaagcgggtgcggggcggggctgtactccaaccagaaagacggtggtccctccgagcgacccccgaggagagagggggagcgctctggggcgggggcggggcgggctgtggcaggagaggggagggcgggggcgatgcagcggtggaggcggcttggcgcccagccactgaccgccccctcccttcccctcccctccccctctccccgcctctctccggctccgggtccgccacgccggacccgctctccccgcgctgcgctgggtcggacgccaggtctgcgcgccgcggctgagcgcccactcgccctgcggaaagagccgcggaggaaccggcgggggcggctgcgggagccgaaggaggtggcaatcgggagcagaaccagaaggagacagggaggcagaagctcgcggctccgtggcacgcactccctcggccagggatgggtcccggcgcggcccagcccctgcccggcccgccgggcagagactgaaccgcggatccccaccgtcctgtggacgaccggacagagagaggcactgaccgatcgccagcagcctcccggtgggaccgcgtctcctgcacaccccgcgcagcgccccccgccggagccgcaccgggcaagccggcgagggagcggggctgattggcggccgccggcggccaggggagggggcgccgcgcggggccatggcaggctcggaggcgtcctagcccgagccggagccgatccgagcccacgcggccgccgcctctccgctcccgggcccccgccgccaccgcgccccccgcgggagatggaacagcggaaccggctcggtgccctcggatacctgccgcctctgctgctgcatgccctgctgctcttcgtggccgacggtgagcgcgggaactttgctgccgctgtggactcgggggggtctttgctggggccgccaccgagaagaagaagaaagagaacgaaccgggaagcttcgcggtctccagcaatcccgctgtgcagcctgggcccggaggggtagggagaggcgagcggcgaagggtcgccgcagcagcagcgccgcgcccgagtcgttcccagtcccgccggggccccggctgcggaaaggatgcctgcggggagcgggagtaggcgcgccccagccaggctctggcggtgcggccaggggcgggggagaagcacgagtcgcccctgccgccccgccccatccggagggaagcagtaggcagccgatggccggtccctgcctcggccctgcagccgcttccccgaactttgctagcccctccggccgtgcgccagggagcagctgcggggtggggggcacaaggccagccagccagagaccgactgcctcgctttaggttgccccaggcccccgacctacagctggtcacgcctctctctctctccccacccccagctgcattcacagaagtccccaaagatgtgacagtacgggagggagacgacatcgaaatgccctgcgcgttccgggccagcggagccacctcgtattcgctggagattcagtggtggtacctcaaggagccaccccgggagctgctgcacgagctggcgctcagcgtgccgggcgcccggagcaaggtaacccgccgcccacgcggtaccggcgcgcgcccggctcgcgcccggggcggcgaaggctaacccagggagggaagcagcgggcttcactcgcgcagggcgccgccctgtggcgcagcccatcttccaccttcgcatcccaaagcatcttcaaagtcagcagtggttacccccaaacctgtcaattattttgacagcatcgctgttcccaccacctcccagaactccattcacgcccagcccctaaagagccacacctcagcctggtcgcttgctcgtgctcgctggctgcggccctctgatgggtgctgggtagtgaaggaagcccccttggtcccatcaggctctccccgccctctgccactttgaggaccccagggctcccacggctgcgttccagaggccaccagaaaaccgagtaccggaaagccggcaggacctccag

SEQ ID NO: 115959 - DNA, 2267 bp, Homo sapiens
  chr19:30019113-30021380
  Hyper
accagggcagccacccgttggtcaggcaccatgctagctccaaagcccgcttcctcctgggaaactcttggaaagccggacgtcctttgtgccctcaacccccatcccccgggcggtttcggtcctagcctgccggaggagggtgcccttgcctaaaggcggatccgagttcccctagccagaaggccgcgagcctcacgtctctctctccctctttgcattttaggtaacaaataaggatgcaactaaaatcagcgtaagtgtggagcccagcgcgggccgcgggagaccccttctggccgcctcgggtcccgcagctccctcccttagcaagccgcggcggccgcgcatgtggggccgcgcaagtagggcagcgatcgcagccttgcatcggtggctgctcggcgtgtccgggcgccatctgtcgccggttgcagggtcgggttctcttttgtgtaaatcaagggtccaaggcttgagtcccctaattcggctcggcgctgacctgtaaaactccccttggtcggactgcgcgcttagggcctctcgcgcctgccagcctccgctctgcgggcattcctcctagcaccgggagcgcgcggctgctcgccctcgccgcgaccgtggcgccagcttcccgccccctctgccccgccctgagcatctgctctgcgccctccgctgcaaccctttatcctccgcctggattgcgggtctgggtgcggggtgttgcaggcttgcaggggacggggtagggggtggttgtgccaggctgcgaggggcccgggtcatggggttgctaactctgggaggagatgcgcccaagcttcccacctggagcgtagaaaggcctggagatgacgaagcctcctcgtgggctcggttcagaggtgagggctccctgggtgtttgttgagagccgtagagcagtacttcccgaagtccccaccggggcgcaggggaggagcacttcgctggggggcttctggagatcccgcggaaaggcgggttggtagcaggtggccagggagccaggcagcagcctcagcgttgcttgccttcttaagaaagcacagtgttagctgtaaagggcggggtccggtgacagggtggctttccttaggaagcgattcgggcaggccctccgtgctccgggaggtgaggagggccggctggggcgggactgtcggttggagcgcgtcggggcgggaaagacgtggggaagttaaggaacaaggaatccagcctggggtttcctgaaggtgcaggagggaggaaggagaggtggactctgcccttctgaagcgccagctacgggaagacaagcagtgttggtttgtatgggcggggcagatgcaaggtgggcgtttggttaacgtgatggggacgtggggacacagtccaaagagctggctgcctggcgtccacgcagagttggaagccctatgccactgggtagacgcgggtgaaagggaagccggatcgtgatggtgggcaaaccaggatccgggaagtgttggggtgcgcggatgagggggcgcgacggccagggtggccagaagagtaggtttgggagctgcccagcccggcctctaaccctgctctcttgcagaccgtacgcgtccagggcaatgacatctcacaccggcttcggctgtctgccgtgcggctgcaggacgagggcgtgtacgagtgccgcgtgtcggactacagcgacgacgacacgcaggagcacaaggcccaggcgatgctgcgcgtgctctcgcgcttcgcgccgcccaacatgcaggccgccgaggccgtgtcccacatccagagcagcggcccgcgtcgccacggcccagccagcgccgccaacgccaacaacgcgggcgccgcgagccgtaccacctccgagcccggccgcggcgacaagagcccgccgcccgggagccctcccgccgccatcgatcccgcagtccccgaggccgcggcagcctcggcggcccacacgcccaccaccacagtcgcggcagctgctgctgcctcgtcagcgtcgccgccatcgggacaggcggtcctgctgcgccagaggcacggctcgggtaagggatcgcggagagggggcgcacgcgcggggatggcgcagggctagggctgcgccgggacgccccggggggctccggacccaggacccgccccctgggcgcatttgcatatgcatactccttcctagttaggtcgggagcgccccccccagggccttcttcccgcggtttctctgtctt

SEQ ID NO: 115960 - DNA, 74 bp, Homo sapiens; identical to SEQ ID NO: 83065
  chr19:30056243-30056317
  Hypo

SEQ ID NO: 115961 - DNA, 30 bp, Homo sapiens; identical to SEQ ID NO: 83066
  chr19:30174182-30174212
  Hypo

SEQ ID NO: 115962 - DNA, 93 bp, Homo sapiens; identical to SEQ ID NO: 83067
  chr19:30188529-30188622
  Hypo

SEQ ID NO: 115963 - DNA, 30 bp, Homo sapiens; identical to SEQ ID NO: 83068
  chr19:30211721-30211751
  Hypo

SEQ ID NO: 115964 - DNA, 465 bp, Homo sapiens; identical to SEQ ID NO: 83069
  chr19:30215009-30215474
  Hyper

SEQ ID NO: 115965 - DNA, 39 bp, Homo sapiens; identical to SEQ ID NO: 83070
  chr19:30244714-30244753
  Hypo

SEQ ID NO: 115966 - DNA, 159 bp, Homo sapiens; identical to SEQ ID NO: 83071
  chr19:30252171-30252330
  Hypo

SEQ ID NO: 115967 - DNA, 30 bp, Homo sapiens; identical to SEQ ID NO: 83072
  chr19:30252886-30252916
  Hypo

SEQ ID NO: 115968 - DNA, 30 bp, Homo sapiens; identical to SEQ ID NO: 83073
  chr19:30259225-30259255
  Hypo

SEQ ID NO: 115969 - DNA, 135 bp, Homo sapiens; identical to SEQ ID NO: 83074
  chr19:30272553-30272688
  Hypo

SEQ ID NO: 115970 - DNA, 27 bp, Homo sapiens
  chr19:30329268-30329295
  Hypo
cacatcagtaatctacgttgaatgagc

SEQ ID NO: 115971 - DNA, 30 bp, Homo sapiens; identical to SEQ ID NO: 37384
  chr19:30334621-30334651
  Hyper

SEQ ID NO: 115972 - DNA, 30 bp, Homo sapiens; identical to SEQ ID NO: 83078
  chr19:30410677-30410707
  Hypo

SEQ ID NO: 115973 - DNA, 30 bp, Homo sapiens; identical to SEQ ID NO: 83080
  chr19:30416554-30416584
  Hypo

SEQ ID NO: 115974 - DNA, 388 bp, Homo sapiens; identical to SEQ ID NO: 45804
  chr19:30555329-30555717
  Hypo

SEQ ID NO: 115975 - DNA, 30 bp, Homo sapiens; identical to SEQ ID NO: 45805
  chr19:30562726-30562756
  Hypo

SEQ ID NO: 115976 - DNA, 30 bp, Homo sapiens; identical to SEQ ID NO: 83084
  chr19:30565672-30565702
  Hypo

SEQ ID NO: 115977 - DNA, 184 bp, Homo sapiens; identical to SEQ ID NO: 45806
  chr19:30579049-30579233
  Hypo

SEQ ID NO: 115978 - DNA, 30 bp, Homo sapiens; identical to SEQ ID NO: 83086
  chr19:30580294-30580324
  Hypo

SEQ ID NO: 115979 - DNA, 204 bp, Homo sapiens; identical to SEQ ID NO: 83087
  chr19:30588597-30588801
  Hypo

SEQ ID NO: 115980 - DNA, 30 bp, Homo sapiens; identical to SEQ ID NO: 83088
  chr19:30614219-30614249
  Hypo

SEQ ID NO: 115981 - DNA, 33 bp, Homo sapiens; identical to SEQ ID NO: 45807
  chr19:30636005-30636038
  Hypo

SEQ ID NO: 115982 - DNA, 76 bp, Homo sapiens; identical to SEQ ID NO: 83090
  chr19:30637494-30637570
  Hypo

SEQ ID NO: 115983 - DNA, 30 bp, Homo sapiens; identical to SEQ ID NO: 83091
  chr19:30646730-30646760
  Hypo

SEQ ID NO: 115984 - DNA, 163 bp, Homo sapiens; identical to SEQ ID NO: 83092
  chr19:30699747-30699910
  Hypo

SEQ ID NO: 115985 - DNA, 677 bp, Homo sapiens
  chr19:30713398-30714075
  Hyper
caacaagggccgcgccgggaggtctccccggggacccccactcagcttgctcaggtcctggaggcatgcagagggcgtcggcgccgacagggggagccggagagccccctgcccggccgtctgcggggctcaggcggggcttggcctccgatgagcgcgctgtctctgcccggtgggtcccaccccgcccggccacgcaaagccgtggcagccccctcgcggcagcgcgccccaggcgaagcaccccgggccaccgggagcgcggccctcccgagacgcacgggctccgaggccgcagaagccttgggcctccaggcctggaaggggctcccctggcctggaggccatgggcccggcccagaccggccagacaccgccagggacccccagaacgacgccaggacgcgcgccgggctccgtgcctcccacggcccaggcgaggccggcggctcgagggttaaaaggcgacccccattctgtaggggagaaagtgccttttctccaagtccatatggtcacttcctttcgacctgctcggccctgctcgcctctttgtccgctctgtcacttataaagaatcacttgacttacaataacaggttcaaaagacgacggagtataatcagttgatccacgaagaattggaataaagaacaccccaccgctcaggctatcat

SEQ ID NO: 115986 - DNA, 321 bp, Homo sapiens; identical to SEQ ID NO: 83095
  chr19:30714424-30714745
  Hyper

SEQ ID NO: 115987 - DNA, 603 bp, Homo sapiens; identical to SEQ ID NO: 83096
  chr19:30715266-30715869
  Hyper

SEQ ID NO: 115988 - DNA, 2731 bp, Homo sapiens
  chr19:30716203-30718934
  Hyper
tgaattatgccagggcgacaatggagagcgtttttaatggtacaatgcatttcacctaccagatagggggaggccgagccggggatggggatgtctgctggggctgggtgatgagtatcaatgaacggggcgattctgaaaagaggctgatgaaaatcgagcccgccctgccccggctgggctgggaacagttcgcagggctctgccgagtgggcgagtgaggcgcgcgagcagggcgcccgtcccccctcagccccggaaaatgatcaagtcaatcgtgtgggcatgtttcattattcattgaacacaatcttttacaacgctccgtttacgtgcccgagtttgctcctgacgcccgcgtttcaatgtttaaggtaaggaaaacaaaggtgggggggggatcgcggggcgcggcgcggtgcggggggcgcggcgcgggggggcggcggcgggtgggggggcagcttcggcgtccgggaggtggcaaagtgagtttggactcttggcgcggcccccccgtcccctccccctccccatctcggcgaggcctgccgcccggttccttctcgccccatcgcgattaaaaaatacggtctaattaaatatccgtggctgtgacgttggcgagagaagctgtcagcgggtggggggtggggggaaagaagaggaaaaccgagccggcggctgcggccgggcatcgtatggcgctagagaacttcggcggcgagcgggacctgcgcctgggccgccgcctccccgcccgcggtcccgggaccgttactttgaaaaggagtcccgaggcctggcgcccggcgcgcgatcgggaccccgcgtccagctccggggacccggccggcgccccccacccgcgagcggcccgcgagccactctcaggccccgggaaactttcaagagggtctggggggtggggggagtaaaaaggggagggggtaggctggggccgcggaaacttctgctcaagtgactttccccattttctcctctgcctgggacgggggttcgccttgcgctctttctctggtccgcgctcactgcggggttccggcccctccgcccgtggagagagggtaatttgcaaccttttttttttttcaattaaagttagctgatgcttacaatgtgtcaaacttgcgggcgccgagagccgctgagatctgccattttgtgattgcatcggcctcctgtgccccgggagcctggccaggctgaggccggagagttggtttcagggctgaggtgccagggtccgaacccgcgaccccaggaaaggccgtggcgcctgcaagcgcaggcggcgcccgcagcacctgccccagccgggcctcggcctgggggcccagccgggggccaaagaggaaataaataaataaataagtaacaggttatggagggaaaagagccggccagtcccaggctggagaaatgaggccaatcagagcgaggaagtgcgggcgtgggggctctggaaggcagaggagaggcagggcttgcgcggcgtctgggaagagtgcaatctggggggacgcctcccgtccccccagcgcagatgcatgactggggtaggaatgatctttgctgataagcctttttctgtttgcttcaagacattatttttcgaagatgaattgaggaaaacagtcgtaggcgagactcggggtgtattttaggcaaaaaaaaaaaagttagggttgggggagagctttcctttgatgagtaggaaagtgtccagatctcgacgcgcccatctgttgcagttttgcaaataatttaaaatatagatatctccatatagacggatgtatgtgaagtggaggaaggtcgaaacgcggggaagttagggaaaaagaaagaaaaagggctgggcagagagagacctgtgttgctcactcttcactctgcggagtgaactccggcagggctttctttggggacaggtggaaagttaagtcccccccttttcacttctgtattgtgagtggttcctactgtgtgcctgttggagaacatgtccaccgttcccgagttaggtggaggattggaatgttggggggcggggagcgttggagttgaggacgcagtggccaggggctgggggccgagaaagagcagggcggggtctcagccccgcgtgcgggtggcagcggcggccgggttttgtttgccagatattgttatgtctaacgggtgcctcgccggagacgtgatttgtcagccgccttcgttttcactttagcagaaaatacggcagctgcgaggtgtcccggcctgcggggctcgggcacccggtgcgtcctgggggctgggtcgtgtgcgcgggtgggagccggcggccggcggggccggggcgaggggcgagcgggaggggcggagtgagcgagcgcgcggtacggccctccggttcctcctgcgccttctcccggcagccgccgccgccgccgccgccgctgtgcaatttagcagaaatccgacaggggccgcgtttgctgagcgcatccggcggccgggcagcccgagcgggccgccgggcctggtcggccggtgtagaggcgcggagggggccggcggaggggaccggcggggatgggcgcgggaagcacgcctgaccagagcacgcgccgttccccaaccctggtgtccccggcgagttgggcagccccgcgcgccctgaccttgacgccccagtctccagccagggcttaggtgaacttgg

SEQ ID NO: 115989 - DNA, 1051 bp, Homo sapiens
  chr19:30718994-30720045
  Hyper
gagactgggaacgcgctgttttctttcccagtttgatactagcaactggatttttactttaagaccggctttgctctctgctggggttgggagggggggcgatcttttcccatcactcacatctttgttcattgttcactgagtggaaggcaggcgacttaaagagacgaaagagaggaaaaaggggtgagagacggagagaggaaaaagaggggggcggccagaagagggaaggagaggcgtggggacagggcccccgcccccgccggggtcgggtttgatggtgaaatagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatcccgcgcctcccagtccggagtccatttgcataattggattttttttttttgcctccttctttctccctgaaacttgtttgaaaacccaagtgaaaaccgcgacgatctgcacactcaaaagcaagtgccaagtaagtgccctgcggtggcctcggcgcgccccggggtgagcgcgcaaagccgggagcgaggtgccgcgagctgcgcgccgccccgggccggcctcgcgtgtgggcggctgggcggctgggcggcgggaggacggcctccgcgggctccgggactgcccggctggctgctcgcacaactttttttttttcccccgtctgctgacttttcgggccaggtgaagtgtttgggccacgcgtgtacctgtggcgagactcgggaggcgatcttggggggcgcgcggtcgcagttgggcatcttgcctgggtcgggggcgggcagtcggtcccagtggccgccgctgagggcagagctgcgagcgagcggggccggctgctggtcgcgccgcgccgtaaatgcaagcctgtagccaaatgcttcccccattattctaaggtttgtgtctgcgtgtgcgtgtatgtatgtgt

SEQ ID NO: 115990 - DNA, 30 bp, Homo sapiens; identical to SEQ ID NO: 83102
  chr19:30769986-30770016
  Hypo

SEQ ID NO: 115991 - DNA, 1044 bp, Homo sapiens
  chr19:30865459-30866503
  Hyper
cgccctgaagaaaggcgccttggcaccgcctcggtgcccaccagaaggtgcccggattgcctcttttgcgcaaagacaaagggggtaattttttggcaagaaaacaaacccaaggaaaacacaacaaactgagtgttgtttttttttctttccctcctgcaacttctcggaccgtctctgccctctctcctccagagagggcgagtttcatcctggagggaggccgggggagctgcgaggccacccccagccggcgcccgggcggattgcgagcccccgcgggtccggccgggggagcggagactggccccccgcccgggctggggcgcctgccgcccgcgagccggaagagcgccccattcacgagcaggcagccctggcagagggttaattgaggatcattgttgttggttccaggaggagcgaagcgcctggagatcgggcgcgcgggcgcggctctgggagcgggggaaggtgaggggaaatgggacatgatggcattaataatcgttaccaaagacggtgggagtaacaaaggaatgcgtctccgagacgccgcccagccccggggtgttttctggcgcggtcgcggtgcaggaacgcgagccccgccgccgagcctcccgccgcctgcgttcgttggcgcggcgcccggcggtagtgccaccccgaggccgagcgctgcccccgccggcccgcggctgccagccggccctgcccgcgcccgggccccgcgagcggccgcacttcaccttacggaggggagataatgagatcaattagaggcgccgtcaccgcgccggagacagctgccgccgcatagtaatcacccgcgggctgggtgcgcgggggctccccgctacctgcgcgcctgctgctcccaccacgcggcaccgacccgggcgcgcccccggcccctgtccgcagcccacagccacaccgcgcaccctacaccctccttgcgcctctgctggggagctcaccccctccactcgcacagtgcgctgcggcccggggtgtgggaggtcccgggacttggggtgt

SEQ ID NO: 115992 - DNA, 32 bp, Homo sapiens; identical to SEQ ID NO: 83105
  chr19:30901662-30901694
  Hypo

SEQ ID NO: 115993 - DNA, 95 bp, Homo sapiens; identical to SEQ ID NO: 83106
  chr19:30931166-30931261
  Hypo

SEQ ID NO: 115994 - DNA, 182 bp, Homo sapiens; identical to SEQ ID NO: 83107
  chr19:30934382-30934564
  Hypo

SEQ ID NO: 115995 - DNA, 354 bp, Homo sapiens; identical to SEQ ID NO: 83108
  chr19:30935523-30935877
  Hypo

SEQ ID NO: 115996 - DNA, 223 bp, Homo sapiens; identical to SEQ ID NO: 83109
  chr19:30954451-30954674
  Hypo

SEQ ID NO: 115997 - DNA, 142 bp, Homo sapiens; identical to SEQ ID NO: 83110
  chr19:31017204-31017346
  Hypo

SEQ ID NO: 115998 - DNA, 53 bp, Homo sapiens; identical to SEQ ID NO: 83111
  chr19:31038908-31038961
  Hypo

SEQ ID NO: 115999 - DNA, 30 bp, Homo sapiens; identical to SEQ ID NO: 83112
  chr19:31057923-31057953
  Hypo

SEQ ID NO: 116000 - DNA, 55 bp, Homo sapiens; identical to SEQ ID NO: 83113
  chr19:31117725-31117780
  Hypo

SEQ ID NO: 116001 - DNA, 247 bp, Homo sapiens; identical to SEQ ID NO: 83114
  chr19:31210572-31210819
  Hyper

SEQ ID NO: 116002 - DNA, 87 bp, Homo sapiens; identical to SEQ ID NO: 83115
  chr19:31213098-31213185
  Hypo

SEQ ID NO: 116003 - DNA, 79 bp, Homo sapiens; identical to SEQ ID NO: 83116
  chr19:31217835-31217914
  Hypo

SEQ ID NO: 116004 - DNA, 134 bp, Homo sapiens; identical to SEQ ID NO: 83118
  chr19:31567889-31568023
  Hypo

SEQ ID NO: 116005 - DNA, 205 bp, Homo sapiens; identical to SEQ ID NO: 45810
  chr19:31587355-31587560
  Hypo

SEQ ID NO: 116006 - DNA, 30 bp, Homo sapiens; identical to SEQ ID NO: 83121
  chr19:31768075-31768105
  Hypo

SEQ ID NO: 116007 - DNA, 30 bp, Homo sapiens; identical to SEQ ID NO: 83122
  chr19:31770460-31770490
  Hypo

SEQ ID NO: 116008 - DNA, 172 bp, Homo sapiens; identical to SEQ ID NO: 83123
  chr19:31780548-31780720
  Hypo

SEQ ID NO: 116009 - DNA, 243 bp, Homo sapiens; identical to SEQ ID NO: 83124
  chr19:31804724-31804967
  Hypo

SEQ ID NO: 116010 - DNA, 1577 bp, Homo sapiens
  chr19:31839600-31841177
  Hyper
aaatgaggaatcaatcgtgttagtactaaggtggccgaggggaccggctcgctcactcgttcgcgctccctggctcggcggacaccaggcagtcccccggcggtcggccgctcggaggacgcggaagatgtcccggggaactcaggtgaccccgcccgccacccacagaaagagccaggccggggttgcttcccattccctctgcagccggagagctgaggaggtagggacctggcgcggctcagcgcgctccgcgagcggctccccaaatgggtgcgagagggaagagggcagagcgcggcggggcgtccggggggcgcccggtacccgaggcgggcgcacgcacccaaacaggagagcggcgcccggagttactcagtgcgggcagaagagcggggcgaggagcggggtcgcgcccgctggaggcgcggggcgagcggaggaagaggaggaggagagcagaaggaaggggaagcggctcgtacctgctgcgcgccggggcgcctgctgcttcctcctcggcatgatgcttctccggcgactgccactgccgccgccgccgccgctgccgggctgaggacagggagggagggggcggcgggcccgcgggggggcgaggcgggcctgctctcagcctcccccccggagagcggccgcccgcaggatgctgctgcgcccaggctctccgcgtcccccccgcgccgcgctccgccgcgaaccccgaacgtgcggagggaagaaggagggcgggcgagggaggctcggggagggaggagcacgggggggaggaggaggcagaggaggaggaggtggaggaggaggaggaggaccgcgctgccggcggaatgggaagtttgacaaatcgctccagaggccagaggaggagggggcggggaggagcggcggccctgcccccccccgccccgtccccagacgaggtgcgcggggttcggggctggggggcggggagagggcgggcagagcggtgggaggaggagcgcgggagcggcccggaccggtactgccccggcccccgcccctaggccgggggtcacggcatccggggggacgcgcagccgccgccgcggcccggggctcggcggtccagtcttctgcccgtggcgcggctggagcggcggcgtcggcaacaggcaagcttaaaggaaaaggagatgatcgtgtcaatcgcccgcccgcgggggcgccgcgcccccgcccccggccccaggcccgcgtgggacccccgccccgccagcgaaaggggtgccgcccctccgcctccgccccgtgcgcacacgcgggggcgcggcgccagccccgccgagcccgtcccggggcgctcgttaccccccacccctattcccacccagcgttcgtccccagccaccccccagctgccccacccggctcgcactcctctccacccgccgactccggagcccccagcgtggtccccgggccggggctggcgtcccccggggaagccagagcccacgggcaggccccctccagggaggaggcgggcgcgggccggggcgggtgggggcagccctcagaccccgcgccacccagctcct

SEQ ID NO: 116011 - DNA, 173 bp, Homo sapiens; identical to SEQ ID NO: 83127
  chr19:31841410-31841583
  Hyper

SEQ ID NO: 116012 - DNA, 88 bp, Homo sapiens; identical to SEQ ID NO: 83128
  chr19:31841908-31841996
  Hyper

SEQ ID NO: 116013 - DNA, 669 bp, Homo sapiens
  chr19:31842200-31842869
  Hyper
aagatcaaaagtctccgctcgcccagcctgcgggcttgggctgggtccagacgtctcccaggatgcagatgcgccgccgctggcctccccggctataaagccgcctccagcgcctttccgcgcgcaggagcgctcggagttgtggggtacggaccccaggcggggcagggagtccgaggcgggctgcggcggggctctcgggctggcggactcgggggctgaggcgccgtgcgcgttgggtgcccgcggccgcagaggccagaaccgctactcctccaggccggggagacgcggccgtggagcgtgaaacgcttcttgcaagcgaggaaacggtgagttggccgacaccgccggcggcctcaccattctggtggccgcgctgagctcctgtcgcctggaggcgggttgcgccgcacggggtcagctcccgccggctcccagctcaccttcgaagctcccacttaggcgcgcccggtgcggcgtgtgcacagcgcggggcgccgcacacggaagcgtgtagttctccctggtcgcgcttttctcctcctttccatcccctcgctgttcttgcaaacctctgttccttcggccccctcccactgcgggccgcggcctgaactcgggtctccgcgtagccggccgccgccgctgggtcgctgcctggccctc

SEQ ID NO: 116014 - DNA, 249 bp, Homo sapiens
  chr19:31847973-31848222
  Hyper
gctttcctgcgcgggcgatggctcctctctggcgcggagggcacccacatttgcatgataaattgaccagactggcggcagccaatgaaatattcaaattaggctgggtggcggtagtaggggtggagtccctggggctgccccttggcgcggcggcgggagcgggcgctaccacctctccgtcagcgccctctggaggcgggacagcgcgggcggccgctctggcccaaaagacgagatggggggttg

SEQ ID NO: 116015 - DNA, 30 bp, Homo sapiens; identical to SEQ ID NO: 83133
  chr19:31956583-31956613
  Hypo

SEQ ID NO: 116016 - DNA, 30 bp, Homo sapiens; identical to SEQ ID NO: 83134
  chr19:31993710-31993740
  Hypo

SEQ ID NO: 116017 - DNA, 30 bp, Homo sapiens; identical to SEQ ID NO: 45812
  chr19:32026024-32026054
  Hypo

SEQ ID NO: 116018 - DNA, 76 bp, Homo sapiens; identical to SEQ ID NO: 83136
  chr19:32078937-32079013
  Hypo

SEQ ID NO: 116019 - DNA, 160 bp, Homo sapiens; identical to SEQ ID NO: 83137
  chr19:32083599-32083759
  Hypo

SEQ ID NO: 116020 - DNA, 32 bp, Homo sapiens; identical to SEQ ID NO: 45814
  chr19:32232273-32232305
  Hypo

SEQ ID NO: 116021 - DNA, 30 bp, Homo sapiens; identical to SEQ ID NO: 83143
  chr19:32268791-32268821
  Hypo

SEQ ID NO: 116022 - DNA, 504 bp, Homo sapiens; identical to SEQ ID NO: 83144
  chr19:32364179-32364683
  Hypo

SEQ ID NO: 116023 - DNA, 30 bp, Homo sapiens; identical to SEQ ID NO: 83145
  chr19:32366594-32366624
  Hypo

SEQ ID NO: 116024 - DNA, 35 bp, Homo sapiens; identical to SEQ ID NO: 83148
  chr19:32454989-32455024
  Hypo

SEQ ID NO: 116025 - DNA, 32 bp, Homo sapiens; identical to SEQ ID NO: 83149
  chr19:32471100-32471132
  Hypo

SEQ ID NO: 116026 - DNA, 58 bp, Homo sapiens; identical to SEQ ID NO: 83150
  chr19:32516346-32516404
  Hypo

SEQ ID NO: 116027 - DNA, 84 bp, Homo sapiens; identical to SEQ ID NO: 83151
  chr19:32532918-32533002
  Hyper

SEQ ID NO: 116028 - DNA, 30 bp, Homo sapiens; identical to SEQ ID NO: 83152
  chr19:32570308-32570338
  Hypo

SEQ ID NO: 116029 - DNA, 30 bp, Homo sapiens; identical to SEQ ID NO: 83153
  chr19:32630194-32630224
  Hypo

SEQ ID NO: 116030 - DNA, 89 bp, Homo sapiens; identical to SEQ ID NO: 45817
  chr19:32672320-32672409
  Hypo

SEQ ID NO: 116031 - DNA, 588 bp, Homo sapiens
  chr19:32715369-32715957
  Hyper
gctgccaccaaaacccgctccgagggccccgccgggccgccctggcagctggaaaagcgcattcctgctcgcccgaggatgcagaaggcaaccgagtccccgggcggcggcggggcaactgcggaaatcacgcagccagatgaagctcataaatttcccctatgaacaattgttttcatttccctcccatgccactagatattataagtggaaagcaaaacacaagtaaatatgttcattccgctcttgcgatcggtgataaaccggaggcggccgaggccgacagaggtcagcaggccgctcgccacgggtctgcgagcggacactgccaccctccggccgcgcgcgggactgcaccggccccaccgcccggctctcccgcccgctcgctgcccgccaatgttcgctttgcgcccttcgctcaatgtgcgtgcaaattacagggacattcgaaaggacagagagctcccatatttaaaataatcatttttgttcatcataacctctcttccagagataaccgctcttattaacgttttcgtacaattatctccagtctttatgtgcattctacgatgtcttctgtgt

SEQ ID NO: 116032 - DNA, 93 bp, Homo sapiens; identical to SEQ ID NO: 83157
  chr19:32718922-32719015
  Hypo

SEQ ID NO: 116033 - DNA, 30 bp, Homo sapiens; identical to SEQ ID NO: 83158
  chr19:32753918-32753948
  Hypo

SEQ ID NO: 116034 - DNA, 30 bp, Homo sapiens; identical to SEQ ID NO: 83159
  chr19:32832651-32832681
  Hypo

SEQ ID NO: 116035 - DNA, 30 bp, Homo sapiens; identical to SEQ ID NO: 83160
  chr19:32834773-32834803
  Hypo

SEQ ID NO: 116036 - DNA, 145 bp, Homo sapiens; identical to SEQ ID NO: 83161
  chr19:32835111-32835256
  Hypo

SEQ ID NO: 116037 - DNA, 30 bp, Homo sapiens; identical to SEQ ID NO: 83162
  chr19:32835942-32835972
  Hypo

SEQ ID NO: 116038 - DNA, 23 bp, Homo sapiens
  chr19:32853027-32853050
  Hypo
caagtgtccgcccaccttggcct

SEQ ID NO: 116039 - DNA, 42 bp, Homo sapiens; identical to SEQ ID NO: 83165
  chr19:32898448-32898490
  Hypo

SEQ ID NO: 116040 - DNA, 141 bp, Homo sapiens; identical to SEQ ID NO: 83168
  chr19:33143094-33143235
  Hypo

SEQ ID NO: 116041 - DNA, 20 bp, Homo sapiens
  chr19:33143475-33143495
  Hypo
catcccgggggtagggtgtg

SEQ ID NO: 116042 - DNA, 605 bp, Homo sapiens
  chr19:33166918-33167523
  Hyper
cctggggaggatggacgagggagcgggggaccgctaacggggctccctctgcgcgccccgtccgcagaggcgcacgtcgagggtcccgggcgggctccgtggacgttggcggtagcgccgagcgagtcacggaccatgaagagcgttcgtgccgcgcggcccaaggccgggatgggggttagccacatcctgccgcgctgagggggaggctaacgggcgcgggcggccgggcccagccggagcccaccgcgatggcgagggaggagtgcaaggcgctgctggacgggctcaacaagacgactgcgtgctaccaccacctggtgctgaccgtcggtggctcggcggactcgcagaacctgcggcaggagctgcaaaagacgcgccagaaggcgcaggagctggcggtgtccacctgcgcccggctgactgctgtgctgcgcgaccggggcctggccgccgacgagcgcgccgagttcgagcggctctgggtggccttctcgggctgcctggacctgctggaagcggacatgcgacgcgcgctggagctgggcgccgcgttcccgctgcacgcgccgcggcggccgctggtgcgcacaggtgtggct

SEQ ID NO: 116043 - DNA, 64 bp, Homo sapiens; identical to SEQ ID NO: 83173
  chr19:33167843-33167907
  Hyper

SEQ ID NO: 116044 - DNA, 156 bp, Homo sapiens; identical to SEQ ID NO: 45822
  chr19:33415273-33415429
  Hypo

SEQ ID NO: 116045 - DNA, 72 bp, Homo sapiens; identical to SEQ ID NO: 83175
  chr19:33425338-33425410
  Hypo

SEQ ID NO: 116046 - DNA, 50 bp, Homo sapiens; identical to SEQ ID NO: 83177
  chr19:33468018-33468068
  Hypo

SEQ ID NO: 116047 - DNA, 26 bp, Homo sapiens
  chr19:33557330-33557356
  Hypo
ttaaccacctccgttttctaggctgc

SEQ ID NO: 116048 - DNA, 23 bp, Homo sapiens
  chr19:33557746-33557769
  Hypo
aaaaaaaaaaaagtccgggcgcg

SEQ ID NO: 116049 - DNA, 92 bp, Homo sapiens; identical to SEQ ID NO: 83182
  chr19:33685144-33685236
  Hyper

SEQ ID NO: 116050 - DNA, 83 bp, Homo sapiens; identical to SEQ ID NO: 83183
  chr19:33685570-33685653
  Hyper

SEQ ID NO: 116051 - DNA, 118 bp, Homo sapiens; identical to SEQ ID NO: 83184
  chr19:33685902-33686020
  Hyper

SEQ ID NO: 116052 - DNA, 354 bp, Homo sapiens; identical to SEQ ID NO: 83185
  chr19:33716410-33716764
  Hyper

SEQ ID NO: 116053 - DNA, 363 bp, Homo sapiens; identical to SEQ ID NO: 83186
  chr19:33717533-33717896
  Hyper

SEQ ID NO: 116054 - DNA, 30 bp, Homo sapiens; identical to SEQ ID NO: 83187
  chr19:33781895-33781925
  Hypo

SEQ ID NO: 116055 - DNA, 138 bp, Homo sapiens; identical to SEQ ID NO: 83188
  chr19:33792492-33792630
  Hyper

SEQ ID NO: 116056 - DNA, 84 bp, Homo sapiens; identical to SEQ ID NO: 83189
  chr19:33793876-33793960
  Hyper

SEQ ID NO: 116057 - DNA, 397 bp, Homo sapiens
  chr19:33794400-33794797
  Hyper
caccgcttcctcccccgcctccccattcaggtgggcgccaacggcgggagcgagggtgtccaggccgccgggctgccaggtccgagcacgcacagggagaactctgcccagtggttcgccgggcgctgtagtccccgggatcctagggaccgaggcggccaggccctggggccccttgagtgcggcagctaatgctctcaccgcggcgggggaaggagcttgccaccgagacccccagccacgtgcgtccctcgcattctttaccggggccggggtggcggctacggaccgtcagctgggcccagatggagtcttgggagccctcaagtgtctcctgtccttgcccgcgccgcccctcgccactggcgctgaggcctgacgccgcctgcgtcccggc

SEQ ID NO: 116058 - DNA, 204 bp, Homo sapiens; identical to SEQ ID NO: 83192
  chr19:33907896-33908100
  Hypo

SEQ ID NO: 116059 - DNA, 41 bp, Homo sapiens; identical to SEQ ID NO: 83193
  chr19:33950319-33950360
  Hypo

SEQ ID NO: 116060 - DNA, 30 bp, Homo sapiens; identical to SEQ ID NO: 83194
  chr19:33996127-33996157
  Hypo

SEQ ID NO: 116061 - DNA, 30 bp, Homo sapiens; identical to SEQ ID NO: 83195
  chr19:34048983-34049013
  Hypo

SEQ ID NO: 116062 - DNA, 2090 bp, Homo sapiens
  chr19:34112213-34114303
  Hyper
aagggagcacctgttcgcagggcactttcagcagaatctagagccccagggatttgaggatggatgcggacacccgggcctgaggcagctcgcggccttgaccgaattccacgcgagctgaagcccagggatatcccagaatcttcctcaggatcaatcttccgcctttcaccggccctgcgcccccgcagcatcgggtcctgggcgcgcgcccctgccccgctgtggtcaaggcccgccccggtgacgcctggtccttttcccgggttggcgccgcgtgcgacccaccgaggcagtggcagcactggccgcggtctggagcctagcgtcaggccggagtccggctctcctgaaccgggagaccggcgcagccccagccacgaccgctcccacccccgcggccgccggaccgcgcccagcagcgactctttctgagagcgctgccagaggggccgcgggagccgcagagcgcgcgtgggcgcggcgcccgcgagcccccgggagggccgagtgcatcgctggagcgatccccgcccggcccggccaccgccgtagccgccaccacggcggggcggggcacgggccgggggcggggcgccgggcgggcgcggcgctatttccagcctcgccggaggcttcgctctcacttcgctgggagccttcccggcgcgcaagccggatccggcagtgctgcggggaggagagaggacgaggcggcggcggcagcaggaggtgggggaccgatcgcgccgggggccgaagaggaacgccgccccgcgccctctcgctccccgcacgctccggctgccggccccacgctgctcgcccacagatcgcactgggttccgcttggagcgggcggaggcaccgggcccgagctgggtcggaggtcctctccgccgcctgcgcgccccaagcagaggatccgccgcggagaaccgctcccggactggaggcgcccgcggcctcgggtgcgtccgctgcgccaggtaagtggctgcgcccctgccccacccctgttcccgccctgcgcaggctcctggcctgcagagacgccaggaaggggtcccgagcgggccccggactgcaccgctcgccatccccgccaccgcacgcgaatgggagtccgaagctgcgggcggaggtgggcgcgcggggctcgggtctggttgcactttggggaccggccccggtagcgggaactttaattagactttctctccttggatctcactcgctgccgcgcttctgggaactgccgtccctcgggccctcttggtccctgcggactcccgctccgcctcctggccctcggtgctgcccgcggggaggcggcgtcgggcgctgagcagcgagcgccgagggccaggcaggagcgctcggggcgctggggcttcctggcgcgctcggagccggggctccggacgggttgcggcgggcagagactatgggggaagtttaagtggccttggcttcctacccagcggctccgtcgcgcgcgtccccgacccgcaactctccagggcaccggcctgtgagtgctggaggcgagtgtgcgtgcgtcagcgatggtgtgaaggtgtgtgcgtgcgtgtgtcgggagtgcgggagtcggagcctggggcggctccagggggcggggaaatgatccgtttggccgcgggaccgagccgagctctgacggcggctgcaactccggctaccgactctgcagacccgctctggcctcgctggaggccagccgggccaggagggcgatcacgggttttggcagtgcccgatgctggggcttgggtctgatgtgaccccgattccttctccagtgcgggactcccgccgccctaactttcgcgtacatcttgtctccaggcccgcgaccccgacccggagttgaagcggctgcggcgccctcggctgtgggcgctgctgcccggctgtctgttttaacccagaagtaggcgccgatcctggggctctctgtcctgcagtcgtctccggcgtcccagaggactctgcgtccctgggccactcccgctggctcaggagccgtgatcagctccgttaaggggaacgcgcgtcccggcccctct

SEQ ID NO: 116063 - DNA, 130 bp, Homo sapiens; identical to SEQ ID NO: 83202
  chr19:34175192-34175322
  Hyper

SEQ ID NO: 116064 - DNA, 75 bp, Homo sapiens; identical to SEQ ID NO: 37419
  chr19:34175542-34175617
  Hyper

SEQ ID NO: 116065 - DNA, 189 bp, Homo sapiens; identical to SEQ ID NO: 83204
  chr19:34263083-34263272
  Hypo

SEQ ID NO: 116066 - DNA, 56 bp, Homo sapiens; identical to SEQ ID NO: 83205
  chr19:34263838-34263894
  Hypo

SEQ ID NO: 116067 - DNA, 30 bp, Homo sapiens; identical to SEQ ID NO: 83206
  chr19:34268680-34268710
  Hypo

SEQ ID NO: 116068 - DNA, 179 bp, Homo sapiens; identical to SEQ ID NO: 83207
  chr19:34272529-34272708
  Hypo

SEQ ID NO: 116069 - DNA, 588 bp, Homo sapiens; identical to SEQ ID NO: 83208
  chr19:34288087-34288675
  Hyper

SEQ ID NO: 116070 - DNA, 32 bp, Homo sapiens; identical to SEQ ID NO: 37421
  chr19:34311466-34311498
  Hyper

SEQ ID NO: 116071 - DNA, 108 bp, Homo sapiens; identical to SEQ ID NO: 83210
  chr19:34396791-34396899
  Hyper

SEQ ID NO: 116072 - DNA, 32 bp, Homo sapiens; identical to SEQ ID NO: 83211
  chr19:34397391-34397423
  Hyper

SEQ ID NO: 116073 - DNA, 16 bp, Homo sapiens
  chr19:34436559-34436575
  Hypo
gcgcccagccatcagc

SEQ ID NO: 116074 - DNA, 39 bp, Homo sapiens; identical to SEQ ID NO: 83214
  chr19:34558335-34558374
  Hypo

SEQ ID NO: 116075 - DNA, 23 bp, Homo sapiens
  chr19:34896337-34896360
  Hypo
accgcgcccggcctttcttaagg

SEQ ID NO: 116076 - DNA, 1583 bp, Homo sapiens
  chr19:34972183-34973766
  Hyper
gtggggacgcatctgcgctaggcgcacagtattcctgggcgcgggacgggcgaagcgccgtgggttccaagctgagctgggtcggccctgcagcgccggagagcaaggcggcgcagggaagggagatggggcgggatgtggggaaagctgtcgactgcttggatctctccggcccggatggcgccagctgcctccagctcagcctgcggaaatccgagctcttcccagcggcccgacggcccgggcgccccgcagaccctgggctctccccgcggtgcctccgccgcccgcccctgcgtcctggcccggcctccacgcccctccgaggtcccggcgcagcgcggccgccgccactccccccacattccagaggccgcagcgccgtctccttcctcgcattcctgcccccgcaaaggagtccctccgccccgcgcgaggccgcggcgaggagggggcgcggcccggcgcctgggagcttacattcctccgccgcgcgcgccgccgagcagggcgccgcgtcccccggcccgcgcgtggccgccggaacgaccccggcccggcgccggccccgccccgccccgcgcccaggggtcccggggcgggctccgggcttcgggcggacgatgcggcggcccggccggagcggcggcgggaagcggaggcggaggtgacgcgccagggccggcgggccgggccatgcagcgctccagggcgggcgcggacgaggcggccctactcctggccgggctggccctgcgggagctggagcccgggtgcggctctcccggtcgggggcggcgggggccgcggcctgggcctggagacgaggcggcgcccgcgctgggccgcagagggaagggcagcggcggccccgaggccggggcggacggactgagccgcggggagcggggtccccggcgcgcggcggttccggagctcagcgcgcagcctgcgggcagcccacgggccagcctggcggggtccgacggcggcggcggtggcggcagcgcccgatccagcggcatcagcctgggctacgaccagcgccacggcagcccgcgctccggtcgctcggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggagggcggcccaagcgcggccgagcggcggctggaggcgctcacccgggagctggagcgggcgctcgaggcgcgcacggcgcgggactacttcggtgagctcgctcggcccggcagttccctgcgcgcatggctggggtccggggttccgagactgcctcgggtaggcggccggatcagcggaggagagcacggggctggctgggggtgcagcagtgcacggggttgggacgaggaaggtgcatcccctggggactggggagcgcaaagggtgagtgagtgcgcctggatccccagcagcggcttcacccctgc

SEQ ID NO: 116077 - DNA, 414 bp, Homo sapiens
  chr19:35068466-35068880
  Hyper
caggagacccagcagcgccagggctcgggcggacgccacgcggttcggggtcggggccggtaggtatgcgggtcacactggggcagtgcggacgcaggtccctctggcatctcgggagacgcggtccttaaactccgtgtcctgggggcgggcccgggtggcgtggcttggctggacagggagggtaggggcggtagtggggtttgtggcactccagcgtagcaggttgcatctgcgggtccccgcccctgccccgcccccagcccctcccatggtgctggatccaggcagctgatgtgcaggcggggacccctggctgggcgcggtcctgggcgcgtccctgcgcggttcaggcttccatgcgcgctgagactccgctggctctgtggcctgccccgtcgtgtgtgcgtcacg

SEQ ID NO: 116078 - DNA, 85 bp, Homo sapiens; identical to SEQ ID NO: 83228
  chr19:35168907-35168992
  Hyper

SEQ ID NO: 116079 - DNA, 412 bp, Homo sapiens; identical to SEQ ID NO: 83229
  chr19:35263586-35263998
  Hyper

SEQ ID NO: 116080 - DNA, 30 bp, Homo sapiens; identical to SEQ ID NO: 83230
  chr19:35316742-35316772
  Hypo

SEQ ID NO: 116081 - DNA, 139 bp, Homo sapiens; identical to SEQ ID NO: 83231
  chr19:35323440-35323579
  Hypo

SEQ ID NO: 116082 - DNA, 41 bp, Homo sapiens; identical to SEQ ID NO: 83232
  chr19:35343555-35343596
  Hypo

SEQ ID NO: 116083 - DNA, 21 bp, Homo sapiens
  chr19:35368034-35368055
  Hypo
accaaataggccgggcgcggc

SEQ ID NO: 116084 - DNA, 566 bp, Homo sapiens
  chr19:35395923-35396489
  Hyper
cccagctgcaagggccggcgcacccacgcgcactggttgccaaatctcccgctttcaggccaggtgcggagcgcgcctcgacagtcctgaacattctccacttaacggctgagagccgctgggagcctaacgcctgcaaccgagtgagctcgagtccggctggggtcggaccgttggacctccccgttggccctttgttgtacttcttcgcgccctgggctcgcgcaagctttctctgccacgcgttccaacggccgctcaccggcatcgggctgaacacggtgcgcttcacctcggagttcccactccactccaaggatccaacagcgcacaagctgctcttcacgggcaactacctctgcaagcttcacccccggccccgccacgccccgcagggttccctgtctggtctggatcacctcgctctccctgcgcctctctccttggcctagctagacaagtgcttctcacgatccagcgcgtttaccgctcggtttcgtcgccgctaaggggtggtggtgtctgatccgtcaggctctgcgcttctctctcggatccatcctcaa

SEQ ID NO: 116085 - DNA, 111 bp, Homo sapiens; identical to SEQ ID NO: 83237
  chr19:35454422-35454533
  Hyper

SEQ ID NO: 116086 - DNA, 16 bp, Homo sapiens
  chr19:35497210-35497226
  Hypo
gcgactctttgtctcc

SEQ ID NO: 116087 - DNA, 165 bp, Homo sapiens; identical to SEQ ID NO: 83239
  chr19:35503957-35504122
  Hyper

SEQ ID NO: 116088 - DNA, 97 bp, Homo sapiens; identical to SEQ ID NO: 83240
  chr19:35524526-35524623
  Hypo

SEQ ID NO: 116089 - DNA, 139 bp, Homo sapiens; identical to SEQ ID NO: 83241
  chr19:35531737-35531876
  Hyper

SEQ ID NO: 116090 - DNA, 30 bp, Homo sapiens; identical to SEQ ID NO: 83242
  chr19:35559263-35559293
  Hypo

SEQ ID NO: 116091 - DNA, 30 bp, Homo sapiens; identical to SEQ ID NO: 83243
  chr19:35581749-35581779
  Hyper

SEQ ID NO: 116092 - DNA, 79 bp, Homo sapiens; identical to SEQ ID NO: 83244
  chr19:35589938-35590017
  Hypo

SEQ ID NO: 116093 - DNA, 30 bp, Homo sapiens; identical to SEQ ID NO: 83245
  chr19:35590789-35590819
  Hypo

SEQ ID NO: 116094 - DNA, 30 bp, Homo sapiens; identical to SEQ ID NO: 83246
  chr19:35599404-35599434
  Hypo

SEQ ID NO: 116095 - DNA, 224 bp, Homo sapiens; identical to SEQ ID NO: 83247
  chr19:35607205-35607429
  Hypo

SEQ ID NO: 116096 - DNA, 30 bp, Homo sapiens; identical to SEQ ID NO: 45834
  chr19:35608942-35608972
  Hypo

SEQ ID NO: 116097 - DNA, 551 bp, Homo sapiens; identical to SEQ ID NO: 83249
  chr19:35615955-35616506
  Hypo

SEQ ID NO: 116098 - DNA, 87 bp, Homo sapiens; identical to SEQ ID NO: 83250
  chr19:35621761-35621848
  Hypo

SEQ ID NO: 116099 - DNA, 45 bp, Homo sapiens; identical to SEQ ID NO: 83251
  chr19:35622243-35622288
  Hypo

SEQ ID NO: 116100 - DNA, 274 bp, Homo sapiens; identical to SEQ ID NO: 83258
  chr19:35781236-35781510
  Hypo

SEQ ID NO: 116101 - DNA, 69 bp, Homo sapiens; identical to SEQ ID NO: 83260
  chr19:35784054-35784123
  Hypo

SEQ ID NO: 116102 - DNA, 364 bp, Homo sapiens; identical to SEQ ID NO: 83261
  chr19:35797873-35798237
  Hypo

SEQ ID NO: 116103 - DNA, 156 bp, Homo sapiens; identical to SEQ ID NO: 45839
  chr19:35827208-35827364
  Hypo

SEQ ID NO: 116104 - DNA, 30 bp, Homo sapiens; identical to SEQ ID NO: 83263
  chr19:35827795-35827825
  Hypo

SEQ ID NO: 116105 - DNA, 40 bp, Homo sapiens; identical to SEQ ID NO: 83264
  chr19:35842975-35843015
  Hypo

SEQ ID NO: 116106 - DNA, 224 bp, Homo sapiens; identical to SEQ ID NO: 83266
  chr19:35920847-35921071
  Hypo

SEQ ID NO: 116107 - DNA, 195 bp, Homo sapiens; identical to SEQ ID NO: 45842
  chr19:35940942-35941137
  Hypo

SEQ ID NO: 116108 - DNA, 333 bp, Homo sapiens; identical to SEQ ID NO: 83268
  chr19:36024742-36025075
  Hyper

SEQ ID NO: 116109 - DNA, 867 bp, Homo sapiens
  chr19:36048553-36049420
  Hyper
caccgagcacgcgttcgcccaggcctcccaggctgaggtaggcggtctggaaggcctcgcgccactgctcgtccagcggcagctcctggcccttgataaggatggagctgcagcgctccagcacgcgctcgggggcgcccttcatcaccagcaagtgtcgcgggtcccgcgggtcctccagcgtatggatggacagctgtgggcgggggggagaggcgaggctgtggacgggggaacggggcggggctgtggacgagggaacggggcggggctgaggagaggggcggggccgagagctcggtgcgggctctgagagctgcggggaagggtgaaggtggaagatggaggccttgtgtggaggggtccttggtagaaggtaagcgttaaggcggggctaggtgcagatttggagtcctggacgcagggaatgaacagaattagggtgcggagttgggctgggggcggatttggagagcgaggtgctccccatggacagtcccgccgaggagaagctgtgggcggggctgggtggtgggcggggccttgcctctggtggacggggccataggcggagcgggagatggggtggggtttggctgcggagagaaggggcaaggagcgaagcccctcgtggcccgctgatgtgggtgtggcctggggcggggcccgaggtgggcgggcccaggccgtgggcggggccggctgcgcacctggaacttgttggtggagttgaagggtatctcgcagacttttgggaagcggtcccggtagcccatggcgttgcccagcgtcagctccgagaacttgagcagcgccgtctccgatgcgtctccaatcacgatgcgctgggagcggggaccggtgtca

SEQ ID NO: 116110 - DNA, 86 bp, Homo sapiens; identical to SEQ ID NO: 83271
  chr19:36138505-36138591
  Hypo

SEQ ID NO: 116111 - DNA, 65 bp, Homo sapiens; identical to SEQ ID NO: 83272
  chr19:36166552-36166617
  Hypo

SEQ ID NO: 116112 - DNA, 81 bp, Homo sapiens; identical to SEQ ID NO: 83273
  chr19:36183048-36183129
  Hypo

SEQ ID NO: 116113 - DNA, 30 bp, Homo sapiens; identical to SEQ ID NO: 45843
  chr19:36199677-36199707
  Hypo

SEQ ID NO: 116114 - DNA, 63 bp, Homo sapiens; identical to SEQ ID NO: 83275
  chr19:36220088-36220151
  Hypo

SEQ ID NO: 116115 - DNA, 558 bp, Homo sapiens; identical to SEQ ID NO: 83276
  chr19:36221431-36221989
  Hypo

SEQ ID NO: 116116 - DNA, 131 bp, Homo sapiens; identical to SEQ ID NO: 83277
  chr19:36222351-36222482
  Hypo

SEQ ID NO: 116117 - DNA, 277 bp, Homo sapiens; identical to SEQ ID NO: 45846
  chr19:36249972-36250249
  Hypo

SEQ ID NO: 116118 - DNA, 34 bp, Homo sapiens; identical to SEQ ID NO: 83279
  chr19:36267492-36267526
  Hypo

SEQ ID NO: 116119 - DNA, 83 bp, Homo sapiens; identical to SEQ ID NO: 83280
  chr19:36280047-36280130
  Hypo

SEQ ID NO: 116120 - DNA, 482 bp, Homo sapiens; identical to SEQ ID NO: 83281
  chr19:36334909-36335391
  Hyper

SEQ ID NO: 116121 - DNA, 359 bp, Homo sapiens; identical to SEQ ID NO: 83282
  chr19:36336410-36336769
  Hyper

SEQ ID NO: 116122 - DNA, 147 bp, Homo sapiens; identical to SEQ ID NO: 83283
  chr19:36336989-36337136
  Hyper

SEQ ID NO: 116123 - DNA, 146 bp, Homo sapiens; identical to SEQ ID NO: 83284
  chr19:36342250-36342396
  Hyper

SEQ ID NO: 116124 - DNA, 256 bp, Homo sapiens; identical to SEQ ID NO: 83285
  chr19:36347809-36348065
  Hyper

SEQ ID NO: 116125 - DNA, 580 bp, Homo sapiens; identical to SEQ ID NO: 83286
  chr19:36351788-36352368
  Hyper

SEQ ID NO: 116126 - DNA, 83 bp, Homo sapiens; identical to SEQ ID NO: 83287
  chr19:36353747-36353830
  Hypo

SEQ ID NO: 116127 - DNA, 56 bp, Homo sapiens; identical to SEQ ID NO: 83288
  chr19:36360563-36360619
  Hyper

SEQ ID NO: 116128 - DNA, 230 bp, Homo sapiens; identical to SEQ ID NO: 83289
  chr19:36361080-36361310
  Hyper

SEQ ID NO: 116129 - DNA, 30 bp, Homo sapiens; identical to SEQ ID NO: 83290
  chr19:36442475-36442505
  Hypo

SEQ ID NO: 116130 - DNA, 733 bp, Homo sapiens
  chr19:36449856-36450589
  Hyper
tggttccctcaagcccgacggacgtctgtgttttatgtttccagggctgccgcttcatcacggctttctcggaaaacgggggcgctgagaagcccaacttccagctatatatgtcgccaccgcccacagggcccccgacggcgatgctggtgacagcgctccctgcgtgggcgccactctccccgtgctccccgcgcctgcagccaggcacgacggtgtgggtgtgcccgcccggggcagaggagctgcagggctcgcggcaggcggcgctgtgcaagcagcgacgtcgcggcccgaggaagtggaggcggtgaacgcgcgtgggcgcgcctcccgggacacggcgctggctctgcggcgctacctgctgggcactccctaatcgatggtgacgccgtcgctgccgcccggcgaccggcacaaggagtttgcggtggtggcgggcgctgggcccacgctcttgaggcgcctcaagccccctaagcctgttctgctggaccgcgtaggccaccctgcccgctggccccatccattgagccttgaaggcttccagaggcgctgcagttgcagagagcaggagacctatccggcacccgcgtcgtggccgcccatcctgtcgcgctgctggctggcctcagttgtctgcaagcgagaagcaaggcctgtggccacgcgtttggacgaccgccgccccagggtcgctggagtggtctccacacggtgccccactttg

SEQ ID NO: 116131 - DNA, 154 bp, Homo sapiens; identical to SEQ ID NO: 83293
  chr19:36478149-36478303
  Hyper

SEQ ID NO: 116132 - DNA, 654 bp, Homo sapiens; identical to SEQ ID NO: 83295
  chr19:36523267-36523921
  Hyper

SEQ ID NO: 116133 - DNA, 21 bp, Homo sapiens
  chr19:36546792-36546813
  Hypo
gggcgcggtagctcacgtctg

SEQ ID NO: 116134 - DNA, 187 bp, Homo sapiens; identical to SEQ ID NO: 83297
  chr19:36547420-36547607
  Hypo

SEQ ID NO: 116135 - DNA, 454 bp, Homo sapiens; identical to SEQ ID NO: 83298
  chr19:36604324-36604778
  Hypo

SEQ ID NO: 116136 - DNA, 165 bp, Homo sapiens; identical to SEQ ID NO: 83299
  chr19:36640992-36641157
  Hypo

SEQ ID NO: 116137 - DNA, 196 bp, Homo sapiens; identical to SEQ ID NO: 45849
  chr19:36704661-36704857
  Hypo

SEQ ID NO: 116138 - DNA, 753 bp, Homo sapiens
  chr19:36736016-36736769
  Hyper
agacccggcgagcctcgctgcccttgcgagagccatggattcgcatttgcgcagagtcggggtctgttgctacgggtcccctgggctcctttgaatcgctttggcagctccctcggtttagagctacagggttttctccctcccctgagactctaacgcgtgcaccaactcgcgcctagagggcgtgtatgaccccagctcagttctaagccgaggggctgctgccggacattctagggtctgatctggcgggctcgaagggaggacagtcactgcgacccggaaagctccgcgcttacgacgcccacccagaaaatccggatcacatttcccgtggtccaccgcgcatctaggaggttacctgcgtccaggcggtgacttgcgagggaccacctttcccagggtccacggcgcatttaggtggtggcttgctctggactacatttcccagggtccaccgcggatctaggaggaggcttgagatgcagcctcccagcttcgaggctaccacctgcccgaattggtgctttggcagagtctctggtgcccgggtgaatgggttcagggtctcttaaggaccctccgttgacgatgcctcgagctatgacccaccctggctccgtccacggttgtcggggtcccgggctgcttttcttggagggctcggtgccggaggctactcttgagtcccggttccttcgcccagctgcgggcctcgggctactggatccgctgtctcggtttgggtgcggg

SEQ ID NO: 116139 - DNA, 100 bp, Homo sapiens; identical to SEQ ID NO: 83304
  chr19:36747764-36747864
  Hypo

SEQ ID NO: 116140 - DNA, 650 bp, Homo sapiens
  chr19:36822242-36822892
  Hyper
ataaacctcaacctgcgggtcactccctcccaggcgtgcaacaaaacacctgcctagaaatcaaaaggcgttttacccgagtgggctgaaaaagccccgtttttacctttaatctggagacaatacgggtcagaggtcaggaaactacatcagcgccagtgcgagcgcccacgagtccggtggacggatgagaaacggccggggggcagcctgagtcccagttcccgccgtggcaatggccaatttcccacccgtggacgcaaaaggccaggactccacgctgctgaccctccagcgtcccatgtccggcaggcacgtggccgaatagcccaagactgaggactcacacttcccactttgcacctggaggccacctgcagaccaaccttgcgccaggcttccggaaatgggagggcgggcttccggaaacggcggccaatgggaaacgtgatcagatgttactaggcagacagtccgtttccaggcaacacagaagaaaggaacgcgctcagtcagcctcaaatagacggagatttcagccaatggatgtgcaggttccctccacattagccaataagaagtgcttggggcctacctgcctacaagcacagcaaaagctttcctgcgcatttttgcgctggaatggctac

SEQ ID NO: 116141 - DNA, 105 bp, Homo sapiens; identical to SEQ ID NO: 83307
  chr19:36881579-36881684
  Hypo

SEQ ID NO: 116142 - DNA, 30 bp, Homo sapiens; identical to SEQ ID NO: 83308
  chr19:36904317-36904347
  Hypo

SEQ ID NO: 116143 - DNA, 867 bp, Homo sapiens
  chr19:36909068-36909935
  Hyper
ctcgctctcccagagctctgggattacagatgtgagccacctggtccggcctagtctgcgcgtttctgctgggagtctttggcgtgcagaaactgaccgagggccatttctctgcagctgggcccggtgtgggcagaggatgctggggtcagtcacgcactccacggccacaacaaccttcgctcatacaatagtctctgcacccaagtcagccgcacagactccgtcacgtcccagccccggccccgtcacgcccacgacacacacacccgggcctgaggcgcgggctcccgcccctctgcgatactgcagtggccccgcttacctctctttaccccctgggccgcagcgcttttcctacagattaccaggaccgacgctccgggccaggactgctcactcggggcgcgaacccgaggcacagcgatgcccgaacggaggaagccgctgccgggtcacgccacaatccccggggcctaacgggctgcgcgcggaggctgctgggagggccgggcgcgctcacggagtgcgcaggcgcggccagtctcaagggtccgctcgctggtgcagcccctgctctgcgtgaacccggagccggagctaggtccgtcccagcgaggctgcgcttcgagtcccttagcgcctggggacggcgcggcagggcctggaggggagcggggacagatggctggcgcgttaaagaggggcgcccgcgaccgcctctctatagtgccaactagggagccctgtgagcgaggacggcgctgcgagtctgtccctggcgcgctcctgggtgggattctttcactgggtgtggctgttgggatttgagaccgtgtgactccggagattcggggaagccagttc

SEQ ID NO: 116144 - DNA, 284 bp, Homo sapiens
  chr19:36912309-36912593
  Hyper
ggactgctcagccaccggccgctcccggcaccaggggacgccggacgccctctggacaatcggcgcacttgccacgatcttggacgggcctcgggcctcgaccttaagattccccgctccagctccgagatgtcagcaacgctgatcctggagcccgcgggccgcggctgccgagacaagccggtgcgcatcaccatgcgcggcctggcttcggagccgctggacacgctgcgcgcgcgtccctgcgcgacgagaaggctgggctcttccgctactgcgccgac

SEQ ID NO: 116145 - DNA, 32 bp, Homo sapiens; identical to SEQ ID NO: 83313
  chr19:36912845-36912877
  Hyper

SEQ ID NO: 116146 - DNA, 38 bp, Homo sapiens; identical to SEQ ID NO: 83314
  chr19:36993076-36993114
  Hypo

SEQ ID NO: 116147 - DNA, 271 bp, Homo sapiens; identical to SEQ ID NO: 83315
  chr19:37064089-37064360
  Hyper

SEQ ID NO: 116148 - DNA, 127 bp, Homo sapiens; identical to SEQ ID NO: 83316
  chr19:37064635-37064762
  Hyper

SEQ ID NO: 116149 - DNA, 25 bp, Homo sapiens
  chr19:37093816-37093841
  Hypo
agtgaaactccgtctcaaaagaaaa

SEQ ID NO: 116150 - DNA, 929 bp, Homo sapiens
  chr19:37095665-37096594
  Hyper
cacattcatagtcaccgctcagcgccgtcacacaaacggccccgcccccactcagtcccgcgggcccaatcggggacagtcagggctgtcccgggctgtgcacctgctgtgcacacacaccccctgctgtgcacaccccccgcccccccgggaccatcacaggcgcgcccactcacaccaccacacacggacgcagccacagaacggcacacacaaacacaatcacacagtctccctccccagcaggtgacttgcacacaggcctggggcttctgcctccacaaaccctctccgcgtcccatgaacccaggtcccctgccgtgagctcttctcgcatccagacccgggtcacctcaactcaccacatggaaaacgaacaccaggtcaacggaaaagggagccggggtcctggcagaagcgtagtgccagccgcaatagggcggccgtgggtgcaaacggaggggagcgccggcagctagcaccgcgcggcgactaacgggccgccccggagactcctgggagctcaggcccacgcgcgagtgcgcaggcgcagacgactcaccctgggccgggggtgaggcttggtgggtgccaggggtgctgaggaggccaaggagggcactgggagctccgttccgggagagctgtctaaggacgcggaaccgggtggggaggccagggaggtaaccaagagtccgagccgggcctggaaattctgaggaggaaaccgggaccgcggtatccagacgctccgatctgtacgagccgggcctcgggcgtggtccatgggcgtgaccttgagggtgacccggagcgagctccgcgaagggggattttgcccgttctgatcccgcggaagcgccatcgctggcggcgggtccccgcgcggagcgggcgctgtgtgttcgcgcgcgcgggcgcgcgctgaa

SEQ ID NO: 116151 - DNA, 135 bp, Homo sapiens; identical to SEQ ID NO: 83320
  chr19:37108753-37108888
  Hypo

SEQ ID NO: 116152 - DNA, 30 bp, Homo sapiens; identical to SEQ ID NO: 45851
  chr19:37110908-37110938
  Hypo

SEQ ID NO: 116153 - DNA, 880 bp, Homo sapiens; identical to SEQ ID NO: 83322
  chr19:37157302-37158182
  Hyper

SEQ ID NO: 116154 - DNA, 87 bp, Homo sapiens; identical to SEQ ID NO: 83323
  chr19:37159081-37159168
  Hypo

SEQ ID NO: 116155 - DNA, 38 bp, Homo sapiens; identical to SEQ ID NO: 83325
  chr19:37179419-37179457
  Hypo

SEQ ID NO: 116156 - DNA, 28 bp, Homo sapiens
  chr19:37260522-37260550
  Hypo
aataaaaattcagcgatggagttgatgg

SEQ ID NO: 116157 - DNA, 1072 bp, Homo sapiens; identical to SEQ ID NO: 83327
  chr19:37263321-37264393
  Hyper

SEQ ID NO: 116158 - DNA, 30 bp, Homo sapiens; identical to SEQ ID NO: 83328
  chr19:37286524-37286554
  Hypo

SEQ ID NO: 116159 - DNA, 32 bp, Homo sapiens; identical to SEQ ID NO: 37459
  chr19:37287904-37287936
  Hyper

SEQ ID NO: 116160 - DNA, 571 bp, Homo sapiens
  chr19:37288236-37288807
  Hyper
cacttcttattggctaatctggagcaaacctgcatatccattggctgaaagctccgtctattttagggtgactgagagcgtctcttccttctgtgttgcctggaaacggactgttcgcctagtaacatctgatcacgtttcccattggtcaccgtttccggaagcccgctctcccgtttccggaatccccgcaggcgctgggtctgcagatggcgtccaggtacacagtggcgagtgtgattccgcagtcttgggctgtttggccaagcgcccgccggacatggtacgccgaagggtcatcggcgtggagtcctcgctttcagcgtccgcggctgggaaatcggccatcgctacggcgggaactgggactcgggctgcgtcccggcccttccacatcggtccaccgcactcgtgggcgcccgcattggtgctgacataatttcctgacctctgacccgtattgtctcgcgattaaaggtaaaaaacggggctttttcatcccactggggtaaaacgcccttttatttctagccaggtgttctgttgcagaacgcctcgaagggagggagtg

SEQ ID NO: 116161 - DNA, 17 bp, Homo sapiens
  chr19:37292008-37292025
  Hypo
ggcgcttggccaagggg

SEQ ID NO: 116162 - DNA, 30 bp, Homo sapiens; identical to SEQ ID NO: 83334
  chr19:37295038-37295068
  Hypo

SEQ ID NO: 116163 - DNA, 210 bp, Homo sapiens; identical to SEQ ID NO: 83335
  chr19:37328802-37329012
  Hyper

SEQ ID NO: 116164 - DNA, 390 bp, Homo sapiens
  chr19:37329072-37329462
  Hyper
tgcatcaatttcactctcgcatccactgctcccatcgcgatcgctcgcccccacgctccctcgccggcaaagccaccaactccaaagacattagcacctcactcccctcagccccggcctcgggccctccggagtcattcggcttctgtgtctcggaatcactcacccggccctgcggtcccttgatggtggaaggttccgcgatctttctattaaccctaaagggacagagggctgacaggaagttgcccggggaacggtgcactctgggaaatgtagtccggagcctgggccgtctttaactgccccggacaccgcggtcaccattaacggaccctgcatttgagccccatcccctcgctgggcaaagaccatcgcccacacaccgct

SEQ ID NO: 116165 - DNA, 535 bp, Homo sapiens
  chr19:37340723-37341258
  Hyper
aatatgacctccccacgcccaaagctgcacacatcttgacctcacttctctcacacacacaccaatctgacccgcacgcggtttctttcactcaactacccagacacccctcatcccaccagcacaagcaggcccaccgcggtctcacacacactcgagccttcctttgcccagtctcacatgcatgactgggatcgcggatttgtccccttccgactccccatgctggttcggtcccagacgctcaggtgccacattggggtgcgctctcccggctcctccacacgctacgcagctgcccgcctcaagagcgtctgcgtgcttccagcgttaagtggaattccaagcagcctccggggcacagttagtctggtcactgcggccagactgccgcctcaggacccagagaacgcagcacactttagttgggcccatctatccccggcgaggcttggactacgtttcccaggagaccctgcggtccagtatgtctcccgaggaggggcggaagcccgggagccgccctctgaggctg

SEQ ID NO: 116166 - DNA, 720 bp, Homo sapiens; identical to SEQ ID NO: 83340
  chr19:37341469-37342189
  Hyper

SEQ ID NO: 116167 - DNA, 30 bp, Homo sapiens; identical to SEQ ID NO: 83341
  chr19:37406378-37406408
  Hypo

SEQ ID NO: 116168 - DNA, 825 bp, Homo sapiens
  chr19:37406765-37407590
  Hyper
ctccacctttcaggccgctccgcccgcaggggcccaaggcgccagctccccatcggtcttcggtatcctcacctaagccctttccagtcatcccggatgggaacttgcagacctgagccagttctcctggggaccaaaatatctcacctcccagatctaagggtcccgccaggagtgacgaaacgttcgaattcctgcgagaaaagtggcaggccaccaggccctctgggaaatgtagtccagagcgggacccacgccgattcctgtcagctcctcgcctgggcccacccgaaacggctgctccctcaactctcaacatccagccgagcctcggagttgcgggtcgccgtagcgctgcgcaatggagatgagcctcccggggaacccggcccaagcctcaccctcacacaggaaagcagatgtgttctggccggaagttgagtggggccgcggggcctgctgggaggtgttgtcctcggaaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatggtgagtggttgcagttgatgggacaaaaaactgtgatgggagttagtgtgggtgtgtggttgtgtgtgtgagtgtgacggcacgaataatctgatgg

SEQ ID NO: 116169 - DNA, 772 bp, Homo sapiens
  chr19:37463993-37464765
  Hyper
ccagtgaccgtggtgcggtccaggccccgggtggcgcacccacctctggactacatttcccagggggccccgcggccaaccttttccggccgaagaaggctagtcacctttccttggcgggtgttggaaagcaaagggctggaacgtcccgggctgcggagctcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaggggaggtcagggctgtgcgatggggaaggaagagagtgtcggggcggtgcagtcgggatgggagaagggtgtcagggccactggcccccagctcggcagagggcagtgtcgggccgcgcgcaggcagggagtgggtgtggtgtgaggctggcgctggagcggtctgggaatgttaggaggtctagggtatcgcggccctgcgtcctcttgtctggactaaaagtccgggcagttctccccggacctggattgtgggcccagcgacaggtgcttggcgatctgtgcccgctgtgcctgcggggctgtggtgggagtcctgtctgcacggtattctgtgtggctgtgcatgtaagtgtgagcgtgtgccgggtcatcgaccccatctttgggaggcctgggagggggcgggacaccctcgctgtacattctggggatacgctgggcggggtctgccctgt

SEQ ID NO: 116170 - DNA, 89 bp, Homo sapiens; identical to SEQ ID NO: 83348
  chr19:37500805-37500894
  Hypo

SEQ ID NO: 116171 - DNA, 134 bp, Homo sapiens; identical to SEQ ID NO: 83349
  chr19:37502995-37503129
  Hypo

SEQ ID NO: 116172 - DNA, 30 bp, Homo sapiens; identical to SEQ ID NO: 83350
  chr19:37504196-37504226
  Hypo

SEQ ID NO: 116173 - DNA, 18 bp, Homo sapiens
  chr19:37551294-37551312
  Hypo
ctcctcccctcagcccgt

SEQ ID NO: 116174 - DNA, 41 bp, Homo sapiens; identical to SEQ ID NO: 83352
  chr19:37557046-37557087
  Hypo

SEQ ID NO: 116175 - DNA, 30 bp, Homo sapiens; identical to SEQ ID NO: 83353
  chr19:37569468-37569498
  Hyper

SEQ ID NO: 116176 - DNA, 310 bp, Homo sapiens; identical to SEQ ID NO: 83355
  chr19:37663494-37663804
  Hyper

SEQ ID NO: 116177 - DNA, 15 bp, Homo sapiens
  chr19:37693192-37693207
  Hypo
cggcacccggcctca

SEQ ID NO: 116178 - DNA, 84 bp, Homo sapiens; identical to SEQ ID NO: 83357
  chr19:37702085-37702169
  Hypo

SEQ ID NO: 116179 - DNA, 30 bp, Homo sapiens; identical to SEQ ID NO: 83361
  chr19:37795994-37796024
  Hypo

SEQ ID NO: 116180 - DNA, 30 bp, Homo sapiens; identical to SEQ ID NO: 83362
  chr19:37803863-37803893
  Hyper

SEQ ID NO: 116181 - DNA, 30 bp, Homo sapiens; identical to SEQ ID NO: 83366
  chr19:37933859-37933889
  Hypo

SEQ ID NO: 116182 - DNA, 73 bp, Homo sapiens; identical to SEQ ID NO: 83367
  chr19:37940221-37940294
  Hypo

SEQ ID NO: 116183 - DNA, 30 bp, Homo sapiens; identical to SEQ ID NO: 83368
  chr19:37947570-37947600
  Hypo

SEQ ID NO: 116184 - DNA, 935 bp, Homo sapiens; identical to SEQ ID NO: 83369
  chr19:37957671-37958606
  Hyper

SEQ ID NO: 116185 - DNA, 1043 bp, Homo sapiens
  chr19:37959786-37960829
  Hyper
cctcccaatttttttcgggtatccagcacaattctaggaattcgcctcccacccattttgagtagacgcgccactagcgcgttcccacgcacaaaccttttccctgcggccaacctgcgattctcaactccccgccctggttgctaagggaggcgcgcagagcgcttgtgcctgcgcacttccacaccagcccgtgtagtgtgacgctgggccccgtccctgtgaccgggccaggctcggagctgcagggaatccggactttcgggctctctggaaggccggggagaggccagtgtgggaggacctggtggggaggaggccgtgttacaaaccctgcgcggagctgcaccgctgctgccagacactgcgacgccgcgaccttttctactccggactacgtttcccagcggaccccgcgggagttgggccggcggcccctttgtgtcctccgggggcggaggcagctgaggcgcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggaggttggtaccgttcagtgcgaggctgtcaccccgtgtgcctgtccacgtcctgtgtgactgggtgcgaggaagtcaatggcaccgtggaatgtgaggctgtgagttgaggcgggagcgggcgactgttcgctgcaccttgttgggccgatacccgcggcttctttgtgactgggttgtgagattgtcgcttgtgatagataccctggtggctgagccttgccggtatgggaaagggtgcccgtgtgaggcagtccatacccatggcctctgactgtggcgtgggtaagacggtggttggcactgtagtttttcagactctgattatgtgggggattgagtgagagactgtgtgccacggagaggcttttaa

SEQ ID NO: 116186 - DNA, 99 bp, Homo sapiens; identical to SEQ ID NO: 83372
  chr19:37995676-37995775
  Hypo

SEQ ID NO: 116187 - DNA, 1034 bp, Homo sapiens
  chr19:37997089-37998123
  Hyper
tatgcactgtatattcgttcccatcgctcccgtctcacttctccatcccccacctaccaaataaactgcttgcactcattctttcctcaggtcggcttctcgggcaagcctccttaggtaaaaaccttgctttcaacatttcctttccattatgcgctaagaactctgatctcttcccgctgcggcagccccgccctttccttgcggctccgccctttccgtgaagtcacgcccgtccttaggctgtctctgtctccctaagagcgagtctcttcgctgctctctaactcctagagctggctcagaaagagtttcacattgccataggggagctcctaggagaggctgcacccattgcacgtaagaagcggtaaaaatgtacgcggccatcttaccaggctgccggagacaaagaaagctcagctttgatgtctgggcgccaccatgttggccacaggaggttttggcatctgagatgctgagttaagagcagagacgacatctctgtttagggatccagggacacttccttctccttgtcctaaaatagccttatcttttggtctagcaaagggcttaatcatccgttttacggcacagttttaaacatggccgccccaggtaggagtcaagtgggcgtcgccatcatacctccaattacagctttgagaaacccagaatcctgttcactggaaggttgccgggtggcggctgacagcctcaaagtcgcaattgagtctgcgcaccggccattcaggatgggacgaccttataccgcggtgaggcggcgtggcaggacgaccaatttcagattcagggcgcggatgcagcataaatgggaaggcacggtttgagaaacggtcaaacctgggactagtggaggatagtgagctgccgactacggtggccgactgggtcagctatgggtgcccgtgagggtcaatgacaagggaactgaagggttaagagattcggcgtctgagcctcgcggggcctcagtggtggcggacagaggtttgcgggagtcagtggca

SEQ ID NO: 116188 - DNA, 503 bp, Homo sapiens; identical to SEQ ID NO: 83378
  chr19:38042365-38042868
  Hyper

SEQ ID NO: 116189 - DNA, 437 bp, Homo sapiens; identical to SEQ ID NO: 83379
  chr19:38085240-38085677
  Hyper

SEQ ID NO: 116190 - DNA, 111 bp, Homo sapiens; identical to SEQ ID NO: 83380
  chr19:38086051-38086162
  Hyper

SEQ ID NO: 116191 - DNA, 21 bp, Homo sapiens
  chr19:38088612-38088633
  Hypo
ccactgcgcccagccagcaaa

SEQ ID NO: 116192 - DNA, 83 bp, Homo sapiens; identical to SEQ ID NO: 83382
  chr19:38107062-38107145
  Hypo

SEQ ID NO: 116193 - DNA, 22 bp, Homo sapiens
  chr19:38107205-38107227
  Hypo
gcctgggcgacatagcgagagt

SEQ ID NO: 116194 - DNA, 30 bp, Homo sapiens; identical to SEQ ID NO: 83384
  chr19:38145556-38145586
  Hyper

SEQ ID NO: 116195 - DNA, 1313 bp, Homo sapiens; identical to SEQ ID NO: 83385
  chr19:38146010-38147323
  Hyper

SEQ ID NO: 116196 - DNA, 717 bp, Homo sapiens
  chr19:38182757-38183474
  Hyper
tcaccattttacagtcgaagaagggaagataagaggcggtgaatccgagactttcattcaggtgacgatccctcgcgggcactcactctcgctcacactacaatcagatcctccatgcggctttcatatactctgtcacactcgcagccagaatcccctcggatggactcttgcaaacctccagccccatcccgggatccgtgcgtcttctacagccaccacttgggccagcgtccaggacgcccaagcgtaacctccccactctaaaccgttaggaatcagtggctggactcaccgcgtcataaaagcataaactgtgacccgatgagtccgcgcactcggaaaacaagagaacgctcccacgtctccgggcgcagcttgtgccagcgactactaggtcagggggcgcagctgagagaattcaagcaacctccccgcaaccggttccgccgcgtttgtgggctggtagcccggaatacatttcccagaggccttcgcggccgacgtgcttcgcgcaggaacgcagccgcctcccgactggaggacgcggtagcggagctgctcaaagcgaggtgctcagccctgggaggctcagggctgcccgaggggcttagtcccagagccagtgctgtcaggggctgagcatgtgaatagggcagtcggaagaccatgtgtgtctgtggcttttaaatacaccccgaacgtctatctctttta

SEQ ID NO: 116197 - DNA, 734 bp, Homo sapiens
  chr19:38210017-38210751
  Hyper
tttctctgttgtagtcgtactaggctgaggaaggcacaggaagcagcagggaacctggagccaagggtcaatagaccccacagagcccagcgaagcacgctttacaaaggacacacacggcatgtacaggtcacacaaggtcgactacgcacccctcacagtcccgcaactgcacccacgtcacacaggcaagccggtcctgtcgccgctgcgcggtctctcacgctccccgcctgtctcctagagacgggcccctcctccgcagctccagcaccctagggcctgaggaggcgggagactcgcccggcccgcctgggggcctccgcgctctgagcgcctcctgcagccccactctcaccgccacgcagggtaccacgcgggcggcgggctggggctgcagaggctcccgcagtgacctgcgccgccttcttcaggtggaaccaaaaggtcccggaaccggagccaggggtccaagttttctccgttgcctttgtaatatgtagtccaagccagaacagtcaggaccgcaggtaccggtgagaaatggagtccagaatcctaaaaacctacgagaaatacggcagcgaccacttggaccgcgcctcccacccaccgctcgagccccggagacttctgggagtggccgccttgcctcgagtgcgcatgcgcagatcggccactactgggcccctggcctgaggcttagggtggagttagtgcgttcttagggccag

SEQ ID NO: 116198 - DNA, 103 bp, Homo sapiens; identical to SEQ ID NO: 83396
  chr19:38228266-38228369
  Hypo

SEQ ID NO: 116199 - DNA, 46 bp, Homo sapiens; identical to SEQ ID NO: 83398
  chr19:38287099-38287145
  Hypo

SEQ ID NO: 116200 - DNA, 418 bp, Homo sapiens
  chr19:38308121-38308539
  Hyper
ttggtcctttggctccgcgctgcgcgtgacctgcagtcacctgagcaagagggcggcgtgggtcgctgcgggagcccctacagccccagcccgcagcccacgtggcaccctacagggctgtgagagtggggctgctggaggcgttcagagcgcggaggccccaggcgcgggccgggctctctcccgcctcctcaggcccgggggtgctggagctgccgaggtgggggctcatctttgggagacaggtggggagtgtgagagaccgcgcagcggcgacagggccgggcgtgcctgtgtgacgtgggtgcagctgtgggactgtgaggggtgcgtggtcgaccttgcgtaacctggatgtgcagtgcgtgtcctttgcaaagcgtgcgttgctgtggctccgtggcgtcagcaacccttc

SEQ ID NO: 116201 - DNA, 26 bp, Homo sapiens
  chr19:38309113-38309139
  Hypo
tagaataaagtaattcggccgggcgt

SEQ ID NO: 116202 - DNA, 64 bp, Homo sapiens; identical to SEQ ID NO: 83402
  chr19:38481038-38481102
  Hypo

SEQ ID NO: 116203 - DNA, 30 bp, Homo sapiens; identical to SEQ ID NO: 83404
  chr19:38554526-38554556
  Hypo

SEQ ID NO: 116204 - DNA, 30 bp, Homo sapiens; identical to SEQ ID NO: 83407
  chr19:38684394-38684424
  Hypo

SEQ ID NO: 116205 - DNA, 30 bp, Homo sapiens; identical to SEQ ID NO: 83408
  chr19:38688124-38688154
  Hypo

SEQ ID NO: 116206 - DNA, 30 bp, Homo sapiens; identical to SEQ ID NO: 83411
  chr19:38700527-38700557
  Hyper

SEQ ID NO: 116207 - DNA, 146 bp, Homo sapiens; identical to SEQ ID NO: 83412
  chr19:38701109-38701255
  Hyper

SEQ ID NO: 116208 - DNA, 662 bp, Homo sapiens; identical to SEQ ID NO: 83413
  chr19:38701550-38702212
  Hyper

SEQ ID NO: 116209 - DNA, 92 bp, Homo sapiens; identical to SEQ ID NO: 37493
  chr19:38718791-38718883
  Hyper

SEQ ID NO: 116210 - DNA, 33 bp, Homo sapiens; identical to SEQ ID NO: 83415
  chr19:38719684-38719717
  Hyper

SEQ ID NO: 116211 - DNA, 37 bp, Homo sapiens; identical to SEQ ID NO: 83416
  chr19:38719919-38719956
  Hyper

SEQ ID NO: 116212 - DNA, 220 bp, Homo sapiens; identical to SEQ ID NO: 83417
  chr19:38720219-38720439
  Hyper

SEQ ID NO: 116213 - DNA, 640 bp, Homo sapiens
  chr19:38746768-38747408
  Hyper
ccgggctcaccatgccgcggtacagctcctccaggcgcccgtcgatccacttctccacgtccagccgccgctgcagctcccgccggtcatacttgacggtgacgcgcgcgtgccgcttctgcagccccccgggactgccccctggcccgcgggcccgcgatggagactgcagcttgctcagcacgcgcttgcccagccgctgagctgccatcgcgctgctggacccagcctggccccgcgctgtgcgccttcgcctcgcgccccgggtgcttcttacgggccagggcggggctagccgggggcgggggctcgggctcgccgggaggtctgccccaccccggccgcctcaggcctcagtttccccgtctgcagtgcgagagtaggccgctgcgtcggcttgaggcacgcagtcgtgcgaagttgaggtatgggcggggacccagagtcccgggcgggtccctgcatcgggggctcccgggccgggatcctgtggggcgggggcctgggacagacactcgggacccggcctgtctgcgccctctggcggtggcggggtggggggctgttggtgcgggagcgcctgcgccgctgtcgctgtagaaggtcgagcggtcacttgttccttcgttcattcattcac

SEQ ID NO: 116214 - DNA, 32 bp, Homo sapiens; identical to SEQ ID NO: 83421
  chr19:38755286-38755318
  Hyper

SEQ ID NO: 116215 - DNA, 135 bp, Homo sapiens; identical to SEQ ID NO: 83422
  chr19:38782535-38782670
  Hypo

SEQ ID NO: 116216 - DNA, 86 bp, Homo sapiens; identical to SEQ ID NO: 83423
  chr19:38789299-38789385
  Hypo

SEQ ID NO: 116217 - DNA, 217 bp, Homo sapiens; identical to SEQ ID NO: 83426
  chr19:38828116-38828333
  Hypo

SEQ ID NO: 116218 - DNA, 60 bp, Homo sapiens; identical to SEQ ID NO: 83427
  chr19:38852327-38852387
  Hyper

SEQ ID NO: 116219 - DNA, 226 bp, Homo sapiens; identical to SEQ ID NO: 83428
  chr19:38852967-38853193
  Hyper

SEQ ID NO: 116220 - DNA, 230 bp, Homo sapiens; identical to SEQ ID NO: 45857
  chr19:38873935-38874165
  Hypo

SEQ ID NO: 116221 - DNA, 397 bp, Homo sapiens
  chr19:38877650-38878047
  Hyper
atcactggagagggccgttctaaggtgaggggcagggtcgagggtgaggcctggggctcccggggtaccatgagtcccgggggtgtggcgctgccagggaaccagacacccagcccacgagtcaggcgcatggcctgggaggtcatctcgggctccaccagggacgtccggcgggagtcgggggcgcggtccgagggctgcacttttcgggagcccccgcccgcggatggctccgactgcaagttccccatttctgacggagctcggagactagtcagaaaaatttactccagtcagcctgccagggccgtggggaccctacgaggctggctgtacttgatctaatgcgtccgcaccggccccgcccctgttctccaagatccgatcaggcccaagt

SEQ ID NO: 116222 - DNA, 32 bp, Homo sapiens; identical to SEQ ID NO: 83431
  chr19:38879580-38879612
  Hyper

SEQ ID NO: 116223 - DNA, 35 bp, Homo sapiens; identical to SEQ ID NO: 37499
  chr19:38879840-38879875
  Hyper

SEQ ID NO: 116224 - DNA, 30 bp, Homo sapiens; identical to SEQ ID NO: 83433
  chr19:38880189-38880219
  Hyper

SEQ ID NO: 116225 - DNA, 30 bp, Homo sapiens; identical to SEQ ID NO: 83434
  chr19:38901928-38901958
  Hypo

SEQ ID NO: 116226 - DNA, 231 bp, Homo sapiens; identical to SEQ ID NO: 83435
  chr19:38905501-38905732
  Hypo

SEQ ID NO: 116227 - DNA, 411 bp, Homo sapiens
  chr19:38924224-38924635
  Hyper
atgtgggcagggctccggcgaaggggagtggccggggagtcctggtccaatggggcccgggggcggggacttcctcccatctctgtccagcatgcgtgtactcctcgcagttccatctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggtgcgtatctctgggttaggggcctgtggggctatctcttggggctctctgagggtctctctgtctctgaatgtccctgtccggcttgctggtggtctctgagactcgaggtctcttccta

SEQ ID NO: 116228 - DNA, 30 bp, Homo sapiens; identical to SEQ ID NO: 83438
  chr19:38931911-38931941
  Hypo

SEQ ID NO: 116229 - DNA, 112 bp, Homo sapiens; identical to SEQ ID NO: 45859
  chr19:38934459-38934571
  Hypo

SEQ ID NO: 116230 - DNA, 35 bp, Homo sapiens; identical to SEQ ID NO: 83440
  chr19:38954122-38954157
  Hypo

SEQ ID NO: 116231 - DNA, 418 bp, Homo sapiens; identical to SEQ ID NO: 83441
  chr19:38956612-38957030
  Hypo

SEQ ID NO: 116232 - DNA, 140 bp, Homo sapiens; identical to SEQ ID NO: 83442
  chr19:38958263-38958403
  Hypo

SEQ ID NO: 116233 - DNA, 38 bp, Homo sapiens; identical to SEQ ID NO: 83443
  chr19:38964007-38964045
  Hypo

SEQ ID NO: 116234 - DNA, 50 bp, Homo sapiens; identical to SEQ ID NO: 83444
  chr19:38973963-38974013
  Hypo

SEQ ID NO: 116235 - DNA, 80 bp, Homo sapiens; identical to SEQ ID NO: 83445
  chr19:38974232-38974312
  Hypo

SEQ ID NO: 116236 - DNA, 476 bp, Homo sapiens; identical to SEQ ID NO: 83446
  chr19:38976314-38976790
  Hypo

SEQ ID NO: 116237 - DNA, 271 bp, Homo sapiens; identical to SEQ ID NO: 83447
  chr19:38990481-38990752
  Hypo

SEQ ID NO: 116238 - DNA, 306 bp, Homo sapiens; identical to SEQ ID NO: 83448
  chr19:38991260-38991566
  Hypo

SEQ ID NO: 116239 - DNA, 38 bp, Homo sapiens; identical to SEQ ID NO: 83449
  chr19:38993187-38993225
  Hypo

SEQ ID NO: 116240 - DNA, 236 bp, Homo sapiens
  chr19:38993515-38993751
  Hypo
gcaggtacatccgcccgtcgatgctgcagcacctgttgcgccgcctggtgttcgacgtgcccatcctcaacgagttcgccaagatgccactcaaggtgagggcaagcgctctttagcatctcatttccaggccgcacccactggtttgctcttccctcctactgcggggctcatttgtgtcggcactgcccagcccaataaacctgcactagttagggcagcgtccccgtagaaat

SEQ ID NO: 116241 - DNA, 61 bp, Homo sapiens; identical to SEQ ID NO: 83450
  chr19:38996547-38996608
  Hypo

SEQ ID NO: 116242 - DNA, 138 bp, Homo sapiens; identical to SEQ ID NO: 83451
  chr19:38998362-38998500
  Hypo

SEQ ID NO: 116243 - DNA, 55 bp, Homo sapiens; identical to SEQ ID NO: 83452
  chr19:39006701-39006756
  Hypo

SEQ ID NO: 116244 - DNA, 30 bp, Homo sapiens; identical to SEQ ID NO: 83453
  chr19:39015083-39015113
  Hypo

SEQ ID NO: 116245 - DNA, 30 bp, Homo sapiens; identical to SEQ ID NO: 83454
  chr19:39026975-39027005
  Hypo

SEQ ID NO: 116246 - DNA, 131 bp, Homo sapiens; identical to SEQ ID NO: 83455
  chr19:39038903-39039034
  Hypo

SEQ ID NO: 116247 - DNA, 52 bp, Homo sapiens; identical to SEQ ID NO: 45868
  chr19:39071019-39071071
  Hypo

SEQ ID NO: 116248 - DNA, 30 bp, Homo sapiens; identical to SEQ ID NO: 83458
  chr19:39077322-39077352
  Hypo

SEQ ID NO: 116249 - DNA, 98 bp, Homo sapiens; identical to SEQ ID NO: 83459
  chr19:39090729-39090827
  Hypo

SEQ ID NO: 116250 - DNA, 30 bp, Homo sapiens; identical to SEQ ID NO: 45869
  chr19:39101480-39101510
  Hypo

SEQ ID NO: 116251 - DNA, 20 bp, Homo sapiens
  chr19:39135434-39135454
  Hypo
cagggcgagactccacctcc

SEQ ID NO: 116252 - DNA, 34 bp, Homo sapiens; identical to SEQ ID NO: 83462
  chr19:39151506-39151540
  Hypo

SEQ ID NO: 116253 - DNA, 30 bp, Homo sapiens; identical to SEQ ID NO: 45871
  chr19:39151783-39151813
  Hypo

SEQ ID NO: 116254 - DNA, 75 bp, Homo sapiens; identical to SEQ ID NO: 83464
  chr19:39187839-39187914
  Hypo

SEQ ID NO: 116255 - DNA, 74 bp, Homo sapiens; identical to SEQ ID NO: 83465
  chr19:39191735-39191809
  Hypo

SEQ ID NO: 116256 - DNA, 33 bp, Homo sapiens; identical to SEQ ID NO: 83466
  chr19:39210343-39210376
  Hypo

SEQ ID NO: 116257 - DNA, 42 bp, Homo sapiens; identical to SEQ ID NO: 45873
  chr19:39222079-39222121
  Hypo

SEQ ID NO: 116258 - DNA, 41 bp, Homo sapiens; identical to SEQ ID NO: 83468
  chr19:39235148-39235189
  Hypo

SEQ ID NO: 116259 - DNA, 89 bp, Homo sapiens; identical to SEQ ID NO: 83469
  chr19:39266345-39266434
  Hypo

SEQ ID NO: 116260 - DNA, 217 bp, Homo sapiens
  chr19:39282944-39283161
  Hyper
ccgcctgcgcaccctcggggcagacgcgatggcagcggccccggctctgcggaacagctgggaggactcgaaggacggcgtgggttttccctggcgcagcgagccccattcccacgcgccctccgctctccccgacggcccggaccccggtcctagccctggtcactgtgacgggaggggaagcggacgccaagtgcagccccggccccagtgtgac

SEQ ID NO: 116261 - DNA, 62 bp, Homo sapiens; identical to SEQ ID NO: 83472
  chr19:39305867-39305929
  Hypo

SEQ ID NO: 116262 - DNA, 67 bp, Homo sapiens; identical to SEQ ID NO: 83473
  chr19:39329572-39329639
  Hypo

SEQ ID NO: 116263 - DNA, 304 bp, Homo sapiens; identical to SEQ ID NO: 83474
  chr19:39329947-39330251
  Hypo

SEQ ID NO: 116264 - DNA, 19 bp, Homo sapiens
  chr19:39393000-39393019
  Hypo
cgcccggcctcattttatt

SEQ ID NO: 116265 - DNA, 68 bp, Homo sapiens; identical to SEQ ID NO: 83479
  chr19:39452631-39452699
  Hypo

SEQ ID NO: 116266 - DNA, 426 bp, Homo sapiens; identical to SEQ ID NO: 83480
  chr19:39466136-39466562
  Hyper

SEQ ID NO: 116267 - DNA, 542 bp, Homo sapiens; identical to SEQ ID NO: 83482
  chr19:39522477-39523019
  Hyper

SEQ ID NO: 116268 - DNA, 30 bp, Homo sapiens; identical to SEQ ID NO: 45880
  chr19:39524876-39524906
  Hypo

SEQ ID NO: 116269 - DNA, 30 bp, Homo sapiens; identical to SEQ ID NO: 83484
  chr19:39568177-39568207
  Hypo

SEQ ID NO: 116270 - DNA, 254 bp, Homo sapiens
  chr19:39574790-39575044
  Hyper
ctgggtcccccttcccgcgccacgccctggtggggtgggcgggtgggtgtggggcgcccaggcaggaccggccggacctgtgggacccggggccctggctgtctagggaggctgtcaccccgaggcgaccggctcttccggggctgggacggctgtaggcggcaagaggcctcggcacccgcgaactcataaataccggggcggcgctggtggcgggagaggcgcgtgcgggcagccggcgcccccgagggtga

SEQ ID NO: 116271 - DNA, 177 bp, Homo sapiens
  chr19:39589664-39589841
  Hyper
gcccactggagtccccgtctggctgtgtttggagacctgggggctgacaacccgaaggccgtcccccggctgcgcagggacacccagcagggcatgtatgacgccgttctccatgtgggtgaggcatccgcaggggcgcgcgcagggacggtggggggcgcgcgcagggatggtggg

SEQ ID NO: 116272 - DNA, 114 bp, Homo sapiens; identical to SEQ ID NO: 83488
  chr19:39597642-39597756
  Hypo

SEQ ID NO: 116273 - DNA, 143 bp, Homo sapiens; identical to SEQ ID NO: 83489
  chr19:39626780-39626923
  Hypo

SEQ ID NO: 116274 - DNA, 30 bp, Homo sapiens; identical to SEQ ID NO: 83490
  chr19:39645862-39645892
  Hypo

SEQ ID NO: 116275 - DNA, 94 bp, Homo sapiens; identical to SEQ ID NO: 45881
  chr19:39646149-39646243
  Hypo

SEQ ID NO: 116276 - DNA, 75 bp, Homo sapiens; identical to SEQ ID NO: 83492
  chr19:39672388-39672463
  Hypo

SEQ ID NO: 116277 - DNA, 30 bp, Homo sapiens; identical to SEQ ID NO: 83493
  chr19:39678735-39678765
  Hypo

SEQ ID NO: 116278 - DNA, 395 bp, Homo sapiens
  chr19:39687582-39687977
  Hyper
ccagccctgtgaaaccgggacagtcgcgcagcctcgagggatggaggaggtgcgtgagggacacgcgctcggtggcgggatggaagccgatgggcccgcgagcctccaggagctgcctccctcgccacggtcgccttcaccgccgccgtcgccgccaccactgccctcgccgccgtcgctgccatcgcccgcagccccggaggcccccgagctccccgagccggcgcagccgtccgaggctcacgcccggcagctgctgctggaggagtgggggccgctgagcgggggcctggagctgccccagcgcctcacctggaagctgctcctgttgcggcggccgctctaccgcaacctgctgcgctcgcccaaccccgaaggtgcgcaagggcccagag

SEQ ID NO: 116279 - DNA, 44 bp, Homo sapiens; identical to SEQ ID NO: 83496
  chr19:39690983-39691027
  Hypo

SEQ ID NO: 116280 - DNA, 835 bp, Homo sapiens
  chr19:39754874-39755709
  Hyper
gggcagaggccaaggcgaggagggggccggctcccgctctctctccctctgtgtgtgctgcgcctcccctgtgagcctaacccaaggcaggggactggacgcgtgggaccctctctttggcctccctgacgtccctcaggagcagagatgcgaccgagtgtgtgggccgcggtggccgcgggactgtgggtcgtgtgcacggtgggcgcggcgatccgccagcgctgcctgctctcgcactaccgctcgctggagccccggacgctggcggcggtcaaggcgctgaggaaccgctaagtgagtgaccgcccagcccttgcgccccccggtacactggccccgccgggttcccacacacccgtcgctgacccgaggggtcctgcgtcctagcgcccagcaggcgcctcttgtacgtcagagcccacagttcccaccacgagatccccgcagtccccgtcgtcagcgcgaacgcaggctcagggtcagtcacaaaaggagccctgcagggcggactcggctccaggtcgcgggcgcagggctatgccgggggagagcgggatgcaattcaaccctggttcacgccttcggggagctccctggttcagtacacgacaggcacgaccgtacgctgccagtacccatccacgtccaggaatcccagactgtgcagaggttaggggccctggcgagggggcccagtcgtatgcgataagcgccgcttgtcccgcaggcggaagaggcgctgagttggaggtcgcgcaactgctccgtccgccccaggagggatcctccgcggccatcggtgaggcccagaagcggacgggagaggcatggc

SEQ ID NO: 116281 - DNA, 30 bp, Homo sapiens; identical to SEQ ID NO: 83502
  chr19:39800520-39800550
  Hypo

SEQ ID NO: 116282 - DNA, 140 bp, Homo sapiens; identical to SEQ ID NO: 83503
  chr19:39811228-39811368
  Hyper

SEQ ID NO: 116283 - DNA, 30 bp, Homo sapiens; identical to SEQ ID NO: 45883
  chr19:39815860-39815890
  Hypo

SEQ ID NO: 116284 - DNA, 347 bp, Homo sapiens; identical to SEQ ID NO: 83505
  chr19:39816895-39817242
  Hypo

SEQ ID NO: 116285 - DNA, 30 bp, Homo sapiens; identical to SEQ ID NO: 83508
  chr19:39823715-39823745
  Hypo

SEQ ID NO: 116286 - DNA, 415 bp, Homo sapiens; identical to SEQ ID NO: 37511
  chr19:39989727-39990142
  Hyper

SEQ ID NO: 116287 - DNA, 25 bp, Homo sapiens
  chr19:39992813-39992838
  Hypo
gagactccgtcgcaaaaaacaaaca

SEQ ID NO: 116288 - DNA, 381 bp, Homo sapiens
  chr19:39993374-39993755
  Hyper
agaatgcggccggggcgctccgtatgcatccatgttcggccgggcccaccccagcacccctcctttgcctgtcctcgcagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgcgtgagtcctgcgttcgaccccaccccgtcccagccggggaccccggcccctcctgagc

SEQ ID NO: 116289 - DNA, 22 bp, Homo sapiens
  chr19:39996552-39996574
  Hypo
ctaaaagattaaatgcggcccg

SEQ ID NO: 116290 - DNA, 453 bp, Homo sapiens
  chr19:39997688-39998141
  Hyper
cctggacctgggccacgccctgcgctgccgctgccgcgccggcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgctcgtggccgcgggcgtggccggcgctgcgctcttgctggtccacgtgcgccgccgtgg

SEQ ID NO: 116291 - DNA, 1175 bp, Homo sapiens
  chr19:40005651-40006826
  Hyper
cgggggttaagggggcgggaattactcggcgaggtcgggaggtcgcgcggtggaacccgggggccaggtggaactcggtgtaacagagcccccagtggtcgcgccgcgtctcagaacccggtgcgggagacgctctccccgcccaaagagggaaggcgggcgggactccccaaccggcttgccccggtccccctgggccccatgaataaccaggcgcggaccccagccccctcctcggcgcggacttcaacctcagtccgggcttctaccccgacccggacaccgactccactccggaccccgactccggtccggactcggacccccatccggaccctgactccagtcctgactccgtctccagccgggacttcccctctggtcctgactcctgctccagcccagattcccactctggtccccactcccgctctggcccggatcccccgtctggttccgcctcctgctccggcctggatccctactccggtgccgactcccgttcccgtccggaacccaactccggtcccgactccggctcggaccctgactcctccagtccgggtcccagccccagccccagcccagctcctggcagggattcgggccgcgctccccgtcttggactcctacctggccccggccctacctttggatccgcccccggaacctgctccggagctgcctttgttgcccgaggaggaccctgagccggcgccgagcctgaagctcatcccgtcggtctccagcgaggccgggcccgccccggggccccttcccacgcgcaccccgctggccgcgaactcacccgggcccaccctggacttcaccttcagggcagacccgtcggccatcgggctggcggatccccccattcccagtcctgtcccctcgcccatcctggggaccatcccgtcggccatctccttacagaattgtacggaaaccttcccctcctccagcgagaacttcgcgctggacaagagggtcctgattcgagtgacctactggtgaggacctcacacatgcctctcccaacccccggggacagggccggcagtgggggctgggtctccggggacgtggaggtcagggttggggtagggcgaggggagggattcaggaagagccccagagttccagttcccagattggaaacccgctcttgtctctca

SEQ ID NO: 116292 - DNA, 200 bp, Homo sapiens; identical to SEQ ID NO: 83521
  chr19:40097695-40097895
  Hypo

SEQ ID NO: 116293 - DNA, 189 bp, Homo sapiens; identical to SEQ ID NO: 16507
  chr19:40218707-40218896
  Hypo

SEQ ID NO: 116294 - DNA, 34 bp, Homo sapiens; identical to SEQ ID NO: 83525
  chr19:40286084-40286118
  Hypo

SEQ ID NO: 116295 - DNA, 764 bp, Homo sapiens; identical to SEQ ID NO: 83526
  chr19:40324254-40325018
  Hyper

SEQ ID NO: 116296 - DNA, 30 bp, Homo sapiens; identical to SEQ ID NO: 83528
  chr19:40430529-40430559
  Hypo

SEQ ID NO: 116297 - DNA, 30 bp, Homo sapiens; identical to SEQ ID NO: 83532
  chr19:40449764-40449794
  Hypo

SEQ ID NO: 116298 - DNA, 55 bp, Homo sapiens; identical to SEQ ID NO: 83533
  chr19:40503231-40503286
  Hyper

SEQ ID NO: 116299 - DNA, 47 bp, Homo sapiens; identical to SEQ ID NO: 83538
  chr19:40561332-40561379
  Hyper

SEQ ID NO: 116300 - DNA, 36 bp, Homo sapiens; identical to SEQ ID NO: 83540
  chr19:40723089-40723125
  Hyper

SEQ ID NO: 116301 - DNA, 117 bp, Homo sapiens; identical to SEQ ID NO: 83541
  chr19:40723426-40723543
  Hyper

SEQ ID NO: 116302 - DNA, 599 bp, Homo sapiens; identical to SEQ ID NO: 83542
  chr19:40723835-40724434
  Hyper

SEQ ID NO: 116303 - DNA, 33 bp, Homo sapiens
  chr19:40732289-40732322
  Hyper
cggcgaagatgtccccggcgtactcgcgttctc

SEQ ID NO: 116304 - DNA, 170 bp, Homo sapiens; identical to SEQ ID NO: 83545
  chr19:40829862-40830032
  Hypo

SEQ ID NO: 116305 - DNA, 343 bp, Homo sapiens; identical to SEQ ID NO: 83547
  chr19:40889677-40890020
  Hypo

SEQ ID NO: 116306 - DNA, 30 bp, Homo sapiens; identical to SEQ ID NO: 83548
  chr19:40900239-40900269
  Hypo

SEQ ID NO: 116307 - DNA, 30 bp, Homo sapiens; identical to SEQ ID NO: 45889
  chr19:40901793-40901823
  Hypo

SEQ ID NO: 116308 - DNA, 432 bp, Homo sapiens; identical to SEQ ID NO: 83550
  chr19:40902263-40902695
  Hypo

SEQ ID NO: 116309 - DNA, 20 bp, Homo sapiens
  chr19:40908670-40908690
  Hypo
gactccgtctcaaaaaaaaa

SEQ ID NO: 116310 - DNA, 95 bp, Homo sapiens; identical to SEQ ID NO: 83552
  chr19:40926574-40926669
  Hypo

SEQ ID NO: 116311 - DNA, 22 bp, Homo sapiens
  chr19:40951175-40951197
  Hypo
aatattattttttgccgggcgc

SEQ ID NO: 116312 - DNA, 221 bp, Homo sapiens; identical to SEQ ID NO: 83554
  chr19:40951614-40951835
  Hypo

SEQ ID NO: 116313 - DNA, 406 bp, Homo sapiens; identical to SEQ ID NO: 83556
  chr19:40972742-40973148
  Hyper

SEQ ID NO: 116314 - DNA, 70 bp, Homo sapiens; identical to SEQ ID NO: 83557
  chr19:41008366-41008436
  Hypo

SEQ ID NO: 116315 - DNA, 30 bp, Homo sapiens; identical to SEQ ID NO: 83558
  chr19:41009824-41009854
  Hypo

SEQ ID NO: 116316 - DNA, 626 bp, Homo sapiens
  chr19:41018532-41019158
  Hyper
caggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccgggga

SEQ ID NO: 116317 - DNA, 536 bp, Homo sapiens; identical to SEQ ID NO: 83561
  chr19:41025379-41025915
  Hyper

SEQ ID NO: 116318 - DNA, 30 bp, Homo sapiens; identical to SEQ ID NO: 83562
  chr19:41028694-41028724
  Hypo

SEQ ID NO: 116319 - DNA, 311 bp, Homo sapiens; identical to SEQ ID NO: 83563
  chr19:41055109-41055420
  Hyper

SEQ ID NO: 116320 - DNA, 444 bp, Homo sapiens; identical to SEQ ID NO: 37525
  chr19:41059909-41060353
  Hyper

SEQ ID NO: 116321 - DNA, 113 bp, Homo sapiens; identical to SEQ ID NO: 83565
  chr19:41062945-41063058
  Hypo

SEQ ID NO: 116322 - DNA, 695 bp, Homo sapiens
  chr19:41073518-41074213
  Hyper
cccgccccggccccacgcctccaacctaaccctggtccctccatcctcagatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggtgaggtgcccgccttatgaccaga

SEQ ID NO: 116323 - DNA, 221 bp, Homo sapiens; identical to SEQ ID NO: 83568
  chr19:41102775-41102996
  Hyper

SEQ ID NO: 116324 - DNA, 434 bp, Homo sapiens
  chr19:41105986-41106420
  Hyper
agagctctactgaagcggcggcggccccgggggccagggggccggggactactgagaaggaggcccccacagcgtgcccccgctggcaaggccccgggtaagcacatccgcctttcctccgcctggggcgaggggggttccgggccagataaagccgtctggttcccacggtccagccgccgcctacccgccccccgttgtagctcagcacccacccccaggacgaggccccctctagggaccccagcgtccggccgtgcgaggtgagcccgggacaggaccagacacaggccagaggcactgacccgcgggggtggggccgggaagccaggcgtccgggctccccgcggccgaagagggagggcgctggcccgttagaaagctccgccgaaccagcccagacaacaaaagcgattgtgcgggttggcgcctgc

SEQ ID NO: 116325 - DNA, 290 bp, Homo sapiens; identical to SEQ ID NO: 83571
  chr19:41115521-41115811
  Hyper

SEQ ID NO: 116326 - DNA, 558 bp, Homo sapiens
  chr19:41119177-41119735
  Hyper
gaggcgggaccaaggcgctgtgggaggagcttagaaacctggcattggtgggggcggggttactgcgatgtgggcggagcttgtctgggaggccgggtcccgtgactccgcccaatctcccgcgtaccctagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctagg

SEQ ID NO: 116327 - DNA, 391 bp, Homo sapiens; identical to SEQ ID NO: 83575
  chr19:41198090-41198481
  Hypo

SEQ ID NO: 116328 - DNA, 39 bp, Homo sapiens; identical to SEQ ID NO: 83576
  chr19:41245584-41245623
  Hypo

SEQ ID NO: 116329 - DNA, 439 bp, Homo sapiens
  chr19:41354396-41354835
  Hyper
ccagggctggaagtgcgggcgcctttccccacctagtccccatccccaggcagaacgcgcgcgggttcctcgtcctgggtgttttccttctcctgcccccgcactcggggtcccctgctcaccgccagtgccccggagggcgtcgatgaggaagcccgcctcctcctggatgcgctcctcgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagcagagctgcaaactcagtcagagaaacacg

SEQ ID NO: 116330 - DNA, 30 bp, Homo sapiens; identical to SEQ ID NO: 83581
  chr19:41381504-41381534
  Hyper

SEQ ID NO: 116331 - DNA, 30 bp, Homo sapiens; identical to SEQ ID NO: 83582
  chr19:41416060-41416090
  Hypo

SEQ ID NO: 116332 - DNA, 165 bp, Homo sapiens
  chr19:41595988-41596153
  Hyper
ccggcgcttctccatcgccaccctaaggggttttggcgtgggcaagcgcggcatcgaggaacgcatccaggaggaggcgggcttcctcatcgacgccctccggggcacgcacggtgagtaggggaccccgagtgcgagggcgggaacccgcgctttctgcctggg

SEQ ID NO: 116333 - DNA, 30 bp, Homo sapiens; identical to SEQ ID NO: 45895
  chr19:41615907-41615937
  Hypo

SEQ ID NO: 116334 - DNA, 290 bp, Homo sapiens
  chr19:41641726-41642016
  Hyper
ggagcccagcaaaggcggggccaatgtgtggatagggcacttggaggtctggtaaggcagcaaaacgaacgaagccggccgcaggagtcggaggccccgaaagggatgtagccagtgacccggcgcttcctggatggggcgtggccggttcccgggcccgcctcctttcccgtccccaccacaggaatcttgttttctaaccggccgtgctggtggacactgcgcaattttgcacttggagcgccgaagaagttcgggttggatacgcggaccatcgaggcgcgtgtcct

SEQ ID NO: 116335 - DNA, 168 bp, Homo sapiens; identical to SEQ ID NO: 83589
  chr19:41673489-41673657
  Hypo

SEQ ID NO: 116336 - DNA, 30 bp, Homo sapiens; identical to SEQ ID NO: 83590
  chr19:41681188-41681218
  Hypo

SEQ ID NO: 116337 - DNA, 23 bp, Homo sapiens
  chr19:41694633-41694656
  Hypo
accacgcccggcaagaactttta

SEQ ID NO: 116338 - DNA, 95 bp, Homo sapiens; identical to SEQ ID NO: 83592
  chr19:41699111-41699206
  Hyper

SEQ ID NO: 116339 - DNA, 30 bp, Homo sapiens; identical to SEQ ID NO: 83593
  chr19:41732411-41732441
  Hyper

SEQ ID NO: 116340 - DNA, 65 bp, Homo sapiens; identical to SEQ ID NO: 83594
  chr19:41854198-41854263
  Hypo

SEQ ID NO: 116341 - DNA, 16 bp, Homo sapiens
  chr19:41881147-41881163
  Hypo
gcatgcaagtgagccc

SEQ ID NO: 116342 - DNA, 120 bp, Homo sapiens; identical to SEQ ID NO: 83596
  chr19:41881463-41881583
  Hypo

SEQ ID NO: 116343 - DNA, 93 bp, Homo sapiens; identical to SEQ ID NO: 83597
  chr19:41927388-41927481
  Hypo

SEQ ID NO: 116344 - DNA, 25 bp, Homo sapiens
  chr19:41947444-41947469
  Hypo
tcttgctgtgcggcccagttcctag

SEQ ID NO: 116345 - DNA, 104 bp, Homo sapiens; identical to SEQ ID NO: 83599
  chr19:41956235-41956339
  Hypo

SEQ ID NO: 116346 - DNA, 470 bp, Homo sapiens; identical to SEQ ID NO: 83601
  chr19:42028283-42028753
  Hyper

SEQ ID NO: 116347 - DNA, 86 bp, Homo sapiens; identical to SEQ ID NO: 83602
  chr19:42069045-42069131
  Hypo

SEQ ID NO: 116348 - DNA, 30 bp, Homo sapiens; identical to SEQ ID NO: 83604
  chr19:42195459-42195489
  Hyper

SEQ ID NO: 116349 - DNA, 22 bp, Homo sapiens
  chr19:42202343-42202365
  Hypo
ttcattttacttcaccggaaaa

SEQ ID NO: 116350 - DNA, 30 bp, Homo sapiens; identical to SEQ ID NO: 83606
  chr19:42257218-42257248
  Hyper

SEQ ID NO: 116351 - DNA, 30 bp, Homo sapiens; identical to SEQ ID NO: 83608
  chr19:42297369-42297399
  Hyper

SEQ ID NO: 116352 - DNA, 155 bp, Homo sapiens; identical to SEQ ID NO: 83609
  chr19:42348878-42349033
  Hypo

SEQ ID NO: 116353 - DNA, 141 bp, Homo sapiens; identical to SEQ ID NO: 83610
  chr19:42349292-42349433
  Hypo

SEQ ID NO: 116354 - DNA, 154 bp, Homo sapiens; identical to SEQ ID NO: 45900
  chr19:42373753-42373907
  Hypo

SEQ ID NO: 116355 - DNA, 757 bp, Homo sapiens; identical to SEQ ID NO: 83612
  chr19:42408203-42408960
  Hypo

SEQ ID NO: 116356 - DNA, 40 bp, Homo sapiens; identical to SEQ ID NO: 83613
  chr19:42409381-42409421
  Hypo

SEQ ID NO: 116357 - DNA, 116 bp, Homo sapiens; identical to SEQ ID NO: 83614
  chr19:42419358-42419474
  Hyper

SEQ ID NO: 116358 - DNA, 149 bp, Homo sapiens; identical to SEQ ID NO: 83615
  chr19:42444147-42444296
  Hyper

SEQ ID NO: 116359 - DNA, 193 bp, Homo sapiens
  chr19:42445005-42445198
  Hyper
ccccgaggcagaaagcgcggaccccgcctgtcgccgccgccgccgcccgctcccggactcgcgccccccgcgcgtccactctgatttctcggcccatttttcttcctctcctgtcactccggcgctcgccctcccgccgccggctgccccgccgcgctccgcttcccgcgggaacccccgctgcagccagccc

SEQ ID NO: 116360 - DNA, 30 bp, Homo sapiens; identical to SEQ ID NO: 83618
  chr19:42474541-42474571
  Hypo

SEQ ID NO: 116361 - DNA, 30 bp, Homo sapiens; identical to SEQ ID NO: 83619
  chr19:42484215-42484245
  Hypo

SEQ ID NO: 116362 - DNA, 22 bp, Homo sapiens
  chr19:42493742-42493764
  Hypo
ttacaggcgtgagccaccgtgc

SEQ ID NO: 116363 - DNA, 50 bp, Homo sapiens; identical to SEQ ID NO: 83621
  chr19:42496595-42496645
  Hypo

SEQ ID NO: 116364 - DNA, 30 bp, Homo sapiens; identical to SEQ ID NO: 83622
  chr19:42501421-42501451
  Hyper

SEQ ID NO: 116365 - DNA, 50 bp, Homo sapiens; identical to SEQ ID NO: 83623
  chr19:42507833-42507883
  Hypo

SEQ ID NO: 116366 - DNA, 166 bp, Homo sapiens; identical to SEQ ID NO: 83624
  chr19:42573985-42574151
  Hyper

SEQ ID NO: 116367 - DNA, 82 bp, Homo sapiens; identical to SEQ ID NO: 83625
  chr19:42578971-42579053
  Hypo

SEQ ID NO: 116368 - DNA, 285 bp, Homo sapiens; identical to SEQ ID NO: 83626
  chr19:42636368-42636653
  Hyper

SEQ ID NO: 116369 - DNA, 85 bp, Homo sapiens; identical to SEQ ID NO: 83627
  chr19:42680612-42680697
  Hyper

SEQ ID NO: 116370 - DNA, 152 bp, Homo sapiens; identical to SEQ ID NO: 83629
  chr19:42683697-42683849
  Hyper

SEQ ID NO: 116371 - DNA, 43 bp, Homo sapiens; identical to SEQ ID NO: 45904
  chr19:42697082-42697125
  Hypo

SEQ ID NO: 116372 - DNA, 143 bp, Homo sapiens; identical to SEQ ID NO: 83631
  chr19:42722596-42722739
  Hypo

SEQ ID NO: 116373 - DNA, 127 bp, Homo sapiens; identical to SEQ ID NO: 83632
  chr19:42774775-42774902
  Hyper

SEQ ID NO: 116374 - DNA, 644 bp, Homo sapiens
  chr19:42827856-42828500
  Hyper
gcacgtctatgggaacgtgacgtttatcagcgactcggtgcccaacttcacggagctcttctccatccccccgcccgccacctccgtaagccccgcggccccagcgcccgaggagctgctggcgccgcccctggagtacctgaccccgctcccggccccgccgccgcccccagcgcccggacccctgagccctcctcctgcctttcgcactccccgcgccccaacaccgcgccgcgaccgtcccctggcgcccgcgcccaccctgcctgactgggttctggcgctgttgcgcacacccccgcagactccctgcgccgtgcccccaccgcccgccttccgcggctctcccccagctccccggccgccgccggagttcgccccgcgcgccccgacgccgccctttgagtacctggccccgctgcccaggcgccccgccacccagtccttccctgactgacaacgtgcgtccacacctggggtggaagggttctccgggggagggggacgggccttcggggccgcatctgccccccgagggtcccggacggcctctgaccctgacccccctcccaggccgggaagcaggtggaggagacagcggtggcggcggcggtggccccgaggggccgcgtggtgaccatggc

SEQ ID NO: 116375 - DNA, 34 bp, Homo sapiens; identical to SEQ ID NO: 83640
  chr19:42856588-42856622
  Hypo

SEQ ID NO: 116376 - DNA, 16 bp, Homo sapiens
  chr19:42884253-42884269
  Hypo
gcgcccagcccagtga

SEQ ID NO: 116377 - DNA, 516 bp, Homo sapiens; identical to SEQ ID NO: 83643
  chr19:42905683-42906199
  Hyper

SEQ ID NO: 116378 - DNA, 46 bp, Homo sapiens; identical to SEQ ID NO: 83644
  chr19:42906867-42906913
  Hypo

SEQ ID NO: 116379 - DNA, 93 bp, Homo sapiens; identical to SEQ ID NO: 83645
  chr19:42907199-42907292
  Hypo

SEQ ID NO: 116380 - DNA, 30 bp, Homo sapiens; identical to SEQ ID NO: 83646
  chr19:42916465-42916495
  Hypo

SEQ ID NO: 116381 - DNA, 101 bp, Homo sapiens; identical to SEQ ID NO: 83648
  chr19:42927377-42927478
  Hyper

SEQ ID NO: 116382 - DNA, 675 bp, Homo sapiens; identical to SEQ ID NO: 83649
  chr19:42927725-42928400
  Hyper

SEQ ID NO: 116383 - DNA, 30 bp, Homo sapiens; identical to SEQ ID NO: 83651
  chr19:43044394-43044424
  Hypo

SEQ ID NO: 116384 - DNA, 152 bp, Homo sapiens; identical to SEQ ID NO: 83655
  chr19:43258522-43258674
  Hypo

SEQ ID NO: 116385 - DNA, 30 bp, Homo sapiens; identical to SEQ ID NO: 83656
  chr19:43385119-43385149
  Hypo

SEQ ID NO: 116386 - DNA, 32 bp, Homo sapiens; identical to SEQ ID NO: 83662
  chr19:43692087-43692119
  Hypo

SEQ ID NO: 116387 - DNA, 30 bp, Homo sapiens; identical to SEQ ID NO: 83665
  chr19:44022537-44022567
  Hypo

SEQ ID NO: 116388 - DNA, 38 bp, Homo sapiens; identical to SEQ ID NO: 83666
  chr19:44029701-44029739
  Hyper

SEQ ID NO: 116389 - DNA, 202 bp, Homo sapiens; identical to SEQ ID NO: 83667
  chr19:44030617-44030819
  Hyper

SEQ ID NO: 116390 - DNA, 225 bp, Homo sapiens; identical to SEQ ID NO: 83668
  chr19:44203639-44203864
  Hyper

SEQ ID NO: 116391 - DNA, 54 bp, Homo sapiens; identical to SEQ ID NO: 83669
  chr19:44223121-44223175
  Hypo

SEQ ID NO: 116392 - DNA, 137 bp, Homo sapiens; identical to SEQ ID NO: 83670
  chr19:44223519-44223656
  Hypo

SEQ ID NO: 116393 - DNA, 133 bp, Homo sapiens; identical to SEQ ID NO: 83671
  chr19:44274041-44274174
  Hypo

SEQ ID NO: 116394 - DNA, 318 bp, Homo sapiens; identical to SEQ ID NO: 83672
  chr19:44302850-44303168
  Hyper

SEQ ID NO: 116395 - DNA, 115 bp, Homo sapiens
  chr19:44324802-44324917
  Hyper
cggatcaggagcgcacgctcattcggcccagtgacctgtgggaattgtagtcccgggccggaaacgcaggagacgccagaaacccaagtttgggacggcgcgtcccaagggtttc

SEQ ID NO: 116396 - DNA, 49 bp, Homo sapiens; identical to SEQ ID NO: 83675
  chr19:44331793-44331842
  Hyper

SEQ ID NO: 116397 - DNA, 215 bp, Homo sapiens
  chr19:44405908-44406123
  Hyper
tgatttctgtggagacgatctactcaccacgtaggggctacagcagctcggacaccggaaaaagatctagagctcgagggtgaccctagcgcggtgacttctgggaaatgtagtccacccggaataaccatgtccacggcgcccgccattctgtagcctatgctcggagggcacatgagcaagagcttgaccatctgtaccgttggttgacttgc

SEQ ID NO: 116398 - DNA, 45 bp, Homo sapiens; identical to SEQ ID NO: 83678
  chr19:44455296-44455341
  Hyper

SEQ ID NO: 116399 - DNA, 46 bp, Homo sapiens; identical to SEQ ID NO: 37556
  chr19:44455621-44455667
  Hyper

SEQ ID NO: 116400 - DNA, 490 bp, Homo sapiens; identical to SEQ ID NO: 83680
  chr19:44488127-44488617
  Hyper

SEQ ID NO: 116401 - DNA, 60 bp, Homo sapiens; identical to SEQ ID NO: 83681
  chr19:44529378-44529438
  Hyper

SEQ ID NO: 116402 - DNA, 67 bp, Homo sapiens; identical to SEQ ID NO: 83682
  chr19:44529707-44529774
  Hyper

SEQ ID NO: 116403 - DNA, 104 bp, Homo sapiens; identical to SEQ ID NO: 83683
  chr19:44556147-44556251
  Hyper

SEQ ID NO: 116404 - DNA, 304 bp, Homo sapiens; identical to SEQ ID NO: 83684
  chr19:44576101-44576405
  Hyper

SEQ ID NO: 116405 - DNA, 27 bp, Homo sapiens
  chr19:44599783-44599810
  Hypo
acaaaatgggcctggcgcggtggctta

SEQ ID NO: 116406 - DNA, 30 bp, Homo sapiens; identical to SEQ ID NO: 83686
  chr19:44615558-44615588
  Hypo

SEQ ID NO: 116407 - DNA, 55 bp, Homo sapiens; identical to SEQ ID NO: 83687
  chr19:44645516-44645571
  Hyper

SEQ ID NO: 116408 - DNA, 448 bp, Homo sapiens; identical to SEQ ID NO: 83688
  chr19:44711515-44711963
  Hyper

SEQ ID NO: 116409 - DNA, 247 bp, Homo sapiens; identical to SEQ ID NO: 83689
  chr19:44905364-44905611
  Hyper

SEQ ID NO: 116410 - DNA, 35 bp, Homo sapiens; identical to SEQ ID NO: 83690
  chr19:44907102-44907137
  Hypo

SEQ ID NO: 116411 - DNA, 533 bp, Homo sapiens
  chr19:44952282-44952815
  Hyper
ccacaagtgggtgggcggctaccctgagaaaattcatgtcatcgatccgcaactgacacagtggagtctcccgcactgcagatctcatctcaaagccagagctggcctcaaactgcttttccaagcctggactgcgagggctgccgacccgggcccaccccgcacaggcgctcagaatgttcgatacgtgcgcctccttacacccctgcctcaccaggccgagctcatggaaatccgtgggcttcgaccctccgccgcacgttgtcccttcacactggtcctatagagccgatcctaattcccatggcctgacagtacaaccgcatggagatgcacgtctctaagacgcctcaccactgcctaagaagcaatcaaggtgacgcgcccaccggaaacggaagtagtcgactcgaggtgtgggactacctttcccagaaccctccgcagcgcagtccgatcctaggggcgatggtgtcgtaaatgcgcgtccacctcgagtcacgcccactgcgaggcggcgggaggcggcatgc

SEQ ID NO: 116412 - DNA, 124 bp, Homo sapiens; identical to SEQ ID NO: 83694
  chr19:45003229-45003353
  Hypo

SEQ ID NO: 116413 - DNA, 251 bp, Homo sapiens; identical to SEQ ID NO: 83697
  chr19:45147116-45147367
  Hyper

SEQ ID NO: 116414 - DNA, 35 bp, Homo sapiens; identical to SEQ ID NO: 83698
  chr19:45147699-45147734
  Hyper

SEQ ID NO: 116415 - DNA, 77 bp, Homo sapiens; identical to SEQ ID NO: 83699
  chr19:45207322-45207399
  Hypo

SEQ ID NO: 116416 - DNA, 30 bp, Homo sapiens; identical to SEQ ID NO: 83702
  chr19:45257135-45257165
  Hyper

SEQ ID NO: 116417 - DNA, 30 bp, Homo sapiens; identical to SEQ ID NO: 83703
  chr19:45257570-45257600
  Hyper

SEQ ID NO: 116418 - DNA, 30 bp, Homo sapiens; identical to SEQ ID NO: 83704
  chr19:45257848-45257878
  Hyper

SEQ ID NO: 116419 - DNA, 41 bp, Homo sapiens; identical to SEQ ID NO: 83705
  chr19:45279876-45279917
  Hypo

SEQ ID NO: 116420 - DNA, 30 bp, Homo sapiens; identical to SEQ ID NO: 83706
  chr19:45287728-45287758
  Hyper

SEQ ID NO: 116421 - DNA, 98 bp, Homo sapiens; identical to SEQ ID NO: 83707
  chr19:45300099-45300197
  Hyper

SEQ ID NO: 116422 - DNA, 63 bp, Homo sapiens; identical to SEQ ID NO: 83708
  chr19:45316633-45316696
  Hypo

SEQ ID NO: 116423 - DNA, 30 bp, Homo sapiens; identical to SEQ ID NO: 83709
  chr19:45316929-45316959
  Hypo

SEQ ID NO: 116424 - DNA, 39 bp, Homo sapiens; identical to SEQ ID NO: 83710
  chr19:45350901-45350940
  Hyper

SEQ ID NO: 116425 - DNA, 33 bp, Homo sapiens; identical to SEQ ID NO: 16517
  chr19:45381918-45381951
  Hypo

SEQ ID NO: 116426 - DNA, 30 bp, Homo sapiens; identical to SEQ ID NO: 83715
  chr19:45511777-45511807
  Hypo

SEQ ID NO: 116427 - DNA, 107 bp, Homo sapiens; identical to SEQ ID NO: 45911
  chr19:45570386-45570493
  Hypo

SEQ ID NO: 116428 - DNA, 257 bp, Homo sapiens; identical to SEQ ID NO: 83721
  chr19:45574443-45574700
  Hypo

SEQ ID NO: 116429 - DNA, 221 bp, Homo sapiens; identical to SEQ ID NO: 83722
  chr19:45574935-45575156
  Hypo

SEQ ID NO: 116430 - DNA, 30 bp, Homo sapiens; identical to SEQ ID NO: 45914
  chr19:45601584-45601614
  Hypo

SEQ ID NO: 116431 - DNA, 30 bp, Homo sapiens; identical to SEQ ID NO: 83724
  chr19:45603183-45603213
  Hypo

SEQ ID NO: 116432 - DNA, 33 bp, Homo sapiens; identical to SEQ ID NO: 83725
  chr19:45603877-45603910
  Hypo

SEQ ID NO: 116433 - DNA, 30 bp, Homo sapiens; identical to SEQ ID NO: 45915
  chr19:45616778-45616808
  Hypo

SEQ ID NO: 116434 - DNA, 30 bp, Homo sapiens; identical to SEQ ID NO: 83727
  chr19:45622695-45622725
  Hypo

SEQ ID NO: 116435 - DNA, 515 bp, Homo sapiens; identical to SEQ ID NO: 83728
  chr19:45626532-45627047
  Hypo

SEQ ID NO: 116436 - DNA, 30 bp, Homo sapiens; identical to SEQ ID NO: 83729
  chr19:45633892-45633922
  Hypo

SEQ ID NO: 116437 - DNA, 30 bp, Homo sapiens; identical to SEQ ID NO: 83730
  chr19:45654552-45654582
  Hypo

SEQ ID NO: 116438 - DNA, 1163 bp, Homo sapiens
  chr19:45655298-45656461
  Hyper
gcttgccctgaggcacggcccgacgggggcgccctggaggcgctgttggcccggtgggcagcgtggggggtatcgcgggtaggggacttgggcgggctgggcggcttgagcgcgctgacggctcggatgagacccatgcgccggcggatggagtggtccaggttgaccgtgcagcgcagcaggctctgcgcctcggccacggtgaaggggaagtcggcgcccaggaagcgctcgaagagctcggggtcgccgtccaggtcgagcacgttctgcaacgccttggtcatggtgtgcagctcgcggctgttgtcgcggaaaacgtcccagaggcgcgcgcggccctcgggcgcgcccccggtctgctgccggtcctccaggcactgcagcgcccagctcaggcggcacggccactggttggcgagcaccacccacgccaccgcctggcgcggcgtggggcccccaaagtccccctgctgctgctgctgctgcagcaggcgcacggtgatgggcacggtgttgacgatgcgccgcatggacaccacgttgtcgggcacgtactcgtagaggcagtcgcgctcgtcgtgaaggcagaagagcgcctcctggattcgccgcgccgcctcgtcgtcgatgcggccctgcccgcgctccgtccccgcctgcgcctgcaccgccagcagctgcgcgctctcgcccccggcgtcccccggcagccacggcttgcgcgtcatctcgcggtacaacaggtcgtcgcggctctgcaccgcatcgtgcaggaactgcagcttggtgcggcggcccataatgggcacagagaagggcagcgtgacagtgcggttgaggaagaggtagccgttatcggccgtgcccttcatgttgcccgcgctctctaggcacgcggccaggatgctggggtccacgaccaggatgaagatgaagggcgcgtggctgtcggacagcagcgtgttgatggcgttgagcacgcccaccacgcgctccgggtagcacgtgtccagcccggtgacctccagcaccacgcgcagcctgcgccgctggtagatctccaggaagcacaggaagtcggtgagcagctccacctccttcttcacctcgcacatgaaacccagctggctgccgaacttttcacgcgacaccagccgctc

SEQ ID NO: 116439 - DNA, 720 bp, Homo sapiens
  chr19:45656661-45657381
  Hyper
gcagccccaggcacacgcggcgccgacaatgccactcgctctggcagcagtcctgcctggtggccggcttgttgcccagcaccgagtacacgctgaagggcagtgcgccatagtggcggcggatgccctcgcacaacgtggtcaccaggccggcccacagcttgtcggtgcccgcgtactgccaggcgctaaagcggatgaaaaggaactgcacgttcctgcgccgcaggtgcacctcggtgatgatgggctgcaggaacaccaggtaccacagtagctgcgggacgccccagccgctcacggcacgcggccgccactgcacgtgctgcagctcctcgctctcgcgctgcgcggcctcctgctgcatcagcgctgcgggaagggagcccgggagccgcgtgagccgcagacccgccggggtgggcggggcctagtacgggcagggcggagcgctcctggagaggcgaggggcgcccagcagaggcgaggggctggaagcgagccgcggccgctccttaaagagctggaagccggtgcagaagcgggggcgtggagaggcctggagccgggcttggaccggaagcggtctgaaggccaggctgtggggtcgggatgggcagaggtagagccggcagaggagagatgggaggaggcaaaaagagatacgaggaagagccagggatgggcaagaggctggaggcggagcgagggtgtggaggg

SEQ ID NO: 116440 - DNA, 30 bp, Homo sapiens; identical to SEQ ID NO: 16519
  chr19:45709152-45709182
  Hypo

SEQ ID NO: 116441 - DNA, 120 bp, Homo sapiens; identical to SEQ ID NO: 83738
  chr19:45751309-45751429
  Hypo

SEQ ID NO: 116442 - DNA, 44 bp, Homo sapiens; identical to SEQ ID NO: 83739
  chr19:45753553-45753597
  Hypo

SEQ ID NO: 116443 - DNA, 83 bp, Homo sapiens; identical to SEQ ID NO: 83740
  chr19:45755351-45755434
  Hyper

SEQ ID NO: 116444 - DNA, 264 bp, Homo sapiens; identical to SEQ ID NO: 83741
  chr19:45810003-45810267
  Hypo

SEQ ID NO: 116445 - DNA, 92 bp, Homo sapiens; identical to SEQ ID NO: 45921
  chr19:45810770-45810862
  Hypo

SEQ ID NO: 116446 - DNA, 492 bp, Homo sapiens; identical to SEQ ID NO: 83743
  chr19:45826794-45827286
  Hyper

SEQ ID NO: 116447 - DNA, 35 bp, Homo sapiens; identical to SEQ ID NO: 83744
  chr19:45835233-45835268
  Hypo

SEQ ID NO: 116448 - DNA, 250 bp, Homo sapiens; identical to SEQ ID NO: 83745
  chr19:45851193-45851443
  Hypo

SEQ ID NO: 116449 - DNA, 77 bp, Homo sapiens; identical to SEQ ID NO: 83746
  chr19:45852140-45852217
  Hypo

SEQ ID NO: 116450 - DNA, 30 bp, Homo sapiens; identical to SEQ ID NO: 83747
  chr19:45855901-45855931
  Hypo

SEQ ID NO: 116451 - DNA, 624 bp, Homo sapiens
  chr19:45888782-45889406
  Hyper
cgccaggtacccaggcgccagcagccctgcctcgcacctgccaggtaggtggcgcagtcagcataaccctcgcggtaagggtcgcacttctcgaaggcggtggcgccgtcgctgagcgtggtggcgaagattgcagcgccgtgctgcaccagcgccatgcagatgactgtgtcgttgcacgacgccgcgcagtgcaagggtgtcctaggcgtgggggtggggggttgcggggaacgatgcgtgagaggctgcgcgtccgcccacgggggacccagcccaccgcgcgggtcggggctcaccagccgtggctgtcgggggagttgacattggcacccgcggtgatgaggaaatccacgatagagtagttggcgccgcagatggcgttgtgcaaggcagtgatgccctcctcgttgggctggctcgggtcgttcatctgagtgcaccgggggagggggaagactcagtcccgcggctggcatctgcgatgcccccgccgtgcccacctcccgctcagcagcgctcacctccttcaccgcctgctgcaccacctccagctccccggtcagcgccgcgtccaggaggagcaccagagggttgaggcgcgcgcggcgggccttgcgcggg

SEQ ID NO: 116452 - DNA, 30 bp, Homo sapiens; identical to SEQ ID NO: 83750
  chr19:45926223-45926253
  Hypo

SEQ ID NO: 116453 - DNA, 163 bp, Homo sapiens; identical to SEQ ID NO: 83751
  chr19:45931112-45931275
  Hyper

SEQ ID NO: 116454 - DNA, 53 bp, Homo sapiens; identical to SEQ ID NO: 83752
  chr19:45931735-45931788
  Hyper

SEQ ID NO: 116455 - DNA, 34 bp, Homo sapiens; identical to SEQ ID NO: 83753
  chr19:45941595-45941629
  Hypo

SEQ ID NO: 116456 - DNA, 30 bp, Homo sapiens; identical to SEQ ID NO: 83755
  chr19:45976163-45976193
  Hyper

SEQ ID NO: 116457 - DNA, 264 bp, Homo sapiens; identical to SEQ ID NO: 83756
  chr19:45997416-45997680
  Hypo

SEQ ID NO: 116458 - DNA, 783 bp, Homo sapiens
  chr19:46001719-46002502
  Hyper
agggctgaaggatggcggtcctggcccgccagctgcagcgtctcctctggaccgcttgcaagaaaaaggagagggagaaggaggggagggaggaagaggaggaggaggaggcggggcgcagggcccccgaagggcctcggtctctgttgacagcgccgcgccgcgcccagcggccgcacgggggtgccgaggcgtctgggggcctgcgcttcggggcgagcgcagcgcaaggctggcgcgcgcgcatggaggatgctcactgcacttggctttcgttacctggtctgcccccgggctgggccttgtttgccgtcctcgacggccacggtggggctcgagctgcccgcttcggtgcacgccatttgccaggccatgtgctccaggagctgggcccggagcctagcgagcccgagggcgtgcgcgaggcgctgcgccgagccttcttgagcgccgacgagcgcctgcgctccctctggccccgcgtggaaacgggcggctgcacggccgtggtgttgctggtctccccgcggtttctgtacctggcgcactgcggtgactcccgcgcggtgctgagccgcgctggcgccgtggccttcagcacagaggaccaccggccccttcgaccccgggaacgcgagcgcatccacgccgctggcggcaccatccgccgccgccgcgtcgagggctctctggccgtgtcgcgagcgttgggcgactttacctacaaggaggctccggggaggccccccgagctacagctcgtttctgcggagccagaggtgg

SEQ ID NO: 116459 - DNA, 32 bp, Homo sapiens; identical to SEQ ID NO: 83760
  chr19:46012412-46012444
  Hyper

SEQ ID NO: 116460 - DNA, 21 bp, Homo sapiens
  chr19:46087047-46087068
  Hypo
ccgcgccggaccttactatgc

SEQ ID NO: 116461 - DNA, 150 bp, Homo sapiens
  chr19:46105207-46105357
  Hyper
gagcaacagagggggcgggcaccgagacggcgcgggagactgaggcagcccccgagggggcggggaggagcggtctcgccacgagcagggcaacctagtgagaccccgcagcatcgcgggcagccggggaggacccggcacttacctgcg

SEQ ID NO: 116462 - DNA, 86 bp, Homo sapiens; identical to SEQ ID NO: 83765
  chr19:46144079-46144165
  Hypo

SEQ ID NO: 116463 - DNA, 45 bp, Homo sapiens; identical to SEQ ID NO: 83766
  chr19:46146928-46146973
  Hyper

SEQ ID NO: 116464 - DNA, 61 bp, Homo sapiens; identical to SEQ ID NO: 83767
  chr19:46148823-46148884
  Hyper

SEQ ID NO: 116465 - DNA, 30 bp, Homo sapiens; identical to SEQ ID NO: 83768
  chr19:46172830-46172860
  Hyper

SEQ ID NO: 116466 - DNA, 355 bp, Homo sapiens; identical to SEQ ID NO: 83769
  chr19:46173896-46174251
  Hyper

SEQ ID NO: 116467 - DNA, 200 bp, Homo sapiens; identical to SEQ ID NO: 83771
  chr19:46180359-46180559
  Hyper

SEQ ID NO: 116468 - DNA, 151 bp, Homo sapiens; identical to SEQ ID NO: 83773
  chr19:46234852-46235003
  Hypo

SEQ ID NO: 116469 - DNA, 60 bp, Homo sapiens; identical to SEQ ID NO: 83774
  chr19:46269160-46269220
  Hypo

SEQ ID NO: 116470 - DNA, 146 bp, Homo sapiens
  chr19:46283022-46283168
  Hyper
cggttcggcttacctcgctgaacgccccgcgtccgatcaccttcagaatctcgaagtcgtccctctgcagtcggacctccttaagcctcaccacgatgggctccgctgggggggtggtgggggaaaagaaccgagggtcaccagaa

SEQ ID NO: 116471 - DNA, 244 bp, Homo sapiens; identical to SEQ ID NO: 83777
  chr19:46321178-46321422
  Hypo

SEQ ID NO: 116472 - DNA, 85 bp, Homo sapiens; identical to SEQ ID NO: 83778
  chr19:46324647-46324732
  Hypo

SEQ ID NO: 116473 - DNA, 149 bp, Homo sapiens; identical to SEQ ID NO: 83779
  chr19:46327091-46327240
  Hypo

SEQ ID NO: 116474 - DNA, 30 bp, Homo sapiens; identical to SEQ ID NO: 45930
  chr19:46346873-46346903
  Hypo

SEQ ID NO: 116475 - DNA, 95 bp, Homo sapiens; identical to SEQ ID NO: 45931
  chr19:46356540-46356635
  Hypo

SEQ ID NO: 116476 - DNA, 599 bp, Homo sapiens
  chr19:46379843-46380442
  Hyper
ctctacctgccacctcgcaggccaggccctctattcctgtcgctgcgccccgccttgccggctgcgtgtcacccccgccccctgccgcgctggctccccgtccgtcccaccagccttgctgtcctgggcaggccggggaattcctcccggttcctggaaaaaacaactggggccgagagaaaggccctcagtctccccaggcacccgcccccctccctcgggcctgggggtctctcccggagtcggccagcccgaggcaggaagccctgcggtttctggcttctcccaggcggcctccggatctggcccccgccccccggccaacagcccaaatattattccgcgggaggagtcggtggtggcgggaggaggcccaggctgaaagaggctttcagggcggccaggcctggggcttcctgtccccaggctcgggcctcaggccgccccagtggggacctcaggtggccggaggggcggggtgttgttgtagggtcctcgggggagggtggggccatccgtcggggtgtctggtggccaccagctctgctggcgtgggcaggtgtgacccccaccccagggacagccggctgatgtccagc

SEQ ID NO: 116477 - DNA, 149 bp, Homo sapiens; identical to SEQ ID NO: 83784
  chr19:46404522-46404671
  Hypo

SEQ ID NO: 116478 - DNA, 22 bp, Homo sapiens
  chr19:46461106-46461128
  Hypo
agcactttgggaggccgaggcg

SEQ ID NO: 116479 - DNA, 30 bp, Homo sapiens; identical to SEQ ID NO: 83786
  chr19:46474960-46474990
  Hyper

SEQ ID NO: 116480 - DNA, 529 bp, Homo sapiens
  chr19:46476943-46477472
  Hyper
acagagcctggagagcggccgtgagcaggatggcagggccgaggggggtctccgatagggccgggaaagaactgagaggtggggtctctcctgggaccacagaggctggggactggacgcgccactggggggacgggactccccgcttcttcttggctccctggggcaagagggccgagccccccagaccctgctcggggtggggggccggaggagcgtggccggagtgggaggcggaggcggccgctagtgggggcccggggggcggcgggcgcgggcggcggcggcgacggggctggcggtggctgctggcccgagcatcttcttcccggaggctcccacagcgcctggcccctcccacccaacgaggtcacgcccatgccgggtagggccacgcccttcggcgcccccattggtccagccttgaagcctggaccacgtccctctgggttggccacgcccctcccggcggcagagagctggacccgactcccccaggctgctgggaggaccccgggctcctccaagc

SEQ ID NO: 116481 - DNA, 327 bp, Homo sapiens; identical to SEQ ID NO: 83789
  chr19:46519255-46519582
  Hyper

SEQ ID NO: 116482 - DNA, 30 bp, Homo sapiens; identical to SEQ ID NO: 83790
  chr19:46580568-46580598
  Hyper

SEQ ID NO: 116483 - DNA, 25 bp, Homo sapiens
  chr19:46763496-46763521
  Hypo
ctaccgcgcccggccttttttgtct

SEQ ID NO: 116484 - DNA, 45 bp, Homo sapiens; identical to SEQ ID NO: 83795
  chr19:46800530-46800575
  Hyper

SEQ ID NO: 116485 - DNA, 30 bp, Homo sapiens; identical to SEQ ID NO: 83796
  chr19:46807600-46807630
  Hypo

SEQ ID NO: 116486 - DNA, 238 bp, Homo sapiens; identical to SEQ ID NO: 83797
  chr19:46811841-46812079
  Hypo

SEQ ID NO: 116487 - DNA, 35 bp, Homo sapiens; identical to SEQ ID NO: 83799
  chr19:46876191-46876226
  Hypo

SEQ ID NO: 116488 - DNA, 635 bp, Homo sapiens; identical to SEQ ID NO: 83800
  chr19:46907187-46907822
  Hyper

SEQ ID NO: 116489 - DNA, 51 bp, Homo sapiens; identical to SEQ ID NO: 83801
  chr19:46908071-46908122
  Hyper

SEQ ID NO: 116490 - DNA, 604 bp, Homo sapiens
  chr19:46916491-46917095
  Hyper
tttccaggatgcctacgtgagccgggggcgaggtcagtcccaaggctcaaggcccactccaagctggaaacgtggtgtcccagctccaagttggggcgcgcgggctgccagcgactcttcctgccccaggccccagggacgcggctggaacttgggacaggacttcgcagacaaagacggtccagtcgaagctattcaatatggccgaggcgctgggaggccccagcccgggcctccagtagggtcccccgcccccaggcaggccgccacccagctccaggctgaccttgacgcgccgcagcctgccagcccgcgcgcttagagctctgcaccgtggagcgcgcgggcaggaagttcctcctcgccctccgccagaatgaggcccaccttcccccgtctcatcttacactcccagactctggaagactgacaggggggctgtccactcccttcggggcggcctccttcccctcccccacaggggtgtggccgcgccccgggcctagctgggcccattgcttcccagcgaagcggcagtggcccacgtcagcacctttcctgaaaggcagcggttcccaaacctgccatccgaaatgtgcaagtt

SEQ ID NO: 116491 - DNA, 205 bp, Homo sapiens; identical to SEQ ID NO: 83804
  chr19:46929995-46930200
  Hyper

SEQ ID NO: 116492 - DNA, 52 bp, Homo sapiens; identical to SEQ ID NO: 83805
  chr19:46931467-46931519
  Hypo

SEQ ID NO: 116493 - DNA, 283 bp, Homo sapiens; identical to SEQ ID NO: 83806
  chr19:46932053-46932336
  Hyper

SEQ ID NO: 116494 - DNA, 471 bp, Homo sapiens
  chr19:46974489-46974960
  Hyper
ccccaacccaggccccggtgctcacacgtgtccctgaatctgcagcaaaaggccctaggaccctcccccgggcctgacgctccgcctgcccagccgggacttacttggcagatcagcctccgaccgcccagccaggccaaggagacgcagtggaatgcagccgtttcccagtcgctggctccggctaccccggcgccgctgctagaggcagaaagggccaagaaggcgccgtccgcccccgctccggcccaggcgggtcacggggcgtccagactcgatgccgttagcggcgagaagccgaggttggcgtcgcagcgcgcgcctgcgcactggctcccgcaccgccgctcgggggtcttgggctgcgcaggtgccgacgtctccatggcaaccgggcgtgggttgctagggctgagcccggccggcgcgccggcgctgcaattggacctagggagccgggtgcaagagtgg

SEQ ID NO: 116495 - DNA, 1017 bp, Homo sapiens
  chr19:46992698-46993715
  Hyper
tcctcatctagggagcgtaaccccagcctccccaccgcatgctccctgcgggagggtcctgtttcctgcaccaagaacagggcctgggacgcgccagccctggataaatctcatggactgcgcggatggcgctgagggctcctcccagacagtcgccttctctcccaggagggggcaaccgcgctccgctccacccgtcgccagaggctccacgcgcgggacagacccggctgctgcagcctgtgctggtctctgtgcaccgggacccttccctgcaggatctcaaggcctttacgcggctgctccttcgaccccaaacactcctccccatccccgccggagcactccctccaggaatgagggaatgaaaacaatgtttctttccagcacattccccaccaggcctatctgggatctgactcacccagtccgcgtggttcattccgaccgtcagtcattcaacaaataacagccgccgccgcgtgccaggcacggtgttggggctggggacacgaaggggaaaggccaagccacactttttccctacggagctggccctaagccgctctgccgcgcctctccccgccacgcccacctgcccccatgccgcataggtccccacagccaccgctcagggccctctgcaggggctgctgctgctgcaagcccacggggcgctggggggagtttgaaagcaggaggaaagggacgccatttgggggaatgctcaggccgtggtggcagcagcagctggcggtcactgcggtgaaccaggggctcccgggtctctcctcaagcaagccggccccgtgcgtggaacttggcagtcctacactagggctctgatcaccagcctttcccaagtggctcctccagccctcgggagggagcagctccctgcattgctaatattgggacaaaacgatctccctgtttttgcacttcctgattgcaataccccagtcaccaatttcctctattaacctccctgacaagtacagtcggtgtgccaggggg

SEQ ID NO: 116496 - DNA, 77 bp, Homo sapiens; identical to SEQ ID NO: 37596
  chr19:46996589-46996666
  Hyper

SEQ ID NO: 116497 - DNA, 225 bp, Homo sapiens
  chr19:46996871-46997096
  Hyper
cttggatccagtgggcgcctggcccttggcctcgcctgccctggcatgggccccggcgcccgcgctccccttcttcttcctgcttcctgcggcgtcgtcctgggccgagccccggctcccggctttcttctcgggagtgacgccccggcctcggcctcggccgcccgcgcgggttttgcgggccccggaagcggtgggaggcgcgccggccggagtcaggcccct

SEQ ID NO: 116498 - DNA, 30 bp, Homo sapiens; identical to SEQ ID NO: 83816
  chr19:47017854-47017884
  Hypo

SEQ ID NO: 116499 - DNA, 30 bp, Homo sapiens; identical to SEQ ID NO: 83818
  chr19:47105822-47105852
  Hyper

SEQ ID NO: 116500 - DNA, 20 bp, Homo sapiens
  chr19:47116638-47116658
  Hypo
gctggaatgcagtggcgcca

SEQ ID NO: 116501 - DNA, 260 bp, Homo sapiens; identical to SEQ ID NO: 83820
  chr19:47116898-47117158
  Hypo

SEQ ID NO: 116502 - DNA, 337 bp, Homo sapiens; identical to SEQ ID NO: 83822
  chr19:47142808-47143145
  Hyper

SEQ ID NO: 116503 - DNA, 542 bp, Homo sapiens
  chr19:47152566-47153108
  Hyper
caagcggccctcagccgggctgtcggggggtgagggggcggcgggcggcgcagcgggctcgggtgccgcctccgactcccacgacgacgcccaggcgcggctcaaggcggcagggctggtggggtggcccccgacgcgctccaacgagggctcccgcgcgggtcgcgcgctgccgggggacggagacgcgtcgggcggccgctggcgcacgctgttctggcgccgcgggccgccgtccgcgcccccgggactggtccggggctggcccgccccccggcggcggcgcctgcgcaggagcgccgagatgtagccgtccaggggccgccctgcgccccccgcgtcgggcgagtcggtgggagggcggccgcagggccgcgggctgcgcatcgccacggcgtgcagggggctgggcgtcagaaagggcccggcgcgggcccgccgctccgccgaggagcaggcctccgggccggcggacccccctgccgtcgggtagggcgctgagaaggaccgcggcaccgctgcccgcgcgcccaccacctccg

SEQ ID NO: 116504 - DNA, 377 bp, Homo sapiens; identical to SEQ ID NO: 83824
  chr19:47200235-47200612
  Hypo

SEQ ID NO: 116505 - DNA, 37 bp, Homo sapiens; identical to SEQ ID NO: 83827
  chr19:47273996-47274033
  Hypo

SEQ ID NO: 116506 - DNA, 37 bp, Homo sapiens; identical to SEQ ID NO: 45936
  chr19:47284561-47284598
  Hypo

SEQ ID NO: 116507 - DNA, 30 bp, Homo sapiens; identical to SEQ ID NO: 83829
  chr19:47345049-47345079
  Hypo

SEQ ID NO: 116508 - DNA, 44 bp, Homo sapiens; identical to SEQ ID NO: 16528
  chr19:47429440-47429484
  Hypo

SEQ ID NO: 116509 - DNA, 32 bp, Homo sapiens; identical to SEQ ID NO: 83831
  chr19:47482387-47482419
  Hypo

SEQ ID NO: 116510 - DNA, 294 bp, Homo sapiens; identical to SEQ ID NO: 83832
  chr19:47522989-47523283
  Hyper

SEQ ID NO: 116511 - DNA, 162 bp, Homo sapiens; identical to SEQ ID NO: 37600
  chr19:47523562-47523724
  Hyper

SEQ ID NO: 116512 - DNA, 248 bp, Homo sapiens; identical to SEQ ID NO: 83834
  chr19:47524686-47524934
  Hyper

SEQ ID NO: 116513 - DNA, 35 bp, Homo sapiens; identical to SEQ ID NO: 83835
  chr19:47540684-47540719
  Hypo

SEQ ID NO: 116514 - DNA, 76 bp, Homo sapiens; identical to SEQ ID NO: 83836
  chr19:47593170-47593246
  Hypo

SEQ ID NO: 116515 - DNA, 66 bp, Homo sapiens; identical to SEQ ID NO: 83837
  chr19:47603348-47603414
  Hypo

SEQ ID NO: 116516 - DNA, 30 bp, Homo sapiens; identical to SEQ ID NO: 45939
  chr19:47633375-47633405
  Hypo

SEQ ID NO: 116517 - DNA, 666 bp, Homo sapiens
  chr19:47742597-47743263
  Hyper
ctgcagacctaaaaccgtctcgtctccaagatcttgtctgccattctgggcaagcagatttcgcagcctggggagagggagttgggaaggacttaacttttcaccgcagggcctgagtcctggctttccgcggtggggaaggggtctcccgggtcccctcggtgtggccggccctgcaggccgggaggctggaccggggccgggtgggggctgggcgggggcgcgggcgtccgcagggtccgagcggccggcgcgcgtgtgaaggttaccgcttcccggcggggcgggggccgcgcgctgttgctggggtctgcggggcctgcctgcgcccgcgccccccctccttcccggccagccagtgagcggtacccgccgccgttgccaggggaaactcgccgccccgttacccagcaacaagcctggcccaaccaggcgcgaggaccccccaggccccgcccgccgctgcccaccgcgtgcccaatgccaggcgggcagagccggcccagctcccggagacggcgagcgcgctcattggccaccgccgcgtccgcccggatctgggggagccctcggcgcggggggcggggaaccgggccccggggagctgccgggcgcgcggcctgcaaacctgcgaccggctggggtgatacccgggctgtgcaccat

SEQ ID NO: 116518 - DNA, 30 bp, Homo sapiens; identical to SEQ ID NO: 37603
  chr19:47746438-47746468
  Hyper

SEQ ID NO: 116519 - DNA, 77 bp, Homo sapiens; identical to SEQ ID NO: 83842
  chr19:47783551-47783628
  Hypo

SEQ ID NO: 116520 - DNA, 26 bp, Homo sapiens
  chr19:47819208-47819234
  Hypo
catccatctgtccatcgattcatcca

SEQ ID NO: 116521 - DNA, 30 bp, Homo sapiens; identical to SEQ ID NO: 45941
  chr19:47847634-47847664
  Hypo

SEQ ID NO: 116522 - DNA, 146 bp, Homo sapiens; identical to SEQ ID NO: 83845
  chr19:47848947-47849093
  Hypo

SEQ ID NO: 116523 - DNA, 30 bp, Homo sapiens; identical to SEQ ID NO: 83846
  chr19:47861508-47861538
  Hypo

SEQ ID NO: 116524 - DNA, 23 bp, Homo sapiens
  chr19:47864411-47864434
  Hypo
atgacaatggcaggccgtcccgg

SEQ ID NO: 116525 - DNA, 83 bp, Homo sapiens
  chr19:47910482-47910565
  Hyper
gcgggggaggcagagcggggcgagcaggggcagtggctctgcggggctcggggcctccgtcagcaccgcggacagcgcccggg

SEQ ID NO: 116526 - DNA, 508 bp, Homo sapiens; identical to SEQ ID NO: 83850
  chr19:47921346-47921854
  Hyper

SEQ ID NO: 116527 - DNA, 39 bp, Homo sapiens; identical to SEQ ID NO: 83851
  chr19:47923045-47923084
  Hyper

SEQ ID NO: 116528 - DNA, 99 bp, Homo sapiens; identical to SEQ ID NO: 83852
  chr19:47923344-47923443
  Hyper

SEQ ID NO: 116529 - DNA, 77 bp, Homo sapiens; identical to SEQ ID NO: 83853
  chr19:47924604-47924681
  Hyper

SEQ ID NO: 116530 - DNA, 39 bp, Homo sapiens; identical to SEQ ID NO: 37606
  chr19:47925553-47925592
  Hyper

SEQ ID NO: 116531 - DNA, 623 bp, Homo sapiens; identical to SEQ ID NO: 83856
  chr19:47933200-47933823
  Hyper

SEQ ID NO: 116532 - DNA, 137 bp, Homo sapiens; identical to SEQ ID NO: 83858
  chr19:47947714-47947851
  Hyper

SEQ ID NO: 116533 - DNA, 146 bp, Homo sapiens; identical to SEQ ID NO: 83859
  chr19:47950977-47951123
  Hyper

SEQ ID NO: 116534 - DNA, 420 bp, Homo sapiens
  chr19:47960571-47960991
  Hyper
ggatctggatgacctcgcggcggctggcgtccagctcgcgcgcctcggcggggcccgggcccaggccgcccagctcacctggggcctcggcgcccacgaacgtgccgtccagctcgatgctcttcggggggtcgccctcggcgcctatgatgatgccgctgcgtgggtcggtgcggtagcgcttgtacacgtacttgtagaagagcagccgcttgtcggccatccaggcgaataccacgcacaccgggaagaagaccagggtcagcagcgcctcccacacctgcgggcggcgggcgtcagggcgaggccgggcgggccgccttctccctccccgcctctctgtctcagtctctgtccgcctctgccactcctcatctctctccccaacccccaaccccgccccgtcgtctctccctatcc

SEQ ID NO: 116535 - DNA, 30 bp, Homo sapiens; identical to SEQ ID NO: 83863
  chr19:47969433-47969463
  Hypo

SEQ ID NO: 116536 - DNA, 78 bp, Homo sapiens; identical to SEQ ID NO: 83865
  chr19:47986518-47986596
  Hypo

SEQ ID NO: 116537 - DNA, 319 bp, Homo sapiens; identical to SEQ ID NO: 83866
  chr19:48003347-48003666
  Hypo

SEQ ID NO: 116538 - DNA, 186 bp, Homo sapiens; identical to SEQ ID NO: 83867
  chr19:48003928-48004114
  Hypo

SEQ ID NO: 116539 - DNA, 324 bp, Homo sapiens; identical to SEQ ID NO: 83869
  chr19:48076446-48076770
  Hyper

SEQ ID NO: 116540 - DNA, 31 bp, Homo sapiens; identical to SEQ ID NO: 83870
  chr19:48106994-48107025
  Hypo

SEQ ID NO: 116541 - DNA, 71 bp, Homo sapiens; identical to SEQ ID NO: 83871
  chr19:48137031-48137102
  Hypo

SEQ ID NO: 116542 - DNA, 30 bp, Homo sapiens; identical to SEQ ID NO: 45947
  chr19:48137321-48137351
  Hypo

SEQ ID NO: 116543 - DNA, 146 bp, Homo sapiens; identical to SEQ ID NO: 83873
  chr19:48151265-48151411
  Hypo

SEQ ID NO: 116544 - DNA, 30 bp, Homo sapiens; identical to SEQ ID NO: 83876
  chr19:48207394-48207424
  Hypo

SEQ ID NO: 116545 - DNA, 24 bp, Homo sapiens
  chr19:48213122-48213146
  Hypo
agttcacagatcctccggaatttt

SEQ ID NO: 116546 - DNA, 80 bp, Homo sapiens; identical to SEQ ID NO: 83878
  chr19:48237374-48237454
  Hypo

SEQ ID NO: 116547 - DNA, 94 bp, Homo sapiens; identical to SEQ ID NO: 83879
  chr19:48244303-48244397
  Hypo

SEQ ID NO: 116548 - DNA, 37 bp, Homo sapiens; identical to SEQ ID NO: 83880
  chr19:48293267-48293304
  Hypo

SEQ ID NO: 116549 - DNA, 38 bp, Homo sapiens; identical to SEQ ID NO: 83881
  chr19:48297784-48297822
  Hypo

SEQ ID NO: 116550 - DNA, 30 bp, Homo sapiens; identical to SEQ ID NO: 83882
  chr19:48313221-48313251
  Hypo

SEQ ID NO: 116551 - DNA, 30 bp, Homo sapiens; identical to SEQ ID NO: 83883
  chr19:48334093-48334123
  Hypo

SEQ ID NO: 116552 - DNA, 300 bp, Homo sapiens; identical to SEQ ID NO: 83886
  chr19:48478580-48478880
  Hypo

SEQ ID NO: 116553 - DNA, 182 bp, Homo sapiens; identical to SEQ ID NO: 83888
  chr19:48525268-48525450
  Hypo

SEQ ID NO: 116554 - DNA, 44 bp, Homo sapiens; identical to SEQ ID NO: 83889
  chr19:48563530-48563574
  Hypo

SEQ ID NO: 116555 - DNA, 21 bp, Homo sapiens
  chr19:48586356-48586377
  Hypo
ccaccgcgcctggccctggct

SEQ ID NO: 116556 - DNA, 21 bp, Homo sapiens
  chr19:48614830-48614851
  Hypo
aagcccagcactaagcgtcat

SEQ ID NO: 116557 - DNA, 30 bp, Homo sapiens; identical to SEQ ID NO: 83892
  chr19:48771570-48771600
  Hypo

SEQ ID NO: 116558 - DNA, 115 bp, Homo sapiens; identical to SEQ ID NO: 83893
  chr19:48774859-48774974
  Hyper

SEQ ID NO: 116559 - DNA, 60 bp, Homo sapiens; identical to SEQ ID NO: 83894
  chr19:48775188-48775248
  Hyper

SEQ ID NO: 116560 - DNA, 84 bp, Homo sapiens; identical to SEQ ID NO: 83895
  chr19:48775999-48776083
  Hypo

SEQ ID NO: 116561 - DNA, 30 bp, Homo sapiens; identical to SEQ ID NO: 83896
  chr19:48800316-48800346
  Hypo

SEQ ID NO: 116562 - DNA, 274 bp, Homo sapiens; identical to SEQ ID NO: 83897
  chr19:48800569-48800843
  Hypo

SEQ ID NO: 116563 - DNA, 168 bp, Homo sapiens; identical to SEQ ID NO: 83898
  chr19:48806475-48806643
  Hypo

SEQ ID NO: 116564 - DNA, 16 bp, Homo sapiens
  chr19:48834248-48834264
  Hypo
tggagtgcagtggtac

SEQ ID NO: 116565 - DNA, 30 bp, Homo sapiens; identical to SEQ ID NO: 45957
  chr19:48844484-48844514
  Hypo

SEQ ID NO: 116566 - DNA, 18 bp, Homo sapiens
  chr19:48857797-48857815
  Hypo
aagcgtgagtcactgtgc

SEQ ID NO: 116567 - DNA, 32 bp, Homo sapiens; identical to SEQ ID NO: 37612
  chr19:48867764-48867796
  Hyper

SEQ ID NO: 116568 - DNA, 325 bp, Homo sapiens; identical to SEQ ID NO: 83903
  chr19:48901815-48902140
  Hyper

SEQ ID NO: 116569 - DNA, 33 bp, Homo sapiens; identical to SEQ ID NO: 83904
  chr19:48902532-48902565
  Hypo

SEQ ID NO: 116570 - DNA, 153 bp, Homo sapiens; identical to SEQ ID NO: 83905
  chr19:48902805-48902958
  Hypo

SEQ ID NO: 116571 - DNA, 30 bp, Homo sapiens; identical to SEQ ID NO: 83906
  chr19:48903408-48903438
  Hypo

SEQ ID NO: 116572 - DNA, 215 bp, Homo sapiens; identical to SEQ ID NO: 83907
  chr19:48918124-48918339
  Hyper

SEQ ID NO: 116573 - DNA, 95 bp, Homo sapiens; identical to SEQ ID NO: 83908
  chr19:48918639-48918734
  Hyper

SEQ ID NO: 116574 - DNA, 291 bp, Homo sapiens
  chr19:48946736-48947027
  Hyper
gcctggagctgctgccgccgccgcgccatctcagctgctcgcacgatggcctggacggcggctggtgggcgccaccgcctccaccctgggccgccgggcccctgccccgacgccgggcccgctgcgggtgcccgcggtcgcacccgcaccgcccgcgggcctcgcaccgcacgcccgccgccgccgcgccccaccaccacaggcaccggcgcgccgctgggggctgggacctcccgccgcccgcgcccacctcgcgctcgctcgaggacctcagctcgtgccctcgcgccg

SEQ ID NO: 116575 - DNA, 236 bp, Homo sapiens
  chr19:48947309-48947545
  Hyper
ccccgcctggagcagcgtcctgcgccccctggttctggaggaaccgcaagccggagaggatttggtccctcaactatcacccagcctgagaacgagggggcgggggccttggagcccaccggacttttttttaaacccgacaagggctttttaacgtcaccagatggggcgggaggtggggggttcacgccactcccgcgtcccacctccacgcccggggccgtggcccccacatc

SEQ ID NO: 116576 - DNA, 48 bp, Homo sapiens
  chr19:48947850-48947898
  Hyper
ctctgacctaggacacgtccccaacggaagccccgccttcccttgcac

SEQ ID NO: 116577 - DNA, 22 bp, Homo sapiens
  chr19:48989603-48989625
  Hypo
ccgcgcccggccttttggaaca

SEQ ID NO: 116578 - DNA, 66 bp, Homo sapiens; identical to SEQ ID NO: 83912
  chr19:48994825-48994891
  Hyper

SEQ ID NO: 116579 - DNA, 43 bp, Homo sapiens; identical to SEQ ID NO: 83913
  chr19:48997015-48997058
  Hyper

SEQ ID NO: 116580 - DNA, 30 bp, Homo sapiens; identical to SEQ ID NO: 83914
  chr19:49002701-49002731
  Hyper

SEQ ID NO: 116581 - DNA, 30 bp, Homo sapiens; identical to SEQ ID NO: 83915
  chr19:49012484-49012514
  Hypo

SEQ ID NO: 116582 - DNA, 217 bp, Homo sapiens; identical to SEQ ID NO: 83916
  chr19:49014319-49014536
  Hyper

SEQ ID NO: 116583 - DNA, 32 bp, Homo sapiens; identical to SEQ ID NO: 83917
  chr19:49015396-49015428
  Hyper

SEQ ID NO: 116584 - DNA, 25 bp, Homo sapiens
  chr19:49043152-49043177
  Hypo
agcactttaggaggccgaggcaggt

SEQ ID NO: 116585 - DNA, 84 bp, Homo sapiens; identical to SEQ ID NO: 83919
  chr19:49043417-49043501
  Hypo

SEQ ID NO: 116586 - DNA, 177 bp, Homo sapiens; identical to SEQ ID NO: 83920
  chr19:49117219-49117396
  Hypo

SEQ ID NO: 116587 - DNA, 374 bp, Homo sapiens; identical to SEQ ID NO: 45960
  chr19:49119027-49119401
  Hypo

SEQ ID NO: 116588 - DNA, 420 bp, Homo sapiens; identical to SEQ ID NO: 83922
  chr19:49127373-49127793
  Hyper

SEQ ID NO: 116589 - DNA, 105 bp, Homo sapiens; identical to SEQ ID NO: 83924
  chr19:49143016-49143121
  Hypo

SEQ ID NO: 116590 - DNA, 55 bp, Homo sapiens; identical to SEQ ID NO: 83925
  chr19:49180462-49180517
  Hypo

SEQ ID NO: 116591 - DNA, 30 bp, Homo sapiens; identical to SEQ ID NO: 83926
  chr19:49218773-49218803
  Hypo

SEQ ID NO: 116592 - DNA, 239 bp, Homo sapiens; identical to SEQ ID NO: 83927
  chr19:49242534-49242773
  Hyper

SEQ ID NO: 116593 - DNA, 61 bp, Homo sapiens; identical to SEQ ID NO: 83928
  chr19:49244940-49245001
  Hyper

SEQ ID NO: 116594 - DNA, 24 bp, Homo sapiens
  chr19:49266812-49266836
  Hypo
gcgagactccgtctatttaaaaaa

SEQ ID NO: 116595 - DNA, 20 bp, Homo sapiens
  chr19:49285394-49285414
  Hypo
gagacagctctctgtcgcct

SEQ ID NO: 116596 - DNA, 76 bp, Homo sapiens; identical to SEQ ID NO: 45962
  chr19:49328490-49328566
  Hypo

SEQ ID NO: 116597 - DNA, 29 bp, Homo sapiens
  chr19:49394189-49394218
  Hypo
gaaaataaaaggaaacgtcaccacaatgg

SEQ ID NO: 116598 - DNA, 173 bp, Homo sapiens; identical to SEQ ID NO: 83933
  chr19:49399218-49399391
  Hyper

SEQ ID NO: 116599 - DNA, 85 bp, Homo sapiens; identical to SEQ ID NO: 83934
  chr19:49402037-49402122
  Hypo

SEQ ID NO: 116600 - DNA, 41 bp, Homo sapiens; identical to SEQ ID NO: 83935
  chr19:49459034-49459075
  Hypo

SEQ ID NO: 116601 - DNA, 31 bp, Homo sapiens; identical to SEQ ID NO: 83936
  chr19:49463923-49463954
  Hypo

SEQ ID NO: 116602 - DNA, 30 bp, Homo sapiens; identical to SEQ ID NO: 45965
  chr19:49482126-49482156
  Hypo

SEQ ID NO: 116603 - DNA, 113 bp, Homo sapiens; identical to SEQ ID NO: 83938
  chr19:49541820-49541933
  Hypo

SEQ ID NO: 116604 - DNA, 199 bp, Homo sapiens; identical to SEQ ID NO: 83939
  chr19:49545552-49545751
  Hypo

SEQ ID NO: 116605 - DNA, 177 bp, Homo sapiens; identical to SEQ ID NO: 83940
  chr19:49553709-49553886
  Hypo

SEQ ID NO: 116606 - DNA, 30 bp, Homo sapiens; identical to SEQ ID NO: 83941
  chr19:49558182-49558212
  Hypo

SEQ ID NO: 116607 - DNA, 30 bp, Homo sapiens
  chr19:49560012-49560042
  Hyper
cctcgaggtacttaacgtcctggaagctga

SEQ ID NO: 116608 - DNA, 116 bp, Homo sapiens; identical to SEQ ID NO: 83943
  chr19:49560299-49560415
  Hyper

SEQ ID NO: 116609 - DNA, 311 bp, Homo sapiens
  chr19:49575257-49575568
  Hyper
gcccgtctccacccacgccccgcctctcaccgggccggctgcggctgcagcagcaagccccgtgccgtcgcggtcgtcgcggaagtcaggcagcgtctcgaggcagaagacgacgatggagacgaggatgaccagcacggagactacggcgagcacgcgcgcggcctgagagctctcgggaaactcgaaaagcagccacagctggcgggcgaaggcgcggcggggcagggggcgctcgggcggcaccgggcagccctcgtcctcgcgcaggcgtgccagggccgccgcgcccagcccgtagaaggccacct

SEQ ID NO: 116610 - DNA, 45 bp, Homo sapiens
  chr19:49576081-49576126
  Hyper
cctgccctgccccgccgccgccgccgcccgcgcctgctctgcgcc

SEQ ID NO: 116611 - DNA, 95 bp, Homo sapiens; identical to SEQ ID NO: 83947
  chr19:49628304-49628399
  Hypo

SEQ ID NO: 116612 - DNA, 88 bp, Homo sapiens
  chr19:49646130-49646218
  Hyper
ccaacctgtcagacacggagatccagcgcgagatcggcatcagcaacccgctgcaccgactcaagctacgcctcgccatccaggagat

SEQ ID NO: 116613 - DNA, 30 bp, Homo sapiens; identical to SEQ ID NO: 37622
  chr19:49649675-49649705
  Hyper

SEQ ID NO: 116614 - DNA, 137 bp, Homo sapiens; identical to SEQ ID NO: 83950
  chr19:49652128-49652265
  Hyper

SEQ ID NO: 116615 - DNA, 88 bp, Homo sapiens; identical to SEQ ID NO: 83951
  chr19:49661511-49661599
  Hyper

SEQ ID NO: 116616 - DNA, 88 bp, Homo sapiens; identical to SEQ ID NO: 83952
  chr19:49703569-49703657
  Hypo

SEQ ID NO: 116617 - DNA, 30 bp, Homo sapiens; identical to SEQ ID NO: 83955
  chr19:49867107-49867137
  Hyper

SEQ ID NO: 116618 - DNA, 42 bp, Homo sapiens; identical to SEQ ID NO: 83956
  chr19:49890887-49890929
  Hypo

SEQ ID NO: 116619 - DNA, 200 bp, Homo sapiens; identical to SEQ ID NO: 83957
  chr19:49924370-49924570
  Hyper

SEQ ID NO: 116620 - DNA, 939 bp, Homo sapiens; identical to SEQ ID NO: 83958
  chr19:49925640-49926579
  Hyper

SEQ ID NO: 116621 - DNA, 49 bp, Homo sapiens; identical to SEQ ID NO: 83959
  chr19:49929427-49929476
  Hyper

SEQ ID NO: 116622 - DNA, 135 bp, Homo sapiens; identical to SEQ ID NO: 83960
  chr19:49931210-49931345
  Hyper

SEQ ID NO: 116623 - DNA, 189 bp, Homo sapiens
  chr19:49931986-49932175
  Hyper
caccaaagctgcccccgccgccccgcgggggtcgcccgcagcgtctggaggccctgtcccccgccacgctccccaacaacttcgtgtgagccccaccgagttctgccggacctgcacatccccacagtgaaggaaaaccctgcgcttctggtatgcttagctagagtagtgccccggataaagggtcta

SEQ ID NO: 116624 - DNA, 664 bp, Homo sapiens; identical to SEQ ID NO: 83962
  chr19:49935705-49936369
  Hyper

SEQ ID NO: 116625 - DNA, 366 bp, Homo sapiens; identical to SEQ ID NO: 83963
  chr19:49936853-49937219
  Hyper

SEQ ID NO: 116626 - DNA, 30 bp, Homo sapiens; identical to SEQ ID NO: 83964
  chr19:49939994-49940024
  Hyper

SEQ ID NO: 116627 - DNA, 46 bp, Homo sapiens; identical to SEQ ID NO: 83965
  chr19:49944610-49944656
  Hyper

SEQ ID NO: 116628 - DNA, 178 bp, Homo sapiens; identical to SEQ ID NO: 83966
  chr19:49954045-49954223
  Hypo

SEQ ID NO: 116629 - DNA, 71 bp, Homo sapiens; identical to SEQ ID NO: 83967
  chr19:49971866-49971937
  Hypo

SEQ ID NO: 116630 - DNA, 30 bp, Homo sapiens; identical to SEQ ID NO: 83969
  chr19:49976596-49976626
  Hypo

SEQ ID NO: 116631 - DNA, 86 bp, Homo sapiens; identical to SEQ ID NO: 83970
  chr19:49979926-49980012
  Hypo

SEQ ID NO: 116632 - DNA, 28 bp, Homo sapiens
  chr19:49997370-49997398
  Hypo
gagccatcgcgcccggccaatttttttt

SEQ ID NO: 116633 - DNA, 93 bp, Homo sapiens; identical to SEQ ID NO: 83972
  chr19:49998339-49998432
  Hypo

SEQ ID NO: 116634 - DNA, 102 bp, Homo sapiens
  chr19:50028553-50028655
  Hypo
gcagtctgcccagatcgcctgcctggcctcgcctctgcccatcagacacttggtgctggaatctccgaggctgggagggactgggagcgccccagttctgtg

SEQ ID NO: 116635 - DNA, 96 bp, Homo sapiens
  chr19:50030845-50030941
  Hypo
cgcccggccttttttcttttctttcgttctttttgtttatttttgttttgttttgttttgtttggtatagaagtgttggaacgtacacctctttct

SEQ ID NO: 116636 - DNA, 120 bp, Homo sapiens; identical to SEQ ID NO: 83973
  chr19:50049634-50049754
  Hypo

SEQ ID NO: 116637 - DNA, 140 bp, Homo sapiens; identical to SEQ ID NO: 83974
  chr19:50050702-50050842
  Hypo

SEQ ID NO: 116638 - DNA, 31 bp, Homo sapiens; identical to SEQ ID NO: 83975
  chr19:50053089-50053120
  Hypo

SEQ ID NO: 116639 - DNA, 59 bp, Homo sapiens; identical to SEQ ID NO: 83976
  chr19:50129682-50129741
  Hypo

SEQ ID NO: 116640 - DNA, 244 bp, Homo sapiens; identical to SEQ ID NO: 83977
  chr19:50166617-50166861
  Hypo

SEQ ID NO: 116641 - DNA, 796 bp, Homo sapiens; identical to SEQ ID NO: 83978
  chr19:50194078-50194874
  Hyper

SEQ ID NO: 116642 - DNA, 130 bp, Homo sapiens; identical to SEQ ID NO: 45976
  chr19:50216075-50216205
  Hypo

SEQ ID NO: 116643 - DNA, 174 bp, Homo sapiens; identical to SEQ ID NO: 45977
  chr19:50216693-50216867
  Hypo

SEQ ID NO: 116644 - DNA, 87 bp, Homo sapiens; identical to SEQ ID NO: 83982
  chr19:50250231-50250318
  Hypo

SEQ ID NO: 116645 - DNA, 98 bp, Homo sapiens; identical to SEQ ID NO: 83983
  chr19:50292243-50292341
  Hypo

SEQ ID NO: 116646 - DNA, 33 bp, Homo sapiens; identical to SEQ ID NO: 83984
  chr19:50297021-50297054
  Hypo

SEQ ID NO: 116647 - DNA, 30 bp, Homo sapiens; identical to SEQ ID NO: 83985
  chr19:50302697-50302727
  Hypo

SEQ ID NO: 116648 - DNA, 30 bp, Homo sapiens; identical to SEQ ID NO: 83986
  chr19:50305210-50305240
  Hypo

SEQ ID NO: 116649 - DNA, 41 bp, Homo sapiens; identical to SEQ ID NO: 83987
  chr19:50306672-50306713
  Hypo

SEQ ID NO: 116650 - DNA, 30 bp, Homo sapiens; identical to SEQ ID NO: 83988
  chr19:50308605-50308635
  Hypo

SEQ ID NO: 116651 - DNA, 30 bp, Homo sapiens; identical to SEQ ID NO: 83989
  chr19:50309103-50309133
  Hypo

SEQ ID NO: 116652 - DNA, 133 bp, Homo sapiens; identical to SEQ ID NO: 83990
  chr19:50315790-50315923
  Hypo

SEQ ID NO: 116653 - DNA, 525 bp, Homo sapiens; identical to SEQ ID NO: 83991
  chr19:50316196-50316721
  Hyper

SEQ ID NO: 116654 - DNA, 120 bp, Homo sapiens; identical to SEQ ID NO: 83992
  chr19:50318985-50319105
  Hypo

SEQ ID NO: 116655 - DNA, 120 bp, Homo sapiens; identical to SEQ ID NO: 83993
  chr19:50319645-50319765
  Hypo

SEQ ID NO: 116656 - DNA, 120 bp, Homo sapiens; identical to SEQ ID NO: 83994
  chr19:50320005-50320125
  Hypo

SEQ ID NO: 116657 - DNA, 30 bp, Homo sapiens; identical to SEQ ID NO: 83995
  chr19:50326491-50326521
  Hypo

SEQ ID NO: 116658 - DNA, 124 bp, Homo sapiens; identical to SEQ ID NO: 83996
  chr19:50326993-50327117
  Hypo

SEQ ID NO: 116659 - DNA, 45 bp, Homo sapiens; identical to SEQ ID NO: 45981
  chr19:50331949-50331994
  Hypo

SEQ ID NO: 116660 - DNA, 432 bp, Homo sapiens; identical to SEQ ID NO: 83998
  chr19:50353152-50353584
  Hypo

SEQ ID NO: 116661 - DNA, 30 bp, Homo sapiens; identical to SEQ ID NO: 45983
  chr19:50362485-50362515
  Hypo

SEQ ID NO: 116662 - DNA, 389 bp, Homo sapiens; identical to SEQ ID NO: 84000
  chr19:50364773-50365162
  Hypo

SEQ ID NO: 116663 - DNA, 75 bp, Homo sapiens; identical to SEQ ID NO: 84003
  chr19:50387489-50387564
  Hypo

SEQ ID NO: 116664 - DNA, 714 bp, Homo sapiens
  chr19:50393297-50394011
  Hyper
cccaacgcttgacgacgccggtgccgtcccagagctggcgcacgacaggcccgtgcaatgccgccacgtcgtcgagcgccaagcgcaacgcctcttcccggctcaagccggcgaacgctgccgccgcgtccgaccacgtgtacgaggccagcagcagcgcgccctcgcgcggcggcgggtagaaaatcatgcgcgacgggcgatcggtgtttgagtggccgccttcaatgtgctcctcgcgccagaagggcctgcggaagcttaggaacaccttggtggccggcacgtagtgcagcctccgcagcgcctcctgcatgtggcggggcagcggcggcgagaaggtgatgcgcttcaccgccggtccgctcgccgtcagcagcaccacgtcggccttcagcaccttcagattccgcgccgggggagaggtctcgatctgcacgtgcacatcgtgcggtccctgggtcatcgccaccacgggcgcgttcaacagcacaagcccggacagcgagctcagcagcgcgcgcggcagcaggtcccagccacccacgatgcggctgtacctgcaggcggggcggggcggggtgggggcgtgacctgggctctgcggccctgcccctctgccttgccccacccaccccggcagctggcccttatgggcaccggcccgctcccccgtcatccacctctcccgaccccgcccgtccctgacatccc

SEQ ID NO: 116665 - DNA, 212 bp, Homo sapiens; identical to SEQ ID NO: 84007
  chr19:50394919-50395131
  Hypo

SEQ ID NO: 116666 - DNA, 30 bp, Homo sapiens; identical to SEQ ID NO: 84009
  chr19:50441485-50441515
  Hypo

SEQ ID NO: 116667 - DNA, 30 bp, Homo sapiens; identical to SEQ ID NO: 84011
  chr19:50475206-50475236
  Hypo

SEQ ID NO: 116668 - DNA, 30 bp, Homo sapiens; identical to SEQ ID NO: 84012
  chr19:50477609-50477639
  Hypo

SEQ ID NO: 116669 - DNA, 51 bp, Homo sapiens; identical to SEQ ID NO: 45986
  chr19:50481531-50481582
  Hypo

SEQ ID NO: 116670 - DNA, 438 bp, Homo sapiens; identical to SEQ ID NO: 84014
  chr19:50553997-50554435
  Hyper

SEQ ID NO: 116671 - DNA, 30 bp, Homo sapiens; identical to SEQ ID NO: 84015
  chr19:50578991-50579021
  Hypo

SEQ ID NO: 116672 - DNA, 30 bp, Homo sapiens; identical to SEQ ID NO: 37635
  chr19:50651036-50651066
  Hyper

SEQ ID NO: 116673 - DNA, 30 bp, Homo sapiens; identical to SEQ ID NO: 37636
  chr19:50651328-50651358
  Hyper

SEQ ID NO: 116674 - DNA, 30 bp, Homo sapiens; identical to SEQ ID NO: 84020
  chr19:50694460-50694490
  Hypo

SEQ ID NO: 116675 - DNA, 30 bp, Homo sapiens; identical to SEQ ID NO: 37637
  chr19:50706864-50706894
  Hyper

SEQ ID NO: 116676 - DNA, 76 bp, Homo sapiens; identical to SEQ ID NO: 84022
  chr19:50762327-50762403
  Hyper

SEQ ID NO: 116677 - DNA, 758 bp, Homo sapiens; identical to SEQ ID NO: 84023
  chr19:50815293-50816051
  Hyper

SEQ ID NO: 116678 - DNA, 53 bp, Homo sapiens; identical to SEQ ID NO: 13470
  chr19:50816431-50816484
  Hyper

SEQ ID NO: 116679 - DNA, 30 bp, Homo sapiens; identical to SEQ ID NO: 84025
  chr19:50817841-50817871
  Hyper

SEQ ID NO: 116680 - DNA, 37 bp, Homo sapiens; identical to SEQ ID NO: 84026
  chr19:50818167-50818204
  Hyper

SEQ ID NO: 116681 - DNA, 734 bp, Homo sapiens; identical to SEQ ID NO: 37641
  chr19:50818424-50819158
  Hyper

SEQ ID NO: 116682 - DNA, 149 bp, Homo sapiens; identical to SEQ ID NO: 84028
  chr19:50829560-50829709
  Hyper

SEQ ID NO: 116683 - DNA, 636 bp, Homo sapiens; identical to SEQ ID NO: 84029
  chr19:50831403-50832039
  Hyper

SEQ ID NO: 116684 - DNA, 91 bp, Homo sapiens; identical to SEQ ID NO: 84031
  chr19:50832951-50833042
  Hyper

SEQ ID NO: 116685 - DNA, 142 bp, Homo sapiens; identical to SEQ ID NO: 37645
  chr19:50833828-50833970
  Hyper

SEQ ID NO: 116686 - DNA, 160 bp, Homo sapiens
  chr19:50836291-50836451
  Hyper
caagtaccttggccccgaaagctcagagtcgaggggaatctccccgctataatctttgggtccctggatcccaagtcccccgtctccaaaactaggattcgggctgtcttaccgcccccggaccctgagccttcgccccctcccccgtactcaccccaag

SEQ ID NO: 116687 - DNA, 350 bp, Homo sapiens; identical to SEQ ID NO: 84035
  chr19:50837039-50837389
  Hyper

SEQ ID NO: 116688 - DNA, 306 bp, Homo sapiens; identical to SEQ ID NO: 84036
  chr19:50919769-50920075
  Hypo

SEQ ID NO: 116689 - DNA, 95 bp, Homo sapiens; identical to SEQ ID NO: 45988
  chr19:50926491-50926586
  Hypo

SEQ ID NO: 116690 - DNA, 170 bp, Homo sapiens; identical to SEQ ID NO: 84038
  chr19:50938552-50938722
  Hypo

SEQ ID NO: 116691 - DNA, 89 bp, Homo sapiens; identical to SEQ ID NO: 84039
  chr19:50947770-50947859
  Hypo

SEQ ID NO: 116692 - DNA, 104 bp, Homo sapiens; identical to SEQ ID NO: 84040
  chr19:50967770-50967874
  Hypo

SEQ ID NO: 116693 - DNA, 30 bp, Homo sapiens; identical to SEQ ID NO: 84041
  chr19:50979216-50979246
  Hypo

SEQ ID NO: 116694 - DNA, 100 bp, Homo sapiens; identical to SEQ ID NO: 84042
  chr19:51022774-51022874
  Hypo

SEQ ID NO: 116695 - DNA, 183 bp, Homo sapiens; identical to SEQ ID NO: 84044
  chr19:51046349-51046532
  Hypo

SEQ ID NO: 116696 - DNA, 45 bp, Homo sapiens; identical to SEQ ID NO: 84045
  chr19:51049613-51049658
  Hypo

SEQ ID NO: 116697 - DNA, 30 bp, Homo sapiens; identical to SEQ ID NO: 84046
  chr19:51051953-51051983
  Hypo

SEQ ID NO: 116698 - DNA, 30 bp, Homo sapiens; identical to SEQ ID NO: 37649
  chr19:51055016-51055046
  Hyper

SEQ ID NO: 116699 - DNA, 213 bp, Homo sapiens; identical to SEQ ID NO: 84048
  chr19:51071278-51071491
  Hyper

SEQ ID NO: 116700 - DNA, 56 bp, Homo sapiens; identical to SEQ ID NO: 37650
  chr19:51111640-51111696
  Hyper

SEQ ID NO: 116701 - DNA, 33 bp, Homo sapiens; identical to SEQ ID NO: 45994
  chr19:51128766-51128799
  Hypo

SEQ ID NO: 116702 - DNA, 30 bp, Homo sapiens; identical to SEQ ID NO: 84051
  chr19:51132785-51132815
  Hypo

SEQ ID NO: 116703 - DNA, 619 bp, Homo sapiens
  chr19:51142492-51143111
  Hyper
gacccactgggagcccggccaccccctcccacctccgggcccccagctcccgttgagggcttagagactacaattcccggcaggtctcgcgctcgcgctgctgcggcttcatagacccggcgctgcaggatctgctgggagttgaagtccttaatgcctccgggctgcagagaggatgggattttttttttttttttaaggttttggggggttaagatgctggggtcccaagacgcttcaggggaggggaacgatgtccgggacttcgaaaagccacggagccctaagtccttaggggccacggaatgaggaaacgatccccccgcgctggggatcggtgggcgaggggtgggatacacccaggtgtttcgggacccccttccagggccacgtgcccctcccccggggtggccagagagcgctgcagcgctcccactccccggcccgagatccacgcgcctctgcatctaccccgcccccatgcgccggggccgaccccagggatttgactggggctggggctgtggcaggaggagggggaggagcggactcacccggagccgccgctgccgccgctgccgccgccgccgccgccgcagccccgcgcgccagccgcggt

SEQ ID NO: 116704 - DNA, 46 bp, Homo sapiens; identical to SEQ ID NO: 84055
  chr19:51143316-51143362
  Hyper

SEQ ID NO: 116705 - DNA, 230 bp, Homo sapiens; identical to SEQ ID NO: 84056
  chr19:51161225-51161455
  Hyper

SEQ ID NO: 116706 - DNA, 1318 bp, Homo sapiens
  chr19:51161685-51163003
  Hyper
agagccactgaggggcggggccaagagtgagcgcggttggaggtaaggtccggtgagatcagagagaaggagggatctcgagtgagtaggggcccgagtttgagtgacccagtagtgaccgggatagaggtctgagcctggaaaggcagctgtgagggggtggaagagactgagcacatagtaggtgtggggccaggggtgatagggtggggacaggcctggagtgcctagggtagagcgcagcctgcagtcgccagtggagggtcgggcctttgggcggtttgagatggagcctcgacagacagtgattaggacgcagaaccaggctaagagagcgtaaggagcctagagcgacccaggcgagagggcagggctggaggggagtttagggacggagcgatggtccgctggaccagggcctgtaaacgactccagggaccaggcagggactcttcgacgatcaaagccagggctgaaacgacctgcgagttccttttccgtccccaccccccttacaggtggctcatcgcggtcacggacttccagacgcgctcgcgcttgctgcgctccgggctcagtccccgcgggcttgcgcaccagatcgtgcgccacgacgacctcctgctgggcgactaccgcctgcacctgcgccgctccctggtccggcggcgcatgctcgaggccctgggggcggagccgaacgaggaggcctgacgcccgggcgggccccggcagcgcttgcgcaccgccccgcgggctggggccacccacccggagccccggaggacagggggcgttgccttcccaggaaggaggcggggccggctcgagggggtggatactgtgagtttaattataaagaatgacctggtacaaaagccatttctctctgcaaaatcttggtggggagtcaggggaagggaggtgatggggggtaggaatgaacccccatgttataatcccgcgtccctaatcttcctccagtccctgtacgtggacgcctgggtcccaatcccttgagggatgaactgaagcccgcgaaagggaagacctgggcaccggggctttcagcgcgtgccgagccctgtctcagcgagaatcagacgtcctcatccgcccccctcctcttcccctcccacccccccttggaagacaattctcgggcttttatttcaggttttttttctggatttttttgtgtgttctaggggttttgtgttttttttttctgttttttatattttcttcttttgttattgttcctctttttgctttttctctcctctccaccccgcgctgtccccgcattcggtccctc

SEQ ID NO: 116707 - DNA, 664 bp, Homo sapiens
  chr19:51170699-51171363
  Hyper
ctcgtcacaggggcccggggctggcagttttcaaggaaccgcacgtgcagcggcagccgctcgggttcttcgggggctgcggacctccagggcttgcttactccggggtgcggggccgggggctccgtccccagctgcagcaggaggggccccaccccgggagcggtgggcggcaggcggtgtagcagggaacgccgggcggcgggcgggctggcgggaagggacttctcctggctgcccagcccggccctgtaccccagctcccggcgcgcagggtccggcggggaggccccccagagacgcagcactggctcgtggtgggcgtggggcgagtggtggtgcggggtgggcggcggggcctcgtagcggggcgatgggggcctgggaggcggctggggggccccgccgccctccgaggactccttcagcgctcgctcgcgggcggccagggccagccccagcggggaggcgggatccagggccttgccggtcagcgggtgcaccaggggtcgcgggggcaggaagctggtgaaggcgctgctgcccccgccacccccgtaggctcggctaccggccccgtagccgccgtagcccgcgccgctgcccgcagactccagtcggaggtagggctcggcggagaacatgccctcgtcgatggatttgg

SEQ ID NO: 116708 - DNA, 357 bp, Homo sapiens; identical to SEQ ID NO: 84061
  chr19:51197437-51197794
  Hyper

SEQ ID NO: 116709 - DNA, 143 bp, Homo sapiens
  chr19:51198128-51198271
  Hyper
ccgcaaagcaggaggcggcgcgctccgttacctgtagatgtaccagacgctgcgccgccggggccccagggctggccagctggaggacagcgcggggggcggctgcggcagggagctcccaccggggccgcccccgagacccc

SEQ ID NO: 116710 - DNA, 689 bp, Homo sapiens; identical to SEQ ID NO: 84063
  chr19:51198505-51199194
  Hyper

SEQ ID NO: 116711 - DNA, 82 bp, Homo sapiens; identical to SEQ ID NO: 45995
  chr19:51203231-51203313
  Hypo

SEQ ID NO: 116712 - DNA, 78 bp, Homo sapiens; identical to SEQ ID NO: 84065
  chr19:51211065-51211143
  Hypo

SEQ ID NO: 116713 - DNA, 69 bp, Homo sapiens; identical to SEQ ID NO: 84066
  chr19:51222519-51222588
  Hyper

SEQ ID NO: 116714 - DNA, 1207 bp, Homo sapiens
  chr19:51227602-51228809
  Hyper
ggtcctcaggccccccgctgcatctccaggctccccctccagcatgatccctgtctgtccgcagtgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggtgagtccgcggcgcgcggggtggaaaaaaatgagactatctgggccaggaatgggactggttgagaaggtgaccctaggtgtccggggcgggagagttcgggagagctgctgtgtgctagcggacggggttagagagctgggaggctgaatgcagggagcgggtgggcactccagacccgcgcggacccgactggggcagcaccacgccccctacagtccagctcccaccgcctggccccgcccctggcggaccagactctccacctcctggctcccgcggttctgaccacgcctcctcccagccctccccatgagttcctggccccgcctccctccacccccggatgttttgtcctcgcccccttccagactctgaatgcatgaccccgcctccttctctacccggccccgcccacaggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatctcccttcc

SEQ ID NO: 116715 - DNA, 27 bp, Homo sapiens
  chr19:51250646-51250673
  Hypo
cagcctgggtgacggagcaagactctg

SEQ ID NO: 116716 - DNA, 85 bp, Homo sapiens; identical to SEQ ID NO: 84071
  chr19:51269827-51269912
  Hypo

SEQ ID NO: 116717 - DNA, 30 bp, Homo sapiens; identical to SEQ ID NO: 84072
  chr19:51274279-51274309
  Hypo

SEQ ID NO: 116718 - DNA, 30 bp, Homo sapiens; identical to SEQ ID NO: 84073
  chr19:51281105-51281135
  Hyper

SEQ ID NO: 116719 - DNA, 328 bp, Homo sapiens; identical to SEQ ID NO: 84074
  chr19:51281335-51281663
  Hyper

SEQ ID NO: 116720 - DNA, 30 bp, Homo sapiens; identical to SEQ ID NO: 84075
  chr19:51295128-51295158
  Hypo

SEQ ID NO: 116721 - DNA, 93 bp, Homo sapiens; identical to SEQ ID NO: 84076
  chr19:51295373-51295466
  Hypo

SEQ ID NO: 116722 - DNA, 30 bp, Homo sapiens; identical to SEQ ID NO: 45996
  chr19:51304561-51304591
  Hypo

SEQ ID NO: 116723 - DNA, 48 bp, Homo sapiens; identical to SEQ ID NO: 45997
  chr19:51340799-51340847
  Hypo

SEQ ID NO: 116724 - DNA, 138 bp, Homo sapiens; identical to SEQ ID NO: 84079
  chr19:51412508-51412646
  Hyper

SEQ ID NO: 116725 - DNA, 30 bp, Homo sapiens; identical to SEQ ID NO: 84080
  chr19:51413099-51413129
  Hyper

SEQ ID NO: 116726 - DNA, 33 bp, Homo sapiens; identical to SEQ ID NO: 84082
  chr19:51451909-51451942
  Hypo

SEQ ID NO: 116727 - DNA, 354 bp, Homo sapiens; identical to SEQ ID NO: 37669
  chr19:51520138-51520492
  Hyper

SEQ ID NO: 116728 - DNA, 210 bp, Homo sapiens; identical to SEQ ID NO: 84085
  chr19:51520740-51520950
  Hyper

SEQ ID NO: 116729 - DNA, 937 bp, Homo sapiens
  chr19:51521998-51522935
  Hyper
atggagcggggccgggatggggcggcgtaagaggaggagaaagaacgcggcgaagagtccacggaagagcgaggatccgggtggcagaaatcggacagggcctgagtggggcgggtcacccaggggccgagccagaagaagggcccagctgacttgggggcgggccgtgctccggagcgctgggtgggtgctggggtctcgggggaggagaggtgcgcggggcttggtgacgggaacacattctcctcccgcccgtgcctcccaccggcgcctctccccgccccctgcccccgaccttaccccagagttgcgccatcagcagcggcagcagcttcgccagagcccgggcgccagaggcggcggagaggtggaggtgcggagctctcatggccaggatctgctggggtgtgtgcaggggcgggttaaaacagatgctccgttagagacccccacctcgccgcgctcatccgcccagcctgggccaccccagcccgcaagcacccttttgacctgcagccgataaccccaggggctggcagacgggagattcgggctggaacagcggtaatgggcacaattaccctaatgacgcccctcgcggcatcttcccgtcctccctgtgcccgagtggagcgctctccgcgccccagctaccctggctgcagccacgccgcgcccgaggtttccccctccttcacgcgcggggtggggatccgaggctcggagccagtgggagcctctttctcaacctcacagcggggggacttccgcgtcccgcaggtggagaaaccgaggctctaagccggctcctgcctgtggcccgggggtccccacccatcctctcgcaatccaccccaacccgggtggggtgcaggtagcttcacctgggagtcgccgataggaaggagggaggggacccagacgtgcctctgccctg

SEQ ID NO: 116730 - DNA, 90 bp, Homo sapiens; identical to SEQ ID NO: 84088
  chr19:51523176-51523266
  Hyper

SEQ ID NO: 116731 - DNA, 105 bp, Homo sapiens; identical to SEQ ID NO: 84089
  chr19:51535305-51535410
  Hypo

SEQ ID NO: 116732 - DNA, 642 bp, Homo sapiens; identical to SEQ ID NO: 84091
  chr19:51568062-51568704
  Hyper

SEQ ID NO: 116733 - DNA, 150 bp, Homo sapiens; identical to SEQ ID NO: 84092
  chr19:51684620-51684770
  Hypo

SEQ ID NO: 116734 - DNA, 36 bp, Homo sapiens; identical to SEQ ID NO: 84093
  chr19:51688376-51688412
  Hypo

SEQ ID NO: 116735 - DNA, 30 bp, Homo sapiens; identical to SEQ ID NO: 45999
  chr19:51715131-51715161
  Hypo

SEQ ID NO: 116736 - DNA, 95 bp, Homo sapiens; identical to SEQ ID NO: 84095
  chr19:51754542-51754637
  Hypo

SEQ ID NO: 116737 - DNA, 30 bp, Homo sapiens; identical to SEQ ID NO: 37672
  chr19:51814766-51814796
  Hyper

SEQ ID NO: 116738 - DNA, 176 bp, Homo sapiens; identical to SEQ ID NO: 84097
  chr19:51815099-51815275
  Hyper

SEQ ID NO: 116739 - DNA, 166 bp, Homo sapiens; identical to SEQ ID NO: 84098
  chr19:51830260-51830426
  Hyper

SEQ ID NO: 116740 - DNA, 631 bp, Homo sapiens
  chr19:51830759-51831390
  Hyper
actaggggtgcactacgggagagtccagagtcctgagaggccagggtgcctggaggggggcggcggtgggagtgacccgaggtacatgaggtgctagaacccgaggcgatgggtcactggggtagggggcagaatgctgggtcaccggggaacggaggagcctgagagtcggggggctggcctggctgggcgctgcggcccggcccctgacccggatccctggcaggctgagcagcggcacggccgaaggcctgaaggtgcagacggagcgcacccgctcgatgcttctctttgccaacgtgagcgcccggcattacggcaactatacgtgtcgcgccgccaaccgactgggagcgtccagcgcctccatgcggctcctgcgtgcgtcttcgggcggggcggggccgggaaggtgggcggggccgggggcggggctagggaagtggagacgccgggaccgcccttcaggctggccctgaacttaggagatggacgctgagactgaaaagcaatgcgagtaagaaaccgatccacgcaatcaatattcattgagtgccagctaagggtttgtcgtgggggacgcagctgtgcacaaaagaaacaaggtttggggattcgcagagcttatagt

SEQ ID NO: 116741 - DNA, 126 bp, Homo sapiens; identical to SEQ ID NO: 84101
  chr19:51843467-51843593
  Hyper

SEQ ID NO: 116742 - DNA, 45 bp, Homo sapiens; identical to SEQ ID NO: 84102
  chr19:51843801-51843846
  Hyper

SEQ ID NO: 116743 - DNA, 30 bp, Homo sapiens; identical to SEQ ID NO: 84103
  chr19:51857522-51857552
  Hypo

SEQ ID NO: 116744 - DNA, 60 bp, Homo sapiens; identical to SEQ ID NO: 84104
  chr19:51914569-51914629
  Hypo

SEQ ID NO: 116745 - DNA, 30 bp, Homo sapiens; identical to SEQ ID NO: 84105
  chr19:51918050-51918080
  Hypo

SEQ ID NO: 116746 - DNA, 137 bp, Homo sapiens; identical to SEQ ID NO: 84106
  chr19:51950127-51950264
  Hypo

SEQ ID NO: 116747 - DNA, 240 bp, Homo sapiens; identical to SEQ ID NO: 84107
  chr19:52058092-52058332
  Hypo

SEQ ID NO: 116748 - DNA, 256 bp, Homo sapiens; identical to SEQ ID NO: 84108
  chr19:52074277-52074533
  Hyper

SEQ ID NO: 116749 - DNA, 84 bp, Homo sapiens; identical to SEQ ID NO: 84109
  chr19:52077608-52077692
  Hypo

SEQ ID NO: 116750 - DNA, 30 bp, Homo sapiens; identical to SEQ ID NO: 84110
  chr19:52079361-52079391
  Hypo

SEQ ID NO: 116751 - DNA, 30 bp, Homo sapiens; identical to SEQ ID NO: 84111
  chr19:52079718-52079748
  Hypo

SEQ ID NO: 116752 - DNA, 25 bp, Homo sapiens
  chr19:52081316-52081341
  Hypo
aaagttaactactttcgtcactttt

SEQ ID NO: 116753 - DNA, 120 bp, Homo sapiens; identical to SEQ ID NO: 84114
  chr19:52081641-52081761
  Hypo

SEQ ID NO: 116754 - DNA, 22 bp, Homo sapiens
  chr19:52086395-52086417
  Hypo
ccgtgcccggctatgggcatct

SEQ ID NO: 116755 - DNA, 40 bp, Homo sapiens; identical to SEQ ID NO: 84116
  chr19:52091303-52091343
  Hypo

SEQ ID NO: 116756 - DNA, 795 bp, Homo sapiens
  chr19:52097245-52098040
  Hyper
agaaagacgattgtgcgtaactgttcaccgcgtccacgtcccgagagttgcgcacgcgtggagatctgcaaaacgctccctttcagctccgcgcatgcacagagaccccaccccgcaagtccttgcccttcggcctgggcaggcgtccactcccatggctgcagggcgcgccgaagagcccactctgcatccccgagacgcggcccaatcctaggaatgtgcttagcgcaggtgctatcttcccttttcacattcccaatctctttctccgccccctcaaactcttgccatactcccacaacagcagaaaatctgaaaaaaaagtccatcccatctttgcactgacagcagtgcacagcagctggcagagaattctggcacggctattgtgcttgcgcaggcgcagacgggaagcgggccggaccggcctagtacactctgggaggcgtgcgcagaatgcgcagcgctgccgcgaggatctctgggaactgtaggcccagtttgtccgagagccgcaagtgtttcgggacgacgcaacgcaggggcacctgggagtcgtaggcggatgggcccaaagccttccgggagtcgtagtccttccgcccgctcctcgtttctttggaggttggcccttccagctccagttctgcccaggtgagcgcccatcccgcggccggccggtcctggccctttgtcgcgatgacgtggcggagttgagggtctctgtatttctctcccccgcgttctggtaggcgtccctggaaagatggcacccttttccgtgatctctcaatc

SEQ ID NO: 116757 - DNA, 34 bp, Homo sapiens; identical to SEQ ID NO: 84119
  chr19:52102053-52102087
  Hypo

SEQ ID NO: 116758 - DNA, 57 bp, Homo sapiens
  chr19:52104552-52104609
  Hyper
aggggggtgcccttccgcgctgccgcccgctgcagttcgcctcgcaggaggtggtgc

SEQ ID NO: 116759 - DNA, 143 bp, Homo sapiens; identical to SEQ ID NO: 84121
  chr19:52205697-52205840
  Hyper

SEQ ID NO: 116760 - DNA, 721 bp, Homo sapiens; identical to SEQ ID NO: 84122
  chr19:52207085-52207806
  Hyper

SEQ ID NO: 116761 - DNA, 30 bp, Homo sapiens; identical to SEQ ID NO: 84123
  chr19:52217139-52217169
  Hypo

SEQ ID NO: 116762 - DNA, 743 bp, Homo sapiens
  chr19:52222430-52223173
  Hyper
cgagtgggctgaaggcgcctctactcacctgcacgtagtccaccgaatctccgagcgccttgaaggctgtgtacatgacctcgcgcttgccgccccagcgctgcgccacgcacacgcacctgcgagtcctcaccagcgcctccactgccagccgcccaggatcctccgcctccacctcccgataggctccggcgcccaccgcgcccgccgccgcgggttcccagggctggtggtagttgccgtcccacacgtacgtggcggggtcctcgtcagcgaagacctcgcggaacatgtcgaccatgtagaggtcctcggcgcggttgccatccaccaccatgaggacgcgcagccgcgcgcgcgggtacagcagggcgcgggcggacgccaggcactggcgcaggtacgcggggtcctcctggtaggcggagatggtcagcgccacactgcgcgcggtggctgcatccagcggcccccgcgccgccgccgccacccgccggtgctccaggtacgcgaagaggctctgcgccaccaggtgcgctgaaaggaaggccccgtagaggccgaaggccaggaggccgtagcgatcggaggccagcggcaccccggcggcgtaggcccaggtcatgaggcccaggatgagcagggcgaaggcgatggtcagcaccctccgggccaggccggagcagcggcaggctgcaggagtgggcttgggcgcgtcctgctgggagcgagaggggaaagga

SEQ ID NO: 116763 - DNA, 105 bp, Homo sapiens; identical to SEQ ID NO: 84126
  chr19:52248329-52248434
  Hypo

SEQ ID NO: 116764 - DNA, 30 bp, Homo sapiens; identical to SEQ ID NO: 84128
  chr19:52355375-52355405
  Hypo

SEQ ID NO: 116765 - DNA, 214 bp, Homo sapiens; identical to SEQ ID NO: 37683
  chr19:52408028-52408242
  Hyper

SEQ ID NO: 116766 - DNA, 251 bp, Homo sapiens; identical to SEQ ID NO: 84131
  chr19:52430054-52430305
  Hyper

SEQ ID NO: 116767 - DNA, 83 bp, Homo sapiens; identical to SEQ ID NO: 84132
  chr19:52430563-52430646
  Hyper

SEQ ID NO: 116768 - DNA, 18 bp, Homo sapiens
  chr19:52431077-52431095
  Hyper
aaactgtgtctgcttcgg

SEQ ID NO: 116769 - DNA, 17 bp, Homo sapiens
  chr19:52456101-52456118
  Hypo
ggggggtcagccccccg

SEQ ID NO: 116770 - DNA, 30 bp, Homo sapiens; identical to SEQ ID NO: 84135
  chr19:52489503-52489533
  Hyper

SEQ ID NO: 116771 - DNA, 88 bp, Homo sapiens; identical to SEQ ID NO: 84136
  chr19:52490149-52490237
  Hyper

SEQ ID NO: 116772 - DNA, 76 bp, Homo sapiens; identical to SEQ ID NO: 37685
  chr19:52511308-52511384
  Hyper

SEQ ID NO: 116773 - DNA, 143 bp, Homo sapiens; identical to SEQ ID NO: 84138
  chr19:52512030-52512173
  Hypo

SEQ ID NO: 116774 - DNA, 525 bp, Homo sapiens; identical to SEQ ID NO: 84139
  chr19:52531359-52531884
  Hyper

SEQ ID NO: 116775 - DNA, 39 bp, Homo sapiens
  chr19:52552188-52552227
  Hyper
acagcggccgggagacgcggtggacggaggcctcttaaa

SEQ ID NO: 116776 - DNA, 116 bp, Homo sapiens; identical to SEQ ID NO: 84140
  chr19:52598475-52598591
  Hyper

SEQ ID NO: 116777 - DNA, 30 bp, Homo sapiens; identical to SEQ ID NO: 84141
  chr19:52599113-52599143
  Hyper

SEQ ID NO: 116778 - DNA, 30 bp, Homo sapiens; identical to SEQ ID NO: 84142
  chr19:52614030-52614060
  Hypo

SEQ ID NO: 116779 - DNA, 30 bp, Homo sapiens; identical to SEQ ID NO: 84144
  chr19:52753552-52753582
  Hypo

SEQ ID NO: 116780 - DNA, 174 bp, Homo sapiens; identical to SEQ ID NO: 84145
  chr19:52774623-52774797
  Hypo

SEQ ID NO: 116781 - DNA, 137 bp, Homo sapiens; identical to SEQ ID NO: 46005
  chr19:52780320-52780457
  Hypo

SEQ ID NO: 116782 - DNA, 16 bp, Homo sapiens
  chr19:52800002-52800018
  Hyper
ctggagtgcagtggcc

SEQ ID NO: 116783 - DNA, 136 bp, Homo sapiens; identical to SEQ ID NO: 84148
  chr19:52800078-52800214
  Hyper

SEQ ID NO: 116784 - DNA, 222 bp, Homo sapiens; identical to SEQ ID NO: 84149
  chr19:52800693-52800915
  Hyper

SEQ ID NO: 116785 - DNA, 145 bp, Homo sapiens; identical to SEQ ID NO: 84150
  chr19:52839411-52839556
  Hyper

SEQ ID NO: 116786 - DNA, 284 bp, Homo sapiens
  chr19:52839797-52840081
  Hyper
tctttactgacccaacgtcctgccccgcgcttttaaaagtccttaccgcaaggtggattcccgcccggggagcctcccaacctcgcccccggcccctgaagcgcagcgccgcagccccagtcccggcgggggaggccgcgtcctgtactgggtcctgggacccttgagaccccacacttctaataattcagccccacccttttcctccttgatccgggccttcctactccccaggcctccccttcgcagccatcgctactcccgacccccgggtgtggggacgt

SEQ ID NO: 116787 - DNA, 38 bp, Homo sapiens; identical to SEQ ID NO: 84154
  chr19:52872835-52872873
  Hyper

SEQ ID NO: 116788 - DNA, 637 bp, Homo sapiens
  chr19:52872933-52873570
  Hyper
tgcgagcgcccctacagccgatttaaaattaattttaatagcaggaattttcctggatctaatcatcaacaaactttccctctgccgggacacaatctatttccagatagctgagttcttccagtctccacggcaggtctagcctccaaaacgagacgagctgggagcgaggcggagggaagcgcaggctccgcccaatcccacccgggcctggcctcgcctcgcctctcagctgcgcgcgcagtttcctggagacccggaagcagattacgtggagtgacggtcatgctgcggcgtgtgagtttccctttgtttagattaaatctgggatgctgagtcccctcgcgcttctgtacccggcatctcaggggtcacacagaccttgaaatccccgcatcgctccctccaccccgactaaactcagacgttctaatgagagtctggcggtcgcttccctgagtgttaaaatcgctcggaggctggtcctgtccccggtctttcaccacagggccatgtagacagctcctgtcgcggagtttgcctgcttcaaatccttcagtgacccctagacacggcccgcgctgcgtaaagttctcacccgcgagatggatccacgtctttccggtcccccaagcct

SEQ ID NO: 116789 - DNA, 161 bp, Homo sapiens; identical to SEQ ID NO: 84157
  chr19:52893581-52893742
  Hypo

SEQ ID NO: 116790 - DNA, 272 bp, Homo sapiens
  chr19:52900866-52901138
  Hyper
aatagaaggaattttcgtggatataatctacaaccgattttgctctgcgcaggtaagatccgttttcagaccaaaaccctgaaaacaagcgcagccagtcaagcgaacggaagcgcaggcccggcccaggctttgtcccggcccgccctggtcccagccagtccggcctctaggatgcgcgcgcaatttcgtgcaaacccggaagcggaccgcggggggcgaacgcctagagcgcagtttccggtagacccggaagccgattgcagggagaa

SEQ ID NO: 116791 - DNA, 30 bp, Homo sapiens; identical to SEQ ID NO: 84160
  chr19:52907400-52907430
  Hypo

SEQ ID NO: 116792 - DNA, 42 bp, Homo sapiens; identical to SEQ ID NO: 84162
  chr19:52927555-52927597
  Hypo

SEQ ID NO: 116793 - DNA, 327 bp, Homo sapiens; identical to SEQ ID NO: 84165
  chr19:52956606-52956933
  Hyper

SEQ ID NO: 116794 - DNA, 90 bp, Homo sapiens
  chr19:52957141-52957231
  Hyper
catgaggtgtattcacgcccagtgggtcctccaagcctcgcccttctggcctcttggagctcggtcccgcagtctcgatgcatcagcgcc

SEQ ID NO: 116795 - DNA, 25 bp, Homo sapiens
  chr19:52983447-52983472
  Hypo
cgtgcccagtcgattatgaatctta

SEQ ID NO: 116796 - DNA, 156 bp, Homo sapiens; identical to SEQ ID NO: 84168
  chr19:53007644-53007800
  Hypo

SEQ ID NO: 116797 - DNA, 26 bp, Homo sapiens
  chr19:53028928-53028954
  Hypo
ttatttatttagagacggaatctctt

SEQ ID NO: 116798 - DNA, 30 bp, Homo sapiens; identical to SEQ ID NO: 84171
  chr19:53030640-53030670
  Hyper

SEQ ID NO: 116799 - DNA, 53 bp, Homo sapiens; identical to SEQ ID NO: 84172
  chr19:53031294-53031347
  Hyper

SEQ ID NO: 116800 - DNA, 19 bp, Homo sapiens
  chr19:53064806-53064825
  Hypo
tttttttttttgagacgga

SEQ ID NO: 116801 - DNA, 30 bp, Homo sapiens; identical to SEQ ID NO: 84174
  chr19:53071305-53071335
  Hypo

SEQ ID NO: 116802 - DNA, 864 bp, Homo sapiens
  chr19:53073288-53074152
  Hyper
ccagacaattccagggctttcgaatcgtgcttcagccttcctgaccgctctcgcctccaaagcccgaaaaatagagtcgctgggagcgaggctgagagacgcacaggtcccgccccggccccgccctctgccggttctaaagggcaaggtctctccgcctggggccccgcctctacctcgatcaggccccgcccaccttctcgttggctccacccaggcctggctttagtcctgtgcgcacacatccgcgcagaccaggaagcggatcccgtggagtgaaggtcgcaccgcggcggtgagttttgctctgtgttgtattaagtctgcactccccatatccccggcacttccgtacctgggacgtggggtcaccacagacctgtaaattctcgcccatcttccttcaaccagagcaaatgcagacgttcccctgggaatccggaagtcgcttccttttgtgtttaaagtcgccctgaggctgttcccgtctccagtctttctgctacagggcgctgtatacacttcctatcgcgtagtttctgtgctcaaaaccgttttttaactcctccctccccgcgcttttcaaagtcctcacccgagatgtgtatttccgcctgggcgcctcccagtctcaacctttaggcgcctgaagcgcaaacgtcgcgatcccagtctcagggaggccgagttctctgcctggtgctgggatcttgtggaccccaccgaaggcgtcgtcgcaccccacctcccgcctcatgctgggccttgctgcaccccaagtctccccttagcagtcaccactttccttgagccagcgttggggaggtgccaggggccagtcctgtgacacggtgtgttcttgcc

SEQ ID NO: 116803 - DNA, 20 bp, Homo sapiens
  chr19:53098049-53098069
  Hypo
gccaccgcacctggcccgtt

SEQ ID NO: 116804 - DNA, 30 bp, Homo sapiens; identical to SEQ ID NO: 84180
  chr19:53102914-53102944
  Hypo

SEQ ID NO: 116805 - DNA, 740 bp, Homo sapiens; identical to SEQ ID NO: 84181
  chr19:53104346-53105086
  Hyper

SEQ ID NO: 116806 - DNA, 39 bp, Homo sapiens; identical to SEQ ID NO: 46009
  chr19:53105829-53105868
  Hypo

SEQ ID NO: 116807 - DNA, 98 bp, Homo sapiens; identical to SEQ ID NO: 84183
  chr19:53137932-53138030
  Hypo

SEQ ID NO: 116808 - DNA, 454 bp, Homo sapiens; identical to SEQ ID NO: 84184
  chr19:53140899-53141353
  Hyper

SEQ ID NO: 116809 - DNA, 394 bp, Homo sapiens
  chr19:53141413-53141807
  Hyper
agcgatatccggactctcatggggacgtctcaatttgtcctgggtgaaggaagaagggagagaatttccaggtctgtggggaccccacgtctcaggtacagcagcgccggggacctggtaagcgcagacttaatagaagagcgaaactcaccgccacggtgtaactttcactccacataatccgcttccgggtttgcgcgcatgtgcgcgcgcagtacagaagccaggtctgggcggggcccgcgaggtgggcggggcctggatgaggtaggggcggggtgggaagccgagagactttcccctttagaaccagcagtgggcggggccagggcgggacctgtgagtctctcagcatcgttcccagcgcagaggcatttttcgggttttggaggcg

SEQ ID NO: 116810 - DNA, 76 bp, Homo sapiens; identical to SEQ ID NO: 46010
  chr19:53148247-53148323
  Hypo

SEQ ID NO: 116811 - DNA, 811 bp, Homo sapiens; identical to SEQ ID NO: 84188
  chr19:53193195-53194006
  Hyper

SEQ ID NO: 116812 - DNA, 240 bp, Homo sapiens; identical to SEQ ID NO: 84189
  chr19:53194126-53194366
  Hyper

SEQ ID NO: 116813 - DNA, 96 bp, Homo sapiens; identical to SEQ ID NO: 84191
  chr19:53211156-53211252
  Hypo

SEQ ID NO: 116814 - DNA, 30 bp, Homo sapiens; identical to SEQ ID NO: 46011
  chr19:53225425-53225455
  Hypo

SEQ ID NO: 116815 - DNA, 16 bp, Homo sapiens
  chr19:53238443-53238459
  Hyper
gcgtctctcagcctcg

SEQ ID NO: 116816 - DNA, 34 bp, Homo sapiens; identical to SEQ ID NO: 84194
  chr19:53240317-53240351
  Hypo

SEQ ID NO: 116817 - DNA, 79 bp, Homo sapiens; identical to SEQ ID NO: 84195
  chr19:53289871-53289950
  Hyper

SEQ ID NO: 116818 - DNA, 30 bp, Homo sapiens; identical to SEQ ID NO: 46012
  chr19:53299504-53299534
  Hypo

SEQ ID NO: 116819 - DNA, 47 bp, Homo sapiens
  chr19:53324245-53324292
  Hyper
agagctggagctgggcgggcaagaacaccccgcgtcacaggacaagc

SEQ ID NO: 116820 - DNA, 30 bp, Homo sapiens; identical to SEQ ID NO: 84198
  chr19:53324547-53324577
  Hyper

SEQ ID NO: 116821 - DNA, 50 bp, Homo sapiens; identical to SEQ ID NO: 84199
  chr19:53324990-53325040
  Hyper

SEQ ID NO: 116822 - DNA, 27 bp, Homo sapiens
  chr19:53330844-53330871
  Hypo
tgagatggagtcttgcggtgtctgctc

SEQ ID NO: 116823 - DNA, 111 bp, Homo sapiens; identical to SEQ ID NO: 37710
  chr19:53361072-53361183
  Hyper

SEQ ID NO: 116824 - DNA, 30 bp, Homo sapiens; identical to SEQ ID NO: 84202
  chr19:53363084-53363114
  Hypo

SEQ ID NO: 116825 - DNA, 141 bp, Homo sapiens; identical to SEQ ID NO: 84205
  chr19:53387484-53387625
  Hypo

SEQ ID NO: 116826 - DNA, 403 bp, Homo sapiens; identical to SEQ ID NO: 37711
  chr19:53400389-53400792
  Hyper

SEQ ID NO: 116827 - DNA, 30 bp, Homo sapiens; identical to SEQ ID NO: 46014
  chr19:53412458-53412488
  Hypo

SEQ ID NO: 116828 - DNA, 30 bp, Homo sapiens; identical to SEQ ID NO: 84212
  chr19:53426134-53426164
  Hyper

SEQ ID NO: 116829 - DNA, 359 bp, Homo sapiens; identical to SEQ ID NO: 84213
  chr19:53426510-53426869
  Hyper

SEQ ID NO: 116830 - DNA, 24 bp, Homo sapiens
  chr19:53429320-53429344
  Hypo
ataagaagggacaatcggccaggt

SEQ ID NO: 116831 - DNA, 112 bp, Homo sapiens; identical to SEQ ID NO: 84215
  chr19:53445710-53445822
  Hyper

SEQ ID NO: 116832 - DNA, 45 bp, Homo sapiens; identical to SEQ ID NO: 84216
  chr19:53446430-53446475
  Hyper

SEQ ID NO: 116833 - DNA, 652 bp, Homo sapiens; identical to SEQ ID NO: 84217
  chr19:53465861-53466513
  Hyper

SEQ ID NO: 116834 - DNA, 246 bp, Homo sapiens; identical to SEQ ID NO: 84218
  chr19:53496159-53496405
  Hyper

SEQ ID NO: 116835 - DNA, 461 bp, Homo sapiens
  chr19:53496648-53497109
  Hyper
tatgtggggaccccacgtcccctgggacagaagtcccagggacctgcggagcgcagacataacacaacacagagcaaaactcaccgctgcggtgactttcactccacgcgatccgcttcccggtttacgctaaactgggcgctcgggacagaagccaggtctcggcgggacatggcagggggtgggcggggcctgggcgaggtgggggcggggcgcgaggcggagagaccttcccctatagaaccggcagggggcggggcgcgaggcggagagaccttcccctatagaaccggcagggggcggggcgcgaggcggagagaccttcccctatagaaccggcagagggcggggcgggatctgtgagtctctcagcctcggcgtgtttttgggttttggagacgagacctgccaggaaagctgaggcatgattcaaaagccctggaactgtctggaaggggaat

SEQ ID NO: 116836 - DNA, 100 bp, Homo sapiens; identical to SEQ ID NO: 84221
  chr19:53497289-53497389
  Hyper

SEQ ID NO: 116837 - DNA, 20 bp, Homo sapiens
  chr19:53497973-53497993
  Hypo
gttaccgtgcctgtcccaag

SEQ ID NO: 116838 - DNA, 30 bp, Homo sapiens; identical to SEQ ID NO: 84223
  chr19:53507239-53507269
  Hypo

SEQ ID NO: 116839 - DNA, 28 bp, Homo sapiens
  chr19:53549226-53549254
  Hypo
cattttggccgggcacggtggctcatgc

SEQ ID NO: 116840 - DNA, 472 bp, Homo sapiens; identical to SEQ ID NO: 84225
  chr19:53561353-53561825
  Hyper

SEQ ID NO: 116841 - DNA, 142 bp, Homo sapiens; identical to SEQ ID NO: 84226
  chr19:53606212-53606354
  Hyper

SEQ ID NO: 116842 - DNA, 30 bp, Homo sapiens; identical to SEQ ID NO: 84227
  chr19:53606575-53606605
  Hyper

SEQ ID NO: 116843 - DNA, 79 bp, Homo sapiens; identical to SEQ ID NO: 84228
  chr19:53607032-53607111
  Hyper

SEQ ID NO: 116844 - DNA, 132 bp, Homo sapiens; identical to SEQ ID NO: 84229
  chr19:53635472-53635604
  Hyper

SEQ ID NO: 116845 - DNA, 206 bp, Homo sapiens; identical to SEQ ID NO: 84230
  chr19:53635885-53636091
  Hyper

SEQ ID NO: 116846 - DNA, 452 bp, Homo sapiens; identical to SEQ ID NO: 84231
  chr19:53661430-53661882
  Hyper

SEQ ID NO: 116847 - DNA, 452 bp, Homo sapiens; identical to SEQ ID NO: 84232
  chr19:53662182-53662634
  Hyper

SEQ ID NO: 116848 - DNA, 634 bp, Homo sapiens
  chr19:53696112-53696746
  Hyper
gagggaggtggggggcgacggcgccttaggagaggggtggggtatgcaggatcccaggaccaggcagaggcgcggcctccccgggactggggctgcggcgctaacgctccagtagctgactagggcgaggttaggggacggtaaaatcctgcacccacttcgcagatgaggacttcacagggcgcaggtcagtaaagggttttaagcaggaaacggcgcaggaaaggaggtgtctgcatggtctgaaggccgaaagaccgcgggcaggaccagcctgtgtgattttaacccaaagcgatgcgacccccagagtctcgcggcaaagtctgaatttacatggaatggagggagccgtgcggggactttaagggctatacgaacccccggacatcgggtacggaggagcaggggactccgaaacgcaggtttaatctagatagagggaaactcacgcggcgactaacagccttcactccaagagatctgcttccgggtttgcaagaaactgcccgcgcagtaggcaaaggggcgggttgcggtggggaaaggccaggcgttgggagggactgagagcatagggtgggcggggccggggcggggcctgaaccctggaggcggaggttgcaatgagccg

SEQ ID NO: 116849 - DNA, 94 bp, Homo sapiens; identical to SEQ ID NO: 84235
  chr19:53696806-53696900
  Hyper

SEQ ID NO: 116850 - DNA, 30 bp, Homo sapiens; identical to SEQ ID NO: 84236
  chr19:53700031-53700061
  Hyper

SEQ ID NO: 116851 - DNA, 392 bp, Homo sapiens; identical to SEQ ID NO: 84237
  chr19:53700307-53700699
  Hyper

SEQ ID NO: 116852 - DNA, 82 bp, Homo sapiens; identical to SEQ ID NO: 84238
  chr19:53701633-53701715
  Hypo

SEQ ID NO: 116853 - DNA, 33 bp, Homo sapiens; identical to SEQ ID NO: 84239
  chr19:53702028-53702061
  Hypo

SEQ ID NO: 116854 - DNA, 20 bp, Homo sapiens
  chr19:53704275-53704295
  Hypo
gccaccgtgcccagcttgtt

SEQ ID NO: 116855 - DNA, 33 bp, Homo sapiens; identical to SEQ ID NO: 84241
  chr19:53728442-53728475
  Hypo

SEQ ID NO: 116856 - DNA, 40 bp, Homo sapiens; identical to SEQ ID NO: 84242
  chr19:53733589-53733629
  Hypo

SEQ ID NO: 116857 - DNA, 525 bp, Homo sapiens
  chr19:53757722-53758247
  Hyper
ctccctggagaagggcgaagggtgtgtatccaccccgagtgagggctttaccagggggagggaagagggagtcagagaagagttttaagcagagaaacgacgcggtgggcggtcggtgtccacactgacctaaagcaaaaaggtcggggccagtacccacttcagaacgattttaatccgaaatggacgcagatctctagaccctctcggagcgacgggactgggaacgtcttagggccacgccgcgagaggaatgagcaggttcggggttttaacctacagggcgaccccaaaacccgacagcggagcgtgggaacctgtggcccgcgaggcgcaggcttgaacccgaaagacggagactcacccgagagcgccagtagccccgcgagatccgcttccgggtcggcaggaacctgcgcgtacgcgagtgcactggggcggcgcaaggggcaagggcaggggcagggcgcggacaactgtggggatgggcgggcaaatggcggggatgggcggggacaatggcgg

SEQ ID NO: 116858 - DNA, 107 bp, Homo sapiens; identical to SEQ ID NO: 84244
  chr19:53794273-53794380
  Hypo

SEQ ID NO: 116859 - DNA, 76 bp, Homo sapiens; identical to SEQ ID NO: 84245
  chr19:53811828-53811904
  Hyper

SEQ ID NO: 116860 - DNA, 39 bp, Homo sapiens; identical to SEQ ID NO: 84246
  chr19:53836812-53836851
  Hyper

SEQ ID NO: 116861 - DNA, 780 bp, Homo sapiens
  chr19:53868628-53869408
  Hyper
ttctattctctgggccgtcagcatgacattgtaagttctgcccaagcagggctttgcatttcacattctactttgcatccgcgtttcagacaattccagggcttttgaatcatggatcggccttcctggccatctcgcctccaaaacccaaaaacagaggcggtgggagggaggctgagagacgcacagatcccgccccagcccagccccgccccgccctctgccggtactaaagggcaaggtctctccgcctctacccctacctggcccaggccccgcccacctcctcgcaggccccgcccaggcctggcttctgtccttccccgctcagacgcgcgcaaacccggaagcagatcgcgtggagtgaaggtccctcagcggcgcgtgagtttcgctccatcttgtatgaagtctgctcttcccaggtccccggcgcttctgtccctgggacgtggggtccctacagacctggaaattctcacccgtcttccttcgcccagagcaaattgagacgtccccgtgagagcccgggggtcacttccttttgggtttaaagtctccctgaggctggtcccgttccggatctttctgctatagggcaatatatacactttctatcgcgtagttttcctgctctaaacctttttctgactcctcccgccccgcgctttttaaagtcctcacccgagaggtgaattcccgccctgggcgcctcccagcctcgccctcgtcggcccctagagcgcagcgtcgcagctccggtcccggggaggccgagtt

SEQ ID NO: 116862 - DNA, 30 bp, Homo sapiens; identical to SEQ ID NO: 84249
  chr19:53886601-53886631
  Hypo

SEQ ID NO: 116863 - DNA, 38 bp, Homo sapiens; identical to SEQ ID NO: 84250
  chr19:53934719-53934757
  Hyper

SEQ ID NO: 116864 - DNA, 100 bp, Homo sapiens; identical to SEQ ID NO: 84251
  chr19:53935204-53935304
  Hyper

SEQ ID NO: 116865 - DNA, 38 bp, Homo sapiens; identical to SEQ ID NO: 46018
  chr19:53965321-53965359
  Hypo

SEQ ID NO: 116866 - DNA, 28 bp, Homo sapiens
  chr19:53965595-53965623
  Hypo
cagtgtcagcccacccgcaggtagacat

SEQ ID NO: 116867 - DNA, 285 bp, Homo sapiens
  chr19:53966611-53966896
  Hyper
ggcagctttggaaaccgggcctggttagagggtgggggtggggcctggaatgggagtgggcggggcaagagggaggaggctgcctgggggccgggctggacagcaggaaaaggcgggacccgagggttagcgtcatcttgggggtggggtctggaaggggttttttgttctgaagggcggggcctggagggggcgggtccggattcttttctcagctgggccgtggatgtcgcctgctctcatcctcttgccctccaggactgggtcctccgggttctgattggt

SEQ ID NO: 116868 - DNA, 38 bp, Homo sapiens; identical to SEQ ID NO: 84256
  chr19:53970358-53970396
  Hyper

SEQ ID NO: 116869 - DNA, 180 bp, Homo sapiens; identical to SEQ ID NO: 84257
  chr19:53970456-53970636
  Hyper

SEQ ID NO: 116870 - DNA, 817 bp, Homo sapiens
  chr19:53970756-53971573
  Hyper
tccagacaattccagggcttttgaatagtgcctcaaccttactggccggtctcgactccaaaaccctaaaacaggcgctggagcgagggtgacggactcacaggtcccaccccggccccgccctctgcgccttccaaagggcaaagtctctccgcctctcgccccgcccctgcttcgtcaggccccgcccacctcccaggtcccgcccaggcctggcttctgtcctgcgcgcagattcgcgaaaacccggaagcggatcgcgtggagtgacggtcccacggcagcgcgtgagtttggctctgtgttgtattaggtctgcacttcccaggtccctggcgcttctgtacctggggcgtggggtccccacaaacctggaaattctcagccgtcttccttcacccagagcaaattgagacgaccccgtgagagtccgggggtcgcttccttttgtgtttaaggtcgccctgaggctggtcccgtcccgggtctttctgctatagggcaatgtatacactttctatcgcgcatttttcctgctctaaacctttctctgactcctcccaccccgcgctttttgaagtcctcacccaaggggtggattctcgcccacttcggccggtggagcgcagaaccgcggccccagtcccgggaaggccgcgtcctctgtctggtcccgggatcctgcagaccccacccttgtcttaaggcgccctcgcgcccccccccccccacctccctcctcctgccgggccctgctgcttcctaggtctcccctccgcagtcacggcttcccctgagcccacgttggggaggtgcc

SEQ ID NO: 116871 - DNA, 30 bp, Homo sapiens; identical to SEQ ID NO: 84260
  chr19:53982737-53982767
  Hypo

SEQ ID NO: 116872 - DNA, 31 bp, Homo sapiens; identical to SEQ ID NO: 84261
  chr19:54005694-54005725
  Hypo

SEQ ID NO: 116873 - DNA, 687 bp, Homo sapiens
  chr19:54023871-54024558
  Hyper
cgaaaagcattctgacggccgcgcttccagcgctaaggattcccgcgtagtgagcatttcccagaggtctctggggcatggctccattagggccgtgtgcagttgcctgcagggaaacactgatgggcgcccttccagatacgtcgattcccgggttatgagctacatttcccagaagccctcaaggcaggacgcccttagggtcgcgtagagttgcatgctgggaaatcctgacagccgcttccaactctgtggatttccgggttatggactacatttcccagaggcctctgggtcacggctccatttgcgccgtgtagagttgcatgctgggaaacactgacgggcgcccttccagctgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcgg

SEQ ID NO: 116874 - DNA, 266 bp, Homo sapiens; identical to SEQ ID NO: 84264
  chr19:54024618-54024884
  Hyper

SEQ ID NO: 116875 - DNA, 114 bp, Homo sapiens; identical to SEQ ID NO: 46019
  chr19:54033275-54033389
  Hypo

SEQ ID NO: 116876 - DNA, 21 bp, Homo sapiens
  chr19:54039855-54039876
  Hypo
tttaaaaattattctcgactg

SEQ ID NO: 116877 - DNA, 30 bp, Homo sapiens; identical to SEQ ID NO: 46021
  chr19:54046025-54046055
  Hypo

SEQ ID NO: 116878 - DNA, 34 bp, Homo sapiens; identical to SEQ ID NO: 84268
  chr19:54074852-54074886
  Hypo

SEQ ID NO: 116879 - DNA, 58 bp, Homo sapiens; identical to SEQ ID NO: 84269
  chr19:54109845-54109903
  Hypo

SEQ ID NO: 116880 - DNA, 30 bp, Homo sapiens; identical to SEQ ID NO: 84270
  chr19:54162709-54162739
  Hyper

SEQ ID NO: 116881 - DNA, 144 bp, Homo sapiens; identical to SEQ ID NO: 84271
  chr19:54224540-54224684
  Hypo

SEQ ID NO: 116882 - DNA, 19 bp, Homo sapiens
  chr19:54232634-54232653
  Hypo
caggcgtgagccaccgcgc

SEQ ID NO: 116883 - DNA, 47 bp, Homo sapiens; identical to SEQ ID NO: 84273
  chr19:54314338-54314385
  Hypo

SEQ ID NO: 116884 - DNA, 16 bp, Homo sapiens
  chr19:54347071-54347087
  Hypo
tcggcaaagtcacagc

SEQ ID NO: 116885 - DNA, 37 bp, Homo sapiens; identical to SEQ ID NO: 84275
  chr19:54351799-54351836
  Hypo

SEQ ID NO: 116886 - DNA, 66 bp, Homo sapiens; identical to SEQ ID NO: 84278
  chr19:54371989-54372055
  Hyper

SEQ ID NO: 116887 - DNA, 68 bp, Homo sapiens; identical to SEQ ID NO: 84279
  chr19:54372332-54372400
  Hyper

SEQ ID NO: 116888 - DNA, 139 bp, Homo sapiens; identical to SEQ ID NO: 84280
  chr19:54372963-54373102
  Hyper

SEQ ID NO: 116889 - DNA, 90 bp, Homo sapiens; identical to SEQ ID NO: 84281
  chr19:54382714-54382804
  Hyper

SEQ ID NO: 116890 - DNA, 30 bp, Homo sapiens; identical to SEQ ID NO: 84282
  chr19:54393087-54393117
  Hyper

SEQ ID NO: 116891 - DNA, 34 bp, Homo sapiens; identical to SEQ ID NO: 84283
  chr19:54395866-54395900
  Hypo

SEQ ID NO: 116892 - DNA, 54 bp, Homo sapiens; identical to SEQ ID NO: 84284
  chr19:54401772-54401826
  Hyper

SEQ ID NO: 116893 - DNA, 30 bp, Homo sapiens; identical to SEQ ID NO: 84285
  chr19:54402455-54402485
  Hyper

SEQ ID NO: 116894 - DNA, 159 bp, Homo sapiens; identical to SEQ ID NO: 84286
  chr19:54403442-54403601
  Hypo

SEQ ID NO: 116895 - DNA, 435 bp, Homo sapiens; identical to SEQ ID NO: 84287
  chr19:54409951-54410386
  Hyper

SEQ ID NO: 116896 - DNA, 772 bp, Homo sapiens; identical to SEQ ID NO: 84288
  chr19:54411125-54411897
  Hyper

SEQ ID NO: 116897 - DNA, 511 bp, Homo sapiens
  chr19:54412648-54413159
  Hyper
cgggggcggggggcgcgggcaccggcgaccccggtggcggcggcggcggccgggggaagcctcggggccggtcatgcggctgcggggcccgcggcccggagcgtccgcccagccctgagcgaggtgagcgctagcggagggtcctgggaggaagaaggggcgcccctcgaggtggctgcgagccgggtttggggcaacaagggacccgagtggctccaggggtggtgagatcctggcggtcgggacgcccgaattcgagcggctatgggggatgcagggacacctgggcctggcgatcccggaggacggggtccgagggtcccggagtgggaaactgcactcctcgcgtccgagtcgcagcgagcgtgggctggggagggcagaggccgggtccctgaggaaggcgaggtacggggcgagggcggaggacccaggcccggccagagcaggatgtgggtctggaaaggggtcccagaaagggggagttacggtctcccgagagatggaggag

SEQ ID NO: 116898 - DNA, 239 bp, Homo sapiens; identical to SEQ ID NO: 84292
  chr19:54413373-54413612
  Hyper

SEQ ID NO: 116899 - DNA, 435 bp, Homo sapiens
  chr19:54445310-54445745
  Hyper
tacctgttcaccaagcgctacgcggaggaggagatgtaccgtccacacccggccttctaccgcccgcgtctcagcgactgctccgactactcgggccagttcctgcagcccgaggcgtggcgccgcggccggagcccctccgacatctccagcgacgtgtccatccaaatgacgcagaactaccctcccgccatcaagtacccggaccacctgcacatctccacctcgccctgctgaggcccgcccctcggagctccccctgcctcctcctcctcctcgtcttaggggggtctccctgcaatgcagcgcccccttccgtcctcgggactcctcgctcccacccggaggaggctgcgccagctttaggccccgccctcctcccaatggctccgcccacagactcccttatttcaatggccgcgccctcttttcccg

SEQ ID NO: 116900 - DNA, 268 bp, Homo sapiens; identical to SEQ ID NO: 84295
  chr19:54445948-54446216
  Hyper

SEQ ID NO: 116901 - DNA, 39 bp, Homo sapiens; identical to SEQ ID NO: 84296
  chr19:54446419-54446458
  Hyper

SEQ ID NO: 116902 - DNA, 30 bp, Homo sapiens; identical to SEQ ID NO: 84297
  chr19:54461145-54461175
  Hyper

SEQ ID NO: 116903 - DNA, 57 bp, Homo sapiens; identical to SEQ ID NO: 84298
  chr19:54461664-54461721
  Hyper

SEQ ID NO: 116904 - DNA, 52 bp, Homo sapiens; identical to SEQ ID NO: 84299
  chr19:54463017-54463069
  Hyper

SEQ ID NO: 116905 - DNA, 459 bp, Homo sapiens; identical to SEQ ID NO: 84300
  chr19:54465275-54465734
  Hyper

SEQ ID NO: 116906 - DNA, 493 bp, Homo sapiens; identical to SEQ ID NO: 84301
  chr19:54466121-54466614
  Hyper

SEQ ID NO: 116907 - DNA, 637 bp, Homo sapiens
  chr19:54481331-54481968
  Hyper
tcagtggggttgccccgcccccaaccctgaagtatccgcccccaccactgccctccccgctcctccagggttgaaaagaggcgtctgcgtgaagatcaatcatttcccggaggacacggactacgaccacgacagcgcggagtatctactccgtacgtgggggtccgggacagacgtggggagtgggtcaaatcgcggggcctggaaggcgtcggggtgggtgccgggaaaaggcactgggactccggcacttggatcgacacgccgaggttagcctcccagccaatccgagtccagatagtgagatcctctggtccccgattggctgactgatctcgttcccgccccctcctctcaccttggggcgggctgagggaggatcctgggcgctaattggccgctttgctctctttggccctcgcggcgactctgcgccgtgactggttgtggaatcccggactgggattggccaccgcgccgcagagctgtggggcaatctgcggcggtgacgggccactactgggagccggctgggaaagcctgtattgccattggtagctaccccgagaacgcggcaaatcctaaatgatgattggctgcggcctcagccaggttccgaaatcgcaaaatctagttg

SEQ ID NO: 116908 - DNA, 913 bp, Homo sapiens
  chr19:54482817-54483730
  Hyper
cagggagagtgatttcgataaataaagagggggaaagatattccaagagagagaaaaatagtccgaagaaaaaagaaaaggacaaagaaaaagagggagagaaaatcagaccgagaaatagagaaattttaaaaacaggagagagaatgaggcaacagtaaaataaaccagaacacagccggagagagagaatcacagaactgtcgggaggcgccgcgagatggggggccgggaagggggcgcaggcggccgcgtctgaccgccctcgctctccctccttttcctttccttcctcccccgcaggagttgtccgggcctccagcatcttccccatccttagcgccatcctgctgctgctcgggggtgtgtgcgtggcggcctcccgcgtctacaagtccaagaggaacatcattctgggcgcagggatcctgttcgtggcagcaggtgagaggcagagggagggggcgaccggggcggcccacctgggcgcgcacgtgtgtgtgtgtgtgtgtgtgtgtgtgtgcgcgcgcgcgcgtgagtgcaagtgcgcgttcgtgtgtctgcaaagccaccttgccccgagcacccccgggggcccggagccttcctaggcggtccccaagctccatcgccacccgctgggtaaggtgggtgtagttctcgcgtcgccttcggaggagtaaaccgacacaggcaggtgtctggcgcgtaagacgccgggcgcttaggatcccaagcccgccgtcctggagacggaaggggaggagctggggagggggtgggaccttgagacacaattgggctcttgaggatagagaggcggggctgggtcttggagggcgggcccaggagaggtagaaagtgatctgagcgccgatgaggagcctgctttaaggggcgggcctttggagac

SEQ ID NO: 116909 - DNA, 673 bp, Homo sapiens
  chr19:54485524-54486197
  Hyper
gcgcactgccagtctcgctcggacctgctcaaggccggcgggggcgcgggcggcagtggcgggagcggcccctcggccatcctccgtctgcccagttaccgcttccgctaccgccgccgctcccgctctagctcccgctccagcgagccgtcgccgtcgcgggacgcgtctcccggcggccccgggggcccgggctttgcctccacggacatctccatgtacacgctcagccgcgacccctccaagggcagcgtggccgcggggctggcgggggccggcggcggcggcggcggcgccgtgggggcgttcggcggcgcggccgggggcgccgggggcggcggcggaggcggcggcggggcgggtgccgagcgggaccgcgggggggcgtccggcttcctcacgctgcacaacgccttccccaaggaggcgggcggcggcgtcacggtcacggtcaccgggccgcccgccccgcccgcgcccgcgccacccgcgccctctgcgcccgcccccgggaccctggccaaggaggccgccgcctccaacaccaacacgctcaacaggaaaaccacgcctgtgtaggggcgcggcgggggagccgaggggcgtgtccggggcgcgtgcgcgggcgcgcgtgcatcgaggctgccggggtcgggggcgcccccgctttccc

SEQ ID NO: 116910 - DNA, 30 bp, Homo sapiens; identical to SEQ ID NO: 84311
  chr19:54487792-54487822
  Hypo

SEQ ID NO: 116911 - DNA, 246 bp, Homo sapiens; identical to SEQ ID NO: 84312
  chr19:54494857-54495103
  Hyper

SEQ ID NO: 116912 - DNA, 30 bp, Homo sapiens; identical to SEQ ID NO: 84313
  chr19:54523707-54523737
  Hyper

SEQ ID NO: 116913 - DNA, 123 bp, Homo sapiens; identical to SEQ ID NO: 84323
  chr19:55597901-55598024
  Hyper

SEQ ID NO: 116914 - DNA, 16 bp, Homo sapiens
  chr19:55643097-55643113
  Hypo
attatgaaaaactagc

SEQ ID NO: 116915 - DNA, 76 bp, Homo sapiens; identical to SEQ ID NO: 84325
  chr19:55645710-55645786
  Hypo

SEQ ID NO: 116916 - DNA, 155 bp, Homo sapiens; identical to SEQ ID NO: 84326
  chr19:55648515-55648670
  Hypo

SEQ ID NO: 116917 - DNA, 30 bp, Homo sapiens; identical to SEQ ID NO: 84327
  chr19:55666172-55666202
  Hypo

SEQ ID NO: 116918 - DNA, 79 bp, Homo sapiens; identical to SEQ ID NO: 84328
  chr19:55673951-55674030
  Hypo

SEQ ID NO: 116919 - DNA, 146 bp, Homo sapiens; identical to SEQ ID NO: 84330
  chr19:55684817-55684963
  Hyper

SEQ ID NO: 116920 - DNA, 135 bp, Homo sapiens; identical to SEQ ID NO: 84331
  chr19:55685225-55685360
  Hyper

SEQ ID NO: 116921 - DNA, 928 bp, Homo sapiens; identical to SEQ ID NO: 84332
  chr19:55690230-55691158
  Hyper

SEQ ID NO: 116922 - DNA, 30 bp, Homo sapiens; identical to SEQ ID NO: 84334
  chr19:55721224-55721254
  Hypo

SEQ ID NO: 116923 - DNA, 30 bp, Homo sapiens; identical to SEQ ID NO: 84335
  chr19:55723238-55723268
  Hypo

SEQ ID NO: 116924 - DNA, 16 bp, Homo sapiens
  chr19:55727832-55727848
  Hypo
gcgattagatcattga

SEQ ID NO: 116925 - DNA, 78 bp, Homo sapiens; identical to SEQ ID NO: 84337
  chr19:55729117-55729195
  Hypo

SEQ ID NO: 116926 - DNA, 44 bp, Homo sapiens; identical to SEQ ID NO: 84338
  chr19:55752054-55752098
  Hypo

SEQ ID NO: 116927 - DNA, 224 bp, Homo sapiens; identical to SEQ ID NO: 84339
  chr19:55798440-55798664
  Hypo

SEQ ID NO: 116928 - DNA, 58 bp, Homo sapiens; identical to SEQ ID NO: 46027
  chr19:55853009-55853067
  Hypo

SEQ ID NO: 116929 - DNA, 83 bp, Homo sapiens; identical to SEQ ID NO: 84342
  chr19:55865272-55865355
  Hyper

SEQ ID NO: 116930 - DNA, 261 bp, Homo sapiens; identical to SEQ ID NO: 84343
  chr19:55865785-55866046
  Hyper

SEQ ID NO: 116931 - DNA, 204 bp, Homo sapiens; identical to SEQ ID NO: 84344
  chr19:55868920-55869124
  Hypo

SEQ ID NO: 116932 - DNA, 44 bp, Homo sapiens; identical to SEQ ID NO: 84345
  chr19:55870737-55870781
  Hypo

SEQ ID NO: 116933 - DNA, 24 bp, Homo sapiens
  chr19:55904166-55904190
  Hypo
gattacaggcgtgagccaccgcgt

SEQ ID NO: 116934 - DNA, 98 bp, Homo sapiens; identical to SEQ ID NO: 84348
  chr19:55912265-55912363
  Hypo

SEQ ID NO: 116935 - DNA, 30 bp, Homo sapiens; identical to SEQ ID NO: 84349
  chr19:55917603-55917633
  Hypo

SEQ ID NO: 116936 - DNA, 30 bp, Homo sapiens; identical to SEQ ID NO: 46029
  chr19:55927698-55927728
  Hypo

SEQ ID NO: 116937 - DNA, 37 bp, Homo sapiens; identical to SEQ ID NO: 84352
  chr19:55944725-55944762
  Hyper

SEQ ID NO: 116938 - DNA, 39 bp, Homo sapiens; identical to SEQ ID NO: 84353
  chr19:55951941-55951980
  Hyper

SEQ ID NO: 116939 - DNA, 314 bp, Homo sapiens; identical to SEQ ID NO: 84355
  chr19:55952650-55952964
  Hyper

SEQ ID NO: 116940 - DNA, 1428 bp, Homo sapiens; identical to SEQ ID NO: 84356
  chr19:55953539-55954967
  Hyper

SEQ ID NO: 116941 - DNA, 178 bp, Homo sapiens; identical to SEQ ID NO: 84357
  chr19:55962347-55962525
  Hyper

SEQ ID NO: 116942 - DNA, 189 bp, Homo sapiens; identical to SEQ ID NO: 84358
  chr19:55963107-55963296
  Hyper

SEQ ID NO: 116943 - DNA, 209 bp, Homo sapiens; identical to SEQ ID NO: 84359
  chr19:55963515-55963724
  Hyper

SEQ ID NO: 116944 - DNA, 30 bp, Homo sapiens; identical to SEQ ID NO: 84361
  chr19:55974384-55974414
  Hypo

SEQ ID NO: 116945 - DNA, 173 bp, Homo sapiens; identical to SEQ ID NO: 84362
  chr19:55976810-55976983
  Hypo

SEQ ID NO: 116946 - DNA, 30 bp, Homo sapiens; identical to SEQ ID NO: 46031
  chr19:55982821-55982851
  Hypo

SEQ ID NO: 116947 - DNA, 30 bp, Homo sapiens; identical to SEQ ID NO: 84364
  chr19:55989384-55989414
  Hypo

SEQ ID NO: 116948 - DNA, 53 bp, Homo sapiens; identical to SEQ ID NO: 37770
  chr19:56015184-56015237
  Hyper

SEQ ID NO: 116949 - DNA, 68 bp, Homo sapiens; identical to SEQ ID NO: 84366
  chr19:56067053-56067121
  Hypo

SEQ ID NO: 116950 - DNA, 30 bp, Homo sapiens; identical to SEQ ID NO: 84367
  chr19:56101733-56101763
  Hypo

SEQ ID NO: 116951 - DNA, 94 bp, Homo sapiens; identical to SEQ ID NO: 84368
  chr19:56156432-56156526
  Hypo

SEQ ID NO: 116952 - DNA, 220 bp, Homo sapiens; identical to SEQ ID NO: 84369
  chr19:56159449-56159669
  Hyper

SEQ ID NO: 116953 - DNA, 36 bp, Homo sapiens; identical to SEQ ID NO: 84370
  chr19:56159914-56159950
  Hyper

SEQ ID NO: 116954 - DNA, 33 bp, Homo sapiens; identical to SEQ ID NO: 84371
  chr19:56163910-56163943
  Hypo

SEQ ID NO: 116955 - DNA, 30 bp, Homo sapiens; identical to SEQ ID NO: 84372
  chr19:56164542-56164572
  Hypo

SEQ ID NO: 116956 - DNA, 39 bp, Homo sapiens; identical to SEQ ID NO: 46032
  chr19:56179648-56179687
  Hypo

SEQ ID NO: 116957 - DNA, 145 bp, Homo sapiens; identical to SEQ ID NO: 84374
  chr19:56181784-56181929
  Hypo

SEQ ID NO: 116958 - DNA, 202 bp, Homo sapiens; identical to SEQ ID NO: 84375
  chr19:56199417-56199619
  Hypo

SEQ ID NO: 116959 - DNA, 100 bp, Homo sapiens; identical to SEQ ID NO: 46034
  chr19:56200496-56200596
  Hypo

SEQ ID NO: 116960 - DNA, 53 bp, Homo sapiens; identical to SEQ ID NO: 84377
  chr19:56201665-56201718
  Hypo

SEQ ID NO: 116961 - DNA, 95 bp, Homo sapiens; identical to SEQ ID NO: 84378
  chr19:56205701-56205796
  Hypo

SEQ ID NO: 116962 - DNA, 30 bp, Homo sapiens; identical to SEQ ID NO: 84379
  chr19:56209262-56209292
  Hypo

SEQ ID NO: 116963 - DNA, 207 bp, Homo sapiens; identical to SEQ ID NO: 84380
  chr19:56230798-56231005
  Hypo

SEQ ID NO: 116964 - DNA, 210 bp, Homo sapiens; identical to SEQ ID NO: 84381
  chr19:56253382-56253592
  Hypo

SEQ ID NO: 116965 - DNA, 31 bp, Homo sapiens; identical to SEQ ID NO: 84382
  chr19:56256348-56256379
  Hypo

SEQ ID NO: 116966 - DNA, 196 bp, Homo sapiens; identical to SEQ ID NO: 84383
  chr19:56262254-56262450
  Hypo

SEQ ID NO: 116967 - DNA, 30 bp, Homo sapiens; identical to SEQ ID NO: 84384
  chr19:56321275-56321305
  Hypo

SEQ ID NO: 116968 - DNA, 30 bp, Homo sapiens; identical to SEQ ID NO: 84385
  chr19:56346696-56346726
  Hypo

SEQ ID NO: 116969 - DNA, 30 bp, Homo sapiens; identical to SEQ ID NO: 84386
  chr19:56347904-56347934
  Hypo

SEQ ID NO: 116970 - DNA, 196 bp, Homo sapiens; identical to SEQ ID NO: 84387
  chr19:56451612-56451808
  Hypo

SEQ ID NO: 116971 - DNA, 36 bp, Homo sapiens; identical to SEQ ID NO: 84388
  chr19:56477708-56477744
  Hypo

SEQ ID NO: 116972 - DNA, 209 bp, Homo sapiens; identical to SEQ ID NO: 84389
  chr19:56538913-56539122
  Hypo

SEQ ID NO: 116973 - DNA, 30 bp, Homo sapiens; identical to SEQ ID NO: 46038
  chr19:56543855-56543885
  Hypo

SEQ ID NO: 116974 - DNA, 30 bp, Homo sapiens; identical to SEQ ID NO: 84391
  chr19:56588880-56588910
  Hypo

SEQ ID NO: 116975 - DNA, 30 bp, Homo sapiens; identical to SEQ ID NO: 84392
  chr19:56602324-56602354
  Hypo

SEQ ID NO: 116976 - DNA, 30 bp, Homo sapiens; identical to SEQ ID NO: 46039
  chr19:56603841-56603871
  Hypo

SEQ ID NO: 116977 - DNA, 154 bp, Homo sapiens; identical to SEQ ID NO: 84394
  chr19:56617206-56617360
  Hypo

SEQ ID NO: 116978 - DNA, 46 bp, Homo sapiens; identical to SEQ ID NO: 84395
  chr19:56638732-56638778
  Hypo

SEQ ID NO: 116979 - DNA, 40 bp, Homo sapiens; identical to SEQ ID NO: 46041
  chr19:56686390-56686430
  Hypo

SEQ ID NO: 116980 - DNA, 111 bp, Homo sapiens; identical to SEQ ID NO: 84398
  chr19:56688368-56688479
  Hypo

SEQ ID NO: 116981 - DNA, 50 bp, Homo sapiens; identical to SEQ ID NO: 84399
  chr19:56709053-56709103
  Hypo

SEQ ID NO: 116982 - DNA, 30 bp, Homo sapiens; identical to SEQ ID NO: 84400
  chr19:56709484-56709514
  Hypo

SEQ ID NO: 116983 - DNA, 217 bp, Homo sapiens; identical to SEQ ID NO: 84401
  chr19:56727700-56727917
  Hypo

SEQ ID NO: 116984 - DNA, 656 bp, Homo sapiens
  chr19:56728469-56729125
  Hyper
tgccaggaaacacaccgcgtggagacccagcatgactgctgactgattgcaagtccccaggagggctttatttttgcttttcaacatcctgttctgcaggttccttggctctttttgcccgtatgccgaagagccgggcattgggacgggccatgcggagactagcgaaggctttgaaattcttctcctcgatgatgactccagctttctccttctaggcattccggttgggcatgaccggtcctgtcagccgagcggccagtttcagttcttcagcagaactgtctcccttctcggaggccgagggcttcccggggaagcggatgcgtttggagcggggctccttcagccgccgcacgttggcctgcagggactgcgcctcctcggatccgcagaaatgccggcgtccgggcccccttcttcgcgtgccggccaccctgagctcctccaggcggaggccgcggccgtgcgcaccttcgtgtggtaccgaaccgtggggcagcgcacgatgggccggatgggccccgacgcggggcaggggcgaggcggcgcgccttggcttgcccggcctggcgcctgcggatcttctgggccggctggttgaaccgcttggccacgcgccgctgcagtccttggggaagcggggcttcgagatc

SEQ ID NO: 116985 - DNA, 99 bp, Homo sapiens; identical to SEQ ID NO: 84405
  chr19:56806322-56806421
  Hypo

SEQ ID NO: 116986 - DNA, 38 bp, Homo sapiens; identical to SEQ ID NO: 84407
  chr19:56877841-56877879
  Hypo

SEQ ID NO: 116987 - DNA, 552 bp, Homo sapiens
  chr19:56879439-56879991
  Hyper
cagcgttctcaacaccgccaacgggcacaaagccacgcccccacggccgaactcacgcctacgtactcagtcaccagcggaaccctctccaccaggctccgcgtcgaggccctacggggcgtcaatacgcacgcgtactttgtgtcccaggtagctcgtctcttagccatgtacgcctctgcattccggtcactgggagcggggccgtgggggctgcacatgcgcactgcgagtcctcgcctactcccagaaaccacccgggcgcatacgcggtgcggccgctgcttcaggtcggcgggctccagggagacctgggtgggcagcgtcgccgtttctcctttcttgggcagtatttttcccagcgccacgcggaggctgggccattatgaggtttgtgttgcgtcggggcggtccgtctcagaggcgctccggggaggagtgggcggctgaatggccagaggcccagggatccgttcaggtcagcgctggcgtccgggcctgagtttggaggtggcgggtgccttacaagaatgctcgcgtgatcagtgtgtt

SEQ ID NO: 116988 - DNA, 30 bp, Homo sapiens; identical to SEQ ID NO: 84412
  chr19:56888933-56888963
  Hypo

SEQ ID NO: 116989 - DNA, 34 bp, Homo sapiens; identical to SEQ ID NO: 84413
  chr19:56893758-56893792
  Hypo

SEQ ID NO: 116990 - DNA, 857 bp, Homo sapiens
  chr19:56904511-56905368
  Hyper
aaaaaaaaaaaggcacgcataacagtgaatgcaaaacatccgcaatttcagggggtcggagacccctgcgcacccacctaaggggtccatgcacctgggctatgaggctggaagcagaaagggggcgccagaaagcgcacgccgcgagggccggcgggaaatgtagtctcacgccggtaaagccacagagcgacgatgaggcgagacgtctgcgttcttctcaggcctgagacccaaccggcccgggcaccagctcctgctggaccccagagcgcctggaaagctccggaacctctcacctgccgcctcctcgggtccaagtgccaccgcggccgcgcccccggcagcccagggcgcgcttccaccacggtaccggtggattcgccgtgcgcagccggaagatggcgcagacgcacaaagcacaccgatgctgcgccatgatagggccggcgccgcagtgtcttccgggaaacatagtctttaggcgtaaaggcagcagcccggccttgaagccggatctcgcgatgtttcagggtgagccggacgcaggcgtgcctgcgcagtgcgcggaggagtgctgttcgtgtgttcgagtccctgggttgcttcctggggtctgtggtgctgggtgtgctatctgcgtgtgattctctagcgagagattgtgggcgagtgaccgagtgggcaaggggccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgtggaacaacagtt

SEQ ID NO: 116991 - DNA, 803 bp, Homo sapiens
  chr19:56915132-56915935
  Hyper
tgtgcccagggcccacgacagtgcccgatacagcaggcgctcaataagtggcgaatgaaagacagggcaaggcggagagagaagaaacagaaagggaaagagaaagcccgggccgccagagcgcttaatcacacgtacatcctaccgggcccctctccagctggctcaggctccacactggtcctccagctcccttttctcagcgatggactcacagccccacccggagcgctggagcgcggacgcggtcactgcgcgtgcgcctcaccgcgctggcaccccggcctggcagcctttggggacctgaaccagctgcgcctgcgcaggtggaacgggtggaacgggtgggggagcggacagtcgaacggcctgagagggctcagctggtccgggtgggattctgaaggccagcggaggtgggcttactagggaaaggggcgcagcagtaactacccgcaactgagcggcgggatctgcggccgcccggggccctcggccaacatcccagcatcctctgcgccgcgccggccccggactccatttcccagcggcccctgcggcctgccctagggctgcggcgcctttgtgagcgcggccgccggccaggatcgagccctggcccgggccctggcccagccccggcctccaaggaccgcgccgaaggaggtgcccactggagggaggaggcggtgaggagcgcgggatggagctgacgccgggagcggccatgccaccatgtgtgggaccgtgtgtgacagtgtgtgagaatgtgtgagacattaaggaaccgtgtgtgacaatgt

SEQ ID NO: 116992 - DNA, 30 bp, Homo sapiens; identical to SEQ ID NO: 84419
  chr19:56921699-56921729
  Hypo

SEQ ID NO: 116993 - DNA, 35 bp, Homo sapiens; identical to SEQ ID NO: 46044
  chr19:56987547-56987582
  Hypo

SEQ ID NO: 116994 - DNA, 1624 bp, Homo sapiens
  chr19:56988309-56989933
  Hyper
ccttcgcgtgggtcacgcagcgatacacatccgcggtcccgacatagctccctcacacacaggcacacacggctcgcctcacacgcggcgccaacttcacacttgggcgcacaagccccgagaaccacagcagcgaagggcgcaaaccccacgccgtggcgggccgagaacccacgcaggcgcgagcccaccgcccacgcaagcacccgcgcagacgcccacgccatcgtggatgcgcaaacccacgcgcgccttggcaggaacgtccacgcagtggcgggcgcgccgcccacgccctcagacacacccacactctcgccagcccccttacctcggtcttcccgggctcagaccccggcggcgaccaccgagacagccgagcagggactcagcgcctgcgcactcccctccgggaccccgggaccgcgcgctgcaccccccttcacacacgcaccacgcatgcgggcgcgtggccccgcccccaaacaaggccacgcggcgtgcgctcacccgcctctcggggacagtaccaccagccccggcctgaggccccgacccctcagcgccacacgcacaagcgcgttcgcacgattggtgcaggcggacgcgcgaggtcccgcgcctgcgcacacccccgaggctggcacgcacaccggtctcctaggggactggcgcctggccctgcttttcatcctctcaggagatcacgtgtggacactgaggcccttcctcgagctctttaaccaaacccaacctccccaattcgccgccttccccgctcccacaaccacacgttcccgtgtgagggcttattgcctccagccagccagcgtccttcgcccccacattcacgaggtttggagccggcctcacccgcggaggcggacaccgcccacccgcgcgtgcgcactacgcagtcatcctgcgacctccagaatccaccggggtgcagcgaggctgtggaaagtcccacccagaacgtgaggtgaagaaggcttgggctgcgctggttctgctctgtccgggtcggagatgaactgacccgggagagcagcggagggatgtttcttttggccaacagtggggactcacctgcacgttttgcgaagaggcccacagtcctttgcgtggcgctcggactacatttcccaacggcccctgcacgccctgggggctgttccatgcggtgttgcgcctgcgtagccggcgggctggcagtgagactgactgcgtcggggttgagactgggtggatgaggctcaccccggcggggagaagggacgaggaggggcggacagcggaaggtccgggagtgtccgccataaagtcgtttgaggtgaccgttgcgtaattgtgagtctgtgagagaagatgtgaagtatggcctcgtcccggtcatctgggcgtgcgggtcccgggttttgatcgcgcgtttgtgtaggtgagacccacattgtgttaccctgaacatgtgtgaggacgaacctttgtgttttcttatacgtgtgtctctgaggcgatttttgtggttttgtacgtggcggggggcactgattttgaatatgtgtgtatgttctggacatttgtttagcttctgcatccacttctgcggaagggcagagtt

SEQ ID NO: 116995 - DNA, 775 bp, Homo sapiens
  chr19:57018744-57019519
  Hyper
gccagagtcacaacacggtcggggttcctcgtcgctgtcttattccaaaataagcttaacacagaaagataatgacactcccacggactggcacagaaggccgcgctccgaatgacatcgcgatcacagaggcacagacagcgtcacaaagccccacgcgtactcacaccgaaggctcagccgtcgcgcgtttccctcccaggccccaggaactagtaactagggacgcttctggtctctaggcgaggagagggggagagcgcaatctttgcgcctgcgcacactcctgctcttacccgccggaaccctgggccacgcccggctcgcgtaatcacgcactgcgcaggcaccgcccgctctgctctaaggtccctctcactccttcagcagcccgaggacaatcccctcaacactaggccacgccttgtctccgcccctctcgtccgacccctggagagaggctggcgcctgcgcgatggggggttccagcgtcgactcacggagtccttcggatgagagcgtctgggtgccagacgaggccgggggtttgttttgggtggtttgggagtccgagctcgagggctgggccaggaagggcaggcgaggcgggcggctccgacgcgggtcgcgaaggcccagccgcgtcctctgtccccaggacgactacatttcccagaggccagcggggcgcgcgtactcgagtctgcggggcggaggccgcggctcggggctgctgggcgttcggggcggcttggggcggcgggaccactggagt

SEQ ID NO: 116996 - DNA, 41 bp, Homo sapiens; identical to SEQ ID NO: 84428
  chr19:57019931-57019972
  Hyper

SEQ ID NO: 116997 - DNA, 271 bp, Homo sapiens
  chr19:57049841-57050112
  Hyper
ggtgtgtagtcagagcggcctctgcttccggccacacccaggcccagcgttggccaccacttatgcggcggctgcggtccagggacaagtgagagcgacccgcagagggcaggacggacgggcgttgcataggcccggggccaaaccgtatcttgcaacctgagctccgagggccgccgcatccgtccctgcttgggactacgcttcccagcgggcattgcgccgaggccacgcccggttccggcggcgctgcctgcgcactggaagtggg

SEQ ID NO: 116998 - DNA, 30 bp, Homo sapiens; identical to SEQ ID NO: 84431
  chr19:57050463-57050493
  Hyper

SEQ ID NO: 116999 - DNA, 53 bp, Homo sapiens; identical to SEQ ID NO: 84432
  chr19:57051194-57051247
  Hypo

SEQ ID NO: 117000 - DNA, 903 bp, Homo sapiens; identical to SEQ ID NO: 84433
  chr19:57078350-57079253
  Hyper

SEQ ID NO: 117001 - DNA, 444 bp, Homo sapiens
  chr19:57106465-57106909
  Hyper
ctcaatcctccctctcgccccagcctccttggccgcggagtcctctgtgagatggaggagctcagttggctccgctcggctccactcggctgggctcggctgaaaaaagccggggggaggtggcgcgcgcgggtttctgggaagcgtagtccggcgcagtccgcgcaggcgcactgccgtcgggcgggcctagcgggcgcggtcattgtcctggcagagcggcgagccggtgagtgtggctgcggggtcgcgcccaccctctacctgtgccgggggccggaacctggccccggggagggcgcggcctcggggagacggcgtgcaggcccaggtacggggagtgcagggctgggtgctggtccagggcgtgcgggcgcaggagagggcgtgcaggccgggaccgaggtgcgcctggagaggctgagcggccgaggagaggctgag

SEQ ID NO: 117002 - DNA, 272 bp, Homo sapiens; identical to SEQ ID NO: 37793
  chr19:57149347-57149619
  Hyper

SEQ ID NO: 117003 - DNA, 875 bp, Homo sapiens; identical to SEQ ID NO: 84437
  chr19:57154182-57155057
  Hyper

SEQ ID NO: 117004 - DNA, 22 bp, Homo sapiens
  chr19:57174105-57174127
  Hypo
cagctggccaggcaccgtagct

SEQ ID NO: 117005 - DNA, 87 bp, Homo sapiens; identical to SEQ ID NO: 84439
  chr19:57174706-57174793
  Hypo

SEQ ID NO: 117006 - DNA, 421 bp, Homo sapiens
  chr19:57182912-57183333
  Hyper
acacctgcaggaacacgcgcacactacacaccgttgctctcgcctcccggtatcaccttcgaacgcgctggccggccccctcctagcctggtgcagtcggctccgcttctactcagtctcgggtcctcctgggccaacgcagaccctggtgcctccttccttagacgagctaaggtcaagacttctgctgctgcggaggagcccgcgcaccaggccggggtggactgcgcctgcgcatcgggcccgcctggttcttaggaactacgactcccagggggcgctgcgcgctcgccggcaccgcgactaaagcttgcaaagcctgggtcatcgaaactacaactcccagaaggctaagcgtctgcacacgctaggtccgcagggcgctgacccctgggggcccgaggagcgccgggctgctgcc

SEQ ID NO: 117007 - DNA, 30 bp, Homo sapiens; identical to SEQ ID NO: 84441
  chr19:57189156-57189186
  Hypo

SEQ ID NO: 117008 - DNA, 325 bp, Homo sapiens; identical to SEQ ID NO: 84443
  chr19:57276606-57276931
  Hyper

SEQ ID NO: 117009 - DNA, 198 bp, Homo sapiens; identical to SEQ ID NO: 84444
  chr19:57334837-57335035
  Hypo

SEQ ID NO: 117010 - DNA, 30 bp, Homo sapiens; identical to SEQ ID NO: 84445
  chr19:57335688-57335718
  Hypo

SEQ ID NO: 117011 - DNA, 35 bp, Homo sapiens; identical to SEQ ID NO: 84446
  chr19:57399472-57399507
  Hypo

SEQ ID NO: 117012 - DNA, 159 bp, Homo sapiens; identical to SEQ ID NO: 84447
  chr19:57418761-57418920
  Hypo

SEQ ID NO: 117013 - DNA, 40 bp, Homo sapiens; identical to SEQ ID NO: 84449
  chr19:57477131-57477171
  Hypo

SEQ ID NO: 117014 - DNA, 170 bp, Homo sapiens; identical to SEQ ID NO: 84450
  chr19:57491242-57491412
  Hypo

SEQ ID NO: 117015 - DNA, 368 bp, Homo sapiens
  chr19:57610673-57611041
  Hyper
tctgcacagtcagatcgcaggaacgcggcctagctgcttcagccacgttctcgcggcgccacctggtggccatggaccgccatcgccgctggacgtcagggccgccaggcccagcgagatgtcacctcctctgaggagccttccaggatcgcacccggcacgcgctccacgcctcgttgtctgttcttcggagcaccgaccatgatcacaaatcagctcgctcgctgtgtttcctgccgggtcgctaccgccatgatccgcacgtagtggtcaaggctgaggttgtatgaatgtggacgttataaccctggctccctctccctccctatgctgggctcccctcgatccccaggcggtggggtgcccct

SEQ ID NO: 117016 - DNA, 941 bp, Homo sapiens
  chr19:57617484-57618425
  Hyper
ggcctccctgcatcccggagcgcactggggatgaggactcacccaggagagcccgagacacctgagcggccggcacaaaggccctagggaagtgtgggggtacccttggtctcaaagcgctgatccgcctgtgccccctgacctgccagggccggcccccgcttgggtcttggagggcgctgcgcaagcctgcgccccgcactcgcccgggaagggaagggcagggaaggggcgcgcacagcctggcacctgctgtgcaccaggggagacgcgcggcgctccaggtggagtcggcggcggccgagctgcgcggggctgtgcggggctggattctagcctgcaggacgcgaaaacggcctgggtccggcttcctcctcccctgaagcagcgaaggggcgtcactggcgcgctgttaaacgtcttcgccatcggttccctgcatcctccctcctgcctgggtagccagctcctgggcgcgcccaggcgcacacgcttccctcgctcctcctgcagccacaacgcccccaccccccccgcccgcccgccttgtgcggcagcggtgaccgccttctcctgctgccaccccctccaccccctgttcaaggtctgtcaccgtagggggcgggggggcgcgtggagccgctgggggttcggcccaccccgcgaaccgagctcccggccctgtgcgccctcagctctgccgcgggcgttggcctgggcgggcgcaggactgcctggtcgccctggagctcagggtcggggccccgcgtttaaccaccaggcggaggcgcaggcggagcccggagaggacgcgacccctctgggcggccttgggcccctggacgtgccagactctggacccctgcgggggctgccgtggagagcagaggcaccgcgtcctgcccagagctccgataggcgggccgcgttgggggattgtg

SEQ ID NO: 117017 - DNA, 25 bp, Homo sapiens
  chr19:57628160-57628185
  Hypo
tgagacacggcgcctggccaatccc

SEQ ID NO: 117018 - DNA, 206 bp, Homo sapiens
  chr19:57683154-57683360
  Hyper
ctctctgtgcggctccgcaagtatgttggtctccctgagagagtggggcctgcaacctgctgggcgcaggcgccttgagctgccacgtctgcccttttaccggcttgggtgcaggcaagggaaatgcgtccccgggccggggggcgcgagcgggggtccggggccgcgagctggggtccggggagcgcgagcgggggtccgggggg

SEQ ID NO: 117019 - DNA, 333 bp, Homo sapiens
  chr19:57683566-57683899
  Hyper
cgagggggcggggcgcgcgagggggcggggcgcgccgggctcgtcctctccgcggcgctcagtggcagcagggagggccggtgagatgccagagcaaggtagggtcctgtatttggggaccgctgacgtttgggtccccctcccgcggctgttagcgctgcgtggcccgagacctgcggtcgggcggggattaaggctgctttccggagggccccggccgcgtggtcgccctgccagagcggttgatgtcaggcagtgctgggaggcgttgctctccgggttcgcttctctcctgttgtcctaactctgcatctctcccgggtgaatcacaga

SEQ ID NO: 117020 - DNA, 633 bp, Homo sapiens; identical to SEQ ID NO: 84462
  chr19:57702752-57703385
  Hyper

SEQ ID NO: 117021 - DNA, 23 bp, Homo sapiens
  chr19:57715571-57715594
  Hypo
cgagactccgtctcaaaaaaaaa

SEQ ID NO: 117022 - DNA, 80 bp, Homo sapiens
  chr19:57751675-57751755
  Hyper
ctgactcctggggctcgatttcctccggccaagaatggacggtctcgcgcttggtccctggcctccgagttgtgccccca

SEQ ID NO: 117023 - DNA, 787 bp, Homo sapiens
  chr19:57831613-57832400
  Hyper
gtgcccatagtaaagcggcggccctaagacgacgcgggggtccttgtgcgcacttaaatggagtcggctgcgcttggtgagttcccacacccggtagatgtgagggaaaaactgccttactcagaaggcaccaccccttgcgtcggccgcggactctaggccaatgacgggccaggacacgggcgatttctgcgggccagggcggcggaggtgggacttccgcttcgtcgcgtgacgtcatctccgtgagcaggattggccctggaacagtgtggggcctggaccgctgggtaggcgcgtccagcggcctgagcaggggagggtaatgaggctgttacgcgccttctccgcatcttggcgggagcctgacgccccgcttcttccctaacggggtgttccaccggcgcctgccgaggcctaggcctccgcagccgccctccgtctcctcagccccgacgctgcgcccgctttgtgcgcatttttctctggggaaactgaggctccgagtgcgaaagtcagccgaggtcgccccgcccaggacagagaagggctgggggtcggctgagccgcggcattcccgggccccgctagggctgcagggtctcaggatggcagcctcggcgcaggtgagtggacgaggttttggccttgctgctgctctgctacttctggaggcctcgtgggcaggcagaagccaagacagccacaggatgtttctttgtcgccgtcgtttatttaagagaagtggccgtagcttgtcatttcctttatccgcagtcctgcaata

SEQ ID NO: 117024 - DNA, 29 bp, Homo sapiens
  chr19:57854360-57854389
  Hypo
gctgggattacaggcgtgagccactgagc

SEQ ID NO: 117025 - DNA, 766 bp, Homo sapiens
  chr19:57862426-57863192
  Hyper
ctccccctccctgcacgacgcctcttggcagacatccgggagaacccgaaaggcgctcgttgcctggttggatgcagggtacaaactacgttacccagaaatctgtgcccagctcattgttagccggcgtgcagccaatgacagcccagaaactgggcgtttcctgctgctctgggctgcaggggcgagacttctggcgtcgccgtcgtgacgtatttttcctatgcccggtccgtgcattctggttgtgaaggctgagttctagagatcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcaggtgagtgggggcatccctcaagcgcaccccggcctggttggtgtgtcctgggatgttcgctctcatcgcgcacttcagggtgctcactccgtcgcattatgtggaggggttccgctcccctcatcag

SEQ ID NO: 117026 - DNA, 30 bp, Homo sapiens; identical to SEQ ID NO: 84472
  chr19:57866789-57866819
  Hypo

SEQ ID NO: 117027 - DNA, 133 bp, Homo sapiens; identical to SEQ ID NO: 84473
  chr19:57874872-57875005
  Hyper

SEQ ID NO: 117028 - DNA, 30 bp, Homo sapiens; identical to SEQ ID NO: 84474
  chr19:57875222-57875252
  Hyper

SEQ ID NO: 117029 - DNA, 30 bp, Homo sapiens; identical to SEQ ID NO: 84475
  chr19:57879906-57879936
  Hypo

SEQ ID NO: 117030 - DNA, 67 bp, Homo sapiens; identical to SEQ ID NO: 84477
  chr19:57901622-57901689
  Hyper

SEQ ID NO: 117031 - DNA, 38 bp, Homo sapiens
  chr19:57989030-57989068
  Hyper
accaacactagtaagcggcgtctcgcttcacctccagg

SEQ ID NO: 117032 - DNA, 407 bp, Homo sapiens; identical to SEQ ID NO: 84481
  chr19:57998952-57999359
  Hyper

SEQ ID NO: 117033 - DNA, 478 bp, Homo sapiens
  chr19:58011070-58011548
  Hyper
atctccatcatctaccgtctccaatctccatctccgaagttatgcccacttcctcgaagtttggagccacgcgaactacactgcccagaaggcgccgcgccgtgagccgcgatgcttggccaatgaaaagaggtctacccgagagtgcgacgcgcaatgggcgggacttccggcgtctcccctcggcggttgctttcgctgccctcaagagaactcagcttgccggaagctggttgttcgctgcggcgaccagctccggaaagcgcggtggggacgcgctgtgttctcgcagctcagaggcgggtctgaggctcggtggcggcgcccagggtggcccgggccctttcctcggtcgttgtctcaccgccacaggctccgatggcggcggccacgctgagggaccccgctcaggtgagcgccgcgtcctcccggcctcccccgaatcctaaagccctgtgagggccgcctgctcaggtcc

SEQ ID NO: 117034 - DNA, 30 bp, Homo sapiens; identical to SEQ ID NO: 84484
  chr19:58013681-58013711
  Hypo

SEQ ID NO: 117035 - DNA, 30 bp, Homo sapiens; identical to SEQ ID NO: 84485
  chr19:58019691-58019721
  Hypo

SEQ ID NO: 117036 - DNA, 26 bp, Homo sapiens
  chr19:58032735-58032761
  Hypo
gagagagactccgtctcaaaaaaaaa

SEQ ID NO: 117037 - DNA, 710 bp, Homo sapiens
  chr19:58038557-58039267
  Hyper
attgagtcctcacagcgcggcggactgcggcgtggtaggaactacaccacccagaatactgtgcgccgagcgtgccggggccttagaccaatcattgcccaggaaaggggcacctccgtaagtgcgcaatacgccagaatcttccggcgtctttccggtggtggtcgtttttgctgcctgcgagcgcgtccgcgggctgggcgtttccggctcgctgggtccgggccaggtaactggagccggaaaccggtggaggtggtgtccgcccgcagaggagcttgcctggtctcggtctgagcgtcgcccagcgatttgccaccgcacgcacgccggatcccgggctttaccgcccgcctttccaggccccgccccgcctaaagtcccatggccgaggcagcgctagtgattacgccgcaggtgagagcggagtcctcggatcctcacctgggtcctgaggccccggactggggtcacctgcgtgggtctctgcagttcaggcctcttctccaggacagcgaggagttctgggtggggtcctcagagctgacgggcggtgaggtgaagaagggagagcgttgcgtaccgtgggggctgcacgcgcagagcctgggaggtgcgccggggtcgcgagcattcggaaacttgggggcggacctgtgtctgcagggagcagagagaatgaggagaagaaggcacggctgccatggcag

SEQ ID NO: 117038 - DNA, 176 bp, Homo sapiens; identical to SEQ ID NO: 84489
  chr19:58039797-58039973
  Hypo

SEQ ID NO: 117039 - DNA, 30 bp, Homo sapiens; identical to SEQ ID NO: 84490
  chr19:58043143-58043173
  Hypo

SEQ ID NO: 117040 - DNA, 166 bp, Homo sapiens; identical to SEQ ID NO: 84491
  chr19:58046095-58046261
  Hypo

SEQ ID NO: 117041 - DNA, 937 bp, Homo sapiens; identical to SEQ ID NO: 84492
  chr19:58070569-58071506
  Hyper

SEQ ID NO: 117042 - DNA, 878 bp, Homo sapiens
  chr19:58094961-58095839
  Hyper
cagagcaggagcagccgggggcgcggcccccacgtggcctcccgggacacgtgcccacagcgcgacacctaagtcgctcctttcacagaatagccttggccccggcacggcctcgaacgccttgaccccgcaagggaggggcacgaggctcctttgctcccgcaggagcgtcgaatacgtatggaatacgcgtcggtgtggatctggcctcagcttcctgagcctgaatcaatgcttctaatcacgtgggcgctcagccgcgacgggaccacagaaatcgaccagcggcctgtttaaggagcgacaaggcccagccctctcctgcattgtggcgacgccatttccctgcgcccccagcgcggccgcttggcttttgtttgaggtgacgctgggcggcagcatccttccctcagccctggggaccagcggggactacagaacccagaaggttttgtctccagccgcagggatgctgagccaatccgcgctgagaaaagggtcgtttccgctttgggaccaatgggtcggggagggacttccggtatcacttcagtggcggtcatttttgcagcgcttgggtgcatccagaccgtcagagctttgggagcgctttgtttggcgacagtcggaaggcgcgaggggaggggtcctcccgctgaacagtgggggttctaagggtcggcggcggcggggttgacggctttgcctaggtccctccgcccgtagctgtcgggtcccggccccgctctgcccacagactccgatggctgcggccgcgctgagggccccgactcaggtgagcgctgcctctactgggcctcaccctccatccccaaattagtgccttcttgggtcactacggtcgagatcctcatgtc

SEQ ID NO: 117043 - DNA, 179 bp, Homo sapiens; identical to SEQ ID NO: 46051
  chr19:58101908-58102087
  Hypo

SEQ ID NO: 117044 - DNA, 752 bp, Homo sapiens; identical to SEQ ID NO: 84496
  chr19:58111112-58111864
  Hyper

SEQ ID NO: 117045 - DNA, 774 bp, Homo sapiens
  chr19:58125415-58126189
  Hyper
ggcataatttctcagcgcccctcgcagtaccatttggcctttgcccagcgtgcaggggagttagccgtcaccacggccaagtgcacatgagaactgcattgcccagaaacctgtgcgccgcccggcggcggcactcttaggggcgtctccctgcggacggaagctctctgggcgggacttccggtatcttcctcgcggtggacatcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcaggtgggtgctgcctttcccagactttcgcccgccccaaatcctgaagttccaaatgaggagcgcctgtctgagtccctgcagcgcaggccccagtgtccaaggcagcggggcgctggtgggtgggggcgagtgtgactggcagaggggcagcctgagcataggtttggagctggactgagcccgtagcagtcgggagcgtgtgtgaaccgtagtcaggcctgcaatgtcgaggggagaagttgctccttcattgcgaggacgataggagccatggcgggttttgaatggtggagggaagggatccgaaaaaggattttt

SEQ ID NO: 117046 - DNA, 375 bp, Homo sapiens; identical to SEQ ID NO: 84499
  chr19:58144370-58144745
  Hyper

SEQ ID NO: 117047 - DNA, 33 bp, Homo sapiens; identical to SEQ ID NO: 84500
  chr19:58144954-58144987
  Hyper

SEQ ID NO: 117048 - DNA, 30 bp, Homo sapiens; identical to SEQ ID NO: 84501
  chr19:58159508-58159538
  Hypo

SEQ ID NO: 117049 - DNA, 375 bp, Homo sapiens; identical to SEQ ID NO: 84502
  chr19:58175608-58175983
  Hyper

SEQ ID NO: 117050 - DNA, 157 bp, Homo sapiens; identical to SEQ ID NO: 84503
  chr19:58177578-58177735
  Hypo

SEQ ID NO: 117051 - DNA, 148 bp, Homo sapiens; identical to SEQ ID NO: 84504
  chr19:58193437-58193585
  Hyper

SEQ ID NO: 117052 - DNA, 32 bp, Homo sapiens; identical to SEQ ID NO: 84505
  chr19:58201272-58201304
  Hypo

SEQ ID NO: 117053 - DNA, 864 bp, Homo sapiens
  chr19:58219923-58220787
  Hyper
agagcgaaactccgtctcaaagaaaaaaaaactaacataaatggcgtccctcctttgttcagaactctccgtggcttctagcatcctcacaatgacagtacaaccctaggagtaactccgcctcatattcttcgttccctgcagaaaacagctttccgaattctcctggctcagtcgcgcctcaacctttgcacgcgccggttcctccgcctgtcacgctctcccacacctcgtcacacgcagtgtcaaaaaaagggccccacccacgaacgcctcagtgtccccgaccctgggcagcggggactcgagcaggcgcccctcactgatggctttagaacgtgggtgggggaaggtgtgtgaggacgggaagacgccgcactcacctgagttggcgtcctcagagtggccgctgccatcagactctgcgggtagagctgggccgggagcgacgggcgacattggtagggacccggggacagcggtccctatcccaggcctgacgtgggtcccccagggcggcgtcgccaaggcttagacgctttcgtgcaggagggacgacgactcccctcacgccttcgtggccccaactcggcgctctgctatctctgatccggtgaacacacctcagagaagctaaaatggccgccacgaagaggcccccccaaaagtcccgtcctttctttttgtgactctcaaggaaagtcggttttctgagctcttactggcttagtagcgtggcgttcaacgcagagcattctaggtaatgtagttttcatagatcccgaggtgggtgccggggaccctttgcaccaacctcttggagtaaaagcgaagctccagggcgctgggcgatgagaaatggct

SEQ ID NO: 117054 - DNA, 61 bp, Homo sapiens; identical to SEQ ID NO: 84508
  chr19:58233532-58233593
  Hypo

SEQ ID NO: 117055 - DNA, 41 bp, Homo sapiens; identical to SEQ ID NO: 84509
  chr19:58237430-58237471
  Hypo

SEQ ID NO: 117056 - DNA, 867 bp, Homo sapiens
  chr19:58238326-58239193
  Hyper
cagtagcctccttaccggtctcctcgtatccatcctcgcagtccccaccccaaactaatgttctcccctgagcaaatttcgagacacttaaaatcccagctaagatcacgtccttctattcaaaaccctcagttaatctcaacgccctcagaatgaagcgacaacttctcagcctgccattccagtcacagttcctcaaactctgctctgtgttgatgagaaccctgtctcccaaatgtttgggggtcagcagcacccccgagcctttacctgcgccgtcccctccgcccgtaactctcccacacccacccacaccgagataggaccccgccccaagagtgcgtcgctgtcctgggacacaggggctgcaggcactttacgattcggagtcggagaaagggtgactgagggcccggaggacgcagcacccacccgcgcggagtccgttagctccgccataggaccgtgggcgcggacagctgccgggagcggcaggcgtctcgatcggggacgcaggcacttccgtccctgcagagcatcagacgcgtctcgggacactggggacaacatctcctccgcgctttcccaacacctccacctgcggcccacacaagcgttacagaaccccggccagggacagcctgacagaaacaaaatgtccgctacaaggaggagccggaagtcccgcccacgcaccccccgcaggcactgaaacacccctctcctgggccctcattgggtatgcaacgtataggtttgtgggtagagtgtggttcccactgagctatccttcaaggcaggggattctcggcctgggctcttgggaaaactcgaagtaggagggccaagttgtttgggaaaagtaac

SEQ ID NO: 117057 - DNA, 460 bp, Homo sapiens; identical to SEQ ID NO: 84517
  chr19:58280911-58281371
  Hyper

SEQ ID NO: 117058 - DNA, 404 bp, Homo sapiens; identical to SEQ ID NO: 84519
  chr19:58361192-58361596
  Hyper

SEQ ID NO: 117059 - DNA, 544 bp, Homo sapiens; identical to SEQ ID NO: 84520
  chr19:58400029-58400573
  Hyper

SEQ ID NO: 117060 - DNA, 102 bp, Homo sapiens; identical to SEQ ID NO: 84521
  chr19:58433214-58433316
  Hypo

SEQ ID NO: 117061 - DNA, 39 bp, Homo sapiens; identical to SEQ ID NO: 84522
  chr19:58438196-58438235
  Hypo

SEQ ID NO: 117062 - DNA, 99 bp, Homo sapiens; identical to SEQ ID NO: 84523
  chr19:58438295-58438394
  Hypo

SEQ ID NO: 117063 - DNA, 102 bp, Homo sapiens; identical to SEQ ID NO: 84524
  chr19:58445853-58445955
  Hypo

SEQ ID NO: 117064 - DNA, 550 bp, Homo sapiens
  chr19:58446296-58446846
  Hyper
caggttccatcctcccgggtctgtcctccaggccatagcccgcgccggtccctgtgcctgtcgctctccccaccgcatcccacaggtgtcagaaacaaggacctctcccgcgaacgcctcagtgtcccgacgccgggtccgggctgcagacctgtgaacagtcgccgctctctcgctgcttcaggattcgggttaggatgaggtgacctgagggcagggaaggcacaattacctgagccgggagcctcagcgcggccgccgccatcccgagtacgcggggaaagcactgccgggagcggcgggcgccgttacggggcctaagatctgcctctgtgcagcaagaaggactcttcaccttctgggttcagacaccgcggttcggacccatagctccagcgcctctcacctcacaaaccgcagaaacacacccaacattaaccaaaatggtcgctaccagagaacgctgagaatcccgccactacgttacgtgcgcacacagaaacgcctttattctgagcccttactggttctgttgcgctgtcattcaatg

SEQ ID NO: 117065 - DNA, 79 bp, Homo sapiens; identical to SEQ ID NO: 84527
  chr19:58447418-58447497
  Hypo

SEQ ID NO: 117066 - DNA, 45 bp, Homo sapiens; identical to SEQ ID NO: 84528
  chr19:58448051-58448096
  Hypo

SEQ ID NO: 117067 - DNA, 30 bp, Homo sapiens; identical to SEQ ID NO: 84529
  chr19:58455898-58455928
  Hypo

SEQ ID NO: 117068 - DNA, 190 bp, Homo sapiens; identical to SEQ ID NO: 46056
  chr19:58457382-58457572
  Hypo

SEQ ID NO: 117069 - DNA, 873 bp, Homo sapiens
  chr19:58458432-58459305
  Hyper
ccctccccttcctggcgtagatttcataaccctttacagccaagggaaacgtagaaagagccaggcctcagagaagagcatctatggcggtattagatgggctcaagccaccccgtagccccatgcctggccttggagccgggtgccctcgcaatggctgtgtcacctctgtgccccagggctcagtggcgcctctcatcaggggctccttgccagtcgcgccctcccttccctagcacaccaggtgttggaaacgggagcccctccggcgagcccccgtgtcctgtcctgggcagcagggccgcgagcaagcgccctcgggggtgctaggactagcgtggggagggcggggaaggcccagaggacgcggcacatacctgggccggggccgtcagctcggccgccgccatctgactctgtgagcggagcggggccagagaggatgtccttattccgggccgggcctgggtaccctgggcgccgccgagcctcagccacgcctctgtgcagcggggaagactcctctcgcgccttctcagtcagtcacggatgatgctgacccagcgctccggggctttctaccaagtaatcagtccagacaaatgccaaaacgaccgccacaaggaggacaacggaagtcccgccgcgaccgcgcgtgcgcttacggaaacaccacctttcggaggcctcattggctgaaggtcgccgtcgcccaacgcaggccattctgggtaatgttcccacaggcgcacggcgggagagtgagggtcgcctccacctccttccggaagtaaaggccaaacccctgtagggggcgctgggaaatggacactccaggttggggcggaggcgaggcttcgttctttcttaaag

SEQ ID NO: 117070 - DNA, 30 bp, Homo sapiens; identical to SEQ ID NO: 46057
  chr19:58512170-58512200
  Hypo

SEQ ID NO: 117071 - DNA, 1174 bp, Homo sapiens; identical to SEQ ID NO: 84534
  chr19:58513537-58514711
  Hyper

SEQ ID NO: 117072 - DNA, 75 bp, Homo sapiens; identical to SEQ ID NO: 46058
  chr19:58517427-58517502
  Hypo

SEQ ID NO: 117073 - DNA, 634 bp, Homo sapiens
  chr19:58520713-58521347
  Hyper
cacccatgctcctctcggcacctttcacccagcccaagcagcggcggcccagtggtggaaaaggtgccacggccaaacggattggagactcaccccgcattctaggccggagaagcgggcgggcttgggatgccggcaggaggcaatgactctccccaggcgctgcatcctggctccggggcacaagcgcctctccgccctgacgctgatgctcgtctggctgcccgttctttggcatcaaaataccagacgatggtggcgcaccctgtggcctgggctgcctcacctcattcggtcccgcctagaaagaccagaggaccagaaaaccagaagcctgtcagagcgactagaggctggctccagccaacagccgcgcgcctcagcgtccacgagggttacctgggtaacgcgccgcttgggctcggcgcccagccgatgacgtaacccgcgcttgcgtagtggcgccgccctgatgtgtagtctccaggccgccccgaacaccagcccagcgggtcctggacccctaggtcatgtggctacagtggaatccaggcttggccgaatccaggacgaccaggccagacccaccggcagtaccttgcccgcccgctttagtcacttgctctaggtggat

SEQ ID NO: 117074 - DNA, 102 bp, Homo sapiens; identical to SEQ ID NO: 84538
  chr19:58522940-58523042
  Hypo

SEQ ID NO: 117075 - DNA, 30 bp, Homo sapiens; identical to SEQ ID NO: 84539
  chr19:58524599-58524629
  Hypo

SEQ ID NO: 117076 - DNA, 412 bp, Homo sapiens; identical to SEQ ID NO: 84540
  chr19:58536147-58536559
  Hypo

SEQ ID NO: 117077 - DNA, 645 bp, Homo sapiens
  chr19:58545100-58545745
  Hyper
ggacactgtataaaacggttgcgtgtctggaatgccgtcgttttgccccgcggccccatcgtacatgcgcatccccgcagccgccaccgtctccactttccgcagcagcgtccctgacgctgcgcgacccgttgccaaggcgactggaaccgcggcccgaggtaactggagggcacggcgggggcggggcgctcatcccaggcggcttctgattggcctcggccgcctcgtgcgtcacagccccgcccctgcccgggagtcccgcagcggtgacttgtcaccgacgcccggcgtgatccagcggaccaatggcggccgcccgcggcgcgcagggtgcggggatggggtccgcccgcggcgttgggcgcgctcgccagcccaggggtcgccatgaccgagtggcccaggcccgagcgaagcccgcgcgcggtgagtccgccgcggcccatccgtccctccgcccgccagagcgtccatcgggacgcccacccgggagggtctcggcgccgcgtcggcgggagctggcccgggatcgcggtccaggggcgcgcgtcgggggaggcgggcccgggcccgggagggggcgggccgggccggggttccagagcccatcgggagtcctgaggtcgccgtaggggagggaag

SEQ ID NO: 117078 - DNA, 30 bp, Homo sapiens; identical to SEQ ID NO: 84544
  chr19:58551687-58551717
  Hypo

SEQ ID NO: 117079 - DNA, 45 bp, Homo sapiens; identical to SEQ ID NO: 84545
  chr19:58552006-58552051
  Hypo

SEQ ID NO: 117080 - DNA, 38 bp, Homo sapiens; identical to SEQ ID NO: 84546
  chr19:58559411-58559449
  Hypo

SEQ ID NO: 117081 - DNA, 65 bp, Homo sapiens; identical to SEQ ID NO: 84547
  chr19:58565543-58565608
  Hypo

SEQ ID NO: 117082 - DNA, 623 bp, Homo sapiens
  chr19:58570471-58571094
  Hyper
gatgcccaggcaccccgcgcgccctgtttcaccaggcccagtcactccagctccagcagcactgagagctcacgaacgccaagggcgagagcgaggtgggggagggcggccggaaatgcgcgcgcggctctctgggaaatggagttaggctcgcgccggcgcagtgtcggctgccggtgccgcggcctttgtctcgcagtcaggagggtgagctaggccggcgaggagggggaggggaggccaggccgggccgggccgggccgggtgcggggggtccggggatcttcctgaggccctggcggggcgagtttccagcagcgcgcgtctgtgtggagtccgttttgctgcccggggcctggggaaggccgtttcggggctggcgggggcaggctttgcggggcatccctagtctgagaggagggcggggcccaacgcccagctggacaggagctgctccgacggcccctgagggaacgcgcgccccgcccctggccccacctctgccccacaccgggcactgggccgccacctttgttgatggaagagagaaactgaggcatagtgcccagggccaggggaccgcaaccacccggcccttgtcactgtagcgttaaggctcagag

SEQ ID NO: 117083 - DNA, 18 bp, Homo sapiens
  chr19:58590342-58590360
  Hypo
gagcgagactctgtctaa

SEQ ID NO: 117084 - DNA, 169 bp, Homo sapiens; identical to SEQ ID NO: 84551
  chr19:58597308-58597477
  Hypo

SEQ ID NO: 117085 - DNA, 30 bp, Homo sapiens; identical to SEQ ID NO: 84552
  chr19:58598247-58598277
  Hypo

SEQ ID NO: 117086 - DNA, 30 bp, Homo sapiens; identical to SEQ ID NO: 84553
  chr19:58598654-58598684
  Hypo

SEQ ID NO: 117087 - DNA, 626 bp, Homo sapiens
  chr19:58609375-58610001
  Hyper
gggatgccagaccctcggcctcctggacgcacagcgggggctcgcaccccaaccccgggaacaccctggcccctttccctaacgctgcccactgaggcgtcctcaccgtctaccctgttggggtcgctctctgacccccgcgctgcatccccgggaccgacccacctgctgcgcagctaccccaggccggtcccagccgcccggagccccagtgcgcgatggcggccggcaaactgcgcctgcgcactgggcctcaccgcggactacgactcccacaatgccgcgaggctgtgccgcgcaccggggcgagcaagggagccgtgacaggtgacagtgcgcatggccaatcagacgcgagtgtggcctcccggcgtcccgcccactccggcgcctgcgtcattttgggcaccatggcaacgaagtaaacaagcgggtaaataatagacccctgacagccagagacccggagaaacaaagacggtgagaaacggagaaacaaagacaaaaagacgcgcagaccgggagggagagaagcatgaaggcccacagacgctcgggggcagaccaagacgccctggggtccccgaaacagagatgtacagagtcggacacggaaagggagagac

SEQ ID NO: 117088 - DNA, 20 bp, Homo sapiens
  chr19:58622562-58622582
  Hypo
gtaatcgctgctctgacctc

SEQ ID NO: 117089 - DNA, 76 bp, Homo sapiens; identical to SEQ ID NO: 84558
  chr19:58623655-58623731
  Hypo

SEQ ID NO: 117090 - DNA, 30 bp, Homo sapiens; identical to SEQ ID NO: 37846
  chr19:58629357-58629387
  Hyper

SEQ ID NO: 117091 - DNA, 297 bp, Homo sapiens
  chr19:58629637-58629934
  Hyper
actaggccttggctccgcgaccggtgggcgggaacggaggaaacagacccgagaggccgcgagaggacggaactcacttcccgccgccgtagcgtcctcgtcagctcgccctccgactctccgcatgggcgcgcagagttcccggatgcgatattccggtgacaccggacgctgggggcggggcctagtgcgacgagggcggggccggggccggcccggggcggggccgtggccgcagctgcctggcagccagaacctgggagcgctcgcagtgctgcctttcggggttctttgtcc

SEQ ID NO: 117092 - DNA, 731 bp, Homo sapiens; identical to SEQ ID NO: 84561
  chr19:58661613-58662344
  Hyper

SEQ ID NO: 117093 - DNA, 48 bp, Homo sapiens; identical to SEQ ID NO: 84562
  chr19:58665878-58665926
  Hyper

SEQ ID NO: 117094 - DNA, 592 bp, Homo sapiens
  chr19:58666141-58666733
  Hyper
gcagtccgcgagaggcgaggaggatccttggactgtgggcaggatcgcaggcagcggaggccctgcccggaaggcgggatctggggacgatccccattcctcccagccgcagacgcggagcccacaggagtccccgcagccctagcccgtgcacccacggcggagccgaggccgcgactccgggcctgttggctggaacccgcagccgtgtctcgggccgccccggtagcggccacccctgagagcactcggccccgttctatcccgcagtggtttggggagtgcaggtcatcactcccacccgccaaggcggacgccggaccctccattgcgcatgagcgcccactgcggcgccgttgctgcgcatgagtgtgcttccaccgcctacatctcccagaaaaccccgcggcgcggcgctccaccgcttccgccctcgggttgcgttagccgcgacgatggcgccccccagtggcagcagggaggctgtgggggtgctgggcgttgcggtgtgcaggttttctgggaggatacctggcgccgaccttgaagggaccccaacgtgagagggaaagacgcccgtgatgccaaggct

SEQ ID NO: 117095 - DNA, 738 bp, Homo sapiens; identical to SEQ ID NO: 84565
  chr19:58694552-58695290
  Hyper

SEQ ID NO: 117096 - DNA, 32 bp, Homo sapiens; identical to SEQ ID NO: 84566
  chr19:58711048-58711080
  Hypo

SEQ ID NO: 117097 - DNA, 30 bp, Homo sapiens; identical to SEQ ID NO: 84567
  chr19:58728930-58728960
  Hypo

SEQ ID NO: 117098 - DNA, 849 bp, Homo sapiens; identical to SEQ ID NO: 84568
  chr19:58739737-58740586
  Hyper

SEQ ID NO: 117099 - DNA, 41 bp, Homo sapiens; identical to SEQ ID NO: 84569
  chr19:58749920-58749961
  Hypo

SEQ ID NO: 117100 - DNA, 157 bp, Homo sapiens; identical to SEQ ID NO: 46060
  chr19:58836900-58837057
  Hypo

SEQ ID NO: 117101 - DNA, 17 bp, Homo sapiens
  chr19:58855466-58855483
  Hypo
gggcgcggtggctcacg

SEQ ID NO: 117102 - DNA, 120 bp, Homo sapiens; identical to SEQ ID NO: 84572
  chr19:58874833-58874953
  Hypo

SEQ ID NO: 117103 - DNA, 103 bp, Homo sapiens; identical to SEQ ID NO: 84573
  chr19:58891154-58891257
  Hypo

SEQ ID NO: 117104 - DNA, 623 bp, Homo sapiens
  chr19:58907596-58908219
  Hyper
cggcagcccaggctccggccctatcctgccccccgcctccccggtggagtgcctcatctgcgtgtcgtccttcgacggcgtgttcaagctgcccaagcgcctggactgcggccacgtcttctgtctcgagtgcctggcgcgcctatcgttggccacggcgggcggcggcaacgcggtggcctgtccggtgtgccgcgcgcccacgcgcctggccccccgccgcggactccccgcgttgcccacgcagtccggtctcctgccccgcgacgcgcgcgcaccgccctctcgccagggctccgtgcgcttcgaccggcgccgcggccttctctacctgcggccgccgccgcccccgcccgggccgcgcaaggcccgcgccccgccgcccccgccgcctctgcgcctgggccgcccgctgtcgcgccgcttgtcgctggccagcccggcctgggtcttcaacgctgccgtggcgctggcggtgctggtggccgcgggcctcgtggtctcgggcgtctacatcttcttcctcatcccgcacgccacctcctccggccccccgcggccccagctcgtggcgctcgctccagcgcctggcttctcttggtttccgccgaggcccccgccgg

SEQ ID NO: 117105 - DNA, 30 bp, Homo sapiens; identical to SEQ ID NO: 84575
  chr19:58912378-58912408
  Hyper

SEQ ID NO: 117106 - DNA, 19 bp, Homo sapiens
  chr19:58915315-58915334
  Hypo
actccgtctcaaaaaaaaa

SEQ ID NO: 117107 - DNA, 1070 bp, Homo sapiens
  chr19:58951068-58952138
  Hyper
caggatcctgagggccggaatcccagcgggtgagggcctggggcacactccacttacctgcgccgggcccatcagcaacgctggcaaccccattagaacctgtgggctgggcagggccataacaggaggcccagggctagccctgccgctgggccgaaccctcacacttccgctgggtgacggtcgcactcaggacctgtcttcccaaatgcaaaatgcgcgcaaggcctctgggcaccgcagggacgaaggctgggtatggagaccctggagacgcgtggcgctggctccactttcgggaacaccttggctcataaaagcagagtaattagccgggcactatggtgcgtgtgaaggcgcggtgacggtccctgcacccactcccgtgccctggtgtggctccagaggcctgctgtagcccaacccaccagcagcaaaatgaggaccgcaatggcggcgccggaagtcccgcctctcaatgacagctcggacttgccactggtccgagctttcattggctcaaggatccccgccgtctatgacgctatttccctatgcccgtcacgctactgctaggtcgttgccaaggtgattgaggaatggcgtttattgcgtcgctgctcaggcaacgcaaactacattatccagaaggaccctcgcggtgcctcagggctggccattggcagccgaggagacaggcacttccgggcggagtgtaagacgctggccaatcacagcctggcagcgggacttccgtcgtcgtcctcggaccatcactttggcatttctcgattttgtctgcttctgaagggaccgcgttgtcaggcgagggacggaatcttggaggctccctgggcccatggaaacaggagcgaggaaggcacgagagtcggggaagttccgccttcttgacatacaagcgcccccaccgcggcgaatatcgcccctgagcccagtgttcgccccccacaacaccgcaccccccttccccaccctgtgccttagataaagccggcccagtgggaccctcaggttgcaccgcgcggaggtgtccgcggctctcgggagtc

SEQ ID NO: 117108 - DNA, 104 bp, Homo sapiens; identical to SEQ ID NO: 84581
  chr19:58964180-58964284
  Hypo

SEQ ID NO: 117109 - DNA, 150 bp, Homo sapiens; identical to SEQ ID NO: 84584
  chr19:58986525-58986675
  Hypo

SEQ ID NO: 117110 - DNA, 30 bp, Homo sapiens; identical to SEQ ID NO: 84585
  chr19:58987127-58987157
  Hypo

SEQ ID NO: 117111 - DNA, 74 bp, Homo sapiens; identical to SEQ ID NO: 84586
  chr19:59010888-59010962
  Hyper

SEQ ID NO: 117112 - DNA, 30 bp, Homo sapiens; identical to SEQ ID NO: 84588
  chr19:59049735-59049765
  Hyper

SEQ ID NO: 117113 - DNA, 43 bp, Homo sapiens; identical to SEQ ID NO: 84590
  chr19:59074323-59074366
  Hyper

SEQ ID NO: 117114 - DNA, 97 bp, Homo sapiens; identical to SEQ ID NO: 85235
  chr2:142625-142722
  Hypo

SEQ ID NO: 117115 - DNA, 1395 bp, Homo sapiens; identical to SEQ ID NO: 86391
  chr2:287500-288895
  Hyper

SEQ ID NO: 117116 - DNA, 1189 bp, Homo sapiens; identical to SEQ ID NO: 86393
  chr2:289223-290412
  Hyper

SEQ ID NO: 117117 - DNA, 252 bp, Homo sapiens; identical to SEQ ID NO: 86429
  chr2:314488-314740
  Hypo

SEQ ID NO: 117118 - DNA, 30 bp, Homo sapiens; identical to SEQ ID NO: 86432
  chr2:314985-315015
  Hypo

SEQ ID NO: 117119 - DNA, 737 bp, Homo sapiens
  chr2:467966-468703
  Hyper
tgggcctgaaactcccgcgctgtgcattcagggccctcgtggctctcagaggcgcgtcccaggggcgcacactgcaccttgggctgggcagctccgccgggttgtggcgagcggatgagggaaggacgcagaaaccagggcggaggagccgcgaggggcaggacgaggctgcatgggccagcgagggggtcgacaccgagccagagtgagcgcggggcctggggcgcagagcccgcccagggagccgggagacgccgcgcaagctccccggacaaacgcaatgaccgaggacgcgcgggcgaggccgtccagggagccctggtccctcagctgcaccggactgagccgcgaccgctcagcacgcgctgcttataaatcaggggtgcgcttcccaagccccgggtgaggtcccctacgtcggcacagccttaggagctgcaaagcagcgcgcgcctccggggctcctgcgcgccccttgaaccccgcctcccgcatcctcctgcaacagcctggagctccctgtgcaggacgcagcggggggcggggggcggtcttaggaggctgcggggcgcactcccacctcctgcctccccgagacccccagcgccttctccagggtttagagcggaggtgaaggggcctcgtcctgcaccgccactgggcgcctgggctgttcatcatcggttaccgccgattcataggaactcctcaacacattggctcggaaatgtacagtc

SEQ ID NO: 117120 - DNA, 70 bp, Homo sapiens; identical to SEQ ID NO: 39383
  chr2:484928-484998
  Hypo

SEQ ID NO: 117121 - DNA, 190 bp, Homo sapiens; identical to SEQ ID NO: 86611
  chr2:496190-496380
  Hypo

SEQ ID NO: 117122 - DNA, 69 bp, Homo sapiens; identical to SEQ ID NO: 39385
  chr2:503076-503145
  Hypo

SEQ ID NO: 117123 - DNA, 161 bp, Homo sapiens; identical to SEQ ID NO: 86613
  chr2:503840-504001
  Hypo

SEQ ID NO: 117124 - DNA, 74 bp, Homo sapiens; identical to SEQ ID NO: 86621
  chr2:522014-522088
  Hypo

SEQ ID NO: 117125 - DNA, 44 bp, Homo sapiens; identical to SEQ ID NO: 86673
  chr2:602373-602417
  Hypo

SEQ ID NO: 117126 - DNA, 30 bp, Homo sapiens; identical to SEQ ID NO: 86674
  chr2:602842-602872
  Hypo

SEQ ID NO: 117127 - DNA, 72 bp, Homo sapiens; identical to SEQ ID NO: 86721
  chr2:647851-647923
  Hypo

SEQ ID NO: 117128 - DNA, 53 bp, Homo sapiens; identical to SEQ ID NO: 86727
  chr2:648647-648700
  Hypo

SEQ ID NO: 117129 - DNA, 61 bp, Homo sapiens; identical to SEQ ID NO: 14369
  chr2:720836-720897
  Hypo

SEQ ID NO: 117130 - DNA, 38 bp, Homo sapiens; identical to SEQ ID NO: 86848
  chr2:740885-740923
  Hyper

SEQ ID NO: 117131 - DNA, 30 bp, Homo sapiens; identical to SEQ ID NO: 86871
  chr2:747532-747562
  Hypo

SEQ ID NO: 117132 - DNA, 30 bp, Homo sapiens; identical to SEQ ID NO: 86915
  chr2:817019-817049
  Hypo

SEQ ID NO: 117133 - DNA, 30 bp, Homo sapiens; identical to SEQ ID NO: 86937
  chr2:859874-859904
  Hypo

SEQ ID NO: 117134 - DNA, 84 bp, Homo sapiens; identical to SEQ ID NO: 86956
  chr2:875937-876021
  Hypo

SEQ ID NO: 117135 - DNA, 179 bp, Homo sapiens; identical to SEQ ID NO: 86959
  chr2:881951-882130
  Hypo

SEQ ID NO: 117136 - DNA, 30 bp, Homo sapiens; identical to SEQ ID NO: 39390
  chr2:925888-925918
  Hypo

SEQ ID NO: 117137 - DNA, 1629 bp, Homo sapiens
  chr2:945552-947181
  Hyper
agccttgcctgcccccgccgcactggaatttatcctaaacttactttcatttacattaaaacaagacgatttgagtctaccaaacccaatactgcatctgtgaggctccttttggcacaaacctgaatgaacagcgggaaacgccgtctcccctggcgtctgagatctggggtcccctccccacctggtctcctcgctcccgccccagccccgtgcgccccaggagggcaccgccgagcgccgggtccccgcagggttcgggagactccgcggaccggaggagggataggacccccgagctttgggggcgggaagggagggtggaaggaggaggggagcggggttggggaaagttggagcttcggtatcttttctccgggccaggccgtcctcggggccctgcgctgcgtctccaagtgctgggaagactccgcggggaaaggtctgaggacgcggccggctggcacaggtgtggcggcttcagagggccggggagaacccatggcttcgaggctgtggactagaaatgtccctgattagaagctgagaacctttggccagggaggtggggcggcggggaggggtcgtcaagccggtccagagcgcgcccacctgcgccacaagggagaagaggtgccccccgcccccctccgcccaccgccgccacgatgcgccgcggacctcggcgacccagcccgggtagaagcgcgcgctcccctcctccagcctcgtgcgccggcccctgccccgccagccccgctatggtcccccatccacccccgcgggagcgcccctgtccccccatcctgcacttcccccagagtcgcgcgccagtttcccgccccgtggaagcgcccctctcccgacttcggctgatccccgctcgccgccctccccgcgggtgcgcgcccggcccctccctcgcccggggcgggtctgcgtgggcggtgctccgggtcggcgggcggagctccggttccccagccctgcgccccggtggagcccgagccggagccggcagaggggcgcgggcgcggacgcggcgcctggcggggccctgggaggctcggacggggtcctggcgttgagctcggccggcccggagcgcggacccagccgcaggggcggcgatgggcaccgagggacccccgcccccggccgcctcccgcggacgccagggctgcctgctggtacctgcgcgggtgagtgcggcccctcagcgccccttcacctccggccccccttccctctccttcgcgcccttctccccccgcccctcctccctccacgccccctcgctccccgcgaccccttccctgtctccggggacggctggccggagggtgggcgccggagccccgggacgcagtgggcacccgccccctggccgctctgctccctccagcccagtgtcttactggaaacttgcaggctttgctcctccagcgtcttctaaggtttggttttgaggcgcccgggcttccctttactgcgtgggaagtagtgctttccagaatttgggatttgagattggcccggcattgcttcccaggagcggctctttcgggcccaggcggtggctcggaccggagcgtcccccctgcagccttcgggcgcccaggccaggtc

SEQ ID NO: 117138 - DNA, 30 bp, Homo sapiens; identical to SEQ ID NO: 39391
  chr2:951526-951556
  Hypo

SEQ ID NO: 117139 - DNA, 127 bp, Homo sapiens; identical to SEQ ID NO: 87024
  chr2:961623-961750
  Hypo

SEQ ID NO: 117140 - DNA, 49 bp, Homo sapiens; identical to SEQ ID NO: 39392
  chr2:973406-973455
  Hypo

SEQ ID NO: 117141 - DNA, 30 bp, Homo sapiens; identical to SEQ ID NO: 87055
  chr2:980380-980410
  Hypo

SEQ ID NO: 117142 - DNA, 184 bp, Homo sapiens; identical to SEQ ID NO: 84808
  chr2:1019337-1019521
  Hypo

SEQ ID NO: 117143 - DNA, 173 bp, Homo sapiens; identical to SEQ ID NO: 84904
  chr2:1075449-1075622
  Hypo

SEQ ID NO: 117144 - DNA, 138 bp, Homo sapiens; identical to SEQ ID NO: 85036
  chr2:1204780-1204918
  Hypo

SEQ ID NO: 117145 - DNA, 96 bp, Homo sapiens; identical to SEQ ID NO: 85162
  chr2:1310590-1310686
  Hypo

SEQ ID NO: 117146 - DNA, 64 bp, Homo sapiens; identical to SEQ ID NO: 85228
  chr2:1379782-1379846
  Hypo

SEQ ID NO: 117147 - DNA, 62 bp, Homo sapiens; identical to SEQ ID NO: 39395
  chr2:1424987-1425049
  Hypo

SEQ ID NO: 117148 - DNA, 73 bp, Homo sapiens; identical to SEQ ID NO: 85314
  chr2:1588152-1588225
  Hypo

SEQ ID NO: 117149 - DNA, 222 bp, Homo sapiens; identical to SEQ ID NO: 85363
  chr2:1635805-1636027
  Hypo

SEQ ID NO: 117150 - DNA, 30 bp, Homo sapiens; identical to SEQ ID NO: 39397
  chr2:1637034-1637064
  Hypo

SEQ ID NO: 117151 - DNA, 79 bp, Homo sapiens; identical to SEQ ID NO: 85370
  chr2:1653102-1653181
  Hypo

SEQ ID NO: 117152 - DNA, 39 bp, Homo sapiens; identical to SEQ ID NO: 85386
  chr2:1689084-1689123
  Hypo

SEQ ID NO: 117153 - DNA, 30 bp, Homo sapiens; identical to SEQ ID NO: 85405
  chr2:1709360-1709390
  Hypo

SEQ ID NO: 117154 - DNA, 868 bp, Homo sapiens
  chr2:1746445-1747313
  Hyper
cagggaaacctcacccggctccattctaaaagtccactgctgttgagtgagatgcccccgagtcgtccggcctgggctgaccattcacgggctctggaaagaaagccttggtctctctgcggaggaggagaggaactcgggcccccgccccgccccagggcctccaggaagcagcctgcaaactcggcgacccctgggagccgtggtctgtcccagcactttgtttcggaggtaggcgcactggccgcccacttcctgaattgttcactcaatttttttacaacttttgcagactctttgctggtgccaaaaagtcctctggctcagctaagaaacgtgaaaactatttttggcatgcagaaaagtcgctacaggactaaattagagtcggcgcctgaaacgcagcccgcgttcacagatcccgaaaatgttgaatccgactcgcttcagaacacaggaggcctgcagcgaactctggcggcatctcggtacctggagccgcggggcggagggatggggattcctgctgtggagaccgtgacgcgggacggcccgcaggacagggtgtcaaccccaacgcaacgcatccggttaaacgtatagcgcaactgcgaacacgctcgcgtggattagaagcgaaagaagagaaatgcccgaggcagaaacccgctctgagtcccggctccatctagacccgggctgccccgagactaccgcgcggcccctctcgggaaccccggccgcccggctcgctccgggcgcaggaaaagcccctgagaagcgcggggcccccaggacaccccaggagaggacgctccgggcagatgcgggggcactgggagcgggggcgccgcggctgcgggaactg

SEQ ID NO: 117155 - DNA, 1182 bp, Homo sapiens
  chr2:1747625-1748807
  Hyper
gagcggaggaggggccgcgaaccagggggaagcgggaggccggcggagcatgagagggggcggcgggaggcgagcggggggagccccggaggctccaacaacttcccagtcctgcggggattccgagttccgaacaaaggcggctacgaaggccgcgcgcacagcgctctgttccgcccctcggcgtctcccgcagggcgaacaaaggcccagcgggtccccgcgcccaggtccccccacgtcccccttcggaggttcccttctgcgtcccaagtccccaggccccccgcgcgcccgatgccccctccaccctccgcgccccccacctccgatcacccctgcgctcccggatctccacgaagccccggaccccgcgcccccggcgtcccccgcggcactcacaggatggaggtctgcggcgccacggcgggcacggcctccagcagcagatgcatgcagcgcacggtggtgcggaagcacaggcagcggctcggacaccctgcgcccggcttctgggccaccacggccagcgtcccccaggcgcagaacagcacgagcgccaacaggcagcggcgcccggggcccctggagcgcttggccatggccgacggcgcggacggacgctcggacgcacggagccaccacggccggctcccgactgcgcccgcccggccgcggcccacgtcccagctgtgcgcggggggcggggggcgccagctgtgcacatgcgcgaggctcctcccggcccctctgaatccccgagggcggggcggggcgagaacccggggccccagcgtccggcctgagcgccctcatcccggtggggcggcccgcatggccaaggcgagcgctcgggggcgcggaggagagcattggcacccctgattctgcgctcgagactcggggctcgggaccctggggcctacgcgaagcttctccacttctcttacccgtggtttctgcctgcgctcactacgggttttttagttggcgccttaatgtttgtaacacttttagagcgcttgctctgatccgggcacgattccaggcgcgcaggcgcgctcctctctttctccttctccctacccgcaaccacgtaggaaattatttaacgttccaaaaaagcccctcattccttttgaggaaactgaggcccaagccccaaagcgcacagcaagggag

SEQ ID NO: 117156 - DNA, 153 bp, Homo sapiens; identical to SEQ ID NO: 85521
  chr2:1758012-1758165
  Hypo

SEQ ID NO: 117157 - DNA, 171 bp, Homo sapiens; identical to SEQ ID NO: 85633
  chr2:1825400-1825571
  Hypo

SEQ ID NO: 117158 - DNA, 96 bp, Homo sapiens; identical to SEQ ID NO: 85656
  chr2:1858658-1858754
  Hyper

SEQ ID NO: 117159 - DNA, 132 bp, Homo sapiens; identical to SEQ ID NO: 85658
  chr2:1880288-1880420
  Hypo

SEQ ID NO: 117160 - DNA, 30 bp, Homo sapiens; identical to SEQ ID NO: 85663
  chr2:1891322-1891352
  Hypo

SEQ ID NO: 117161 - DNA, 41 bp, Homo sapiens; identical to SEQ ID NO: 39399
  chr2:1893020-1893061
  Hypo

SEQ ID NO: 117162 - DNA, 42 bp, Homo sapiens; identical to SEQ ID NO: 85682
  chr2:1941410-1941452
  Hypo

SEQ ID NO: 117163 - DNA, 39 bp, Homo sapiens; identical to SEQ ID NO: 85683
  chr2:1946870-1946909
  Hypo

SEQ ID NO: 117164 - DNA, 30 bp, Homo sapiens; identical to SEQ ID NO: 39400
  chr2:1950712-1950742
  Hypo

SEQ ID NO: 117165 - DNA, 156 bp, Homo sapiens; identical to SEQ ID NO: 39401
  chr2:1972852-1973008
  Hypo

SEQ ID NO: 117166 - DNA, 21 bp, Homo sapiens
  chr2:2007674-2007695
  Hypo
ttgattcatgcctttcgtgca

SEQ ID NO: 117167 - DNA, 30 bp, Homo sapiens; identical to SEQ ID NO: 39402
  chr2:2030884-2030914
  Hypo

SEQ ID NO: 117168 - DNA, 159 bp, Homo sapiens; identical to SEQ ID NO: 85803
  chr2:2125816-2125975
  Hypo

SEQ ID NO: 117169 - DNA, 30 bp, Homo sapiens; identical to SEQ ID NO: 85814
  chr2:2163389-2163419
  Hypo

SEQ ID NO: 117170 - DNA, 30 bp, Homo sapiens; identical to SEQ ID NO: 85815
  chr2:2166008-2166038
  Hypo

SEQ ID NO: 117171 - DNA, 149 bp, Homo sapiens; identical to SEQ ID NO: 85833
  chr2:2190096-2190245
  Hypo

SEQ ID NO: 117172 - DNA, 109 bp, Homo sapiens; identical to SEQ ID NO: 86174
  chr2:2402544-2402653
  Hypo

SEQ ID NO: 117173 - DNA, 189 bp, Homo sapiens; identical to SEQ ID NO: 14371
  chr2:2522670-2522859
  Hypo

SEQ ID NO: 117174 - DNA, 50 bp, Homo sapiens; identical to SEQ ID NO: 86327
  chr2:2569541-2569591
  Hypo

SEQ ID NO: 117175 - DNA, 87 bp, Homo sapiens; identical to SEQ ID NO: 86328
  chr2:2575682-2575769
  Hypo

SEQ ID NO: 117176 - DNA, 20 bp, Homo sapiens
  chr2:2576136-2576156
  Hypo
cacacacgccacacacgcca

SEQ ID NO: 117177 - DNA, 38 bp, Homo sapiens; identical to SEQ ID NO: 86332
  chr2:2584798-2584836
  Hypo

SEQ ID NO: 117178 - DNA, 30 bp, Homo sapiens; identical to SEQ ID NO: 86341
  chr2:2648264-2648294
  Hypo

SEQ ID NO: 117179 - DNA, 86 bp, Homo sapiens; identical to SEQ ID NO: 86345
  chr2:2665523-2665609
  Hypo

SEQ ID NO: 117180 - DNA, 125 bp, Homo sapiens; identical to SEQ ID NO: 86346
  chr2:2669364-2669489
  Hypo

SEQ ID NO: 117181 - DNA, 30 bp, Homo sapiens; identical to SEQ ID NO: 86348
  chr2:2673084-2673114
  Hypo

SEQ ID NO: 117182 - DNA, 493 bp, Homo sapiens; identical to SEQ ID NO: 86360
  chr2:2725048-2725541
  Hypo

SEQ ID NO: 117183 - DNA, 92 bp, Homo sapiens; identical to SEQ ID NO: 39409
  chr2:2730695-2730787
  Hypo

SEQ ID NO: 117184 - DNA, 262 bp, Homo sapiens; identical to SEQ ID NO: 86371
  chr2:2752881-2753143
  Hypo

SEQ ID NO: 117185 - DNA, 192 bp, Homo sapiens; identical to SEQ ID NO: 86381
  chr2:2799315-2799507
  Hypo

SEQ ID NO: 117186 - DNA, 30 bp, Homo sapiens; identical to SEQ ID NO: 86382
  chr2:2829715-2829745
  Hypo

SEQ ID NO: 117187 - DNA, 30 bp, Homo sapiens; identical to SEQ ID NO: 86383
  chr2:2844571-2844601
  Hypo

SEQ ID NO: 117188 - DNA, 70 bp, Homo sapiens; identical to SEQ ID NO: 86384
  chr2:2844886-2844956
  Hypo

SEQ ID NO: 117189 - DNA, 122 bp, Homo sapiens; identical to SEQ ID NO: 86386
  chr2:2854341-2854463
  Hypo

SEQ ID NO: 117190 - DNA, 30 bp, Homo sapiens; identical to SEQ ID NO: 86387
  chr2:2854703-2854733
  Hypo

SEQ ID NO: 117191 - DNA, 30 bp, Homo sapiens; identical to SEQ ID NO: 86388
  chr2:2863300-2863330
  Hypo

SEQ ID NO: 117192 - DNA, 131 bp, Homo sapiens; identical to SEQ ID NO: 86392
  chr2:2875928-2876059
  Hypo

SEQ ID NO: 117193 - DNA, 30 bp, Homo sapiens; identical to SEQ ID NO: 86396
  chr2:2913672-2913702
  Hypo

SEQ ID NO: 117194 - DNA, 30 bp, Homo sapiens; identical to SEQ ID NO: 39414
  chr2:2939589-2939619
  Hypo

SEQ ID NO: 117195 - DNA, 97 bp, Homo sapiens; identical to SEQ ID NO: 86401
  chr2:2941871-2941968
  Hypo

SEQ ID NO: 117196 - DNA, 105 bp, Homo sapiens; identical to SEQ ID NO: 39416
  chr2:3050299-3050404
  Hypo

SEQ ID NO: 117197 - DNA, 68 bp, Homo sapiens; identical to SEQ ID NO: 86433
  chr2:3175737-3175805
  Hypo

SEQ ID NO: 117198 - DNA, 30 bp, Homo sapiens; identical to SEQ ID NO: 39417
  chr2:3176032-3176062
  Hypo

SEQ ID NO: 117199 - DNA, 30 bp, Homo sapiens; identical to SEQ ID NO: 39418
  chr2:3285842-3285872
  Hypo

SEQ ID NO: 117200 - DNA, 30 bp, Homo sapiens; identical to SEQ ID NO: 86446
  chr2:3286245-3286275
  Hypo

SEQ ID NO: 117201 - DNA, 30 bp, Homo sapiens; identical to SEQ ID NO: 86447
  chr2:3290098-3290128
  Hypo

SEQ ID NO: 117202 - DNA, 165 bp, Homo sapiens; identical to SEQ ID NO: 86448
  chr2:3290515-3290680
  Hypo

SEQ ID NO: 117203 - DNA, 177 bp, Homo sapiens
  chr2:3292754-3292931
  Hypo
cacggccgtatctcccgcaattaaaatgcaggctttcaaatccatgacgctcacgcactgctcagctttctggagttttaattgcccatttgctttcttcctaggcaacagaactgctctattaatatctccccaccggtttcaggggagaggggagacaagcgaggatttgtttct

SEQ ID NO: 117204 - DNA, 30 bp, Homo sapiens; identical to SEQ ID NO: 86449
  chr2:3307369-3307399
  Hyper

SEQ ID NO: 117205 - DNA, 30 bp, Homo sapiens; identical to SEQ ID NO: 14373
  chr2:3331786-3331816
  Hypo

SEQ ID NO: 117206 - DNA, 45 bp, Homo sapiens; identical to SEQ ID NO: 86455
  chr2:3347109-3347154
  Hypo

SEQ ID NO: 117207 - DNA, 33 bp, Homo sapiens; identical to SEQ ID NO: 39420
  chr2:3352677-3352710
  Hypo

SEQ ID NO: 117208 - DNA, 42 bp, Homo sapiens; identical to SEQ ID NO: 86465
  chr2:3438687-3438729
  Hypo

SEQ ID NO: 117209 - DNA, 512 bp, Homo sapiens
  chr2:3750927-3751439
  Hyper
cgcccctcacctgcccgggctccccgttgccccctcacctgtctccgccctgtgccgcgcctcacctgcttgggctccccattacccaatcacctgtccctgccccgtgccgcctgctcacctgcccgggttccccgtcgccccgtctcctgccccggccccgagcccctcgccctggcggccaggcggtcacaatcgcccagggtcgcgtcaacacgcagcctccgcccgcctggcagccccgtcccgtccccgtccagcccccgtcccgtccccgtcccgtccccgtcctgcgccagcggctggagcggacctcccgtcggcggtgcccgggcctgggcgcggctctgcaggcgtcgctgcccgcgctgccgcagcctctcggccccggcgagcgaggagcggggcgcggctatgggaacccgcgggccctccgcgccggtggacaccacgcccgccaagaccatcgtggtgtaccgcaacggggacccgttctacgtgggcaagaagtt

SEQ ID NO: 117210 - DNA, 205 bp, Homo sapiens; identical to SEQ ID NO: 86481
  chr2:3833780-3833985
  Hypo

SEQ ID NO: 117211 - DNA, 129 bp, Homo sapiens; identical to SEQ ID NO: 39422
  chr2:3990793-3990922
  Hypo

SEQ ID NO: 117212 - DNA, 49 bp, Homo sapiens; identical to SEQ ID NO: 86500
  chr2:4130725-4130774
  Hypo

SEQ ID NO: 117213 - DNA, 50 bp, Homo sapiens; identical to SEQ ID NO: 86628
  chr2:5506198-5506248
  Hyper

SEQ ID NO: 117214 - DNA, 30 bp, Homo sapiens; identical to SEQ ID NO: 86639
  chr2:5623242-5623272
  Hyper

SEQ ID NO: 117215 - DNA, 57 bp, Homo sapiens; identical to SEQ ID NO: 14375
  chr2:5704308-5704365
  Hypo

SEQ ID NO: 117216 - DNA, 253 bp, Homo sapiens; identical to SEQ ID NO: 86645
  chr2:5813654-5813907
  Hyper

SEQ ID NO: 117217 - DNA, 1438 bp, Homo sapiens
  chr2:5830956-5832394
  Hyper
gaaaggaagcagattcggataattttcccagtcctacacggctgatttctctggtgaagggatccgggcagtgtcttaggaactgctcaaagttcccagatacccagtgctggggggtgtggagaaggcgagggtggcgacagaccatacctatgaagcggtgattttctttaattgcccccagaatatccgtagaggtagtagggactcaataaagaaacacaaaggagacgaacacggcacgatcgccggggtccgcggctgctctgcgaggcccagcgcgccccaggtcgcggctccccggccgccagcgcacctttccatctccagggaaaatatttagacgggaaactcgagtgcaccttattttctctttggtttatgagtgacccagaaggcttctagctcacaatcgcacgatttcaggacgaggctgccggagaagcgctggcgaccgaggatgggggaaggacaaagaggaagaggaggcctgggaaggagaaaggagcggcggaggggcggggagaggacggggcggggagaggaggggcggggagcagagggagaagggaaggagggcgccgggcccctcgcagggacgccgggcggggcgcgggcttgctggagcctgcgggacccagagcccgctccggagccagccctgggagtggccagcttgaacccgagggccccgcagaccgttactccggcccccgcccggggcggggcgcgcgggggcgcggcgcagcccaacccgcacagccgcgtccccaaacaccaccgaggagggaaaacagacggagaaaaaggacaaaacagaaaaatgcaaaacgggggagggagctcaccgcctctcgagctttaaattgatttctttgccttacaaaaagggagaaagggaaaaggagagcagagcccacgtgccgggaaggttgctgtcttcaagcgccaccttccgtcggccagggccgccgcggggctaccgggcgggctcggggcggcgacccgggggagcggccgagccccgcgaggggctcgccggggagcagctgcgcccaccccggggcaggccgggcgcggctgaccgcgagccgggcggaggccgccgtctcaggctgggcgcgtgcccgagtgtgtgcacccggggagtgagcgcgcgccgtccgctgtcgccgtcgggcctcccggggactgggcacaaaggcgcgcggggcctctcccgggacccggtcctcggttagcgccggcgcccgaaccatcccggttcgccccgggccgcccgctccccgtggtgccgcgcgccgcttccgagcatcccgggaacaggcgcatctgtgcacacacgcggattttttaaaaataacatatttctagacatgcctcctctccccccacccccatctttgcaaagcagcccggagggcggggtggaggggcg

SEQ ID NO: 117218 - DNA, 1418 bp, Homo sapiens
  chr2:5832715-5834133
  Hyper
ggggagggggggagccgcgaaagcggggtgccgaggactttgcaacttgcccaggaaggtggaggggtgggagggggagggggacctccgcacgagacccagcggcccgggttggagcgtccagccctgcagcggatcatggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcgcgggcgacgactacgtgctgggcagcctgcgcgtgagcggctcgggcggcggcggcgcgggcaagacggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagccgtcgcagctgctgagacgctacaacgtcgccaaagtgcccgccagccctacgctgagcagctcggcggagtcccccgagggagcgagcctctacgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcggg

SEQ ID NO: 117219 - DNA, 1444 bp, Homo sapiens
  chr2:5836053-5837497
  Hyper
ccccacccatcctggcgggcgggctgcgcggaggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcggggcacttctatccccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcgggagtcgggggaagacgcggcaggccggccgagggcaccccgaggaacatggcatggcctctgtgcgatccgagtcgcggtctccggggtgcctgggagggccgaaccactggtgagggcgtggggagcagggggtggcagagggcacccgggcggtagtccgggacgcgcaaggcagagccctgacgctccgggtccccgtgcctggctcttcttgcctcgccaccgcgtgctcctgggcgcgccccgccgcgggcccttgaggcgcgcggagacaccagcgctggcttcccgggcccgcgggccggggagggaagcctcggggctgcggggtgagaggaagaaagcaaacccggggagcaggcggctgccgcacccgcgcaccccgggccctcaccacgccctccccgcgcgccggctcaggggctgccccggaatcagctccccggggccgccgcaacgaaggtggatccgcatcttgattgttctccgggagcctcctgggggctccggcggcggcgcgggcgcgacccatcccgctggcgctccccgctcgctgaaccccgtttgcctgtccacaccccctcgctccccaccatttttcctgaccggcctgtgtccccgagccctcgcggcaggcccgagcaggcgatcgcggccgggcacgcgcgccccgggctcccgccccccttccgagcatccgccgcctcttttctgctgggtctgggaggagggaggctgggaggccgctcggggcccagcgtgccagccccggagttcagcctcccgagctgcggcgcccgcagcggaggaggttttcagtggctgattgaaactcactgcaaaatcaccacgactctttcacctactgagatgattgaccgaggtttggccttccatttttactgagatttggcgagaccgaatggaagcgtccgcacagtaactgca

SEQ ID NO: 117220 - DNA, 169 bp, Homo sapiens; identical to SEQ ID NO: 86664
  chr2:5866042-5866211
  Hyper

SEQ ID NO: 117221 - DNA, 201 bp, Homo sapiens; identical to SEQ ID NO: 86665
  chr2:5886248-5886449
  Hypo

SEQ ID NO: 117222 - DNA, 462 bp, Homo sapiens; identical to SEQ ID NO: 86690
  chr2:6121692-6122154
  Hyper

SEQ ID NO: 117223 - DNA, 138 bp, Homo sapiens; identical to SEQ ID NO: 86717
  chr2:6402946-6403084
  Hypo

SEQ ID NO: 117224 - DNA, 30 bp, Homo sapiens; identical to SEQ ID NO: 86731
  chr2:6635445-6635475
  Hypo

SEQ ID NO: 117225 - DNA, 30 bp, Homo sapiens; identical to SEQ ID NO: 39426
  chr2:6809103-6809133
  Hypo

SEQ ID NO: 117226 - DNA, 30 bp, Homo sapiens; identical to SEQ ID NO: 86755
  chr2:6859708-6859738
  Hypo

SEQ ID NO: 117227 - DNA, 35 bp, Homo sapiens; identical to SEQ ID NO: 86766
  chr2:6936496-6936531
  Hypo

SEQ ID NO: 117228 - DNA, 86 bp, Homo sapiens; identical to SEQ ID NO: 86770
  chr2:6989494-6989580
  Hypo

SEQ ID NO: 117229 - DNA, 36 bp, Homo sapiens; identical to SEQ ID NO: 86773
  chr2:7005433-7005469
  Hyper

SEQ ID NO: 117230 - DNA, 152 bp, Homo sapiens; identical to SEQ ID NO: 86777
  chr2:7024377-7024529
  Hypo

SEQ ID NO: 117231 - DNA, 184 bp, Homo sapiens; identical to SEQ ID NO: 86780
  chr2:7035292-7035476
  Hypo

SEQ ID NO: 117232 - DNA, 64 bp, Homo sapiens; identical to SEQ ID NO: 86781
  chr2:7036178-7036242
  Hypo

SEQ ID NO: 117233 - DNA, 187 bp, Homo sapiens; identical to SEQ ID NO: 86789
  chr2:7057229-7057416
  Hyper

SEQ ID NO: 117234 - DNA, 325 bp, Homo sapiens; identical to SEQ ID NO: 86790
  chr2:7058053-7058378
  Hyper

SEQ ID NO: 117235 - DNA, 152 bp, Homo sapiens; identical to SEQ ID NO: 86800
  chr2:7164448-7164600
  Hypo

SEQ ID NO: 117236 - DNA, 387 bp, Homo sapiens; identical to SEQ ID NO: 39430
  chr2:7172412-7172799
  Hypo

SEQ ID NO: 117237 - DNA, 35 bp, Homo sapiens; identical to SEQ ID NO: 86805
  chr2:7185292-7185327
  Hypo

SEQ ID NO: 117238 - DNA, 42 bp, Homo sapiens; identical to SEQ ID NO: 86806
  chr2:7190110-7190152
  Hypo

SEQ ID NO: 117239 - DNA, 16 bp, Homo sapiens
  chr2:7237247-7237263
  Hypo
ccgcccctcatggtgg

SEQ ID NO: 117240 - DNA, 127 bp, Homo sapiens; identical to SEQ ID NO: 86878
  chr2:7488706-7488833
  Hypo

SEQ ID NO: 117241 - DNA, 636 bp, Homo sapiens
  chr2:7571090-7571726
  Hyper
tgggctgcaggcctgcgagtggcaggcgcagcccggctgcaggagcgcggctggggctggccgctctcgctgccctctctccggaactgtttttttctgtcctggtctctgaaagccttattgattgctcaaagtgaacttctcagcccacggtttcctcacccccggggcagcttgcatttcctctgccgcggcctctgtcgcctcccctcccgcgcgcctcggccttttacatttcaaatgctcgacagctgggccaacttctgcttccgcccaaagaagggctctttgccgctcacaatggccggccagtggcgcgggggctcttttctctccagctgtgagagaggctttttcaaaggccggggggaagctgccgtccagctgcgcgcctggccgcgggggccctgcatgctaatcagcggcgcgcagagccgggctccgtggggccgcgcagatgcgccctctccgcccgcagagccttccgggcaggtgaggccaggccggccgggcgtcaccgcaggtgtgcactccgcgcgcgcactcagctcgctttggtgtttctccaggccctcagggcccaccactcctagtcccagcccacaggtctgcccgagtctccgcccaggaatgtgg

SEQ ID NO: 117242 - DNA, 40 bp, Homo sapiens; identical to SEQ ID NO: 86895
  chr2:7605196-7605236
  Hypo

SEQ ID NO: 117243 - DNA, 54 bp, Homo sapiens; identical to SEQ ID NO: 86897
  chr2:7739638-7739692
  Hypo

SEQ ID NO: 117244 - DNA, 213 bp, Homo sapiens; identical to SEQ ID NO: 86920
  chr2:8499980-8500193
  Hypo

SEQ ID NO: 117245 - DNA, 142 bp, Homo sapiens; identical to SEQ ID NO: 86944
  chr2:8658308-8658450
  Hypo

SEQ ID NO: 117246 - DNA, 37 bp, Homo sapiens; identical to SEQ ID NO: 86954
  chr2:8731409-8731446
  Hypo

SEQ ID NO: 117247 - DNA, 155 bp, Homo sapiens; identical to SEQ ID NO: 86955
  chr2:8751867-8752022
  Hypo

SEQ ID NO: 117248 - DNA, 118 bp, Homo sapiens; identical to SEQ ID NO: 86957
  chr2:8768562-8768680
  Hypo

SEQ ID NO: 117249 - DNA, 171 bp, Homo sapiens; identical to SEQ ID NO: 14378
  chr2:8833973-8834144
  Hypo

SEQ ID NO: 117250 - DNA, 174 bp, Homo sapiens; identical to SEQ ID NO: 86962
  chr2:8834722-8834896
  Hypo

SEQ ID NO: 117251 - DNA, 28 bp, Homo sapiens
  chr2:8835589-8835617
  Hypo
gaccccctgcgcccggcctgaccacaca

SEQ ID NO: 117252 - DNA, 30 bp, Homo sapiens
  chr2:8849857-8849887
  Hypo
ctgctgagccagtagcgttgaaccctctca

SEQ ID NO: 117253 - DNA, 30 bp, Homo sapiens; identical to SEQ ID NO: 39438
  chr2:8860441-8860471
  Hypo

SEQ ID NO: 117254 - DNA, 125 bp, Homo sapiens; identical to SEQ ID NO: 86971
  chr2:8870339-8870464
  Hypo

SEQ ID NO: 117255 - DNA, 260 bp, Homo sapiens; identical to SEQ ID NO: 86985
  chr2:8978038-8978298
  Hypo

SEQ ID NO: 117256 - DNA, 321 bp, Homo sapiens; identical to SEQ ID NO: 86990
  chr2:9134235-9134556
  Hypo

SEQ ID NO: 117257 - DNA, 220 bp, Homo sapiens; identical to SEQ ID NO: 86991
  chr2:9143144-9143364
  Hyper

SEQ ID NO: 117258 - DNA, 84 bp, Homo sapiens; identical to SEQ ID NO: 86995
  chr2:9242700-9242784
  Hypo

SEQ ID NO: 117259 - DNA, 30 bp, Homo sapiens; identical to SEQ ID NO: 86996
  chr2:9244301-9244331
  Hypo

SEQ ID NO: 117260 - DNA, 117 bp, Homo sapiens; identical to SEQ ID NO: 86998
  chr2:9347560-9347677
  Hyper

SEQ ID NO: 117261 - DNA, 30 bp, Homo sapiens; identical to SEQ ID NO: 86999
  chr2:9347993-9348023
  Hyper

SEQ ID NO: 117262 - DNA, 180 bp, Homo sapiens; identical to SEQ ID NO: 14383
  chr2:9352635-9352815
  Hypo

SEQ ID NO: 117263 - DNA, 18 bp, Homo sapiens
  chr2:9580845-9580863
  Hypo
tagtagtaggaggtacga

SEQ ID NO: 117264 - DNA, 30 bp, Homo sapiens; identical to SEQ ID NO: 87053
  chr2:9784906-9784936
  Hypo

SEQ ID NO: 117265 - DNA, 30 bp, Homo sapiens; identical to SEQ ID NO: 87056
  chr2:9809292-9809322
  Hypo

SEQ ID NO: 117266 - DNA, 30 bp, Homo sapiens; identical to SEQ ID NO: 87072
  chr2:9908748-9908778
  Hypo

SEQ ID NO: 117267 - DNA, 30 bp, Homo sapiens; identical to SEQ ID NO: 87073
  chr2:9921447-9921477
  Hypo

SEQ ID NO: 117268 - DNA, 142 bp, Homo sapiens; identical to SEQ ID NO: 87074
  chr2:9921692-9921834
  Hypo

SEQ ID NO: 117269 - DNA, 30 bp, Homo sapiens; identical to SEQ ID NO: 87077
  chr2:9949207-9949237
  Hypo

SEQ ID NO: 117270 - DNA, 30 bp, Homo sapiens; identical to SEQ ID NO: 87078
  chr2:9949649-9949679
  Hypo

SEQ ID NO: 117271 - DNA, 590 bp, Homo sapiens; identical to SEQ ID NO: 87082
  chr2:9960219-9960809
  Hypo

SEQ ID NO: 117272 - DNA, 24 bp, Homo sapiens
  chr2:10115715-10115739
  Hypo
taaacacaggccgggcgcggtggc

SEQ ID NO: 117273 - DNA, 120 bp, Homo sapiens; identical to SEQ ID NO: 84795
  chr2:10151722-10151842
  Hypo

SEQ ID NO: 117274 - DNA, 120 bp, Homo sapiens; identical to SEQ ID NO: 84796
  chr2:10151902-10152022
  Hypo

SEQ ID NO: 117275 - DNA, 120 bp, Homo sapiens; identical to SEQ ID NO: 84798
  chr2:10153048-10153168
  Hypo

SEQ ID NO: 117276 - DNA, 240 bp, Homo sapiens; identical to SEQ ID NO: 84799
  chr2:10153228-10153468
  Hypo

SEQ ID NO: 117277 - DNA, 300 bp, Homo sapiens; identical to SEQ ID NO: 84800
  chr2:10153888-10154188
  Hypo

SEQ ID NO: 117278 - DNA, 120 bp, Homo sapiens; identical to SEQ ID NO: 84801
  chr2:10154908-10155028
  Hypo

SEQ ID NO: 117279 - DNA, 120 bp, Homo sapiens; identical to SEQ ID NO: 84802
  chr2:10155268-10155388
  Hypo

SEQ ID NO: 117280 - DNA, 316 bp, Homo sapiens; identical to SEQ ID NO: 84803
  chr2:10156333-10156649
  Hypo

SEQ ID NO: 117281 - DNA, 522 bp, Homo sapiens
  chr2:10182780-10183302
  Hyper
aaccacaccaagagacgcgagcaaccgaaatatagggagaaaaaaaaaggtgccctggacagcgggctagatgtctcctgcaggctcgaggacttcccggagggggcggcgttttctcggggcctgggaagaatgggcgggtttcagcgggcgccttctgggtgactgcccgtttcggcttcccctgaccccgtaacagagcggaagaggcccagagacgccagaggaggggcgtcagcgggacactcaggccaataagctctgactcccgctgtctgcaaaaatgaccggatgcaggaatgtcacctagaaccggccagctttccgacctctccggtcaaggacgcattcctaagagacgaagggagaatgacagaagttaaaaacaaccaaacaaaagccaggttgaggcctctaggtgggtctccgctaccgatggattcagccggtggggctgcaggaggttcctataagcgtggtcccctctccccgcaccgagtccggccccggccctgggatttc

SEQ ID NO: 117282 - DNA, 30 bp, Homo sapiens; identical to SEQ ID NO: 84814
  chr2:10219664-10219694
  Hyper

SEQ ID NO: 117283 - DNA, 247 bp, Homo sapiens
  chr2:10220760-10221007
  Hyper
accctgcggggggcccggctgagtttgttcatttatggaaacgctccccagacgacgctcgccgggcccgtgggaggccgcgggagcttggggggacttcccaaagcctgagccccctagcgatgcgcggggtgggcgggggaaagaccctgagggctgcgcgcgctgcgttcgcgaggtccggccgtcagtgcgccccgacctttcagtgtccgccaggcctgagacgccccgggagggaaggggc

SEQ ID NO: 117284 - DNA, 30 bp, Homo sapiens; identical to SEQ ID NO: 39451
  chr2:10238076-10238106
  Hypo

SEQ ID NO: 117285 - DNA, 29 bp, Homo sapiens
  chr2:10257577-10257606
  Hypo
gctgggattacaggcgtgagccactgcgc

SEQ ID NO: 117286 - DNA, 30 bp, Homo sapiens; identical to SEQ ID NO: 39452
  chr2:10278078-10278108
  Hypo

SEQ ID NO: 117287 - DNA, 68 bp, Homo sapiens; identical to SEQ ID NO: 84821
  chr2:10281126-10281194
  Hypo

SEQ ID NO: 117288 - DNA, 30 bp, Homo sapiens; identical to SEQ ID NO: 84822
  chr2:10303018-10303048
  Hypo

SEQ ID NO: 117289 - DNA, 70 bp, Homo sapiens; identical to SEQ ID NO: 84823
  chr2:10306845-10306915
  Hypo

SEQ ID NO: 117290 - DNA, 49 bp, Homo sapiens; identical to SEQ ID NO: 84825
  chr2:10337316-10337365
  Hypo

SEQ ID NO: 117291 - DNA, 217 bp, Homo sapiens; identical to SEQ ID NO: 84826
  chr2:10344641-10344858
  Hypo

SEQ ID NO: 117292 - DNA, 22 bp, Homo sapiens
  chr2:10368174-10368196
  Hypo
ccgtgcccggccagagctgcct

SEQ ID NO: 117293 - DNA, 30 bp, Homo sapiens; identical to SEQ ID NO: 39455
  chr2:10408242-10408272
  Hypo

SEQ ID NO: 117294 - DNA, 316 bp, Homo sapiens; identical to SEQ ID NO: 84832
  chr2:10444358-10444674
  Hyper

SEQ ID NO: 117295 - DNA, 30 bp, Homo sapiens; identical to SEQ ID NO: 84836
  chr2:10505694-10505724
  Hypo

SEQ ID NO: 117296 - DNA, 30 bp, Homo sapiens; identical to SEQ ID NO: 39456
  chr2:10526275-10526305
  Hypo

SEQ ID NO: 117297 - DNA, 30 bp, Homo sapiens; identical to SEQ ID NO: 39457
  chr2:10577316-10577346
  Hypo

SEQ ID NO: 117298 - DNA, 126 bp, Homo sapiens; identical to SEQ ID NO: 84871
  chr2:10589172-10589298
  Hyper

SEQ ID NO: 117299 - DNA, 172 bp, Homo sapiens; identical to SEQ ID NO: 84873
  chr2:10600641-10600813
  Hypo

SEQ ID NO: 117300 - DNA, 30 bp, Homo sapiens; identical to SEQ ID NO: 84882
  chr2:10634441-10634471
  Hypo

SEQ ID NO: 117301 - DNA, 264 bp, Homo sapiens
  chr2:10688798-10689062
  Hyper
tttccttgctccaggcgccctcagtgcttgcagcctggccgcgtgtgcgcctctgctgggatgacccggtcctgttgccccggggccccatcggaaggccggctttccccaccttgagcggctcggcatctgccggctgaccccagcccttccttcctggaagcccttcctttctcggactctgacttgccacatggctttgctcagatgctcagtcggcgggcagcagatgccttaagcagccactgccgggtggatgtccca

SEQ ID NO: 117302 - DNA, 44 bp, Homo sapiens; identical to SEQ ID NO: 27049
  chr2:10861191-10861235
  Hyper

SEQ ID NO: 117303 - DNA, 56 bp, Homo sapiens; identical to SEQ ID NO: 84912
  chr2:10862045-10862101
  Hyper

SEQ ID NO: 117304 - DNA, 30 bp, Homo sapiens; identical to SEQ ID NO: 39459
  chr2:10911393-10911423
  Hypo

SEQ ID NO: 117305 - DNA, 30 bp, Homo sapiens; identical to SEQ ID NO: 84914
  chr2:10916525-10916555
  Hypo

SEQ ID NO: 117306 - DNA, 226 bp, Homo sapiens; identical to SEQ ID NO: 39460
  chr2:10924927-10925153
  Hypo

SEQ ID NO: 117307 - DNA, 30 bp, Homo sapiens; identical to SEQ ID NO: 84922
  chr2:11018229-11018259
  Hypo

SEQ ID NO: 117308 - DNA, 289 bp, Homo sapiens; identical to SEQ ID NO: 84926
  chr2:11051843-11052132
  Hyper

SEQ ID NO: 117309 - DNA, 385 bp, Homo sapiens
  chr2:11052361-11052746
  Hyper
ggtgcatgcctcccccgcggcgcgcccccgcaggctgctgcccgctgtgaccgcccttccccgcaggcgggcgccggccaggctctccccgagatcagcgcacgggtggcacccgccggacccccagcggcagcggcggcggcggctgcagggggcgcggggcggaggctgcgagggcgcgcgcggggaggatggacgggtccggggagcgcagcctcccggagccgggcagccagagctccgctgccagcgacgacatagagatagtcgtcaacgtggggggcgtgcggcaggtgctgtacggggacctcctcagtcagtaccctgagacccggctggcggagctcatcaactgcttggctgggggctacgacaccatcttctc

SEQ ID NO: 117310 - DNA, 315 bp, Homo sapiens; identical to SEQ ID NO: 84938
  chr2:11269903-11270218
  Hyper

SEQ ID NO: 117311 - DNA, 32 bp, Homo sapiens; identical to SEQ ID NO: 84943
  chr2:11312055-11312087
  Hypo

SEQ ID NO: 117312 - DNA, 62 bp, Homo sapiens; identical to SEQ ID NO: 84960
  chr2:11485462-11485524
  Hyper

SEQ ID NO: 117313 - DNA, 30 bp, Homo sapiens; identical to SEQ ID NO: 84962
  chr2:11487939-11487969
  Hypo

SEQ ID NO: 117314 - DNA, 67 bp, Homo sapiens; identical to SEQ ID NO: 84966
  chr2:11537219-11537286
  Hypo

SEQ ID NO: 117315 - DNA, 93 bp, Homo sapiens; identical to SEQ ID NO: 84967
  chr2:11538637-11538730
  Hypo

SEQ ID NO: 117316 - DNA, 32 bp, Homo sapiens; identical to SEQ ID NO: 84968
  chr2:11538910-11538942
  Hypo

SEQ ID NO: 117317 - DNA, 690 bp, Homo sapiens; identical to SEQ ID NO: 84973
  chr2:11622659-11623349
  Hyper

SEQ ID NO: 117318 - DNA, 90 bp, Homo sapiens; identical to SEQ ID NO: 84974
  chr2:11623469-11623559
  Hyper

SEQ ID NO: 117319 - DNA, 171 bp, Homo sapiens; identical to SEQ ID NO: 84976
  chr2:11678128-11678299
  Hypo

SEQ ID NO: 117320 - DNA, 181 bp, Homo sapiens; identical to SEQ ID NO: 84978
  chr2:11722451-11722632
  Hypo

SEQ ID NO: 117321 - DNA, 375 bp, Homo sapiens
  chr2:11809912-11810287
  Hyper
gcacgaagtagtagccgcggcagcccaggtcgccgaagacccaggggtagtggaaccacacgaagctgtagagctccaccggcacgccgaccagcagcagcagcaggcccgcgagcgccaggctgagcacgtggtggcgcaggcgccccgcgcgcccggcccgcgccttcagcaccacgtgcgcggacagcgcattgcccgccgcgcccagcgcccagatgagtgcgtagagcgcggtgaacagcaccttggcccagaggcgagtgtccacgcccagccgggcgtccaggctcagccccgggttggagctgggccgcgggggccgcgggctgctggtttccatcccgctcccgcggccggcgctccctccctctc

SEQ ID NO: 117322 - DNA, 147 bp, Homo sapiens; identical to SEQ ID NO: 84982
  chr2:11886072-11886219
  Hypo

SEQ ID NO: 117323 - DNA, 60 bp, Homo sapiens; identical to SEQ ID NO: 85022
  chr2:11986834-11986894
  Hypo

SEQ ID NO: 117324 - DNA, 30 bp, Homo sapiens; identical to SEQ ID NO: 85037
  chr2:12072116-12072146
  Hypo

SEQ ID NO: 117325 - DNA, 59 bp, Homo sapiens; identical to SEQ ID NO: 85041
  chr2:12092493-12092552
  Hypo

SEQ ID NO: 117326 - DNA, 152 bp, Homo sapiens; identical to SEQ ID NO: 85048
  chr2:12103180-12103332
  Hypo

SEQ ID NO: 117327 - DNA, 30 bp, Homo sapiens; identical to SEQ ID NO: 85066
  chr2:12179974-12180004
  Hypo

SEQ ID NO: 117328 - DNA, 30 bp, Homo sapiens; identical to SEQ ID NO: 85073
  chr2:12222158-12222188
  Hypo

SEQ ID NO: 117329 - DNA, 30 bp, Homo sapiens; identical to SEQ ID NO: 85074
  chr2:12246101-12246131
  Hypo

SEQ ID NO: 117330 - DNA, 30 bp, Homo sapiens; identical to SEQ ID NO: 85077
  chr2:12284474-12284504
  Hypo

SEQ ID NO: 117331 - DNA, 30 bp, Homo sapiens; identical to SEQ ID NO: 39467
  chr2:12303872-12303902
  Hypo

SEQ ID NO: 117332 - DNA, 26 bp, Homo sapiens
  chr2:12351331-12351357
  Hypo
gtgagccactgcgtccagccgatttc

SEQ ID NO: 117333 - DNA, 76 bp, Homo sapiens; identical to SEQ ID NO: 39468
  chr2:12355766-12355842
  Hypo

SEQ ID NO: 117334 - DNA, 170 bp, Homo sapiens; identical to SEQ ID NO: 85083
  chr2:12471019-12471189
  Hypo

SEQ ID NO: 117335 - DNA, 30 bp, Homo sapiens; identical to SEQ ID NO: 85087
  chr2:12608741-12608771
  Hypo

SEQ ID NO: 117336 - DNA, 30 bp, Homo sapiens; identical to SEQ ID NO: 85093
  chr2:12682673-12682703
  Hypo

SEQ ID NO: 117337 - DNA, 29 bp, Homo sapiens
  chr2:12750064-12750093
  Hypo
aaaaaaaagcaaatcgaacttgtagaagg

SEQ ID NO: 117338 - DNA, 68 bp, Homo sapiens; identical to SEQ ID NO: 85137
  chr2:12856481-12856549
  Hyper

SEQ ID NO: 117339 - DNA, 537 bp, Homo sapiens; identical to SEQ ID NO: 85138
  chr2:12858144-12858681
  Hyper

SEQ ID NO: 117340 - DNA, 32 bp, Homo sapiens; identical to SEQ ID NO: 85249
  chr2:14487999-14488031
  Hypo

SEQ ID NO: 117341 - DNA, 33 bp, Homo sapiens; identical to SEQ ID NO: 85262
  chr2:14772249-14772282
  Hyper

SEQ ID NO: 117342 - DNA, 226 bp, Homo sapiens; identical to SEQ ID NO: 85263
  chr2:14772565-14772791
  Hyper

SEQ ID NO: 117343 - DNA, 30 bp, Homo sapiens; identical to SEQ ID NO: 27055
  chr2:14773043-14773073
  Hyper

SEQ ID NO: 117344 - DNA, 135 bp, Homo sapiens; identical to SEQ ID NO: 85265
  chr2:14773907-14774042
  Hyper

SEQ ID NO: 117345 - DNA, 120 bp, Homo sapiens; identical to SEQ ID NO: 85266
  chr2:14774564-14774684
  Hyper

SEQ ID NO: 117346 - DNA, 348 bp, Homo sapiens; identical to SEQ ID NO: 85267
  chr2:14774939-14775287
  Hyper

SEQ ID NO: 117347 - DNA, 296 bp, Homo sapiens; identical to SEQ ID NO: 85268
  chr2:14775526-14775822
  Hyper

SEQ ID NO: 117348 - DNA, 30 bp, Homo sapiens; identical to SEQ ID NO: 85309
  chr2:15579677-15579707
  Hypo

SEQ ID NO: 117349 - DNA, 30 bp, Homo sapiens; identical to SEQ ID NO: 39470
  chr2:15960211-15960241
  Hypo

SEQ ID NO: 117350 - DNA, 30 bp, Homo sapiens; identical to SEQ ID NO: 85318
  chr2:15991627-15991657
  Hypo

SEQ ID NO: 117351 - DNA, 114 bp, Homo sapiens; identical to SEQ ID NO: 85323
  chr2:16080876-16080990
  Hyper

SEQ ID NO: 117352 - DNA, 105 bp, Homo sapiens; identical to SEQ ID NO: 85324
  chr2:16081299-16081404
  Hyper

SEQ ID NO: 117353 - DNA, 1355 bp, Homo sapiens; identical to SEQ ID NO: 85325
  chr2:16081656-16083011
  Hyper

SEQ ID NO: 117354 - DNA, 30 bp, Homo sapiens; identical to SEQ ID NO: 85340
  chr2:16210239-16210269
  Hypo

SEQ ID NO: 117355 - DNA, 77 bp, Homo sapiens; identical to SEQ ID NO: 85375
  chr2:16689362-16689439
  Hyper

SEQ ID NO: 117356 - DNA, 114 bp, Homo sapiens; identical to SEQ ID NO: 85376
  chr2:16705700-16705814
  Hypo

SEQ ID NO: 117357 - DNA, 30 bp, Homo sapiens; identical to SEQ ID NO: 85404
  chr2:17090745-17090775
  Hypo

SEQ ID NO: 117358 - DNA, 69 bp, Homo sapiens; identical to SEQ ID NO: 85406
  chr2:17097513-17097582
  Hypo

SEQ ID NO: 117359 - DNA, 60 bp, Homo sapiens; identical to SEQ ID NO: 85570
  chr2:17699403-17699463
  Hyper

SEQ ID NO: 117360 - DNA, 753 bp, Homo sapiens; identical to SEQ ID NO: 85594
  chr2:17719677-17720430
  Hyper

SEQ ID NO: 117361 - DNA, 345 bp, Homo sapiens
  chr2:17721522-17721867
  Hyper
taacaaagggtgggccgggggtcggctaggacagaaagcagcgggaaaagcggctccacgtgttccatctctggcctcggccttcagcccccaggttcggtaaccactgggcgtggcgagtccgggtaacccgcagtccctcgcgcccgtccaggtgcgggttgctccggtagccggactcccttttcctatatactttccttttgagcttttgctaaaatctggagacgtggaatccacccgcggaaactccgagcccctccgactgagcatgcgccatcgccaggcggcttttggtcacaggctcccgagttctcctagctggggctgcggagctggggggag

SEQ ID NO: 117362 - DNA, 30 bp, Homo sapiens; identical to SEQ ID NO: 85606
  chr2:17830678-17830708
  Hypo

SEQ ID NO: 117363 - DNA, 284 bp, Homo sapiens; identical to SEQ ID NO: 85616
  chr2:18011883-18012167
  Hyper

SEQ ID NO: 117364 - DNA, 1244 bp, Homo sapiens
  chr2:18058914-18060158
  Hyper
gggcagctggcagggcgtatgctgcgggtaggaacccagggaacactgggcgccttagcttggagcagctggctccgaggaattgttccacgtctgcacaacttaaaaatctgcagtttgggggcgggagggggagcgcgggggtgggtcccgaagcgtcccatttctcctcctggctgttaactgagcgctctcgctcagtgcagcgaggccagcgatgccttctggaccacacgctgtcctcgccgaggtcctggtttgttcctcaacgtcggctgaaggcatcgtcccctgacttcctcttccattcgtccttccgaaaggggacccgactggttcctcttctacatatgaggcgcatctgcttggtgcaaatgtccaagcacctcttctgactcggtgagtggaggaataagacaaagcatcttgttctgcactgtgcctgagtcttcaggcagcgggaccgatggcaaacattggcaggaactggagctatatgtactctccttcgcactttgttttaaaacaagtttgggcctcgcgatttcctgaggaaatccaggcaaattagcaaagtgtcgcttgggccgcgactttagaaaggcggttgccccagccgccggggccgcgggggaggtcatctttttcccgcagggccacggcgcttccggcccaggagggcgcgcaggtgggaggcgcggggcgcgctcctggtcccacccggacagcgcctgccgctccggggtgactctgcacttgggcctgggcgggggcgcgcggccggcagggcagcatctaggtctatgggtctgtccgcctgtctggcggtcggagccccgcagtcctcagccgcccgcgccctcggcccggggcgcccggctgcgggcccgaagcgaggggctggcggagctgcgaccaatggggcggcggccgagcggcgggccccgccccgtcccgtccggccccgccccgcccgcagctcccgggagcctcgctctagcggggcgggaccgacggacagaccggccgacgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtacctggctggcgtccccacctccctgcgcgctccggagacttctccgggcgaccctgcaactttaccgcgccttcccccacct

SEQ ID NO: 117365 - DNA, 309 bp, Homo sapiens; identical to SEQ ID NO: 85618
  chr2:18060617-18060926
  Hyper

SEQ ID NO: 117366 - DNA, 68 bp, Homo sapiens; identical to SEQ ID NO: 39471
  chr2:18453289-18453357
  Hypo

SEQ ID NO: 117367 - DNA, 307 bp, Homo sapiens
  chr2:19550039-19550346
  Hyper
gccagcagggggcagcgtggctctgagcgtggaggccagggctggtccgcgccggcagggccagcctccagtgcccagttgggttcccgggcctcgaagttctagcccgcacaggactcaggagcgttcccggaggaggtggggatggggtggtgaaagcccagagcgttttaacttctgcatcccctgccgctttctcagccagcagggcccggcttgaggctgggatttttggtgcctgcagcagggaagcttatagtccagttgtcatccgcggccgccgcgctccgggcgctgaagctggaga

SEQ ID NO: 117368 - DNA, 536 bp, Homo sapiens
  chr2:19551120-19551656
  Hyper
gtcatcctaataagacggggtggtaggagggggacacgctggcgtccagcagagaaacctggtcctctcaaagagaggacccaaccggtttcctgcgtttaggagggaaattacccatcctgcaatgcctgtaaaataaccgtttatttaatagttaaaaaaaaaaaaaactccagtgataaatgtccgttaccgatggtcagcataaagtgccaatcgcaatataacgcccggctcttggctggctgctccctcgcagtgtcgcggcagcggaggccgggccccctgcagaccccaggcccgaggtccccgtcccgctctcctagtcccggagcccacggccgccagctgagctgcaagagctgggagggggctgccccgcggtccctagggcaggaggctgaagcagatacagggattacacttttgcaggctccgggggtgggggcaggggcgggaggaggaggtgggagctgccagtgctaaggacttcgttgcctctcctctctccactcactctccgcagtcagagttac

SEQ ID NO: 117369 - DNA, 34 bp, Homo sapiens; identical to SEQ ID NO: 85688
  chr2:19555853-19555887
  Hyper

SEQ ID NO: 117370 - DNA, 354 bp, Homo sapiens; identical to SEQ ID NO: 85689
  chr2:19556318-19556672
  Hyper

SEQ ID NO: 117371 - DNA, 133 bp, Homo sapiens
  chr2:19556965-19557098
  Hyper
gatggaacatctacacgccgccggtcgctgctagtcccctccagcgcttctcttccctagggggttgtgaacctgggacacctagccttgcacgtggttttgttccgcagagccaatgcgcagctcttagcct

SEQ ID NO: 117372 - DNA, 30 bp, Homo sapiens; identical to SEQ ID NO: 85691
  chr2:19557459-19557489
  Hyper

SEQ ID NO: 117373 - DNA, 80 bp, Homo sapiens; identical to SEQ ID NO: 85692
  chr2:19557961-19558041
  Hyper

SEQ ID NO: 117374 - DNA, 603 bp, Homo sapiens; identical to SEQ ID NO: 85693
  chr2:19558381-19558984
  Hyper

SEQ ID NO: 117375 - DNA, 636 bp, Homo sapiens
  chr2:19561071-19561707
  Hyper
ttgacaagggaaggacgcaggacacctaagagcaacaagggtactttttaagcgaggttacatgtgtttaggactcgcgaggacgtcacgtttcgaatttggtaaaagtcctcggtagctaggacccaacagttctgccctcctggaaacccaatgaaggtgacaaaactcccatctcattactgggagtccagcgcactccgccaccgcggctgcagcttctgctagctcggagcctgcggactccagccggcgcgaactccgccgcgactctttctggctctctcgctcactgccttcggggcggaaccgcgggcgccggagtggtcccagactcggctgggaccgggcagcctagaagaagggtcccctcagtagagaccaggcctccagctctccgtccggcgctccgctccacaacccgccagtcgatgtgaggtccgtcaagggagcgatccctccgtctgcccgggcttccgggctgtggaccgcactgaacccagtcccgcagcaagccctgctgccgccttttcctgggcacgcctgcggtggtgacggcccgctgctcatgtctccacgccaaaccccagcccctctcccgattcctgctccttggtaaagcgccccagcctgtct

SEQ ID NO: 117376 - DNA, 122 bp, Homo sapiens; identical to SEQ ID NO: 85696
  chr2:19563311-19563433
  Hyper

SEQ ID NO: 117377 - DNA, 477 bp, Homo sapiens; identical to SEQ ID NO: 85730
  chr2:20068489-20068966
  Hyper

SEQ ID NO: 117378 - DNA, 337 bp, Homo sapiens; identical to SEQ ID NO: 85739
  chr2:20212448-20212785
  Hyper

SEQ ID NO: 117379 - DNA, 39 bp, Homo sapiens; identical to SEQ ID NO: 39472
  chr2:20253274-20253313
  Hypo

SEQ ID NO: 117380 - DNA, 215 bp, Homo sapiens; identical to SEQ ID NO: 85750
  chr2:20431241-20431456
  Hypo

SEQ ID NO: 117381 - DNA, 142 bp, Homo sapiens; identical to SEQ ID NO: 14395
  chr2:20432683-20432825
  Hypo

SEQ ID NO: 117382 - DNA, 104 bp, Homo sapiens; identical to SEQ ID NO: 85752
  chr2:20442320-20442424
  Hypo

SEQ ID NO: 117383 - DNA, 44 bp, Homo sapiens; identical to SEQ ID NO: 85753
  chr2:20442484-20442528
  Hypo

SEQ ID NO: 117384 - DNA, 30 bp, Homo sapiens; identical to SEQ ID NO: 14396
  chr2:20456198-20456228
  Hypo

SEQ ID NO: 117385 - DNA, 30 bp, Homo sapiens; identical to SEQ ID NO: 39477
  chr2:20553860-20553890
  Hypo

SEQ ID NO: 117386 - DNA, 33 bp, Homo sapiens; identical to SEQ ID NO: 85757
  chr2:20641885-20641918
  Hypo

SEQ ID NO: 117387 - DNA, 33 bp, Homo sapiens; identical to SEQ ID NO: 85758
  chr2:20642218-20642251
  Hypo

SEQ ID NO: 117388 - DNA, 163 bp, Homo sapiens; identical to SEQ ID NO: 85759
  chr2:20642613-20642776
  Hypo

SEQ ID NO: 117389 - DNA, 43 bp, Homo sapiens; identical to SEQ ID NO: 85760
  chr2:20647266-20647309
  Hyper

SEQ ID NO: 117390 - DNA, 1002 bp, Homo sapiens
  chr2:20865658-20866660
  Hyper
gtgatcacgacgtgccgacccagtctagattttgagttctgcagaaaatgcaattttaaaggaaaaggacccgcctgcccttcttcggcagttcgtttggcccaggccttcgatcagctgaaagtttccgatctagggggatgtccaggctgccggcggagcagagccgataacccccctctcctgcgcgttcccctgagacttggcctccgcaacctgtcccagccgcggagcaaactgctctgcggcccgcgcgagtgcgccccagggcttcgccgctgccgggcgtcccctccatccacctcgggacccgcgccatcaccgcggcggggtaagaagctcggaggcgccatcccggggctctgcgccgtccgctctcccggctcctggccgctcacgcacacagccggtagctggttttcgttagccgctgccctcgcccagaaggcgggtggaaggtcgccagttggacgcacagccaaactcttagcgcactcccgcgcgagatcccccatcacccggggctgccgtcctcatttcgagctctttctagagcttggctcccgctgaagcgcaacttccgcgcccaaaccttgcttttacgacgggcggtccgcgtccaaaggtctcttacaggcctgccctttcagctcctcgccctcccttcctcccctaccggccccctcccctgctctggccgcccgctgcaatcctttggggtctgtggctgagtggggaaccgccgacccgcgatccggaacgcgactttgaggccgccgggagcatcctgtggcctctctctgcgcggccacccggccgcggcgcgaagcggtctggagggcgagcccttccgcggccccaactctgccgccccgttcccggcattgggaaccagggcagggagggggcgggtgtttctctgcgggggagtggggaggaagctgggcgggtgcgcgcggtgccccgagcctggaaccacggagggcgcgttggtcttgggcg

SEQ ID NO: 117391 - DNA, 204 bp, Homo sapiens; identical to SEQ ID NO: 85787
  chr2:20867109-20867313
  Hyper

SEQ ID NO: 117392 - DNA, 30 bp, Homo sapiens; identical to SEQ ID NO: 85788
  chr2:20867534-20867564
  Hyper

SEQ ID NO: 117393 - DNA, 349 bp, Homo sapiens; identical to SEQ ID NO: 27085
  chr2:21022707-21023056
  Hyper

SEQ ID NO: 117394 - DNA, 18 bp, Homo sapiens
  chr2:21089512-21089530
  Hypo
tgttttaagacagagcgt

SEQ ID NO: 117395 - DNA, 16 bp, Homo sapiens
  chr2:22404338-22404354
  Hypo
ccgcccccacaaaaaa

SEQ ID NO: 117396 - DNA, 141 bp, Homo sapiens; identical to SEQ ID NO: 86065
  chr2:23546899-23547040
  Hypo

SEQ ID NO: 117397 - DNA, 196 bp, Homo sapiens; identical to SEQ ID NO: 86066
  chr2:23570208-23570404
  Hypo

SEQ ID NO: 117398 - DNA, 30 bp, Homo sapiens; identical to SEQ ID NO: 86067
  chr2:23570986-23571016
  Hypo

SEQ ID NO: 117399 - DNA, 1172 bp, Homo sapiens; identical to SEQ ID NO: 86070
  chr2:23608475-23609647
  Hyper

SEQ ID NO: 117400 - DNA, 174 bp, Homo sapiens; identical to SEQ ID NO: 27088
  chr2:23609896-23610070
  Hyper

SEQ ID NO: 117401 - DNA, 42 bp, Homo sapiens; identical to SEQ ID NO: 86077
  chr2:23640423-23640465
  Hypo

SEQ ID NO: 117402 - DNA, 66 bp, Homo sapiens; identical to SEQ ID NO: 86128
  chr2:23893248-23893314
  Hypo

SEQ ID NO: 117403 - DNA, 707 bp, Homo sapiens
  chr2:24232756-24233463
  Hyper
ccaccccaaggagaacggtcctgagggcctgccgggcctttccccccgcggattttggttcttcgctgtttccctttggggtgcccttcgcggtttctgcgtttcccccgcgttgccagcagccactcgcgccgcgcccctagcccagaaccgcccctcccaagggcgataaccccgagggcaacggccgcgggcggcgctgcggtggcaatggcggcgccccctgcaccagccgccaaggggtccccgcagccggagccgcacgccccagagcccggcccggggagcgccaagcgagggcgagaggtgagcggggcggcggggaccgggaaggggctgcgtcctcggggagctccagggcgtcgcctcgcagccccttttccagctgggggcagcccggaggggctcggcccaaacctgccagctcaggggctgccctcgcggggttacacggctgggagcggggaggctggtaggtgccggcgccggaaagagactaggacgggaagcctagccctagccaaggaagtaacttggggatgcgtggtcattgctgtcctgattcccggcttaggggtcttgtccgtgccaccgcaggtcctcccggggtccccgagctctgggcaggcagggctttctgaagcgcctggggaggctgcgtccttcccgacctcaggcagctgctgtggcctcggcctccctcccag

SEQ ID NO: 117404 - DNA, 284 bp, Homo sapiens; identical to SEQ ID NO: 86279
  chr2:24272963-24273247
  Hyper

SEQ ID NO: 117405 - DNA, 76 bp, Homo sapiens; identical to SEQ ID NO: 86309
  chr2:24324877-24324953
  Hypo

SEQ ID NO: 117406 - DNA, 21 bp, Homo sapiens
  chr2:24584330-24584351
  Hypo
tggcacagtggctcacgcttg

SEQ ID NO: 117407 - DNA, 141 bp, Homo sapiens; identical to SEQ ID NO: 86311
  chr2:24645761-24645902
  Hypo

SEQ ID NO: 117408 - DNA, 63 bp, Homo sapiens; identical to SEQ ID NO: 39480
  chr2:24775908-24775971
  Hypo

SEQ ID NO: 117409 - DNA, 18 bp, Homo sapiens
  chr2:25047467-25047485
  Hypo
acaggaatggccaggcgt

SEQ ID NO: 117410 - DNA, 30 bp, Homo sapiens; identical to SEQ ID NO: 86314
  chr2:25056369-25056399
  Hypo

SEQ ID NO: 117411 - DNA, 25 bp, Homo sapiens
  chr2:25193340-25193365
  Hypo
tttttttttttgagacggcgtctca

SEQ ID NO: 117412 - DNA, 44 bp, Homo sapiens; identical to SEQ ID NO: 39481
  chr2:25241776-25241820
  Hypo

SEQ ID NO: 117413 - DNA, 209 bp, Homo sapiens; identical to SEQ ID NO: 27092
  chr2:25354748-25354957
  Hyper

SEQ ID NO: 117414 - DNA, 18 bp, Homo sapiens
  chr2:25371415-25371433
  Hypo
atccggcctgtcacttct

SEQ ID NO: 117415 - DNA, 675 bp, Homo sapiens; identical to SEQ ID NO: 86320
  chr2:25391059-25391734
  Hyper

SEQ ID NO: 117416 - DNA, 556 bp, Homo sapiens
  chr2:25438800-25439356
  Hyper
gacccgaaatacgcccgaggcatttatcctaaaaaacgacaaggtccgggcgcccagcagaacggcccggctcgaccgcgcgcagcttgcaggcaggggggtgtgcaggtcaccgcgccaccccggcgagcagagccgcggagggcgccacgtcggtgcgctggccccgcccgagcggggcgggaccttcctgtacccccggaagcccccgcgggcagctggggaggaaaccgcggccacgcgctcggggggcccggctcgggaagggcagtgcgcgcgcatgcgttggggcggggcgcctgggacctgcgggccccaggcccagcgcgccgccagccggagtgcccggcgcccgtcgaaaggcccctgcgccggttcaggacccgcacccagctacgctgcggagccccagctcgcagcaccctcccacccaccgctcctggctgcttttctcctgagtctgcggggcggggtcgtttttgttttttacaaaaatgtatgtaaaggtatttcgatgagtgaaggaacacgctataatgctcactcaatgcagcat

SEQ ID NO: 117417 - DNA, 32 bp, Homo sapiens; identical to SEQ ID NO: 86323
  chr2:25439961-25439993
  Hypo

SEQ ID NO: 117418 - DNA, 119 bp, Homo sapiens; identical to SEQ ID NO: 86324
  chr2:25442329-25442448
  Hypo

SEQ ID NO: 117419 - DNA, 30 bp, Homo sapiens; identical to SEQ ID NO: 86325
  chr2:25476260-25476290
  Hypo

SEQ ID NO: 117420 - DNA, 63 bp, Homo sapiens; identical to SEQ ID NO: 86326
  chr2:25563485-25563548
  Hyper

SEQ ID NO: 117421 - DNA, 84 bp, Homo sapiens; identical to SEQ ID NO: 86330
  chr2:25837886-25837970
  Hypo

SEQ ID NO: 117422 - DNA, 84 bp, Homo sapiens; identical to SEQ ID NO: 86331
  chr2:25838030-25838114
  Hypo

SEQ ID NO: 117423 - DNA, 33 bp, Homo sapiens; identical to SEQ ID NO: 86333
  chr2:26204584-26204617
  Hypo

SEQ ID NO: 117424 - DNA, 145 bp, Homo sapiens; identical to SEQ ID NO: 86334
  chr2:26372899-26373044
  Hypo

SEQ ID NO: 117425 - DNA, 221 bp, Homo sapiens
  chr2:26395401-26395622
  Hyper
gcagaattcagaacccgagctttgggcggcggagcaggacagggcgcgggtgggcgcggcctccgggaggccagcacgagggggagcggcggggcccggacacacccagccagaaggaggaggccgaccccgcgccgactccgcagatgccgctcgggacttcgttgtccctccaggcgcccgccctggggtcctccatcacccgccgtcacctgggcgcg

SEQ ID NO: 117426 - DNA, 407 bp, Homo sapiens
  chr2:26396681-26397088
  Hyper
ccctaggagcagcctcggtcctggggcgggcaggccaccttcgggagaggccggcgggagccgggtctgctgcccggcgtgacccccaaactcccggccctcccccgaatcttgtcccacttcttaataggacctggggcccccagccgctcggctgatggaaccacgcatgggggcccgagagggtacgcccggaggctgcatggagcgaggggaccgtttggggggaggggggtgctgcttggttgggggatgggcggtagccggggctggcagccaggccgggggttttgtgtgtgagaagaataggggtttggcccgcgttggcacactcgcttccatgaatgctaatggggcccgcggccgcaggctcctcgtctccccgtggggcccggcagcccctcctc

SEQ ID NO: 117427 - DNA, 544 bp, Homo sapiens; identical to SEQ ID NO: 86339
  chr2:26401682-26402226
  Hyper

SEQ ID NO: 117428 - DNA, 548 bp, Homo sapiens
  chr2:26407451-26407999
  Hyper
gcagatgcaagagggcgagcacacggtgcgcgccatcatcgagcgcgtgaggctgccggtgaacgtgctggtgcccagccggccgccgcgcaacccctacgacctgcacccggtgcgggagggtcattgctacaagctggttagcatcatctccaagacggtggtgctggggctggcgctgcgccgcgagggcccggcgccgctgcacttcctgctgctcacggacacgccgcgcttcgcgctgccgcagggcctgctggccggggacccgcgcgtcgagcgcctggtgcgcgacagcgcctcctactgccgcgagcgcttcgaccccgacgagtactccacggccgtgcgcgaggcgccagcggagctcgccgaagactgcgccagcccgcgccgcgcgcgcctctgcctgcccgcgccgcgcgcccccgggctcgcccgcgcccccggcccgctagcgccggctcccgccggcgagggcgaccaggagtacgtgagccccgactgggcagccgcgcccgagcccgccgcgccgcccgccgagatcc

SEQ ID NO: 117429 - DNA, 120 bp, Homo sapiens; identical to SEQ ID NO: 86342
  chr2:26521959-26522079
  Hyper

SEQ ID NO: 117430 - DNA, 148 bp, Homo sapiens; identical to SEQ ID NO: 86343
  chr2:26607235-26607383
  Hypo

SEQ ID NO: 117431 - DNA, 97 bp, Homo sapiens
  chr2:26624910-26625007
  Hyper
gtccacccagattctcgcgccctcggtccactccgacaactctcaggagcgcatccaggcccggcgcctccgcatcgctgcgcgcttagaagcccgg

SEQ ID NO: 117432 - DNA, 30 bp, Homo sapiens; identical to SEQ ID NO: 86347
  chr2:26712122-26712152
  Hypo

SEQ ID NO: 117433 - DNA, 18 bp, Homo sapiens
  chr2:26854048-26854066
  Hypo
taactaagtgaagaccgg

SEQ ID NO: 117434 - DNA, 877 bp, Homo sapiens
  chr2:26915677-26916554
  Hyper
agcggcggccggggccgaggcgcgggccgggggcgccggggggccggcggcggcccgggcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggtaacggctcgccgggcggggggcgggaacccagggctgggcgcggggctccgggagtcgtccggggccggctggggctgggggcgggggctcccccgagaggggctgggcgccgaaccctgcgctcgcagaaacccgagttcagcctggcgtgtgtgctccgcggggacggaactcggggaggcgtcgattcctggctccggacctgactctccggccgggccagccctaacttggccctgccatgttgcataggcccccagggactccgaagtgtgtgagaggggcagggacgaccggcggaggctcgggcaggaggggtgtggccgggccaggccctgaacagggcgctgagagtgagcggcgggagagcgccagtgctccgtatccctgaggatcggcttccacagcctagcaggtctacacctgctgggctctggggaggcatgaggatgtcggaatgcggcacttcggggcacttggggccaccctataacggcggctgtgagtgtacgtgtgtctgcgtgt

SEQ ID NO: 117435 - DNA, 69 bp, Homo sapiens; identical to SEQ ID NO: 86352
  chr2:27007856-27007925
  Hypo

SEQ ID NO: 117436 - DNA, 32 bp, Homo sapiens; identical to SEQ ID NO: 86353
  chr2:27008352-27008384
  Hyper

SEQ ID NO: 117437 - DNA, 42 bp, Homo sapiens; identical to SEQ ID NO: 86354
  chr2:27069889-27069931
  Hyper

SEQ ID NO: 117438 - DNA, 1632 bp, Homo sapiens; identical to SEQ ID NO: 86355
  chr2:27070287-27071919
  Hyper

SEQ ID NO: 117439 - DNA, 879 bp, Homo sapiens; identical to SEQ ID NO: 86356
  chr2:27072152-27073031
  Hyper

SEQ ID NO: 117440 - DNA, 29 bp, Homo sapiens
  chr2:27090275-27090304
  Hypo
ctattgatggacattcggtttgttcccaa

SEQ ID NO: 117441 - DNA, 28 bp, Homo sapiens
  chr2:27090604-27090632
  Hypo
gagccaccgcgcccggcccccaattgtt

SEQ ID NO: 117442 - DNA, 30 bp, Homo sapiens; identical to SEQ ID NO: 86359
  chr2:27165703-27165733
  Hyper

SEQ ID NO: 117443 - DNA, 30 bp, Homo sapiens; identical to SEQ ID NO: 86361
  chr2:27304380-27304410
  Hyper

SEQ ID NO: 117444 - DNA, 70 bp, Homo sapiens; identical to SEQ ID NO: 86363
  chr2:27319238-27319308
  Hyper

SEQ ID NO: 117445 - DNA, 119 bp, Homo sapiens; identical to SEQ ID NO: 86364
  chr2:27322524-27322643
  Hypo

SEQ ID NO: 117446 - DNA, 481 bp, Homo sapiens; identical to SEQ ID NO: 86365
  chr2:27341629-27342110
  Hyper

SEQ ID NO: 117447 - DNA, 30 bp, Homo sapiens; identical to SEQ ID NO: 86366
  chr2:27354485-27354515
  Hypo

SEQ ID NO: 117448 - DNA, 24 bp, Homo sapiens
  chr2:27433305-27433329
  Hypo
ctttttttttggagacggagtctc

SEQ ID NO: 117449 - DNA, 168 bp, Homo sapiens; identical to SEQ ID NO: 27111
  chr2:27473190-27473358
  Hyper

SEQ ID NO: 117450 - DNA, 834 bp, Homo sapiens; identical to SEQ ID NO: 86369
  chr2:27484899-27485733
  Hyper

SEQ ID NO: 117451 - DNA, 841 bp, Homo sapiens; identical to SEQ ID NO: 86370
  chr2:27486232-27487073
  Hyper

SEQ ID NO: 117452 - DNA, 89 bp, Homo sapiens; identical to SEQ ID NO: 86372
  chr2:27578409-27578498
  Hypo

SEQ ID NO: 117453 - DNA, 30 bp, Homo sapiens; identical to SEQ ID NO: 86373
  chr2:27581396-27581426
  Hypo

SEQ ID NO: 117454 - DNA, 33 bp, Homo sapiens; identical to SEQ ID NO: 86374
  chr2:27591961-27591994
  Hypo

SEQ ID NO: 117455 - DNA, 56 bp, Homo sapiens; identical to SEQ ID NO: 86375
  chr2:27666342-27666398
  Hypo

SEQ ID NO: 117456 - DNA, 30 bp, Homo sapiens; identical to SEQ ID NO: 86376
  chr2:27669403-27669433
  Hypo

SEQ ID NO: 117457 - DNA, 520 bp, Homo sapiens
  chr2:27717830-27718350
  Hyper
cctaccccatcccggcgcgggcccggcgacgcgggcagcgcggggccgagctgcgggcggagcgggcgcgggtctgcggagcccccagggctcgagcgggccacggagtctgtccgggagcagggggcgttgcccggacgctggcctgggtccccggtgcgggaggcagtgcggcggcctccgcccgcccctgcagcgggatgtgaccgtcccggagagccagccgccgccttctgcagcgctggccccgctcgctccgccgcagcccggccgggacgcgcgggcccgccccgcccagccggggttctcgccgccgtcattcccctcccgccccctcactcccgtcctctcggggctcctcccacgaccctcccaatggcgcctccggagcccccatcccttatcccttctctctcccagctgaagcggacgagtcggcgggggcgtggggggtgagacgcgggtgctagggtctccggcacctgggagatccccttcctccccgcgtggaagagccaag

SEQ ID NO: 117458 - DNA, 141 bp, Homo sapiens; identical to SEQ ID NO: 14400
  chr2:27887525-27887666
  Hypo

SEQ ID NO: 117459 - DNA, 309 bp, Homo sapiens; identical to SEQ ID NO: 86380
  chr2:27938325-27938634
  Hyper

SEQ ID NO: 117460 - DNA, 193 bp, Homo sapiens; identical to SEQ ID NO: 86385
  chr2:28500549-28500742
  Hypo

SEQ ID NO: 117461 - DNA, 35 bp, Homo sapiens; identical to SEQ ID NO: 86389
  chr2:28659202-28659237
  Hypo

SEQ ID NO: 117462 - DNA, 212 bp, Homo sapiens; identical to SEQ ID NO: 39489
  chr2:28676953-28677165
  Hypo

SEQ ID NO: 117463 - DNA, 627 bp, Homo sapiens
  chr2:29033336-29033963
  Hyper
taaccagggtaaccacgctgtgcccgcgtgtgccgggcggggaggggaggccgcagccccagccccgggggcctggttgtctaatcgaagggaagtaaacggccccaacgcaagcctgactgcgagacgtgcccaagggaggtaggtcgaatgaagagggttgtgtgagttttgcgcgggcaggcgggataacggaggagggaggcccgcggccgaggctcgggcgggcggggggcagggaggggcggggttcgccggcgcgcactcccaggcaggccccgccccctcggccggctgtgcgcgctgattggcccctgccggcctcgcgctccctcgctccgggttggcgggagaccttagagcgggtaccgctgctggctagcgaccgacgagcaaccgtctgaggccaggagcgctgcgacggagccttgaccgccgttgcccggccctctcccgcgcagccccgggcttccgcaggtacctgtgctcgcccccgggaaggggcctcgcaggcgaatctccagtttcgagtgtgcccggtccctgggttcgctcgccggcgaccccaccgcccgccttagatgagaaggcagcgctccagcctcgtcctcacgccgcctcccgtgg

SEQ ID NO: 117464 - DNA, 30 bp, Homo sapiens; identical to SEQ ID NO: 86395
  chr2:29093791-29093821
  Hyper

SEQ ID NO: 117465 - DNA, 1175 bp, Homo sapiens
  chr2:29337930-29339105
  Hyper
gccttttacagcaagcgctgccagcagggaactggtggatgtactcttgaccacgctcggctggactctggggagcccaagacgggtaagactaggtccccggccccagcagctggtgggggcgccgcaggttagagacgtgaggccgcgaggctgagggctgtgaaggcggtgggcacgcacggcgtgccggggccgcctggcttcgcggcgggggaggtaacactgcgacaccccgcagacgctgtcagccggggtcgcggccccgcgtgcgcccgatcatctgactgctggggagtgcgggggcgcgggagccaggcgagccagcgcaggcgcgcgctgcctcctccgtccccaccgagtccccagcgcgtgcgcggggccgtggccgaggcctgcgcgccgcccggccgcctgcactgcgcgcgcgcccaccccgcgtgggaggcagcgggaggggcccggagaggtgtggagcggcgcggcgggaggctccgtgggcggccacgggagacagcgccggcgggagcgcgcctctcggcctttcctccgcgcccccgcgtccccagccggccgctccgagaggacccggaggaggcaggtgggccgggggcgcgcggggcccccccgggccgcgggctggccggcggcggggttggggccggggtgggcggccctgggggcccgcggggaggtcagtggccccgggagggtcgcgcagaggcgctgggggctgtggaagccccgcggccgcctcccgtgggcaccggtgtcgctggccgcggggaggccttctcggggcggagcggcccacccggcggggatggggactcctcgtggcggccgctgacggacggcccaactttaggttgaggggcgcggggtgtgcgggacccggcggcggagctgggctctgggccacgaccgccagccgcggctgccccgagagtccccgcacgcgcagtggctttccaacgcggcctcttcccatttctcacttgactccccttgcgcattaaattgtcgagaaacctttggccagtgggtcttcaaagctaaaccaaatggctgtccttgcagtccttggctacctgagatcccttaattctgaaccatccgcacctgggaggggaagttgaaaggagcgctggagctgagcccgcatccttaaggat

SEQ ID NO: 117466 - DNA, 40 bp, Homo sapiens; identical to SEQ ID NO: 39490
  chr2:29462699-29462739
  Hypo

SEQ ID NO: 117467 - DNA, 219 bp, Homo sapiens; identical to SEQ ID NO: 86403
  chr2:29504677-29504896
  Hypo

SEQ ID NO: 117468 - DNA, 95 bp, Homo sapiens; identical to SEQ ID NO: 86404
  chr2:30142882-30142977
  Hyper

SEQ ID NO: 117469 - DNA, 436 bp, Homo sapiens
  chr2:30143276-30143712
  Hyper
gccagccttcagctccgaggaggatggtggcagcagtaggtcccgggcgtagacacggaagagcgagggcaccacgaagtcaactgccagactcttcctctgcaggcgcgagtagctgagtggctcccggggctgcagcggcggccccgcagctggggagcccgcgcgctggccggtccccatcccggagcccacagctgccgtggaaagcagcagcggcaggagccacaggagcccgatggctcccatcccgccggaggaggccgtttacactgctctccgggcccagcctcacccttcgctctccccgagatgggaagaggctctgaacagtccttggtacccagcggctccttccacctgatctccagaggactgtgcgtgcgcgcaagtctcttgctttcccccaactgcacggaggcgagcaggagtctaa

SEQ ID NO: 117470 - DNA, 775 bp, Homo sapiens
  chr2:30143918-30144693
  Hyper
gggtctgtcccctctcggggcagcctccaatctctgcaacttttaaggctgagaacggcggctcccagctgctgcacgctgtcctggccgccttttgcgttccttttggctcctccaagctcttctgcccggtctgggcgggaaccgagggcggaggctgccgtcttgcgcaccctcaagctatctctccgctgcgggaaggcttcggactgtctgcctgctgaacttctgggcgtgaatcccagcccccgcgctgcgcaagtttgcagcgtccttgctctcaccggcgcctcggctcctcagagttcgcaggcactggagcggccccggcggcagcagctgagggcgttcagggcaggggcgcccgaaatcttgccgccccctcctcacccatcatcagcgcccgcggctttgggtggccgaccagagggcggccggaaagcacctcggtgccccgcgaccctccgaacagaggcggcgggaggtaccagctgctaccaccgctgccgcccccagagccgctggatcgcatctgcctgggcgcccgccacttgcagctggctgagccgcgcgagcgcgcgcagggagggggcggggcccggagggggcggggctcacaagccaactccgcgctgctgcccgacccacgcagtccggcctcgccccgccccacccgcaccctccaaccaatggcgtggctcgatcggctcctatgcaaatctgcagaggcctcggcattcattgagaaaaggagtgagcccgccccaccctccct

SEQ ID NO: 117471 - DNA, 32 bp, Homo sapiens; identical to SEQ ID NO: 86410
  chr2:30144922-30144954
  Hyper

SEQ ID NO: 117472 - DNA, 87 bp, Homo sapiens; identical to SEQ ID NO: 39492
  chr2:30368623-30368710
  Hypo

SEQ ID NO: 117473 - DNA, 27 bp, Homo sapiens
  chr2:30404502-30404529
  Hypo
ctttctttttttaaacggagtcttgtt

SEQ ID NO: 117474 - DNA, 30 bp, Homo sapiens; identical to SEQ ID NO: 86413
  chr2:30407504-30407534
  Hypo

SEQ ID NO: 117475 - DNA, 145 bp, Homo sapiens; identical to SEQ ID NO: 86414
  chr2:30443158-30443303
  Hypo

SEQ ID NO: 117476 - DNA, 1316 bp, Homo sapiens
  chr2:30453590-30454906
  Hyper
gtcaaggatggggggcggcgtgcacaccgcccgcccacaccttctgcccccgctgcagaccgggcgtatgtgtgtctccaatggaaaaatcctacccaggacgacaccacatccttgctcccacaaataaaaccttccacggaactcagggctgcagaccagcccttcgcaagccaacgcgccccgtgggcactcggtcccccggctccgcgtctctgccaccttcccaccgcttcttctttaaccatgctcttgtttcccctcgctgatcgcaaggctgcgggcgaggattccagagagaggcctagtatggggaacaaacgcttcagaggggtccgaggtgggctggggacagccagtggatgggaaggagggcgctggcgccgggcggctggggtggaggagtggcgggtgccctaccccggcgcagagcagccgccgagctgtcatgtcccgagcggcccccgcgccctccttgcgcccacctccgccgcgctggagttcggggtgtgcgtggagggggctgtgagcgggaagcggcgcggacgcggagtccgggccggtgcgagtgagcgcgtgtgcgcgtgggagagcggcgggagggggccgggctcgcagccgcagcgaaccacggccccgggagcagagccgagcgcgcccccgagccgccgcccgccggagctgcgagcgctgaagccattcatgattttggtgacgttattccaggagtgggcgagggagggcggggcctctcggggccaagccccgcccccgcccctataaatacggcttcccgggctctttgtggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactggtgagtaccctgcgcctgcggcgggcgtctgtctcgcggcggtggctgcgggcccgggcgcctgcttcgtgccggctccgggtgcgagggcagccggcggcgcgggcgctcagcgctaacccgccgcccgagcccgtgcaggagtcaacgtcaaggttgcaaaggtgggggtggggggagggggtgctgagaacatccagacaaaggacgtgaactcggagccctcacctaagtgacggccggagggtttgtattggttggcgggggagccagggg

SEQ ID NO: 117477 - DNA, 404 bp, Homo sapiens; identical to SEQ ID NO: 86417
  chr2:30455403-30455807
  Hyper

SEQ ID NO: 117478 - DNA, 30 bp, Homo sapiens; identical to SEQ ID NO: 86418
  chr2:30471090-30471120
  Hypo

SEQ ID NO: 117479 - DNA, 30 bp, Homo sapiens; identical to SEQ ID NO: 86419
  chr2:30486255-30486285
  Hypo

SEQ ID NO: 117480 - DNA, 100 bp, Homo sapiens; identical to SEQ ID NO: 86420
  chr2:30497260-30497360
  Hypo

SEQ ID NO: 117481 - DNA, 30 bp, Homo sapiens; identical to SEQ ID NO: 86422
  chr2:30512636-30512666
  Hypo

SEQ ID NO: 117482 - DNA, 16 bp, Homo sapiens
  chr2:30541168-30541184
  Hypo
ttggagacggagtttc

SEQ ID NO: 117483 - DNA, 826 bp, Homo sapiens
  chr2:31360195-31361021
  Hyper
atttcctcaactccccgccaataccaaggcgtctgtttttacaggctctttcgtggtgttctgggcacattcaacttccaatgcagctgagagggtcgggaacagttagagaacaggggtggcagccgcccgggaggctgcaaggcgctcgcccgcaacgcacaggcgcgcgcggcgcacccggcctccggcctccccaggtcgggcctggcagctgcgggaaggaggtcagcgcagccgccacacttcgcccgggcgctggcccgacccgaccgccggcgactctctggcagcgcccggagaccgccagcccctgggccgcccgtccgcagagccccctccgccccgggaccctcgcgcgcagctcaagttgggagccccgctccgcaggcgagcgcgcgcccaccacccacacccactgccactcatgcacaccgcgggtccggagatgcccccgagcgttttaaaatccagaaacatcacatggtagccacatccggcggctgttacctgctcgcagcacccagaccctcgccctggtttcccgggagcccgcaaacccggcacgcgggctgcgcgccctcccgcaagccaccgctcagcgccagcgcgccggcaagccgcctaccttaggggtctgcacttcaggtcccgtcggcacctccaacttcctcttggttacccagaagaacagcagcaccgtgatccagagcaccccgaagactggcagaaccagccgacgagtcaggcgccgcatggtcccctttgccgcttcctctccgcggcgctacgtcccgggggcaccccccggcggtcagggttggcg

SEQ ID NO: 117484 - DNA, 394 bp, Homo sapiens; identical to SEQ ID NO: 27135
  chr2:31361296-31361690
  Hyper

SEQ ID NO: 117485 - DNA, 745 bp, Homo sapiens
  chr2:31456682-31457427
  Hyper
caactgaaggagaggcgattcaaagcagggagtgtgatgaataggtcaactctgtcctcgcagccgtccctgagagggcgctgttcccaaatcgaagccccagaggcggagactgagacaccggcactctcccactggactgggtcagcatccctctccccgcgcggccgcaggtctagagctgagcgcctgcccacaaacatggcggcgccctgcgcggcttcccgtcgccgcaaccgtggggccggccctgccttgccagtactaggggacttcctctgcgcgccggcttcctgcccagctggcatttaaaccaccgcctggggctgcaggatgctgctgcggatgcagagctgtccgcgggctgggcagcgtcgccgtctcccctgagccgcctcggtccggcaggagcggagccgaagcatcccttgctgcacgcagggcagagcaggcgagggctgggggccgatcggggaccccggcttgggaccccggcatctggcagtttccttgcaggttcaactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggaca

SEQ ID NO: 117486 - DNA, 89 bp, Homo sapiens; identical to SEQ ID NO: 86435
  chr2:32263995-32264084
  Hypo

SEQ ID NO: 117487 - DNA, 31 bp, Homo sapiens; identical to SEQ ID NO: 86436
  chr2:32275102-32275133
  Hypo

SEQ ID NO: 117488 - DNA, 17 bp, Homo sapiens
  chr2:32360509-32360526
  Hypo
ttcgattattctaaatc

SEQ ID NO: 117489 - DNA, 16 bp, Homo sapiens
  chr2:32472347-32472363
  Hypo
gacaagcttaacctgc

SEQ ID NO: 117490 - DNA, 30 bp, Homo sapiens; identical to SEQ ID NO: 39497
  chr2:32494200-32494230
  Hypo

SEQ ID NO: 117491 - DNA, 120 bp, Homo sapiens; identical to SEQ ID NO: 86440
  chr2:32504329-32504449
  Hypo

SEQ ID NO: 117492 - DNA, 42 bp, Homo sapiens; identical to SEQ ID NO: 86441
  chr2:32504749-32504791
  Hypo

SEQ ID NO: 117493 - DNA, 27 bp, Homo sapiens
  chr2:32551637-32551664
  Hypo
tgtgagccaccgcgcccagcctaccct

SEQ ID NO: 117494 - DNA, 29 bp, Homo sapiens
  chr2:32620220-32620249
  Hypo
aaaaacagcaacaacgacaacaacagaaa

SEQ ID NO: 117495 - DNA, 150 bp, Homo sapiens; identical to SEQ ID NO: 86444
  chr2:32852511-32852661
  Hyper

SEQ ID NO: 117496 - DNA, 34 bp, Homo sapiens; identical to SEQ ID NO: 86450
  chr2:33313226-33313260
  Hypo

SEQ ID NO: 117497 - DNA, 30 bp, Homo sapiens; identical to SEQ ID NO: 39501
  chr2:33315571-33315601
  Hypo

SEQ ID NO: 117498 - DNA, 16 bp, Homo sapiens
  chr2:33373991-33374007
  Hypo
ctcccatgggctgggc

SEQ ID NO: 117499 - DNA, 21 bp, Homo sapiens
  chr2:33379839-33379860
  Hypo
ttgaactaggccgggcgcggt

SEQ ID NO: 117500 - DNA, 159 bp, Homo sapiens; identical to SEQ ID NO: 86457
  chr2:33529420-33529579
  Hypo

SEQ ID NO: 117501 - DNA, 44 bp, Homo sapiens; identical to SEQ ID NO: 86458
  chr2:33530065-33530109
  Hypo

SEQ ID NO: 117502 - DNA, 70 bp, Homo sapiens; identical to SEQ ID NO: 39503
  chr2:33532830-33532900
  Hypo

SEQ ID NO: 117503 - DNA, 42 bp, Homo sapiens; identical to SEQ ID NO: 86460
  chr2:33544683-33544725
  Hypo

SEQ ID NO: 117504 - DNA, 87 bp, Homo sapiens; identical to SEQ ID NO: 86461
  chr2:33653893-33653980
  Hypo

SEQ ID NO: 117505 - DNA, 60 bp, Homo sapiens; identical to SEQ ID NO: 86462
  chr2:33775696-33775756
  Hypo

SEQ ID NO: 117506 - DNA, 59 bp, Homo sapiens; identical to SEQ ID NO: 86463
  chr2:33953179-33953238
  Hypo

SEQ ID NO: 117507 - DNA, 38 bp, Homo sapiens; identical to SEQ ID NO: 86464
  chr2:33997908-33997946
  Hypo

SEQ ID NO: 117508 - DNA, 21 bp, Homo sapiens
  chr2:34556567-34556588
  Hypo
ccactgcgcccagccttggga

SEQ ID NO: 117509 - DNA, 30 bp, Homo sapiens; identical to SEQ ID NO: 86467
  chr2:36245456-36245486
  Hypo

SEQ ID NO: 117510 - DNA, 236 bp, Homo sapiens; identical to SEQ ID NO: 86468
  chr2:36600958-36601194
  Hypo

SEQ ID NO: 117511 - DNA, 66 bp, Homo sapiens; identical to SEQ ID NO: 39505
  chr2:36824207-36824273
  Hypo

SEQ ID NO: 117512 - DNA, 30 bp, Homo sapiens; identical to SEQ ID NO: 86470
  chr2:36998369-36998399
  Hypo

SEQ ID NO: 117513 - DNA, 16 bp, Homo sapiens
  chr2:37445969-37445985
  Hypo
gcgccactgcattcca

SEQ ID NO: 117514 - DNA, 177 bp, Homo sapiens; identical to SEQ ID NO: 86472
  chr2:37571733-37571910
  Hyper

SEQ ID NO: 117515 - DNA, 48 bp, Homo sapiens; identical to SEQ ID NO: 86473
  chr2:37899949-37899997
  Hyper

SEQ ID NO: 117516 - DNA, 33 bp, Homo sapiens; identical to SEQ ID NO: 86474
  chr2:37979626-37979659
  Hypo

SEQ ID NO: 117517 - DNA, 226 bp, Homo sapiens; identical to SEQ ID NO: 86475
  chr2:38007974-38008200
  Hypo

SEQ ID NO: 117518 - DNA, 144 bp, Homo sapiens
  chr2:38301221-38301365
  Hyper
aaatgtgttctcactcgcaagcaggggaggggacgatagagacaagataggagaccggaggggtcggggcaccgctgggtggggcgcgtgcgcgtgtcgcagccctcactgtgagtccctttaccgacgcgatcttggttttga

SEQ ID NO: 117519 - DNA, 1990 bp, Homo sapiens
  chr2:38301719-38303709
  Hyper
aagttgctgaagttgcggttgagctgctcgaattcgcggaaaacggtgcgcaccgggttggggaagtactgcagccagggcatcacgtccaccaggctgcccgcgcccaccgtgcgcccgaactcttcgttgtggctgagcagctcacggaactcggggtcgtcgtggctgtagcggcagccgaaacacacggcactcatgacgttggccacggccacgacggtcagcggcctcgggtcgaggaaggcgccgtccgcgctgccgcgcaccagcagcgccaccagctcgcgcgcctcgctcagcacgtggccctcgaggacttggcggctgcgcggctggcgcgtgaagaagttgcgcatcatgctgtgggctgcgcgccgctgcaccttccagtgctccgagtagtggccgaaagccatgctgcggccgccggacaccacacggaaggaggcgaaggccggccggtcggcgaaggccgagccctgctgcaccagggcctggtggatggcgcgctcgccattcagcaccactatggggcagctgcccaggcggatctggaaaacgtcgccgtagcgccgcgccaggcgagcgaacgagaggtgagccgcctggcccaccgccgccgcgtttccgatcagtggccacgcaaacgggcccgggggcgcggaccggagctgccgcctccgttgcctcagcagccgctggcccacatgcacagtggccagcaccgacaggagtagcaggagcgtggtctgctggatggacagcgggtttagcggccaagggtcgttcgggctgaggctggtgcccatgctggggacagagaggagaaggcgtgacactcaggggtgcagagacaggagcgggcgccccacgcccctaccccagcctctggggactgagtgccgttgggtggagaggtcggagctgactctctggagaaatggccgaagacgccccttcccatccccaacccactctcccttggagaagagaaggggcgtgtttccacctcgctgtaacccagcgccaaacccttcccctccccgcaaggcgcgtaacggttcctgcaatctggggacaacgctgcgggcatcgaggcggtggcgcttgatttcctttaaagtacctaccacgccacccgctacctgtaataatccatctgaagaggtcgccgggcagcgcctcggcagacagactgacctgcggggaggtgcggtttccagtggcgcgggacagccggctccgagaaggaactgggacctttgcctagggcaagacgtcaacaggaacccgcagcccggcctggacacctgctgccctcactggaagctttaactcccactcgagtctcttggcgtcgtcagtgccaggagcgcttggattgggatggggacggagaagggtgcctcgctcgccgagccccgctgcccttggggacctggcaaagtcgaggtttcctcacagcgttgagattgagactgggggtcggtgagtggcgtcaattcccatgcccttgcggctctcacaactggagtcgcagaagcgctcgctcccactcccactccagagtcaaagcgcgccatcccgctcctccgggttttaaggactgggtagaaggagggcagcgcgacctggcagggcggggcctgcggggggcggggcgcgccgcacaccaggccgctttgacccggactcccgtccaggcgcaccggccggcctcggagctctaccagcaggctttcatgggagcggaggtgcccacgtttccattgtgcggtaaccgcgcttcatcacagccacctccaatcgaggccgcacggtgtccccagaaccacgctcggtacaacctgccccggccgctgcgctcgacttgggagcgcgccccgccccgagcgcacgacctcccttccctctccgcgacttgagcttgcttcccggaaagccagtgtagtggcagcggtttgcctcacagcgcccctggttggtt

SEQ ID NO: 117520 - DNA, 21 bp, Homo sapiens
  chr2:38365727-38365748
  Hypo
ctcccccgtcctgtcttaaag

SEQ ID NO: 117521 - DNA, 30 bp, Homo sapiens; identical to SEQ ID NO: 86483
  chr2:38466890-38466920
  Hypo

SEQ ID NO: 117522 - DNA, 16 bp, Homo sapiens
  chr2:38669261-38669277
  Hypo
tcgcgccacagcgctc

SEQ ID NO: 117523 - DNA, 19 bp, Homo sapiens
  chr2:38744252-38744271
  Hypo
actccgtctcaaataataa

SEQ ID NO: 117524 - DNA, 79 bp, Homo sapiens; identical to SEQ ID NO: 27143
  chr2:38755384-38755463
  Hyper

SEQ ID NO: 117525 - DNA, 30 bp, Homo sapiens; identical to SEQ ID NO: 86487
  chr2:38756521-38756551
  Hypo

SEQ ID NO: 117526 - DNA, 20 bp, Homo sapiens
  chr2:38953653-38953673
  Hypo
caccccgcctggccaagtct

SEQ ID NO: 117527 - DNA, 549 bp, Homo sapiens
  chr2:39187170-39187719
  Hyper
cccggagatggacttcgagtcctctccggcggagccgctgggcaacgtggagcgctccctgcgcgccccggccgagctcctgcccgatgcccgcggcttcgtgcccgcggcctacgaagagttcgagtacggcggcgagatcttcgcgctgcccgcgccctacgacgaggagccgttccaggctccggccctcttcgagaactgctcgcctgcctcctccgagtccagcctggacatctgcttcctgcggcccgtcagcttcgccatggaggccgagcggccggagcacccgctgcagccgctgcccaagagcgctacgtcgccggcgggcagcagcagcgcctacaaactggaggcggcggcgcaggcgcacggcaaggccaagccgctgagccgctctctcaaagagttcccgcgtgcgccgccagccgacggcgtggccccacgcctctacagcacgcgcagcagcagcggcggccgcgcgcccatcaaggccgagcgcgccgcgcaggcgcacggcccggccgccgccgccgtcgccgcccgcgg

SEQ ID NO: 117528 - DNA, 94 bp, Homo sapiens; identical to SEQ ID NO: 86491
  chr2:39188263-39188357
  Hypo

SEQ ID NO: 117529 - DNA, 75 bp, Homo sapiens
  chr2:39892733-39892808
  Hyper
aaggggaaggggggtcgctggagaggagggcggactgtggatcggaggtagggagaggggcgagaggagtgcgcg

SEQ ID NO: 117530 - DNA, 1041 bp, Homo sapiens; identical to SEQ ID NO: 86494
  chr2:39893018-39894059
  Hyper

SEQ ID NO: 117531 - DNA, 697 bp, Homo sapiens; identical to SEQ ID NO: 86496
  chr2:40678187-40678884
  Hyper

SEQ ID NO: 117532 - DNA, 696 bp, Homo sapiens
  chr2:40678944-40679640
  Hyper
tgccaaagcagagggaagtgtagccttatgagcagcaaatggaaaatagttcttggtctctgactaaatgccttctgcctgtccatcataagatcctacctggtttggggagtgtgaatggattcttcctccgttcctccacgctagtagaaaatacggcgcactccctccttttaaacagctcccgatcaggaagaggtcgctcccatcttctgtgggaagcacaaagcaggcggcggcggcgggctgactaccgtgcagcgccggcgcgagcgggagccgcggcagcgggcagcggtgcgcgcgggcgggaggcaggcgcggaggccgggaggctgggagggccggggcccgggcgcgcgcgcgctccccctccctcccgcgcacactcgcccgcccgccgcccgcagcctcgcactcgctcacacgcgcgctcggccccgcggctgccgggcgccccggggccccctgcgcgccccttgggctccccaggcgatcgcgtcggggcaaagccggcgcgtttctggagcaccgagcgggtggggagcccttccagcctcccagcctctgccggcgagcagctttttcgatttcctgccggctctcggccccgcagtgcgttgtggccgcgcgctagcgctgtctctcgcacccagcccatcgatgacacgcgcacacaggcgctgcaacttttct

SEQ ID NO: 117533 - DNA, 26 bp, Homo sapiens
  chr2:41770131-41770157
  Hypo
gctaaaaaatatttgcgaccaggcgc

SEQ ID NO: 117534 - DNA, 147 bp, Homo sapiens; identical to SEQ ID NO: 86502
  chr2:42274544-42274691
  Hyper

SEQ ID NO: 117535 - DNA, 152 bp, Homo sapiens; identical to SEQ ID NO: 86503
  chr2:42275776-42275928
  Hyper

SEQ ID NO: 117536 - DNA, 203 bp, Homo sapiens; identical to SEQ ID NO: 86504
  chr2:42281964-42282167
  Hypo

SEQ ID NO: 117537 - DNA, 30 bp, Homo sapiens; identical to SEQ ID NO: 39508
  chr2:42282578-42282608
  Hypo

SEQ ID NO: 117538 - DNA, 519 bp, Homo sapiens
  chr2:42329318-42329837
  Hyper
gtgatcagggaaagtcgaaagtgcagatgggttcgcaaacgtggactctctagttttgggtctgcagatggggccggccaccacgtgctctctgagttctctttccaagtacagatccctccggagacggaacattgttccgcctttaattcttcccaggagctgcggaggaaggcgtgagaaccggagcccggggtgacttgcgggggaggggatcgcttccccgtcgcccacacctgcctaacccacgcccacggcggccgcaaaggcgacaccgcgtgaatctggaaagccccgagtttcaacaggcccaaccatcggcggctttgcaggcgcagcaccaagtgctgctctgcctgtgttcccccagacagcccctggttgtgatttgtcgtttccagtccagctagagtcccaaggccaagaactagacccttgcagcgagatccgcgcccccccccaccccaccccgcctcattctccacaggcgccacagccacaggccgcataaataaatcc

SEQ ID NO: 117539 - DNA, 30 bp, Homo sapiens; identical to SEQ ID NO: 86508
  chr2:42338267-42338297
  Hypo

SEQ ID NO: 117540 - DNA, 45 bp, Homo sapiens
  chr2:42719904-42719949
  Hyper
gacgggacgtatggacgggacggacagacgcgacaggacggacgg

SEQ ID NO: 117541 - DNA, 984 bp, Homo sapiens
  chr2:42720262-42721246
  Hyper
agaaggtgtaggtgtcggacatgcggtcgtcgaggcggcgctggcagcagtactcgaggtgcgcgccctccaggccccagtagatcatctcgttgtagaaggagagctcgcacatccgcggcgcgaagcgcagcttgccgtggccgcgcacgtagagcaggatgaagccgaaggcctccgagtgccggtcgaagaagtactcgttgcgctcgcggtcgtagtcgtcgcacacctcgagcacgtcgcgctcggagcggcagccgtgcagccggctcacgcggcgcagcgggaagtccttcagcagctcccgggacagcgaataccgggcgccgcccacgttcagcaccaccgaggccgccccgctgcgcccgaaggtcatggctggccgcccgggggactttcggcccgagggccccgctgcagccccccaccccaagccgccacgcggggcctgcctgcccgtggctgacgggggagcgcgccgtcggggcccgcgctccctcggggctccgctcctgccctccgctggcccgggggtccctgggctcgagtatctccggcgctgctagtagcgcgccctccgcccggcggtacctgcgggtggccggggagtcctcgccggcgccagcgctgagccccaccggctgggaacgcggctgtgtccgcgccgccgaccctcgcgcccgagggctgcgcacaccgaggccgcggtgccctctcccaagccgcggggccgaccccctgagggctgcgggcgccgaatggagccgccggggcggaatagctccccgtctccggcgctccctgcggccgcgaatccggcggccgccccgccgccgtccagaggcgagaggcaaagtgagcgggttcggaggcggcgaagagccggctcgcggcggcgggggcggggcctctgtgcagtcctcctcctcgcccgccggctccgcgcgcgccgctcacctccctccgcgccgccctccgctt

SEQ ID NO: 117542 - DNA, 756 bp, Homo sapiens
  chr2:43019598-43020354
  Hyper
gagcttgttgcagaccgggggctggaaggagccccggttctccttcacccaggccctcactcccaggcggcgctccatgactgtcccgggcgcctcctcgcagcgctgtcctcccgccgtcggaggcccgcagctccgcccagccgcctttttaaccagaatcccaagctcacgaggcggagcaaacccccgcgaccccgtggtgggggcttggggcccgcggactttgccccctggtggactttggtctgagcccgccgccctccgcgccactccaggccctggcgagcgcggcggcggcagcgctggggaacggcgtcccgcgccctctgcttctccgcggggcaggggctcggtccccgccaccgtctccggggcgccccacacactggcgcctgcggtggggcctgctcccggcggaggacaaagaatccagacccttcctggacgcttgtccccagacgttccttccctctacgccccgaggggaatcccagggaaggttcccagaaatactacagtgaggagatcgcgggttggaagtcccagcacctgagaacacggtgctggcgctgggctcaagatttggctttcccatctggaaaaggggaatgactgccccgccactcagggctgcggcgctcacccagcgggaagccgcacggcggtccccgcaggtcccgattcaaggtgagccccagacctgctgcgtgcggccggcagactccgccgcgggctcggcgaggggagcggtgc

SEQ ID NO: 117543 - DNA, 241 bp, Homo sapiens; identical to SEQ ID NO: 86513
  chr2:43037936-43038177
  Hyper

SEQ ID NO: 117544 - DNA, 30 bp, Homo sapiens; identical to SEQ ID NO: 86514
  chr2:43038607-43038637
  Hyper

SEQ ID NO: 117545 - DNA, 251 bp, Homo sapiens; identical to SEQ ID NO: 86515
  chr2:43227374-43227625
  Hypo

SEQ ID NO: 117546 - DNA, 19 bp, Homo sapiens
  chr2:43365437-43365456
  Hypo
tgggcgacaaagtgaggct

SEQ ID NO: 117547 - DNA, 189 bp, Homo sapiens; identical to SEQ ID NO: 4967
  chr2:43408168-43408357
  Hypo

SEQ ID NO: 117548 - DNA, 39 bp, Homo sapiens; identical to SEQ ID NO: 14407
  chr2:43412683-43412722
  Hypo

SEQ ID NO: 117549 - DNA, 30 bp, Homo sapiens; identical to SEQ ID NO: 86519
  chr2:43413669-43413699
  Hypo

SEQ ID NO: 117550 - DNA, 401 bp, Homo sapiens; identical to SEQ ID NO: 86520
  chr2:43448395-43448796
  Hyper

SEQ ID NO: 117551 - DNA, 1494 bp, Homo sapiens
  chr2:43450949-43452443
  Hyper
ctggtttgtttacaccggtctgagacacaattaggaacttcttccaagagaagggttcccacatctggacttaactaatgctgttcaagtgaagagatggaatggtggttggtagctgctggtgctgggttgatttttcctgaagtcccaaactcatcggagtcctaacaaagtttaagtgttttttttttttttttgttctattcgtatcacaactgccctgttgtgaatattttgttcaacagaaaaagttcgacttttttgctcaaaaagaatgaaacttcgtaataaaaataaaaaaaaaaagacaagaggaaaccgaaaaaggaggggtgggggcccctcccggcacagagttcgagtccaagtgctcggtcgggcttgcagtctgcctagggcccatgtcaccccccccactcccgtgcccccagcaagggcgagatggcgaggggtgtcctccaacatctctgaaccgccttcccttcctcctcactggcgccctcttgcctcagtcgtcggagatggagaggcggctgaagattggcaggcggcggccagggtcgaggctgggagactcagagccgctgaggctgccggagctcagggagccgcttaggtagctgtcgcggtccgacagcgagtccggggggctggggggcgcgtcgaacacgggcgagtcggacaggcggcgcggcagctggaagctgaagggcggcgagggaggtgcggcggccccggcggggagggtcgcgctgggcggcgccggcggctgcgcggggggcgccaggccctgctgctgctgctgctgctgactgcggtagtaggcggcggcggccacggcggcaaagttgtgggtctggatggcgagcggcgtgatgaggctgctgagctccggaccgaaggcgaaggcgttgttggcgcacgaggccgacgagcaggccgcgcacggggcccccggcgccagcaggtcctcggcgcccccggtgccgtacagcagagcggccgcagccgcggccgccgcggaggcgcagcatgtcggggcgcccgagggcgtggaggccgcggaggccgaggaacaggaggaggcggaggaggagcaggacgaggccgaagagcaggagggcggcggcggcgtgcgcgacgtggggctgtcgagcagcagcggcgactcgaggccgcccgggggctgatggtggcccgacgggaagcccgagaagctgaggctgtggtgcaacttgggccgcggctcccgcgggaagcccaggtgcaacgcatcgcgcgtgccaaaggcacgcaggtccccggaggcgccccccgacggcgcgggccgccgctcgtccgcgttgtggatgaagtggcagcgcggcccataggggcagaagccgatggtatgaaaggtgcggcacagctcggtcttgtacttcggatggcgagtcaggctgcgcagctcgtggaagccatgcgcgaactggcacttttcgccgtacttgcacg

SEQ ID NO: 117552 - DNA, 30 bp, Homo sapiens; identical to SEQ ID NO: 86523
  chr2:43654231-43654261
  Hypo

SEQ ID NO: 117553 - DNA, 107 bp, Homo sapiens; identical to SEQ ID NO: 39512
  chr2:43812086-43812193
  Hypo

SEQ ID NO: 117554 - DNA, 21 bp, Homo sapiens
  chr2:43824111-43824132
  Hypo
ggctgtagtgctcttcgccca

SEQ ID NO: 117555 - DNA, 21 bp, Homo sapiens
  chr2:43824372-43824393
  Hypo
ccatggcgcccggaccgtaat

SEQ ID NO: 117556 - DNA, 534 bp, Homo sapiens; identical to SEQ ID NO: 86527
  chr2:43864196-43864730
  Hyper

SEQ ID NO: 117557 - DNA, 53 bp, Homo sapiens; identical to SEQ ID NO: 86528
  chr2:43865097-43865150
  Hyper

SEQ ID NO: 117558 - DNA, 32 bp, Homo sapiens; identical to SEQ ID NO: 86529
  chr2:44104688-44104720
  Hypo

SEQ ID NO: 117559 - DNA, 30 bp, Homo sapiens; identical to SEQ ID NO: 86530
  chr2:44126101-44126131
  Hypo

SEQ ID NO: 117560 - DNA, 91 bp, Homo sapiens; identical to SEQ ID NO: 86531
  chr2:44224202-44224293
  Hypo

SEQ ID NO: 117561 - DNA, 45 bp, Homo sapiens; identical to SEQ ID NO: 39515
  chr2:44497699-44497744
  Hypo

SEQ ID NO: 117562 - DNA, 431 bp, Homo sapiens
  chr2:45028940-45029371
  Hyper
tccttttaattgtgacggtgcggccgcttgggcgtgatcccttggctggggctgcagggggcccgtcctccaggggcgcagagggaaggaccagcgtttccaagccgggctctggccgccggcgcgagagcgaggccaaggtctgggggcagttcagggggaccccgaagtcgggacggcccagaaacgctttgcccacagccaccgccctttcctttgtgagtttccccaaagccgtcggtgcgacccggcgccgactctcctcctcttctccctgcgagggcccgcgccgcccgggcccagtcctgggggatagatccctcggggcccaacggctgggccaccgccggtctccggccactgctgcgaggacaggcgctgcctaactaatttctcctctaagggggctgtgcgtgcgtctccttcccaac

SEQ ID NO: 117563 - DNA, 446 bp, Homo sapiens
  chr2:45029713-45030159
  Hyper
gtacacttagctactcgctcagccgcggtggcggggcccgcgcggtccctccgcagactcgcgggccgggggaggccctgctgcggcgccgcggcgtaccaagggttaagcggcgcggctcgcggccctcccggctcccctcccctgcgtgttgattttcaggcccaccgagccgcccgagaaagttttcaattcgatggggctgcagcgtctcaggggctgagctccttagaaagcttcgggggcccccgagggccgccttgcggggagggggcggctgccccgtccgggacccgctaattacagggattcggtttccccgctctgaaggaatgcattacctgcagcaaaggaggcgcggcctctcaggaaggccccgagaggaagctgaatgccccagtgcattccagccccatccctaggtttatacccgcaacctcagccca

SEQ ID NO: 117564 - DNA, 30 bp, Homo sapiens; identical to SEQ ID NO: 86537
  chr2:45034776-45034806
  Hyper

SEQ ID NO: 117565 - DNA, 143 bp, Homo sapiens; identical to SEQ ID NO: 86538
  chr2:45154224-45154367
  Hyper

SEQ ID NO: 117566 - DNA, 2555 bp, Homo sapiens
  chr2:45155125-45157680
  Hyper
ttgcttttggtgtgccggcaacttttggttgttgctgctgttgccagtgcgcttagcagagtaggaagctcgaagcgcaaagcaaccggaccgaggcagctctgccttcttgcagcccaagggtcctgcaagccgctctttctctctgcgcagcttcagcgatccaggcgcgcagggcccggctgaatgctaatttgggatacacaggagcgcaagttcaccgagttttccgcagttttgcaaatccttttccctctccccatgcctcgcggtttaagaccacgcgatttcccaaaaagaaaaactcaaaagatgccaggcgccgggctggagtcacttagagccagctctggctgctcctccgcctccccgacccccggccgccgctccgccctgcccctcgcgcctcgaccccttctcccgaaactccgtcctctccgccgaggggctgccttgcccccaacccaccccccgcgtggagaataaacacagttgacatcactcttataatctttatttaaaactgtttccaaggttacaaattgccgagcctcgtatgcaacaggttcctccaaagcggtatcattacagattaactgtaatgtgtaggattagaataaaagcataagggattaggtaaaagggcgacgctccagacataacgcccgagcgcatctcgactgagtcagcctagggagactgcgaaggcgcagggtgtcggggcgccacggggccgcaaagccggactcggttcctccgctcccggccctggccccggccccagagcggtcgggacagcggcgccggaaggccaacgcggccgaaggtttcggagccaggcttcccgggcgtcaggggctagggacgggtccccggagctggggaagatgaggggccgagaggccgtggaggcggaggacgcgggcaagccacggcccggctgggagcttcgggaagcgccgcgcccgggacgcggtctccgggcggggcgaagcgcagggaaggcggcgagggggtccccacacccgcacggggcaccgggtttgtccatgtgggtgacactgccttcaaggcccaggcccgatggggcccttcctggcgtcctcctcacccccactccgccgcgcctcccctgtccagctggggctggggacagcggcaggggctgggcagccgcgcaggccgcccgcacccttccgagcccaggcctcgggccttcgccgcccgcccaggccgtgcgccctattggaccaccttccccccggccttcgcctgcccctctcgcgccaggaaggccctggagctccctctccccctcacaccgcttcctgcggggccagggctcgccgtgctggccccatttggactcaggcctgacctgggccacggcctcaggccgctgacgcagccccgagggctgtttgcgtgttggggtggagggcgcggggctggaaaaacaaacagggcgggggcgcggaggtttggggtgggggccgcagggggctggaaggaagtgcgcagtgtggcgagagcgcgaacaaagccctctccggagccccgtcacccctcggtgaccccaggcccgccccgctgagccgcggggctcccgggcctcgcctccgagcaggccgcaccgcccggtgggcgcacgtcaggcctccgcggccgcccgggccagtgctcccctcggtccccgcaggccgagcccgcggccggccccgaaggcgcgagggacagcgcggccggcggtggagcctcactcaggcacggagcccacagagcgaggctgaggaggactccatgctgttgtccgtcgggaaaccggactactctggggcgcgctggagccaccattctgccagcagccggggaggggccgcgagggctcccaagtggacggaagtaggcgaccaacttcgccgcgactcctgcttcctagagaagggccttggctgaggaggcggcgggaggggactgttgcaaacagctgttcctcatacatatttcattacacaatcagataatgcgtcccaccaccttctcaattattcacagataaacattttcaagacgttttgacatctgtcttagtgcctgctattaatttagtaatcactgtagttaaaaatgtatgggatttttgccgtcggagcacctcgtatccggcgcgcgggcccagtgtgggactgcggctgggagcccgggccctccgggagtgaagatacctttggaggtgagacggcctctctagcgcgttgacactgttgatggaagggattaaaggggtatcaggttattttaatttattgttgaagatgatgactgccccctccccgatccgcataccgtcctcactttcccaccccaaccctagacccgacaacaccgttcagccctttgccccgggcagcggaaatggttagcttcctctaggagtttctgctgaggaaggcgcaggcaaccctagtcggcttagagagagacaaccgcacgcgatcaccgagcacgatttctcccaacaaaaaaactaacaataatagcgatccacacactca

SEQ ID NO: 117567 - DNA, 1526 bp, Homo sapiens; identical to SEQ ID NO: 86543
  chr2:45159488-45161014
  Hyper

SEQ ID NO: 117568 - DNA, 1934 bp, Homo sapiens
  chr2:45161221-45163155
  Hyper
gagaggatggggaaacgcgcgccccaagagcaaaagcaaacagctgtggaggcgctgcccgcggctcaggcttcccaacaggttagctatactgggatccacccggcatttcgcaggaaggggtggggggaagacagagcgagagggggagagaggctcacaagaggacagagggagggagggaaagagagataggagccagagagcgcaccgcgcggcttaaaaggagagacttactaatgaatatttatccgccgctgctccgtgctcccggcttcccttacctttcggcaggtaagatcctccctgtgccccagccccgggggccctcctagctccccagtcggggagcctgtggctgggcgggagggctctccgttggtgggggtgggagggcggctctactctgcgttcactttgggtgcccaggcatgcgaccctgcacgactaggaaccgcgtgcgtgggctccatgtgtggaatgagtgtgagcatgtaagagtgtgtttgtgtgtgtgcgagagagagacagagagactatgcgcccgcaagcgcgcgcgcgcgcctgtttgtggcgcgctctggaaacattttccgacttttcactcggacgccctggatttctcgcctttgcctttctctgcttcccctccctcttctctcgccctcccctcccccacccaggtctaccccaccctaccccactcctaccccggctgctgaggcgctcttctgccggctattgtacggctggcgcgggctccccctggccacatcccgggcctctcacacaagaagaatagttctgtttccgccgtaaacccccacacaaaggctgcccggccaccgggtcccctgtcccccttcccggggacttcggcttttgaggtgctgctgcgcgttctttctccctccccctctcagggcgccagggcccagaccaaggagctaagagtgatcgggacttgggggtaccgggtggaactccttgggggccgcccgccaggcttcctgggctgcaactcggagcccagagacccccaggggaagggcgcctcttcccccaccaccaccccagccgtcgcctgcgggaggagcacggggaacccggcccagccaaagggggaagagggaggggaaaaggaagaaggtcggggaggggctgaccatataaccagaattctttaaacggacttacccggccacctgttgagaatccatgtggggtcggctggctccggagttgcgcaaggtggacacacaaaaccaaaagccggagttgggaaaagaaaattctttctctgaccatgccagacgcggccggtcaggctcgcagctccgcgctaggatcgggcggctgtacaaccaagatcgactttgccctgtcccccaacgcccccctcatcccacggctccacggctgggaggctccggactcagagctcgcggactcggcgctcagggtcagcaccagcagctcggcttaagccggggcaggctctctaagccctgctcagaagtcaagagcagcagtgctgcctctcctcgccgcctttcatgccgcggccgctccttattcttgtgtctcggcctctcccggccccctcggacaaaacccccagagcccggccactctcttcccgctaaatccccttcggggtcagtgctctaccagcaccgggccgcgcgcctctcctgccagccgtgtggctcttaaagagctgcacccctcctccgccctgcgcgatcccccgacccccgcctcccctcccctctcctccggatctagccccccacgccgacgcctgaggtccctgctgccccgaccgatgcctgcggactcccagccccctcccctcgcctcctcccctgagcagccggtgggcctggcctcgaggccacagggctgagttctaccctcgcctcaggtcccct

SEQ ID NO: 117569 - DNA, 539 bp, Homo sapiens
  chr2:45164617-45165156
  Hyper
aggccgcctttgagccgtcggggcggcttcattaagctgcgctaacaaggcgtacaaatgccgagcccagcagctttcttgcaatgcccggccttagcagggcgccggactaatgagggtcactcaaaggggctgatcaaatattcaaatttccccgcacgccaggaacttttatgcatggagaaagttgaggcaactgagctgtgtttactgtccggggcgacaattgcttggagcgccagtccccggaggctaaggcggggggcgggggtgcggggagggagcagttgttgttgttgtttttcaaaggaaagtaatcggggtccttgaagggcttcgcggcctccccgcctgcgtgctgcgctcccctgcgccctccctggccgcccgcgccaagcgcctcagtttgcagcttgcggggaggcccagactacgggccacccggccagcctccgcctcccgacatcctgggagccggaaggggcgttgcccccacagggcaaaccttcccccggcctcctggtcggctgtttagagct

SEQ ID NO: 117570 - DNA, 1043 bp, Homo sapiens; identical to SEQ ID NO: 86549
  chr2:45165470-45166513
  Hyper

SEQ ID NO: 117571 - DNA, 43 bp, Homo sapiens; identical to SEQ ID NO: 86550
  chr2:45168189-45168232
  Hyper

SEQ ID NO: 117572 - DNA, 93 bp, Homo sapiens; identical to SEQ ID NO: 27186
  chr2:45168959-45169052
  Hyper

SEQ ID NO: 117573 - DNA, 926 bp, Homo sapiens
  chr2:45169287-45170213
  Hyper
gttgccaaacttcgccgattctcaccaccgctccatacttctggcgagtagcggcggcgggaacggtgcgggaggcggcggcggcgcgggaggcggcagcggcggcgggaacggtgcgggaggcggcggtgctggcggagcaggcggcggcggcggcggcggctccagggcccccccggaagagttgtccatgttccagctgcccaccctcaacttctcgccggagcaggtggccagcgtctgtgagacgctggaggagacgggcgacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctcgaggcgcactaccaggaggccgagaagctgcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggttagtggcggggcccgcggcctggctacagcctcagaggcctgggaaggggagaggggttgagatggggctagcggagcggccgctgagagccagggaagccgtgactcctggccagtcggagaaagtttccgcttgtccgggacgcgcggaagagggggccg

SEQ ID NO: 117574 - DNA, 678 bp, Homo sapiens
  chr2:45171246-45171924
  Hyper
tccccacttttccaccgccagctttcctattttctctaccctcggtcctgcgctctgcgctggcatccagagagcaaagtatgcagttctacccggagactggccgggcggtggggaacccgcagctcccggtgtgtgtttgagggagcagggacggggttactaggggaactcgaccggtcgcggggcagccggctcagtttgaagagccccagggactgcggagggaagaagcgcccggctcctctccgacttctgcttctccagggcttggcgtactttgtcgcttgcacccaggcctccccaagcggccgggctcgggttctgcctctcctccgaggccagcctctatctgagaagacttgggatgctcccgaaagcggaatggggagcggcggcgcgggggagccgggtggcgggcctctgtgtcagggcgggcgcggatctctttctcccgcaggctccagcaccaggccattggaccgagcggcatgcgctcgctggccgagcccggctgccccacgcacggctcggcagagtcgccgtccacggcggccagcccgaccaccagcgtgtccagcctgacggagcgcgcagacaccggcacctccatcctctcggtaacctccagcgactcggaatgtgatgtatgatagccaaggccgccctcctccctct

SEQ ID NO: 117575 - DNA, 271 bp, Homo sapiens; identical to SEQ ID NO: 86557
  chr2:45172153-45172424
  Hyper

SEQ ID NO: 117576 - DNA, 641 bp, Homo sapiens; identical to SEQ ID NO: 86558
  chr2:45176593-45177234
  Hyper

SEQ ID NO: 117577 - DNA, 760 bp, Homo sapiens; identical to SEQ ID NO: 86559
  chr2:45179296-45180056
  Hyper

SEQ ID NO: 117578 - DNA, 984 bp, Homo sapiens; identical to SEQ ID NO: 86560
  chr2:45181451-45182435
  Hyper

SEQ ID NO: 117579 - DNA, 487 bp, Homo sapiens
  chr2:45231112-45231599
  Hyper
cttagaaagtccaagcgaaagggtattctgattttatcccggttttaccagaaaatgctgaaaggaaaagccccgagaggacacagtgctctaggaactcggggcgccacgagcgcctcatcccctcccttccgcccggccgcggtgccctggtcgctgagggacgcggtcagtacctaccgccactgcgacccgagaagggaaagcctcaacttcttcctctcggagtcctgcccactacggatctgcctggactggttcagatgcgtcgtttaaaggggggggctggcactccagagaggagggggcgctgcaggttaattgatagccacggaagcacctaggcgccccatgcgcggagccggagccgccagctcagtctgacccctgtcttttctctcctcttccctctcccacccctcactccgggaaagcgagggccgaggtaggggcagatagatcaccagacaggcggagaaggacagga

SEQ ID NO: 117580 - DNA, 341 bp, Homo sapiens; identical to SEQ ID NO: 27198
  chr2:45231852-45232193
  Hyper

SEQ ID NO: 117581 - DNA, 61 bp, Homo sapiens; identical to SEQ ID NO: 86564
  chr2:45232401-45232462
  Hyper

SEQ ID NO: 117582 - DNA, 413 bp, Homo sapiens; identical to SEQ ID NO: 86565
  chr2:45233374-45233787
  Hyper

SEQ ID NO: 117583 - DNA, 1411 bp, Homo sapiens; identical to SEQ ID NO: 27201
  chr2:45235475-45236886
  Hyper

SEQ ID NO: 117584 - DNA, 765 bp, Homo sapiens
  chr2:45237178-45237943
  Hyper
gggcacattctaccccggcgcaggccagtgggatgggagagtttggacgtgctcgggtgccgcccaaagacttggctttttctgctgacagcgccccacccccatcctagaaactctggactcagcggtcctcgagggaaaaggggagggagtagacgaaagaaatggggaagatttggcagtggccgcaggcggacgccggagaatcgacttcccggaggatcccgcctttcctccctctcctagccccgccggctgcctggcggcctgtaccgccccaactctgcgctctctgctcctcgccgggcggggactcagacttaaccccacgggtcccacagcccgaggagcgccaggcagttccgtgtggcctctatggaagctgactccggccggcagctgcgacgcagaaccccggacggcgcagacccgcagtctgcccaccggggcgggggagaggggcgacggcagggactctaggacggtggtggggcttccccggtgggtggtcggggaggagaacggaggcaagattcccagtcctcccgcttcgccgctggggatcggctcggctcctggccactccagcctgggaaccggctcgctgagctccgggatgaggtgctttaaaagggggtcctgttttttgcttctttgtcagggtgccaatggaaacatgtggtgctggtcctgtgggagaagggctcgcacaaaggtgggagaactgaggatgggtgtgttcttgctctacgttttgaaaagccc

SEQ ID NO: 117585 - DNA, 1500 bp, Homo sapiens
  chr2:45240323-45241823
  Hyper
tccagcctataaaggcggcagaaatcccctgggtagactctggccctggcgccgcccgcctcgggcgctccatgctgctccgcacctcgggctctgggatgctccggcctggatggaggctctccgccctctcccagctccgagcgccccagccgacatgggcctggcgcgttccccagacagtcccggagttctctgggcctgggcgacgtgtttcgttgaaagcgggcaggtggtgccgggcggggctgcgctgaggctccggtgcctccccacctgcccctcgtacctgccggtctgtcgggtcccggcggacgcaaccagctactcgcaaaccctgcaccagcggttttccgtgttgtcctaagaggggcaggtcagggcgaggccagtcggctcacacgaattctctgtgtcggagaacacgccccgcgacgttccgagcccgggcaaggttgagaggcgctgggctccgggcggtcgcactcttggaaccgcgcgaaccgcggcgtcgcccgcgccgcacgtggctggggcagtcacaggccccgagagctggagcaacggggtcaccgccacccctctgccctccaggccttcaccttgagacccacgcggcagcctggagggcccacaagagcaaacggtttagaggccgcgggctcacgagggatcttgttcaaacgaaaagaacgagcacaggggctcggggccagcctggaggccggcacagaggcgagtcggcccgggtggcgccgggaccaggcgggatttggggcgggtatccgggcccgggcgctggcagcctccctgcgacccccggccctgcgtccccgcccgcggtcccgccttagtcctggagtcccttcctgggccccttcgcctgggtgcggaggggcgcgggcgcggcgggcagggccacggggcgaggggacgggctcgcggctttgggttcagggagccgcggagctccaccgccgggttgttttgcaatggggctttggagaggttgcgcgtcccgggccccatggctccgccgggtctgcacgccagcgcccccacgcggcgggcccagagttcaggccggcggggctgcgcgctcggctccccgcaggcctgtagcccaggagggagaggagggagaggacgcggagagggcccgctggttcttccctcctcaccccagcactgacccgcctgtgcgctggcacggagggctcgaaaatcggggcgcgtccgcgaagagcgagacctcggagacagacacacaacccagaggtgcactaggttgccagacggtctgatcacaggattcttggggggatagacgctggcttttctccatcacacgtttcccctgcaacgtctgggtgcccaggaaatgtttgaatggatgcctgaatgaccaatcgggtttgactgacagcaacagctgggaagtgacccggccaataggagaatggccctcttcctcctctttcctcccgctcttctctccca

SEQ ID NO: 117586 - DNA, 1141 bp, Homo sapiens; identical to SEQ ID NO: 86573
  chr2:45395854-45396995
  Hyper

SEQ ID NO: 117587 - DNA, 54 bp, Homo sapiens; identical to SEQ ID NO: 86574
  chr2:45397223-45397277
  Hyper

SEQ ID NO: 117588 - DNA, 77 bp, Homo sapiens; identical to SEQ ID NO: 86575
  chr2:45879337-45879414
  Hyper

SEQ ID NO: 117589 - DNA, 45 bp, Homo sapiens; identical to SEQ ID NO: 86576
  chr2:46525712-46525757
  Hyper

SEQ ID NO: 117590 - DNA, 237 bp, Homo sapiens; identical to SEQ ID NO: 86577
  chr2:46526002-46526239
  Hyper

SEQ ID NO: 117591 - DNA, 132 bp, Homo sapiens; identical to SEQ ID NO: 86578
  chr2:46770699-46770831
  Hyper

SEQ ID NO: 117592 - DNA, 16 bp, Homo sapiens
  chr2:47194061-47194077
  Hypo
attgtgttggccgggc

SEQ ID NO: 117593 - DNA, 160 bp, Homo sapiens; identical to SEQ ID NO: 86582
  chr2:47200582-47200742
  Hypo

SEQ ID NO: 117594 - DNA, 47 bp, Homo sapiens; identical to SEQ ID NO: 86583
  chr2:47235457-47235504
  Hypo

SEQ ID NO: 117595 - DNA, 30 bp, Homo sapiens; identical to SEQ ID NO: 86584
  chr2:47249809-47249839
  Hypo

SEQ ID NO: 117596 - DNA, 89 bp, Homo sapiens; identical to SEQ ID NO: 86585
  chr2:47335736-47335825
  Hypo

SEQ ID NO: 117597 - DNA, 185 bp, Homo sapiens; identical to SEQ ID NO: 86586
  chr2:47567513-47567698
  Hypo

SEQ ID NO: 117598 - DNA, 30 bp, Homo sapiens; identical to SEQ ID NO: 39518
  chr2:47574359-47574389
  Hypo

SEQ ID NO: 117599 - DNA, 229 bp, Homo sapiens; identical to SEQ ID NO: 86588
  chr2:47596565-47596794
  Hyper

SEQ ID NO: 117600 - DNA, 120 bp, Homo sapiens; identical to SEQ ID NO: 39519
  chr2:47597757-47597877
  Hypo

SEQ ID NO: 117601 - DNA, 180 bp, Homo sapiens; identical to SEQ ID NO: 39520
  chr2:47598297-47598477
  Hypo

SEQ ID NO: 117602 - DNA, 83 bp, Homo sapiens; identical to SEQ ID NO: 39521
  chr2:47598537-47598620
  Hypo

SEQ ID NO: 117603 - DNA, 42 bp, Homo sapiens; identical to SEQ ID NO: 86592
  chr2:47599472-47599514
  Hypo

SEQ ID NO: 117604 - DNA, 473 bp, Homo sapiens; identical to SEQ ID NO: 86593
  chr2:47748050-47748523
  Hyper

SEQ ID NO: 117605 - DNA, 40 bp, Homo sapiens; identical to SEQ ID NO: 27215
  chr2:47748726-47748766
  Hyper

SEQ ID NO: 117606 - DNA, 45 bp, Homo sapiens; identical to SEQ ID NO: 86595
  chr2:47753181-47753226
  Hypo

SEQ ID NO: 117607 - DNA, 2488 bp, Homo sapiens
  chr2:47796750-47799238
  Hyper
aaaacaggaaggaaccggtagcccttggcacgtattcttagaggagaaaacggaggctcacaaaggtcagatcacagagccggccagtgttggagcacaggcggcccggggtgagcgccagaggtgggctttcttccctcactgaaagccgggagggagagagagagagagaacgggggccggcggagaagagggcgagacgaaagtaagcaaagggacattagaagggaaggcagagccgagggacgcggaccgagcggccgagcagtggaaagggcggcaggtgaaaggcacagagaggaaagatgcgcgggggacgcgccgctcacctatggttgacaccacggtgcccacgaagtagaaggcgccggggaagtcccagcgcgggcgcagcgcgtcggcgcggacgccggcggccagcgcggcctcgtagtgccggaggaaggcgcgcagctctggctcggccacgccgtgcgcagcgctgaagttgcgcagcgtggcgccccagcgcgcccgcgcctccgcctcgccggggctctcgagcgccgagaagactgtggcacccgccaccaggtagaggccgatgagcgccgccagcagcacgaagcggccggtgtcctcgttgaggtgcgaacggcggcagcagcagcagcagcaggaggggcgcggcaggcggcggcggctacggcggggcgggggccgggggctgcgggaggacatggtccggagctcagccccggggccggggcggcgctcggggcccgggccacgacatccccccggcgggagcaggagcgtgaggatggtggccaggggtccggggccgccgcggagcccctcgccgccttcgcagagcccctcgtcgccttcccagagcccggacagaggggcgcctccgcctcctccccggcgctcaggccacacgcgagtcccgtggcccagcgggtgcccgggcaggggcgctcctctgcgcgccccgacgcctcgccggctcccgcggctccttacccgccgctctcgggcgcggggctccgcagctaggcccctgccgcccggtggccggcgtccgcggggccccgggcctcatactcctctccagacaggccgcgggctgcgggcggggtgggccgtggatcccgggcgcctaggaccgggacgcggcagcaaggcgtggagagagcccccgggggcgtcccatgaggcgttcgggatcggcgcctcctaggtgcgggctgtgcgggcagtcctgctcccgcccccggggctgagctggcggcgtcggcttcagagcctcggagccgagccgagtccggggaagcgctcctttctcagctccagccgaagagccgcccggcagggagaggcggagtcactggcgcccggggcggggtgttggggaggggtgagtagggacaggagggagggggtggagagttgggctgctgcgacgcctcccggtggctctggcggcaccaatgcggggcaccggagcaggtgtccgactgcggtgcgggctaccactccgccggggaacctcgtcttgctcctccctgcgcttcgcctctggaatctctcccttatctcatgccgcggtgaaactttgctcaagttggtggtgctctgaggtctccagggctggaggccgcgcgacgcgaatcgccgacactggattctcgggcgttagtccgaagtttaagttcccttcgttcactcctttgccctggatcgaaccgcagccccaggacgcagcgggttccactggaaacggggaatcggggagaggcggtcgctgggctccgggcgacctgggaacgagggcgtttgctccccctcccgaccgagcgggcggccggcgtcagcaccgcggacagcgcatcggtgccgcagccgcgggcgggcgccgctagggctgccaggggtccgaggcgcgggcaaggctgctcaccccgctgtgctgtgcaccccaaaccttccctgttttcctttctacctcccgtgtgcacccccctacccgccacccgaggcaggtgcggtcgctgaagcaggctgctgacagggcggggacgctgcggaatagagacgggggaggagtcaagcgcgggtagggggccaaggtgccacagggagaaagagcccaggcccggcggactgccgggctcctcgcgccaccccagctcaccgacccctctagcccggggcggggaataacaccctgggtgcggtagagagtagaggaatagaggaggtgtaggggaagctcactggcagctcccctgaggccggcgcggggaacggtgtgctatggaacgcccctgggaaatggtcgcccccctacgccccaccgcggcaggaaaagacgacggatgccccgcgcggctgcgggtgctcctctgctggacacaagccggctttgccggggccacaaaagttctggcgtggaacaccctcagtacaggcggaaaatcatcctcttcgggcagccagctcc

SEQ ID NO: 117608 - DNA, 91 bp, Homo sapiens; identical to SEQ ID NO: 86600
  chr2:48209807-48209898
  Hypo

SEQ ID NO: 117609 - DNA, 193 bp, Homo sapiens; identical to SEQ ID NO: 86601
  chr2:48323080-48323273
  Hypo

SEQ ID NO: 117610 - DNA, 182 bp, Homo sapiens; identical to SEQ ID NO: 86603
  chr2:48625247-48625429
  Hypo

SEQ ID NO: 117611 - DNA, 149 bp, Homo sapiens; identical to SEQ ID NO: 86604
  chr2:48655875-48656024
  Hypo

SEQ ID NO: 117612 - DNA, 85 bp, Homo sapiens; identical to SEQ ID NO: 86605
  chr2:48757541-48757626
  Hyper

SEQ ID NO: 117613 - DNA, 420 bp, Homo sapiens
  chr2:48982519-48982939
  Hyper
tttgatagggcaaagcgtttttctccaagcttccagggaaagggggccaaaggagtagggagggaaggtggcatagagcgatggagggtcctgcatcaagggcgccgcgacgggagcgctgtgtactcacagtcgagtgagaccggccgtggggccggggcagcgcagggcgccgtcgggcacgcagttgcagggctcagggcagagcgcctcgcgcagcgctcgtggcagcggcggctgcagcagcagcagcagcttcagcagctgcagcgccgagaaccgctgcttcatggccggcgaactgggcttctgcggcttgccagtgtcttggacggcctctgagtgcggcccgcacccctctccccgccccttggctgcccttccacacacccttccctgccggcccgcccctgccctccc

SEQ ID NO: 117614 - DNA, 19 bp, Homo sapiens
  chr2:49004570-49004589
  Hypo
tcaccggctgattgtttta

SEQ ID NO: 117615 - DNA, 149 bp, Homo sapiens; identical to SEQ ID NO: 86609
  chr2:49172411-49172560
  Hypo

SEQ ID NO: 117616 - DNA, 16 bp, Homo sapiens
  chr2:49461025-49461041
  Hypo
ccgtagtgagcaccat

SEQ ID NO: 117617 - DNA, 92 bp, Homo sapiens; identical to SEQ ID NO: 86614
  chr2:50497730-50497822
  Hypo

SEQ ID NO: 117618 - DNA, 379 bp, Homo sapiens
  chr2:50573464-50573843
  Hyper
ggtcccttagctgagcgcggcgccccatccggccactgagtgaccttctggcaactgacgcccccttcccgcggggcccagccgcgcgaccagggctggtcctttagtaggtgtccacatctctctcccagtacctcgacaaggaacgcccctcccacccctcaccaccaacacccgcgacgccttcccccatcccctttctattgtcttcaaagagataagtggctcgcaccaagcacacccaaatgcacctcccttttgtcgagctcccatttctctgagccttaggagcccaggagcgagtgcagggtagaaagaggggagcgaggggataacccgcgagaacttggcatcgcagacccaccgtgtccgcctcgca

SEQ ID NO: 117619 - DNA, 1036 bp, Homo sapiens
  chr2:50574047-50575083
  Hyper
agcccagctcggcgccgcaccggagcatcctctggtacatggcggggcgcccgccgaggggcagccgccgcgggaggcaaagtttggggcgcggggagaggagagggcgcaggggagcgggcggcgcggagtgggctgaggggccggccgcctcaccgcgccagggcacccatcctctccctccttcggacagtcttctcggggtcctggagtccgccgtgcctagcaccccaaacaatccgaaacatagccgaggcgaatgcagctggagaggggcttgtccggaaaggcagccccgggaacagcaagcgcggagcgggtggctgctcccagatttccagggctccaggttctcgagagatactcccaaagagtttcgggcgagagtgcgtgccggcgggtggggggccgagaaattgtttaaagctcctcctggaaggtcctcacttctacatgacagacatccaccgcgaatccactaggtaaatccatttagctttgtgtgcggggactagggaggccacttcgccggcccaacctcctttcaagacagaagcagaccccatggaatccaggcgccccttccctccattcagccccggccggctcgcccgctagcgccagcctcccccgggcagcgcgcggagcagcggcgcgcatcgcctgctcccgaggcaatctccgcgtccgccgcctcctgacacttacgcccggcgaggggttcagagggaagagtgcgcccttctgaaggaagtgggaatcgaacggcggaaaggcagctgagaagaagatgcagacgaaggagtaagggagagaaacagaaaaagaaaaagaaaaagaaaaaaagaaaagaaaaaccacacacgctggtgaagcaaggggctctatgcaaatctgcagtctccaaacagcaaatcactgaagctcggatgcaatgcagaggacgagcctatgtaacgagggaggctggtctagcttcccacgaaaatcgccctgctttgcctctcccttgcattctccacgcatcaaagggaca

SEQ ID NO: 117620 - DNA, 305 bp, Homo sapiens; identical to SEQ ID NO: 86620
  chr2:51259261-51259566
  Hyper

SEQ ID NO: 117621 - DNA, 67 bp, Homo sapiens; identical to SEQ ID NO: 86622
  chr2:52798706-52798773
  Hypo

SEQ ID NO: 117622 - DNA, 132 bp, Homo sapiens; identical to SEQ ID NO: 86623
  chr2:52856761-52856893
  Hypo

SEQ ID NO: 117623 - DNA, 66 bp, Homo sapiens; identical to SEQ ID NO: 86624
  chr2:53241890-53241956
  Hypo

SEQ ID NO: 117624 - DNA, 30 bp, Homo sapiens; identical to SEQ ID NO: 86625
  chr2:53743692-53743722
  Hypo

SEQ ID NO: 117625 - DNA, 82 bp, Homo sapiens; identical to SEQ ID NO: 86626
  chr2:54951713-54951795
  Hyper

SEQ ID NO: 117626 - DNA, 199 bp, Homo sapiens; identical to SEQ ID NO: 86627
  chr2:54952233-54952432
  Hyper

SEQ ID NO: 117627 - DNA, 62 bp, Homo sapiens; identical to SEQ ID NO: 86629
  chr2:55289153-55289215
  Hypo

SEQ ID NO: 117628 - DNA, 82 bp, Homo sapiens; identical to SEQ ID NO: 86630
  chr2:55458383-55458465
  Hypo

SEQ ID NO: 117629 - DNA, 30 bp, Homo sapiens; identical to SEQ ID NO: 86631
  chr2:55554706-55554736
  Hypo

SEQ ID NO: 117630 - DNA, 30 bp, Homo sapiens; identical to SEQ ID NO: 86632
  chr2:55646190-55646220
  Hyper

SEQ ID NO: 117631 - DNA, 30 bp, Homo sapiens; identical to SEQ ID NO: 86633
  chr2:55646428-55646458
  Hyper

SEQ ID NO: 117632 - DNA, 96 bp, Homo sapiens; identical to SEQ ID NO: 86634
  chr2:55652969-55653065
  Hypo

SEQ ID NO: 117633 - DNA, 21 bp, Homo sapiens
  chr2:55669245-55669266
  Hypo
tggagccaagatggccgaata

SEQ ID NO: 117634 - DNA, 28 bp, Homo sapiens
  chr2:55874935-55874963
  Hypo
gcgtgagccaccgcgcccagcagacatt

SEQ ID NO: 117635 - DNA, 638 bp, Homo sapiens; identical to SEQ ID NO: 86637
  chr2:56149809-56150447
  Hyper

SEQ ID NO: 117636 - DNA, 455 bp, Homo sapiens; identical to SEQ ID NO: 86638
  chr2:56150698-56151153
  Hyper

SEQ ID NO: 117637 - DNA, 21 bp, Homo sapiens
  chr2:56263732-56263753
  Hypo
ccacagcgcctggccagatat

SEQ ID NO: 117638 - DNA, 253 bp, Homo sapiens; identical to SEQ ID NO: 86641
  chr2:56411000-56411253
  Hyper

SEQ ID NO: 117639 - DNA, 270 bp, Homo sapiens; identical to SEQ ID NO: 86642
  chr2:56411529-56411799
  Hyper

SEQ ID NO: 117640 - DNA, 72 bp, Homo sapiens; identical to SEQ ID NO: 86643
  chr2:56412255-56412327
  Hyper

SEQ ID NO: 117641 - DNA, 29 bp, Homo sapiens
  chr2:58269102-58269131
  Hypo
acaagtatcgattgacgtcttctgtctcc

SEQ ID NO: 117642 - DNA, 30 bp, Homo sapiens; identical to SEQ ID NO: 5265
  chr2:58614664-58614694
  Hypo

SEQ ID NO: 117643 - DNA, 166 bp, Homo sapiens; identical to SEQ ID NO: 39527
  chr2:58641373-58641539
  Hypo

SEQ ID NO: 117644 - DNA, 168 bp, Homo sapiens; identical to SEQ ID NO: 86661
  chr2:58654927-58655095
  Hyper

SEQ ID NO: 117645 - DNA, 203 bp, Homo sapiens; identical to SEQ ID NO: 86662
  chr2:58655428-58655631
  Hyper

SEQ ID NO: 117646 - DNA, 254 bp, Homo sapiens; identical to SEQ ID NO: 86663
  chr2:58655979-58656233
  Hyper

SEQ ID NO: 117647 - DNA, 166 bp, Homo sapiens; identical to SEQ ID NO: 86666
  chr2:58943963-58944129
  Hypo

SEQ ID NO: 117648 - DNA, 30 bp, Homo sapiens; identical to SEQ ID NO: 86667
  chr2:59140038-59140068
  Hypo

SEQ ID NO: 117649 - DNA, 30 bp, Homo sapiens; identical to SEQ ID NO: 86668
  chr2:59145084-59145114
  Hypo

SEQ ID NO: 117650 - DNA, 18 bp, Homo sapiens
  chr2:59269708-59269726
  Hypo
tgtcgcatttactaacat

SEQ ID NO: 117651 - DNA, 209 bp, Homo sapiens; identical to SEQ ID NO: 86670
  chr2:59273588-59273797
  Hypo

SEQ ID NO: 117652 - DNA, 30 bp, Homo sapiens; identical to SEQ ID NO: 86671
  chr2:59393002-59393032
  Hypo

SEQ ID NO: 117653 - DNA, 103 bp, Homo sapiens; identical to SEQ ID NO: 86672
  chr2:59479352-59479455
  Hypo

SEQ ID NO: 117654 - DNA, 82 bp, Homo sapiens; identical to SEQ ID NO: 86675
  chr2:60411668-60411750
  Hypo

SEQ ID NO: 117655 - DNA, 172 bp, Homo sapiens; identical to SEQ ID NO: 86676
  chr2:60442223-60442395
  Hypo

SEQ ID NO: 117656 - DNA, 30 bp, Homo sapiens; identical to SEQ ID NO: 86677
  chr2:60687883-60687913
  Hypo

SEQ ID NO: 117657 - DNA, 110 bp, Homo sapiens; identical to SEQ ID NO: 14414
  chr2:60705907-60706017
  Hypo

SEQ ID NO: 117658 - DNA, 30 bp, Homo sapiens; identical to SEQ ID NO: 86679
  chr2:60706520-60706550
  Hypo

SEQ ID NO: 117659 - DNA, 217 bp, Homo sapiens; identical to SEQ ID NO: 86680
  chr2:60706757-60706974
  Hypo

SEQ ID NO: 117660 - DNA, 30 bp, Homo sapiens; identical to SEQ ID NO: 86681
  chr2:60732287-60732317
  Hypo

SEQ ID NO: 117661 - DNA, 30 bp, Homo sapiens; identical to SEQ ID NO: 39533
  chr2:60733708-60733738
  Hypo

SEQ ID NO: 117662 - DNA, 98 bp, Homo sapiens; identical to SEQ ID NO: 86683
  chr2:60780399-60780497
  Hyper

SEQ ID NO: 117663 - DNA, 153 bp, Homo sapiens; identical to SEQ ID NO: 86684
  chr2:60784352-60784505
  Hyper

SEQ ID NO: 117664 - DNA, 453 bp, Homo sapiens; identical to SEQ ID NO: 86685
  chr2:60796196-60796649
  Hyper

SEQ ID NO: 117665 - DNA, 633 bp, Homo sapiens; identical to SEQ ID NO: 86686
  chr2:60796709-60797342
  Hyper

SEQ ID NO: 117666 - DNA, 30 bp, Homo sapiens; identical to SEQ ID NO: 14415
  chr2:60887794-60887824
  Hypo

SEQ ID NO: 117667 - DNA, 299 bp, Homo sapiens; identical to SEQ ID NO: 86688
  chr2:60962750-60963049
  Hyper

SEQ ID NO: 117668 - DNA, 22 bp, Homo sapiens
  chr2:61135115-61135137
  Hypo
cacgccccgccttatttgtact

SEQ ID NO: 117669 - DNA, 76 bp, Homo sapiens; identical to SEQ ID NO: 86691
  chr2:61231438-61231514
  Hypo

SEQ ID NO: 117670 - DNA, 15 bp, Homo sapiens
  chr2:61231814-61231829
  Hypo
cgaagtgaaccataa

SEQ ID NO: 117671 - DNA, 204 bp, Homo sapiens; identical to SEQ ID NO: 86693
  chr2:61406160-61406364
  Hypo

SEQ ID NO: 117672 - DNA, 80 bp, Homo sapiens; identical to SEQ ID NO: 86694
  chr2:61992300-61992380
  Hypo

SEQ ID NO: 117673 - DNA, 30 bp, Homo sapiens; identical to SEQ ID NO: 86695
  chr2:62116817-62116847
  Hypo

SEQ ID NO: 117674 - DNA, 56 bp, Homo sapiens; identical to SEQ ID NO: 39538
  chr2:62409597-62409653
  Hypo

SEQ ID NO: 117675 - DNA, 82 bp, Homo sapiens; identical to SEQ ID NO: 86697
  chr2:62497735-62497817
  Hypo

SEQ ID NO: 117676 - DNA, 150 bp, Homo sapiens; identical to SEQ ID NO: 86698
  chr2:62589735-62589885
  Hypo

SEQ ID NO: 117677 - DNA, 147 bp, Homo sapiens; identical to SEQ ID NO: 86699
  chr2:62652367-62652514
  Hypo

SEQ ID NO: 117678 - DNA, 32 bp, Homo sapiens; identical to SEQ ID NO: 86700
  chr2:62732906-62732938
  Hyper

SEQ ID NO: 117679 - DNA, 30 bp, Homo sapiens; identical to SEQ ID NO: 86701
  chr2:62764362-62764392
  Hypo

SEQ ID NO: 117680 - DNA, 199 bp, Homo sapiens
  chr2:62798327-62798526
  Hyper
agacgccgcccgtgccgtgtcaggttgtccccgagtgcgcttgccgtgagtttctgccgcgtgactcacccgtgtccctcgctctcagccatcggaacagcagaagcgggtcggggagagcgcgctgccctgacacctgcaccccatccccacctccaactccatctccagaatttagccttcgcggagcccagcggct

SEQ ID NO: 117681 - DNA, 30 bp, Homo sapiens
  chr2:63275056-63275086
  Hyper
cctggtcagatccctcggcctcagatccaa

SEQ ID NO: 117682 - DNA, 1188 bp, Homo sapiens
  chr2:63275304-63276492
  Hyper
tggacatttgcctagcgacggccgcctcaatcctctgcgctgctttcaagaaactttcatcccagtctctctccctctccactctcctccctctccccctctcctctttcttttcttaatcctggggttttatgggctgagcgttaagaaaattcgcctgcaatttgggattagataaatactctaattaggaaaaaaaaaatccgtgctacttgatacctcccaacttccccgagaatggtggcagcatctggaaccgagagcgccggcctcccgcgaggcgtaccccggggaccgcgctggcacattccagagcgcactgccgtcccacctcgctgcgccggacccaggtcaggtgctgaggctgcaggcgaaacagggcctggtggagggaggaatgagttaaggtggaggaatggggcaaggtcacgcgccccggcactggagggccaaccccggcacacagcggactggccgggactagggcagcgccgggctatggacgcggacgccggcgaagcgcaccccgggacgtccgcatattctttcccccaaaactagtgcgctccagccggcgcctttcctcggaacctaaggaaggggtatatttcgttgctttctttaaacctcagcacgatcacagtggctccgagccgcgggcggctgaccgcgggcctcgcgggctactcctggtaggggcctgcgcgagcctaaggtgtgtccccgcctgggttagcgctgcgctctgcactgtttcttttcctcttaaagcttctttctcactcactctctccctccttctctctctcattttttccccatttctctcgttcttttattcagctttctctctttctctcccttttgtgaatgggccgcggtgtctttgttctgtagagaagcgcccgtgtcgctgacttttgtgaaccagagaaggatcttgtaaaacctccttttctccttcgtacgcccccactcccacccctcctcccctgcctctttgattagatgttccctcatcgtcaaaaaaaaaatgtaatttcgttggtctggcggccactttctttgaacattagctcgctttcagctccaacttcaattagaaggagttgattttgagagatcaacaaaagaaccgaccaaagccttattaaaggtcctaagaagatctcccgggtcctttgagaa

SEQ ID NO: 117683 - DNA, 442 bp, Homo sapiens
  chr2:63278633-63279075
  Hyper
ctcccccgcctcctccgaagtaaccaagctgaagtgctaagtttggagaaagtctttgaaaactcacgctgcagcttcgcaaagccgtcgcagctttgagtcccattttccttcggccctagagccctggctgcttcccttccggtccccttcctacaagctggactccctcagcccaggtcttgggtcccagaagacgggggcgggaacggggctggggggagcttctttagctctaacttctctccttgaacgtcctagcccgagtccctggcttgcttcacagcgatcccgctaagcggggtgtagcgatggccccccagggccccaggcccagtttccagcgcccctccctgacccctgagagtggcaccccgggttcccggcagcggcgggggcgaggcttcgacctcccagctcgggtctgcgtgggctacgccgc

SEQ ID NO: 117684 - DNA, 49 bp, Homo sapiens; identical to SEQ ID NO: 86707
  chr2:63280496-63280545
  Hyper

SEQ ID NO: 117685 - DNA, 699 bp, Homo sapiens; identical to SEQ ID NO: 166
  chr2:63280952-63281651
  Hyper

SEQ ID NO: 117686 - DNA, 325 bp, Homo sapiens
  chr2:63282650-63282975
  Hyper
cgccgcgccaaatgccgccagcagcagcagagcgggagcggaaccaagagccgcccagccaagaagaagtcctctccagtgcgggagagctcgggctccgaaagcagtggccaattcacgccgccagctgtgtccagctctgcctcgtcctctagctcggcgtccagctcttccgccaacccagcggctgcagcggctgcgggactaggtgggaacccggtggcggccgcgtcgtcgctgagtacaccagctgcctcatctatctggagcccggcctccatctcgccaggctcagcgcccgcgtccgtgtcggtgccggagccat

SEQ ID NO: 117687 - DNA, 30 bp, Homo sapiens; identical to SEQ ID NO: 86710
  chr2:63283512-63283542
  Hyper

SEQ ID NO: 117688 - DNA, 461 bp, Homo sapiens; identical to SEQ ID NO: 86711
  chr2:63283790-63284251
  Hyper

SEQ ID NO: 117689 - DNA, 41 bp, Homo sapiens; identical to SEQ ID NO: 86712
  chr2:63284311-63284352
  Hyper

SEQ ID NO: 117690 - DNA, 2768 bp, Homo sapiens
  chr2:63284558-63287326
  Hyper
gtctaagcacagggtcgcagttccagtttacaaacctaaaacaagaaaaccaaaaccagggaacaaaacaacaaaacaaaacaaaatccgtaaaagtacagcattagggaaaaacaaacaaacccaggccccaaacccagttccaactcctctgtcggcttctctctttcaacacccttgttttgtctagtgagtttttagtgcaccttcgttctccgaaatctgcggagagcccgcgcgcctgtgtatcaattttggctttggccgcttcgtccagtaggtgggaaagtaatttgtaaatttgatttgtctgatgtgaagatcacaaattacttgttgaaatgtaaggcagtccccctcctcctctttatctacattacttcccgaaaataaatgcaaattaatgaacggcttgtcagtgttgctcttctgattccagcccgaggtcctggtctcggggggctaaaagcgagggaaactccgtgttaataacccgcgtgttaatgacctgcgtgaagctggaggccaaaggatgaggcgggaggacttggcaagagaagtccccagaaactttcgcttagggagtgtctccccccacccccaccacgcccctccgcgtcagcctggcctcttcccccaggcgttttgaccccgcatcccccctcgccatccaggacagagacaggtgtcaggactcaattcccgaagcaattcctttctcttcagaggcaggagcctggcactgatttcttcaccctaattgcctgcaccagaaagaagagggggaggggaagagggtcgggaggcgggaaaggatagctctgtaatgctctcagagctgagccaaaaaggaaaagaaagcaaaacgacaaaaaactgatccgtgtcctgcatgttggcagcagacaaccttccttgctgctgagctgtcccgggtggcttcaccgcggctggggaatccgagccattccttccacgtgctaagatgtccctctaagccctcagctcctgccagaagtagccaaattacctttcttcgtactgtaaacttcctttaaaacatacaaactcataacctggaaaagtcgacaaggacgcctttcactttggcaggggaagaagacgactggcttgcatctgggggtcaggaaggacagttccatctccctctgagggaagacggggttgaggggtaatcctcccccagaaaatgcagagcctggaactgtccagactctggcctgaaacctcctgggtgtaaggccatgaatctgctcgacttgctcacgggcgggaaggaaacaaggaaacaacgaaaagtttcctgcgaagtgaccaacatcccctattttttaaaaattccgtgtgagacctgagaacacactgtgaagcggggttcggagaacgacccctcccgcgttccgcgcccagcggggtcgcagggctgcgagcccggctgtagcaaagctttctcggccgcgtcctccctccggattcggtaggccaggctcgggcgcgcccttcccacaccaacaaaccatctttcccgactcagcagaggcccacaggggcgcagccgctgtccctccgcccttggcccagcggcgccgccctggtacgccaggcctgaaggcagggccggcccgcgccacgcagggtctcccttaggcggcgccttagggtgaaatgcggggccaagcctgacctgccggggtgccccgtggcatctctggtgcggaccccgcacgtgccggggagaactggcaggcggccagggcgaggaggcttccagcttgcgccgcactggcctgggcacccgggctgcagggccttttgggccctcccctcagtgaccctgcctgtagcggccccagggccgctttggctcaggcagcagctgccaatgccgctcgaggcccgcggctccctgaggcgagctctgcggggcccagcagtcctcttggctgctaaatggaacgaaaccaggagacccggctttgcactcgtttggacaactgtgtggcctccggagcaaggtacccaaacccttgggcctcagtttcgtcgcagttgttatttgaacccactcggcctgggacgtgccagagcttcacactttaggtcgcggctgcgggcgggaggggcagatgcgacccctgggccggcccctcgggggcgtctagaagcttcggcacctgcatactaaggccggagggggctggcagccaggcacaccgaggcccggccggagttcccgcccggggaacgaggcttcgaaaagaggcacgtgcttctcccagggcctcccgccaggtgctgaaaccccacggcactgagtggaaaccggaagagggaaggcgcccagggcctgccgggccgcggcgccacctgaggctgccgggacgctggagcgtgggggagtggggtgagtgcgctgccgggccgggggcggcgggggacggcgggaggtggccaggcccggcagggtgagggcgctggcgttggccgagagtccctgggcagcggcggcgggaacgcggaaggttccctccacccccaccccaacccccacccccacccccgggccggccacctgttgacaggcaggttctctgagaaccgacttcagctcgcccttctgtccaggaagtttgttcggtttgggtttgggtgttcgtgacacaatcggagcaattagaattgaagcaacttcaggagatttagcaacccgcgaaaatttagcaacgttcagacgtcaacagttttct

SEQ ID NO: 117691 - DNA, 164 bp, Homo sapiens; identical to SEQ ID NO: 86718
  chr2:64348216-64348380
  Hypo

SEQ ID NO: 117692 - DNA, 30 bp, Homo sapiens; identical to SEQ ID NO: 86719
  chr2:64372072-64372102
  Hypo

SEQ ID NO: 117693 - DNA, 196 bp, Homo sapiens; identical to SEQ ID NO: 86720
  chr2:64455465-64455661
  Hyper

SEQ ID NO: 117694 - DNA, 146 bp, Homo sapiens; identical to SEQ ID NO: 86722
  chr2:64835504-64835650
  Hypo

SEQ ID NO: 117695 - DNA, 710 bp, Homo sapiens
  chr2:64836207-64836917
  Hyper
gtccgcctggacactcgggagtgaaggcgtgacaggcctcagccggccgtccctcctcgcgcctctgccccgggggacgcacgaggaccagaaagccgagggggcgcagggcctgctctggccgccgggcccgggatgccaggatgcggggggccggggctgccggtgctcttgggggcagggggaagctccgctccctctacagaggacaaccgccccgccgccccggcagcctccgaggcgccctctccgcgcttcactctcggccgctcccccggagccacgcgagccggtcgtggcggctggacccgagcctgggagcctgcaggcggccgcgccgcgctgcgctgccgaaccgcccggagccgcaggtccgccgcccgcccgctcgggggcgccccagcttccggcctccggcggcttccgcgtcgcgctcccaaggcccggcggccgcgccaggtcccctcggcgccccccgtcccctctgccgggcgctcgcccccgcctccaccctgggatctgagcccgggccgtctccccgcggcgccgcgcctgacggtcactctctctgacctcctgggcccagtcctggggccaagagccgcatccccggggaccttggtagaaaaatatgcggctcctgtagccacccaagatcttctggatgagaacccctgcaccagcagactgggtgtcgtggacctccaagc

SEQ ID NO: 117696 - DNA, 30 bp, Homo sapiens; identical to SEQ ID NO: 86726
  chr2:64854140-64854170
  Hypo

SEQ ID NO: 117697 - DNA, 103 bp, Homo sapiens; identical to SEQ ID NO: 86728
  chr2:65413481-65413584
  Hypo

SEQ ID NO: 117698 - DNA, 45 bp, Homo sapiens; identical to SEQ ID NO: 86729
  chr2:65794624-65794669
  Hypo

SEQ ID NO: 117699 - DNA, 30 bp, Homo sapiens; identical to SEQ ID NO: 39543
  chr2:65868490-65868520
  Hypo

SEQ ID NO: 117700 - DNA, 30 bp, Homo sapiens; identical to SEQ ID NO: 39544
  chr2:66561514-66561544
  Hypo

SEQ ID NO: 117701 - DNA, 86 bp, Homo sapiens; identical to SEQ ID NO: 86733
  chr2:66652616-66652702
  Hyper

SEQ ID NO: 117702 - DNA, 1028 bp, Homo sapiens
  chr2:66653022-66654050
  Hyper
tctcagtagtgtccccggctgtctcctttcctccgtctcccggtcctctcccagcgtcacccctcactacctatacccccgcgccctacccccacctggggcgctgggttccacgcctcctcaagaggtgtgagcgcccgcgctgggcgcccgtagcgcggccctcctgtgtccccacttccacccggcggccgctggaagccgggagaaggaacggcaccaatcccctcacgcttctcccaggacgtctgatcccattagcgcacctgaaatcacaaccttggccacaaatgcgcgcttgttgcgacccctccgagtgggccgccgtgccgcaggagccactctggggccggggtccccaacctctcccccctgcaagtcctaaaaggaatcgtagagcaattgatctcggaggagatgagcgcaccccggggctcattgctgcccctgaggaagagccgtccaggaacggaggcgagaagcttccagaattaggccaagaggcaggtggcggggtgatccggcgtccccgagtccagctggggagaaaggcgccctcggatgctcagccccaaagcagcagaagacagaagccggtgcgccatcgtcgctgcgccccagtccgcgggtcctcgcgctcctgctccggctcccgggctgccacccaccgctgcccaagcctgaccaactcccaactccctccggcacaggctgaggcgacccccaaagagaaaaataggatcgcagtcaaaactggcggggatggggcacactggtgggagaggggaccttttcaccttttgctcttcccaggggacacagtcccccaaacctacgtccctgcgccaaaccaggtgcgagcaaactccgcggaccccgcagctggaagtgcatcctgccgggacccccacccgacccagggagtcagcgcgccccagggtgcaggcaggcccagggctctgggtggctcagggcacggggaccggatcgcgctgcagaacaccgccgggacccggcacccggacgcg

SEQ ID NO: 117703 - DNA, 351 bp, Homo sapiens; identical to SEQ ID NO: 86736
  chr2:66659963-66660314
  Hyper

SEQ ID NO: 117704 - DNA, 126 bp, Homo sapiens; identical to SEQ ID NO: 86737
  chr2:66660578-66660704
  Hyper

SEQ ID NO: 117705 - DNA, 72 bp, Homo sapiens; identical to SEQ ID NO: 86738
  chr2:66801890-66801962
  Hyper

SEQ ID NO: 117706 - DNA, 353 bp, Homo sapiens; identical to SEQ ID NO: 86739
  chr2:66802594-66802947
  Hyper

SEQ ID NO: 117707 - DNA, 457 bp, Homo sapiens; identical to SEQ ID NO: 86740
  chr2:66803297-66803754
  Hyper

SEQ ID NO: 117708 - DNA, 1042 bp, Homo sapiens
  chr2:66808525-66809567
  Hyper
agacaaaagggggagcgatgcaggtctgtttgttttctttccccgccgccccactgtcccttttctcgtctccccgcgcacctccccagacgccctgccggggtggctccgcggatgaggcggtcatttgctgtccgctttgcggggacgggtcactttccgcgctggcgtgaaagcaaatgtggagctgcttttggaaggcgccggccggacgtcggctaggctccttctccccgcgggctgggggccctggggctctgcaaggctctggctccgaacagattgcgcctcccgcctggctgccagtaggaactggggtgggagccgcgtaactaacagttgcgcgcaggaggcgagccccaggtgtgagcgcagaggctctctccccagcccgcgggtctgggaacctttcaggacgcctccctccccaactcctacccatgcgtctgctccctaggccgagcccccctcgtgaggttttaatgaccgcggacgcaggggagcccgcacttgagcgaggaccgacttctctggcgggtccacgctgctcgcgcttgcgtccgcgggtagcgcgctgtgcccgggtcagggggcgagctgcgagaagtaggaggggtcaagacccccagaaatccctccatgggcacacacacaatcaagaatagggttgagggtcttgagaggtagaactaccctaggcagggcttctccaactcggcctttggaccccgcgcgcgcccaagggcgtgcccaccgcggaagcacagatcatcttcccgggactgggtctcctggaccctgcgttgctccctttttcctagcggccccgtagctggctgccgcatgtagggcgatcttcattaacttggacgcccaacgtgattgaaatagagaggaggaaaaaacacatttgatctgggccgaccctttgtcttgaagcagattaggcagcctagaaataggaggaaaaacagaaagtctaggcaggaaaacttattgtgttcacaacatataaaaatgatccgagcggtctggtacctca

SEQ ID NO: 117709 - DNA, 39 bp, Homo sapiens; identical to SEQ ID NO: 39545
  chr2:67625453-67625492
  Hypo

SEQ ID NO: 117710 - DNA, 38 bp, Homo sapiens; identical to SEQ ID NO: 39546
  chr2:67625732-67625770
  Hypo

SEQ ID NO: 117711 - DNA, 30 bp, Homo sapiens; identical to SEQ ID NO: 86745
  chr2:67626227-67626257
  Hypo

SEQ ID NO: 117712 - DNA, 39 bp, Homo sapiens; identical to SEQ ID NO: 39547
  chr2:68530252-68530291
  Hypo

SEQ ID NO: 117713 - DNA, 39 bp, Homo sapiens; identical to SEQ ID NO: 39548
  chr2:68537171-68537210
  Hypo

SEQ ID NO: 117714 - DNA, 1048 bp, Homo sapiens
  chr2:68546222-68547270
  Hyper
tccaacccccgggcccgctgggagcggcgcgaggccagaggcccttgagaggctcgggctgtcctgggggcctcagtcctctgcctgtaccccatgggggaccctgctgccaccaggcgccccgcactcactcgacctgcagcgtgctgggtttaatcttcacctcaaccttgtaggaggagccggtgagcagcttgatggtgcggttctggccgaagcgctgcccgtccaccttgtaaaagaccgggccgtcattaggctggatgcgcagcgcgatggagaggcgcacgaggcccggcaggtcccccatgtctgggcgagggtctggcgcggcggctccggggggcggaggacagcgccggctgcggccgagtggctggagcgcgaggggcggagaggaagcgcggggagggtgagggaggtggtggagctgaggctgccgctaggaacccgcgccgtcgccgccgtccgcccgggcttttgaggagcagctccttaggctgtggcccccctccccactcggcgaggaagcgggcccaagagacggctccaaggccgcgcgcttccccatcccccgctccagtgctgcgccctccacgcacccgaaggctcgctctggcccgcaggccgccgcgcagatccgcgcagctgggggcgagggagttaatcctgtttacgcaccacaatccccttcagctggggaagcggacatttaggctcctcctagaacagccccgggcaggaggaggagaggtttgggaggcactgggaaggcgctggagttaagcgaccactatgccaaggagcgagacccccggaatctggataccgcctcggccagctacgtgaggtggacactgctgctcgcggatccggcgccagccaggcgggaggaggctgagggggggtaaagggaggcgggaaggggggacaggaaaccgctagccggtgatttaaatttcaggaaatatgagtctttccaaagcttaggggaaatggccgaggaaaggcgcaattccacgtgatggagccacgctggatgaggaat

SEQ ID NO: 117715 - DNA, 138 bp, Homo sapiens; identical to SEQ ID NO: 86753
  chr2:68559325-68559463
  Hypo

SEQ ID NO: 117716 - DNA, 17 bp, Homo sapiens
  chr2:68561789-68561806
  Hypo
gggcatggtggctctcg

SEQ ID NO: 117717 - DNA, 249 bp, Homo sapiens; identical to SEQ ID NO: 39549
  chr2:68672689-68672938
  Hypo

SEQ ID NO: 117718 - DNA, 51 bp, Homo sapiens; identical to SEQ ID NO: 86757
  chr2:68674579-68674630
  Hypo

SEQ ID NO: 117719 - DNA, 276 bp, Homo sapiens; identical to SEQ ID NO: 86758
  chr2:68675493-68675769
  Hypo

SEQ ID NO: 117720 - DNA, 732 bp, Homo sapiens; identical to SEQ ID NO: 86759
  chr2:68870336-68871068
  Hyper

SEQ ID NO: 117721 - DNA, 87 bp, Homo sapiens; identical to SEQ ID NO: 86760
  chr2:68882389-68882476
  Hypo

SEQ ID NO: 117722 - DNA, 30 bp, Homo sapiens; identical to SEQ ID NO: 86761
  chr2:68979044-68979074
  Hyper

SEQ ID NO: 117723 - DNA, 30 bp, Homo sapiens; identical to SEQ ID NO: 86762
  chr2:69171628-69171658
  Hypo

SEQ ID NO: 117724 - DNA, 139 bp, Homo sapiens; identical to SEQ ID NO: 39551
  chr2:69182056-69182195
  Hypo

SEQ ID NO: 117725 - DNA, 652 bp, Homo sapiens; identical to SEQ ID NO: 86764
  chr2:69240068-69240720
  Hyper

SEQ ID NO: 117726 - DNA, 40 bp, Homo sapiens; identical to SEQ ID NO: 27267
  chr2:69241225-69241265
  Hyper

SEQ ID NO: 117727 - DNA, 469 bp, Homo sapiens; identical to SEQ ID NO: 86767
  chr2:69533515-69533984
  Hyper

SEQ ID NO: 117728 - DNA, 125 bp, Homo sapiens; identical to SEQ ID NO: 86768
  chr2:69534538-69534663
  Hyper

SEQ ID NO: 117729 - DNA, 141 bp, Homo sapiens; identical to SEQ ID NO: 39552
  chr2:69720070-69720211
  Hypo

SEQ ID NO: 117730 - DNA, 95 bp, Homo sapiens; identical to SEQ ID NO: 39553
  chr2:69914132-69914227
  Hypo

SEQ ID NO: 117731 - DNA, 37 bp, Homo sapiens; identical to SEQ ID NO: 86772
  chr2:69990379-69990416
  Hypo

SEQ ID NO: 117732 - DNA, 30 bp, Homo sapiens
  chr2:70055440-70055470
  Hypo
tcagacattagtccacggggaccctcaaac

SEQ ID NO: 117733 - DNA, 20 bp, Homo sapiens
  chr2:70140798-70140818
  Hypo
attcttggccgggtgcggtg

SEQ ID NO: 117734 - DNA, 38 bp, Homo sapiens; identical to SEQ ID NO: 86776
  chr2:70203999-70204037
  Hypo

SEQ ID NO: 117735 - DNA, 127 bp, Homo sapiens; identical to SEQ ID NO: 86778
  chr2:70313348-70313475
  Hyper

SEQ ID NO: 117736 - DNA, 67 bp, Homo sapiens; identical to SEQ ID NO: 86779
  chr2:70351496-70351563
  Hyper

SEQ ID NO: 117737 - DNA, 48 bp, Homo sapiens; identical to SEQ ID NO: 14421
  chr2:70364215-70364263
  Hypo

SEQ ID NO: 117738 - DNA, 94 bp, Homo sapiens; identical to SEQ ID NO: 86783
  chr2:70367805-70367899
  Hypo

SEQ ID NO: 117739 - DNA, 25 bp, Homo sapiens
  chr2:70418602-70418627
  Hypo
aaaaatcgcccgagattttctacat

SEQ ID NO: 117740 - DNA, 25 bp, Homo sapiens
  chr2:70418457-70418482
  Hypo
acttgagttgctggacgtggtggct

SEQ ID NO: 117741 - DNA, 28 bp, Homo sapiens
  chr2:70430867-70430895
  Hypo
ccgatgggttacctccgcttgtcaatac

SEQ ID NO: 117742 - DNA, 23 bp, Homo sapiens
  chr2:70466510-70466533
  Hypo
actgcgcccggccaataaagggt

SEQ ID NO: 117743 - DNA, 25 bp, Homo sapiens
  chr2:70477736-70477761
  Hypo
gtgatgtcggctgagcggggcggct

SEQ ID NO: 117744 - DNA, 30 bp, Homo sapiens; identical to SEQ ID NO: 39557
  chr2:71270959-71270989
  Hypo

SEQ ID NO: 117745 - DNA, 30 bp, Homo sapiens; identical to SEQ ID NO: 86792
  chr2:71272757-71272787
  Hypo

SEQ ID NO: 117746 - DNA, 79 bp, Homo sapiens; identical to SEQ ID NO: 86793
  chr2:71355038-71355117
  Hypo

SEQ ID NO: 117747 - DNA, 439 bp, Homo sapiens; identical to SEQ ID NO: 86794
  chr2:71453947-71454386
  Hyper

SEQ ID NO: 117748 - DNA, 85 bp, Homo sapiens; identical to SEQ ID NO: 86795
  chr2:71455203-71455288
  Hypo

SEQ ID NO: 117749 - DNA, 41 bp, Homo sapiens; identical to SEQ ID NO: 86796
  chr2:71502899-71502940
  Hypo

SEQ ID NO: 117750 - DNA, 918 bp, Homo sapiens; identical to SEQ ID NO: 86797
  chr2:71503413-71504331
  Hyper

SEQ ID NO: 117751 - DNA, 88 bp, Homo sapiens; identical to SEQ ID NO: 86798
  chr2:71504730-71504818
  Hyper

SEQ ID NO: 117752 - DNA, 51 bp, Homo sapiens; identical to SEQ ID NO: 86799
  chr2:71622692-71622743
  Hypo

SEQ ID NO: 117753 - DNA, 558 bp, Homo sapiens; identical to SEQ ID NO: 27271
  chr2:71680684-71681242
  Hyper

SEQ ID NO: 117754 - DNA, 404 bp, Homo sapiens; identical to SEQ ID NO: 86802
  chr2:71693520-71693924
  Hyper

SEQ ID NO: 117755 - DNA, 171 bp, Homo sapiens; identical to SEQ ID NO: 27274
  chr2:71694277-71694448
  Hyper

SEQ ID NO: 117756 - DNA, 34 bp, Homo sapiens; identical to SEQ ID NO: 86807
  chr2:72017134-72017168
  Hypo

SEQ ID NO: 117757 - DNA, 170 bp, Homo sapiens; identical to SEQ ID NO: 86809
  chr2:72125970-72126140
  Hypo

SEQ ID NO: 117758 - DNA, 207 bp, Homo sapiens; identical to SEQ ID NO: 86810
  chr2:72372030-72372237
  Hyper

SEQ ID NO: 117759 - DNA, 167 bp, Homo sapiens; identical to SEQ ID NO: 27276
  chr2:72372591-72372758
  Hyper

SEQ ID NO: 117760 - DNA, 315 bp, Homo sapiens; identical to SEQ ID NO: 86813
  chr2:72373470-72373785
  Hyper

SEQ ID NO: 117761 - DNA, 557 bp, Homo sapiens
  chr2:72374375-72374932
  Hyper
gggggcttgcagcaccgaggggaggcgaaagcggctcaggaccggaccctcccccgggaccgcgcctcgctaggcgcccccggggcgctccacgccccctgccaggccagccgcgacccaggcaagtccatcttgggagccccctcaggtccgggaacccctcttaccagccccctgaacctgcgccgcgggcgccagtggtcccggaaccgcgctgccggcgggctggggaagcccgggctgctgcggcagagaggagggaaggggcggggcggggaccagtgccttcaggctcccggcgccccctggccggcccgccgctccgtctgccccgcgctcgcagctagcggaccccggagtgcagcggagcgagcgcgcccttacctgcagcagccagtggccggtctctccgatgagcgggaagcccatggatcccttggggatgggcagcttgcagctcttgtcgcgagtggcggcccagcgcagctgccacagctgctgcgacacggccagcagcagcgtcacggacaccaggcacgcggcgagggtggccagcg

SEQ ID NO: 117762 - DNA, 232 bp, Homo sapiens; identical to SEQ ID NO: 86817
  chr2:72375350-72375582
  Hyper

SEQ ID NO: 117763 - DNA, 270 bp, Homo sapiens; identical to SEQ ID NO: 86818
  chr2:72375898-72376168
  Hyper

SEQ ID NO: 117764 - DNA, 30 bp, Homo sapiens; identical to SEQ ID NO: 86819
  chr2:72376558-72376588
  Hyper

SEQ ID NO: 117765 - DNA, 358 bp, Homo sapiens; identical to SEQ ID NO: 86820
  chr2:72377029-72377387
  Hyper

SEQ ID NO: 117766 - DNA, 102 bp, Homo sapiens; identical to SEQ ID NO: 86821
  chr2:72778893-72778995
  Hypo

SEQ ID NO: 117767 - DNA, 159 bp, Homo sapiens; identical to SEQ ID NO: 86822
  chr2:73121674-73121833
  Hypo

SEQ ID NO: 117768 - DNA, 88 bp, Homo sapiens; identical to SEQ ID NO: 86823
  chr2:73142014-73142102
  Hyper

SEQ ID NO: 117769 - DNA, 62 bp, Homo sapiens; identical to SEQ ID NO: 86824
  chr2:73142786-73142848
  Hyper

SEQ ID NO: 117770 - DNA, 1008 bp, Homo sapiens; identical to SEQ ID NO: 86825
  chr2:73143487-73144495
  Hyper

SEQ ID NO: 117771 - DNA, 1554 bp, Homo sapiens; identical to SEQ ID NO: 86826
  chr2:73144718-73146272
  Hyper

SEQ ID NO: 117772 - DNA, 1068 bp, Homo sapiens
  chr2:73147149-73148217
  Hyper
ggagggataggggctcggaggagagggcggggtcgttcctaagtcctgtggcctccagccgttcagcttgtccggagtcggcatcctgggccgcaccctcggcttcgaatccagcccctgacgccctccgcaccgcggttcctgcctccgggcgccgagggccgggggcgcctggagagaaatccagctccggctctgagcgtctccagtcaggcgaggcggataaatccttcgcaaaaccctcttggaaattgccgccgcttcctgagccatcagtcccagcgggtacgttatcgagtagcacaaacagttggatttttccctcaagaaccgagtctggacgcggagatggagccaagtgtggctgcattttcggacccggaaatccgttgggcactgaaggacttttcgaaccctgtagcgctgttgcttcgcggtccatcgtcgccgctgcagacggatgcgctccccggcggctctacgccctccagtcccggccaggcctctgggctgggagccgagccgtctcgggccctccggcgccgcgttttctagagaaccgggtctcagcgatgctcatttcagccccgtcttaatgcaacaaacgaaaccccacacgaacgaaaaggaacatgtctgcgctctctgcgcagcgcttgggcggcgcggtcccggcgcgcggggaagcggcgtctccgctaaccgaggcgctggaaggggaaaagcgaatgcggaatcgtccaggactccgaaggtcggggccgctcgcgagcaccgaaggggaggagccgacgaagaccaggagtgggccgcatttcggtactgtttccccgagatcaggaactttccgggtctaggagcaacgcctggagggggctgtagagacccagccccccgggacccgcaactacaatgggccggagcttctaaggtcgcctttgttctggcaggaggacggggaatgaggttatctccgccgcctgtcctgcctctccctctcctagccctagggccctccgcccagccgtccggccctgagcccctggccggcggcggcctctccagcga

SEQ ID NO: 117773 - DNA, 47 bp, Homo sapiens; identical to SEQ ID NO: 27290
  chr2:73150907-73150954
  Hyper

SEQ ID NO: 117774 - DNA, 664 bp, Homo sapiens; identical to SEQ ID NO: 86831
  chr2:73151185-73151849
  Hyper

SEQ ID NO: 117775 - DNA, 53 bp, Homo sapiens; identical to SEQ ID NO: 6222
  chr2:73152398-73152451
  Hyper

SEQ ID NO: 117776 - DNA, 344 bp, Homo sapiens
  chr2:73152656-73153000
  Hyper
agagttgcgagaggccggctccgcggtctcccagctacctcccggctgacttttcaccttccgctcccctttcctcctagtctcgaccctactacaccaccgtcccctcccaagtcccgggcagtgagaagatgcccggcatggggggcagccggagcctccctttagcagccagagtaggaagggggcttagtgagggagcccagacccaaacttcatccgcagctttcttcggcggaccttaccctctcctccttcagtggcattttggcatctattgtcgtcatatctgtctgctgccccacttaatctacaaatcgctcacgggtcggaggcaggacccg

SEQ ID NO: 117777 - DNA, 89 bp, Homo sapiens; identical to SEQ ID NO: 86835
  chr2:73339571-73339660
  Hyper

SEQ ID NO: 117778 - DNA, 1526 bp, Homo sapiens
  chr2:73429292-73430818
  Hyper
ctaggtgaatctggccgaggcttctgcgtcaaggacggcgcgggtcagctgaggccaagaccgcaggcactgccctaccgctctccagatcacagctccgcctctgcaaggccccggggaaacgggcatcccttcttcagtgagcaaaggagaaagacggagcccggtggctgggtgtttcgcccaggatcaccagcgagctcagagtcctccccacgaccgccccagggtgggcatttttaaaagcggaggaagggagggaacacactctttggtgctgtgcccaccttgcctcgcacagagcgggcgctcacaggctttgggggccccgcccggaccgcagtggggagaggccgccccatgccccgccccgccaaatttaagagccttcgccgagcgccaggaggttcccagacaaccggtcttgctcgctgccttttgcagaatcttctcacttctcccgagctcccttccttgcgtccgtccgggcaacggccgcgtcatgcctagccccaggccgcgaggcagcccgccacccgctccctcgggctctcgggtccgacctccgcgctctggccgctctccggcgcccaggtcccctactggcccgaacacgccccgcgctcccggacgcttcgagtcccctttctcggtcgaggccatcctggcgaggcccgacccctgcgcgccggcggcctcccagccgtcgggctccgcctgcgtccacccggccttctggaccgctgcttccctgtgcgccaccgggggtctgccctgggcttgcccgacatcgtggctgcccgcctacctgagcgtaggtttttaccctgtgccagggccgcgcgtggctcccgtctgcggcctgctgggcttcggcgtcacaggtactgcggtcccggcgcccgcacgcgggggactgggcgggggctggagagcctaggtcgccactgccggcgccccagtgcaggagagggcactgagtgtgagaatcacacacggctggagtgggaaggggctctgccaccgtttaccttgcagttgaagccgaggaccgcgacagtcttgctgaaaaagaccccggcgcgaggcttcccccgcacgctgctgaggtgggagagggtgggtgtgagggcggcgcagcgcctgaatgcggtgggcaggaggccagcgctggggctgcaaggggacccagccctgctcccggtctccgcgtcccttgactccctcgcacaccccggggtagcgcttagtgacagagacgcttcccaaagcggctctcgacccgaaccaatggccctgttttttttttttacggggtagggggaagtggacgctccgggcggtgctgttgagcgaggagctgttaggagctggtcaaggctcacaccccactaccgcctccactgctcacgtctgtgaacttgagctacacacttcgctctgagcctgcgtgcatgcaatgctcttaagtagtgcttaagggccaggcacttaaatctcatgagaaagtaattgtaaggttgggc

SEQ ID NO: 117779 - DNA, 23 bp, Homo sapiens
  chr2:73440127-73440150
  Hypo
caggtgatcctcccacgcatcac

SEQ ID NO: 117780 - DNA, 23 bp, Homo sapiens
  chr2:73440270-73440293
  Hypo
cgacaaagcgagaccctgtctca

SEQ ID NO: 117781 - DNA, 30 bp, Homo sapiens; identical to SEQ ID NO: 86842
  chr2:73493641-73493671
  Hypo

SEQ ID NO: 117782 - DNA, 139 bp, Homo sapiens; identical to SEQ ID NO: 86843
  chr2:73512023-73512162
  Hyper

SEQ ID NO: 117783 - DNA, 1662 bp, Homo sapiens; identical to SEQ ID NO: 86844
  chr2:73518205-73519867
  Hyper

SEQ ID NO: 117784 - DNA, 861 bp, Homo sapiens; identical to SEQ ID NO: 86845
  chr2:73520242-73521103
  Hyper

SEQ ID NO: 117785 - DNA, 30 bp, Homo sapiens; identical to SEQ ID NO: 39565
  chr2:73723848-73723878
  Hypo

SEQ ID NO: 117786 - DNA, 93 bp, Homo sapiens; identical to SEQ ID NO: 39566
  chr2:74010528-74010621
  Hypo

SEQ ID NO: 117787 - DNA, 30 bp, Homo sapiens; identical to SEQ ID NO: 86849
  chr2:74152651-74152681
  Hypo

SEQ ID NO: 117788 - DNA, 707 bp, Homo sapiens; identical to SEQ ID NO: 86850
  chr2:74229462-74230169
  Hyper

SEQ ID NO: 117789 - DNA, 22 bp, Homo sapiens
  chr2:74315939-74315961
  Hypo
gctcatgcctgtggtcgcagca

SEQ ID NO: 117790 - DNA, 31 bp, Homo sapiens; identical to SEQ ID NO: 86852
  chr2:74350360-74350391
  Hypo

SEQ ID NO: 117791 - DNA, 17 bp, Homo sapiens
  chr2:74425137-74425154
  Hypo
atatggtctcactctcg

SEQ ID NO: 117792 - DNA, 71 bp, Homo sapiens; identical to SEQ ID NO: 86854
  chr2:74425719-74425790
  Hyper

SEQ ID NO: 117793 - DNA, 317 bp, Homo sapiens; identical to SEQ ID NO: 39568
  chr2:74454002-74454319
  Hypo

SEQ ID NO: 117794 - DNA, 96 bp, Homo sapiens; identical to SEQ ID NO: 86856
  chr2:74454965-74455061
  Hypo

SEQ ID NO: 117795 - DNA, 22 bp, Homo sapiens
  chr2:74669781-74669803
  Hypo
cataaagagcagctgcgcgcgg

SEQ ID NO: 117796 - DNA, 22 bp, Homo sapiens
  chr2:74691369-74691391
  Hypo
gccaccgcgcccagcctctttt

SEQ ID NO: 117797 - DNA, 92 bp, Homo sapiens; identical to SEQ ID NO: 39570
  chr2:74700397-74700489
  Hypo

SEQ ID NO: 117798 - DNA, 44 bp, Homo sapiens; identical to SEQ ID NO: 6233
  chr2:74726199-74726243
  Hyper

SEQ ID NO: 117799 - DNA, 56 bp, Homo sapiens; identical to SEQ ID NO: 86861
  chr2:74726718-74726774
  Hyper

SEQ ID NO: 117800 - DNA, 33 bp, Homo sapiens; identical to SEQ ID NO: 86862
  chr2:74729900-74729933
  Hyper

SEQ ID NO: 117801 - DNA, 473 bp, Homo sapiens; identical to SEQ ID NO: 86863
  chr2:74730171-74730644
  Hyper

SEQ ID NO: 117802 - DNA, 66 bp, Homo sapiens; identical to SEQ ID NO: 86864
  chr2:74733315-74733381
  Hypo

SEQ ID NO: 117803 - DNA, 3266 bp, Homo sapiens
  chr2:74740515-74743781
  Hyper
taaggctcaggggcccgcccgcgggggtcccatccccgggaaggacgcagagttcacgcactcccggctcctggattcatggccagaggtcacaaggtcaccaagcggcttaggtctttccccacctcccttctctgacagctccaggccattttttgagtttgggtggggtaaaatgtttatgggaaacaaggcggccaggatccaaccaaggcctcagtgaggtcccacgtgtcccccgtggcgagatttcgccctcccgccgttgaggaggaagagtgtgagaacagacttcctaggcacagaatggaggggcagagtcctgcattgaggactccctgcacttggggtccgggggtaagtgccagccccaagaacccgccggcctgatttggcccgggttgagccatggtccgttttacacggattttggaaaatcgaaattctaggaaacacaggacaccaattaccggtgcgcatgaacagggctggggggacctacaggagaggccagaaggcgcaccacgatcgccagcccaaagcggccgttccccgcccttagcccctgccgtccccttcccacacctgttctcttcctgggcctgcagctcaccgggcgccgttccccagccgcttcttacgcagccgggaaaccacaacgagatttggtcttcgagagcatttaggcggggaccacaacgaatccgggagttggccagaaggatccatcgagaggcgaagagtgggggctgggggaggaggcacctgcggaggaagccggtgaggcggaggcagcccaaaggcggaggccgcccaaaggcggaggccagcaaggatggaggcgcggtgagcatctccgctgactcagcggcccatgctcgggcccctcccgcgctgagcctggctcctaacaccctggccccctgtccccctccccgcacatctccgccagccagccttccccctgcgcttggcgcaaacaggcgtcccttcccctttaactgctgggccccgcccctgccctacccccagcccccactacccacccgggccgatccgtcagtcactgccccagccggagctggccaaccctctccacccgggacttgggcagcggcgccggcagcccagcgtctatttgcgcttaagagccagcaaggaagctccaggggccccagctggccgtgctcccccgggatgcaagtccctgcgctgacgcccggcagcggctggcacgggcgcggctgctccgggtgcacagggatgctgctgtttcggggaccccggcgccctgccttggccagccccgcgggcccctgaggccactctccggagcgcgccgccgctgggcttctggcgctgcctgaggcatcctccccaaccaccgaacctccggcggttctcctcggcccagaccgatggagccggggatgctgggtccacacaacctcccacaccacgagccaatcagcttcggcatcgatcagatcctgagcggccccgaaaccccagggggcggtctaggcctgggtcgcgggggccagggtcatggggagaatggggcgttctcgggtggataccacggagcctcgggctacggtcccgccggctcacttgccccgctgcccggcagctccggagtgggcccaggcggcgtgatccgcgtccctgcgcaccgcccgctgcctgtgccgccgcccgctgggggggcgcctgcagtgcctgggccctcgggtttgggcggcgccggaggcctagcgggactcaccttcccctggatggacagcggccgccgctttgccaaggaccggctcacgggtgaggttgtctgacccctccagcgtcacgcccgactctgaccccgtctcctcatttcttagctttctgctccaactcaaggacccctttcacacctcccactagatcctcccaggggatcctcccccaactcaaatctctgggtcctgcctccgagaggtgatggggagggagctgccgtcggtgcccgcgccctcctctgtagtcccactgtccacgcgtggggaggggagggtgaagttacaggggacgtctccctcgcatcccaggggaagggcctttcttggctatagggctcggctgatgcttagggcccgggtaaggacagggcgcgggagttctgcggcctggacagccgcgcggccttctcagtggcacctcgggccaccctgcaaatcctgccctggtctttcttcctcccggtagctgcgctctcgcccttctctgggacgcgccgcataggccacccctaccaaaaccggacccctccgaagcggaagaagccgcgcacgtccttctcccgctcacaggtgctggagttggagcggcgcttcctgcgccagaagtacctggcctctgcggagagggcggcgctggccaaggccttgcgcatgaccgacgcacaggtcaaaacgtggttccagaaccgacgcaccaagtggcggtgaggcgcggcgcgggcgagggcggactggggttcccgagcagggcctggtgagaagcgacgcggcgggcgccccgctgaccccgcgtctccctcccttaggcgccagacggcggaggagcgcgaggccgagcggcaccgcgcgggccggctgctcctgcatctgcagcaggacgcgttgccacggccgctgcggccgccgctgcccccggaccctctctgcctgcacaactcgtcgctcttcgcgctgcagaacctgcagccctgggccgaggacaacaaagtggcttcagtgtccgggctcgcctcggtggtgtgagcgacgcccgtccgatcggcgtggagcgccgggcccggagcggtggagcgcgcggctgcctgcgtccatggtctagtggcagccgggcgcgtgaggagcggcaggccttgaggctgtcgtcgagggctcctccaccaccggccggctcccaagccagcgttgcgcagatgcacggccagctcagaggcggcctttcccgccatttttcacttcactgccgttacgccctcgctggaacctgaggcgccgagagggcgggacctgcaggacagtagccaatgaggtgcggggagggggccgggctggccaatgggagctgctttcctgagggactcgaaattctccggcgggtggtcgggagctggggctctgaggggctctagcggcgttgcgcgcggtgccggctgggtctgtaccaaaggtgtgaaggaaagaagacaccgaccacggcgaagcaatagaggg

SEQ ID NO: 117804 - DNA, 30 bp, Homo sapiens; identical to SEQ ID NO: 86872
  chr2:74764874-74764904
  Hypo

SEQ ID NO: 117805 - DNA, 414 bp, Homo sapiens
  chr2:74781935-74782349
  Hyper
accaaggtagtctggcgcatggatgccgaaccttatccgggctagtagtgggtgagagagcccagaaacagggagaggtgggcagcgggctggagagcggcgccgggagttggagagcctgtgactttcccgtgaagttgctttgcacactcccgggaagcgtctgtagtctaggggttctggtcctggggagacggagtggcatcgtccttgggaaacttcgcccccaaccccgtttggaagccccagatcccaaatcgacttgcgccgcaacctccttccccgtcgggacccgggccgcctgcgcacgccactccctctcgagcactctctctctctccctagaggtggaggaagacctgggccgtgctctacccggccagtccccacggcgtagcgcggctcgagttcttt

SEQ ID NO: 117806 - DNA, 24 bp, Homo sapiens
  chr2:74874703-74874727
  Hypo
tgggttcactttaaacgaaatgaa

SEQ ID NO: 117807 - DNA, 32 bp, Homo sapiens; identical to SEQ ID NO: 86876
  chr2:74875128-74875160
  Hyper

SEQ ID NO: 117808 - DNA, 103 bp, Homo sapiens
  chr2:74875415-74875518
  Hyper
ctcacctggtcctcccggctctcagcgtgcgcccgcgcgttcggaggcgcccccctcaggccggcgcggctgggcgggaggctcactgcgggcaaggcggggc

SEQ ID NO: 117809 - DNA, 30 bp, Homo sapiens; identical to SEQ ID NO: 86879
  chr2:75031726-75031756
  Hypo

SEQ ID NO: 117810 - DNA, 30 bp, Homo sapiens; identical to SEQ ID NO: 86880
  chr2:75090539-75090569
  Hypo

SEQ ID NO: 117811 - DNA, 104 bp, Homo sapiens; identical to SEQ ID NO: 86881
  chr2:75146952-75147056
  Hyper

SEQ ID NO: 117812 - DNA, 54 bp, Homo sapiens; identical to SEQ ID NO: 86882
  chr2:75179952-75180006
  Hypo

SEQ ID NO: 117813 - DNA, 140 bp, Homo sapiens; identical to SEQ ID NO: 86883
  chr2:75426430-75426570
  Hyper

SEQ ID NO: 117814 - DNA, 91 bp, Homo sapiens; identical to SEQ ID NO: 86884
  chr2:75426784-75426875
  Hyper

SEQ ID NO: 117815 - DNA, 892 bp, Homo sapiens; identical to SEQ ID NO: 86885
  chr2:75427383-75428275
  Hyper

SEQ ID NO: 117816 - DNA, 170 bp, Homo sapiens; identical to SEQ ID NO: 86886
  chr2:75608174-75608344
  Hypo

SEQ ID NO: 117817 - DNA, 157 bp, Homo sapiens; identical to SEQ ID NO: 27319
  chr2:75787200-75787357
  Hyper

SEQ ID NO: 117818 - DNA, 541 bp, Homo sapiens
  chr2:75787804-75788345
  Hyper
cctttgctggggccccggcgcgcacttccggggactgcgcttggggcgcgcggggccgagcagggggacccggagctgatcactgaggggcggacacgacaaagcgctgcccgggtcttgggccggcaccagtacctcggaaaggaatcccggcggaggggccgccggggtcagggctggcctggggatgtggggtcccggcctgggtgctcacggacggcggcgccaagccccgcagaagctgcaggagcccgagtcagtgggaggaaaaggttgtctcatttccttcgatctcccccctcctccacccgcttggctccggacctgccctccctctcccccgcccccttctgcaagccagcggcccatgtgggcgcccgcaagacgcgaaacctgaacggctgcggcgtgcggcacctccctccgcgccaagttagttcacgctcccaactcctgcctgcctccccgcgctgccgactgtccgcaggaccggggaggttccccatcggcagtccccaacctatcccggtcctccaggctt

SEQ ID NO: 117819 - DNA, 29 bp, Homo sapiens
  chr2:75851938-75851967
  Hypo
caggtgggagccaccgcctccagtcgtta

SEQ ID NO: 117820 - DNA, 145 bp, Homo sapiens; identical to SEQ ID NO: 86894
  chr2:76036826-76036971
  Hypo

SEQ ID NO: 117821 - DNA, 30 bp, Homo sapiens; identical to SEQ ID NO: 86896
  chr2:76975878-76975908
  Hypo

SEQ ID NO: 117822 - DNA, 159 bp, Homo sapiens; identical to SEQ ID NO: 86898
  chr2:79159337-79159496
  Hypo

SEQ ID NO: 117823 - DNA, 486 bp, Homo sapiens
  chr2:79739850-79740336
  Hyper
ccccacctgcggcgccgagcctgccgcgcctccagagctccgccctaccccgccccgccctttcgggcgctccccaggccgcgcgcgcccgcggccccccacccagccacccctcgatgcccggtgcctttccaggcgccgcggagccacggggaccgcgggggcgcgcgagcgagcaagcggccgcgcatgcgcactggctgcctcccctagcggcgatccgggccgctgccgctcgcgcttgggcaggacgcggggcgggcggggggaggggggagcggcttcgcttccagccccgagtgaggcggagacccaggcgggcgggcagagcaggcggcaccgcacctcggccagaggcggctgcagcagctgctgcccttgtccctgccgccgcctctccagtcccttctgtgattaccactccagctgctgggaacgggcgagaaagaggaggaggcgagaaactcccaccgacccacagaggtg

SEQ ID NO: 117824 - DNA, 147 bp, Homo sapiens; identical to SEQ ID NO: 86902
  chr2:80529296-80529443
  Hyper

SEQ ID NO: 117825 - DNA, 1177 bp, Homo sapiens
  chr2:80529662-80530839
  Hyper
ccttgtggatctgcacggcgttctcggcgtgctcgccgcctggaagagccacggtggcaggctcgaatgtgccgtcgtgctgcccctccccgccgtccgcgagcgtggtggccgagctggcagggggccccagatcactgcggttggtgacggccgagagcaggtggccgctggtgggctcggccccatcctcgcacaggtggaaggcgtacacggcgtccaggacgtcctcgccctgtgcgtactccgggctggcgcactgcaagttgccatcgtagcgcccctggaagttgttgagccacgaggctagggcacacacgttgcgcccgcaatcccacaggttcccggccagggtgatgcttgtcagggacttccaagagttgaggatccggggctcgatgtaggtgaggcggttggagtccagctgcagggactgcaggtgcggcacggtctcgaacacatggggctccatgtactcgatctcgttgcccgacaagtccattttctccaggttccaaacccagtccagcgagctgaccacaatggccaccttgttcctccgcaggcagagcgagtgcagggagatgaggcgcgggaagtgggcgaagttcaccttgaccaagtcgttgtgctcgaggtgcagctcggtgagcttaaacaagccggcgaaagagttgcgcgccagactcttgagctgattgtatccgatgtcgagaaacttgaggctgcggcagtcctggaagatgcgcacgggcacaaactggatggcgttggcccgcatatgcagcgtggtgagcttccgcagcccgtggaagaggtcgggcgcgagcgcctgcagcttgttgtacgagaggtccacgctgcgcaggttgggcatgggccggaaggtggtgttgggcagttgggtgatctggttggaactcagcgtgagttccttaactcggcgcagtttctgaaaggcgtccccctgcacggagcagatgtgattgtgatccagatagagccacgtgagctgcattaaccccgtgaactggccggcgcgcagctccgagaggctgttgtagcgcagggacaagcccagcaggccggacaggttgtggggcgcctcggtgaggttgagcgcctcgcagtacagcagccgcccctcgcaccggcacagctgcgggcacccgctggg

SEQ ID NO: 117826 - DNA, 685 bp, Homo sapiens; identical to SEQ ID NO: 27329
  chr2:80531328-80532013
  Hyper

SEQ ID NO: 117827 - DNA, 240 bp, Homo sapiens; identical to SEQ ID NO: 86909
  chr2:80549571-80549811
  Hyper

SEQ ID NO: 117828 - DNA, 30 bp, Homo sapiens; identical to SEQ ID NO: 86910
  chr2:80591074-80591104
  Hyper

SEQ ID NO: 117829 - DNA, 75 bp, Homo sapiens; identical to SEQ ID NO: 86911
  chr2:81421356-81421431
  Hypo

SEQ ID NO: 117830 - DNA, 30 bp, Homo sapiens; identical to SEQ ID NO: 86912
  chr2:81421864-81421894
  Hypo

SEQ ID NO: 117831 - DNA, 54 bp, Homo sapiens; identical to SEQ ID NO: 39574
  chr2:81424249-81424303
  Hypo

SEQ ID NO: 117832 - DNA, 82 bp, Homo sapiens; identical to SEQ ID NO: 86914
  chr2:81694612-81694694
  Hypo

SEQ ID NO: 117833 - DNA, 32 bp, Homo sapiens; identical to SEQ ID NO: 86916
  chr2:82462336-82462368
  Hypo

SEQ ID NO: 117834 - DNA, 18 bp, Homo sapiens
  chr2:83283948-83283966
  Hypo
ctccgcctcaaaaaaaaa

SEQ ID NO: 117835 - DNA, 49 bp, Homo sapiens; identical to SEQ ID NO: 86918
  chr2:84101246-84101295
  Hypo

SEQ ID NO: 117836 - DNA, 36 bp, Homo sapiens; identical to SEQ ID NO: 86919
  chr2:84104568-84104604
  Hypo

SEQ ID NO: 117837 - DNA, 479 bp, Homo sapiens; identical to SEQ ID NO: 86921
  chr2:85107340-85107819
  Hyper

SEQ ID NO: 117838 - DNA, 65 bp, Homo sapiens; identical to SEQ ID NO: 86922
  chr2:85280281-85280346
  Hypo

SEQ ID NO: 117839 - DNA, 29 bp, Homo sapiens
  chr2:85287855-85287884
  Hypo
tgaacgaccgtgcccggccaagccaatgg

SEQ ID NO: 117840 - DNA, 427 bp, Homo sapiens; identical to SEQ ID NO: 86924
  chr2:85360043-85360470
  Hyper

SEQ ID NO: 117841 - DNA, 756 bp, Homo sapiens
  chr2:85360872-85361628
  Hyper
cgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggtaaggaagcaccgcggccacccccgggggatcccggccctgcgtccgctcacccgctcttgcctttgtgtctcctccgcaggcggagaggcgcccgcagcccgtccgggacactttccagaagccgcgggactatttcgccgaaggtatgtgcccgctgggacagccccccactctcgattcccgctgcgctccgctgctcagcccgggcggcccaccgtcccccttgcttgggtggacgcacccttgccctccgcctttattggcggcagcccccgtggggcgcgcgtggggggcgctggggtccccagctcccgcctcgagccccctgccgcggcgctgtcagtcccgggggcctgggcctcacctcgccttggtcttgttcgcagtgagaaggcctcaggacagcgcgttctttaaaggacccccgtaccctgggtaccccttcctgatgatcccggacctgagcagcccgtacctctccaacggacccctgtctcccggaggagcgcgcaccgtgagtgcccgtcgggcgcgccggggagggtgggaggccgcggcccgcaggatgc

SEQ ID NO: 117842 - DNA, 30 bp, Homo sapiens; identical to SEQ ID NO: 39575
  chr2:85533655-85533685
  Hypo

SEQ ID NO: 117843 - DNA, 18 bp, Homo sapiens
  chr2:85534085-85534103
  Hypo
cagcgactgcatttatag

SEQ ID NO: 117844 - DNA, 64 bp, Homo sapiens; identical to SEQ ID NO: 86929
  chr2:85542210-85542274
  Hypo

SEQ ID NO: 117845 - DNA, 49 bp, Homo sapiens; identical to SEQ ID NO: 86930
  chr2:85641060-85641109
  Hyper

SEQ ID NO: 117846 - DNA, 275 bp, Homo sapiens; identical to SEQ ID NO: 86931
  chr2:85645262-85645537
  Hypo

SEQ ID NO: 117847 - DNA, 43 bp, Homo sapiens; identical to SEQ ID NO: 86932
  chr2:85698940-85698983
  Hypo

SEQ ID NO: 117848 - DNA, 34 bp, Homo sapiens; identical to SEQ ID NO: 39577
  chr2:85769773-85769807
  Hypo

SEQ ID NO: 117849 - DNA, 95 bp, Homo sapiens; identical to SEQ ID NO: 86934
  chr2:85837713-85837808
  Hypo

SEQ ID NO: 117850 - DNA, 35 bp, Homo sapiens; identical to SEQ ID NO: 86935
  chr2:85838288-85838323
  Hypo

SEQ ID NO: 117851 - DNA, 30 bp, Homo sapiens; identical to SEQ ID NO: 86936
  chr2:85890872-85890902
  Hypo

SEQ ID NO: 117852 - DNA, 22 bp, Homo sapiens
  chr2:86346762-86346784
  Hypo
gccaccgcgcccagctttccta

SEQ ID NO: 117853 - DNA, 39 bp, Homo sapiens; identical to SEQ ID NO: 86939
  chr2:86423730-86423769
  Hypo

SEQ ID NO: 117854 - DNA, 24 bp, Homo sapiens
  chr2:86425865-86425889
  Hypo
ccccaggctggagtgcggtggctc

SEQ ID NO: 117855 - DNA, 16 bp, Homo sapiens
  chr2:86455870-86455886
  Hypo
gcgcctggcaaccctt

SEQ ID NO: 117856 - DNA, 22 bp, Homo sapiens
  chr2:86562959-86562981
  Hypo
cgagactcggtctcaaaaaaaa

SEQ ID NO: 117857 - DNA, 30 bp, Homo sapiens; identical to SEQ ID NO: 86943
  chr2:86564715-86564745
  Hyper

SEQ ID NO: 117858 - DNA, 23 bp, Homo sapiens
  chr2:86783937-86783960
  Hypo
ccctagcccgctttttcactgga

SEQ ID NO: 117859 - DNA, 44 bp, Homo sapiens; identical to SEQ ID NO: 86946
  chr2:86815266-86815310
  Hypo

SEQ ID NO: 117860 - DNA, 30 bp, Homo sapiens; identical to SEQ ID NO: 86947
  chr2:87016267-87016297
  Hyper

SEQ ID NO: 117861 - DNA, 420 bp, Homo sapiens
  chr2:87016517-87016937
  Hyper
tgtagatatcacaggcgaagtccagccccctcgtgtgcactgacgacaccaaagacgccgacatttaggagagggcccgggacctcccaaccgccccaccgtcccgggaacgtctctccgcctcagatctcggtttcccaccacttggacagcccttgactctacctacagtatcagggctgtccctggcatgggctctccccgcggtgcgtgccgcccccgccccgggcccccgcacgcctcacctgcgccccccgccgctggccggcacgcctctgggcgcagggacaggggctgcgacgcgatggtgggcgccggtgttggtggtcgcggcgctggcgtcgtggtgggcttcgctgcaagagcaacagagcgtggttgggggccaggctggggttatggaggcgccccagccccggc

SEQ ID NO: 117862 - DNA, 746 bp, Homo sapiens
  chr2:87017490-87018236
  Hyper
ggagttgctcagggccgagcagaaatagtagccctcgttctctcggcggaagtcgctcagggtgaggacgaaggtgtcccccaacctcttgcccgagaaccgctgggtgtccagcccctcggccgccttgggcttgttttgggagaggtataggaggaaggtgggactggcggcggcgccgcgcggctggaagagccacgagcagcccgacgtcgggttggacagcagcacctggcacttcagctccactgtctcgcccaggttccaggtccgatccagcggcgacacccggaactggctcggcctggcggcgtctgcaggcggcaagcagcgaggctgagcccgcagtcccgcgccccccgccccccgcccgccccatcccctgccttcccgggcgtctcaaactcacggagcagcaaggccagcggcaggagcaaggcggtcactggtaaggccatgacgcgctccccaggacgctgcttggctcgaagctcgggcgcgaggggaggcgcgcgggagccggtggggcgccgaggggggaaagttgcgcccttcggccggcccggagcctgatttcgcatttggaggatgtgatgtcacccgaagcccccgccgaggagagtcaccctccttttcgcggttgtcgccttccagcccggcgaggaggctggggcccgtgaatagggccgtcgaggcagcctggccaggcaactgggggcagctgaaaactgcgggtttggggatga

SEQ ID NO: 117863 - DNA, 33 bp, Homo sapiens; identical to SEQ ID NO: 86951
  chr2:87034656-87034689
  Hyper

SEQ ID NO: 117864 - DNA, 90 bp, Homo sapiens; identical to SEQ ID NO: 86952
  chr2:87056531-87056621
  Hypo

SEQ ID NO: 117865 - DNA, 493 bp, Homo sapiens; identical to SEQ ID NO: 86953
  chr2:87088683-87089176
  Hyper

SEQ ID NO: 117866 - DNA, 80 bp, Homo sapiens; identical to SEQ ID NO: 39581
  chr2:87961966-87962046
  Hypo

SEQ ID NO: 117867 - DNA, 30 bp, Homo sapiens; identical to SEQ ID NO: 39582
  chr2:88306721-88306751
  Hypo

SEQ ID NO: 117868 - DNA, 196 bp, Homo sapiens; identical to SEQ ID NO: 86964
  chr2:88469231-88469427
  Hypo

SEQ ID NO: 117869 - DNA, 30 bp, Homo sapiens; identical to SEQ ID NO: 27339
  chr2:88469803-88469833
  Hyper

SEQ ID NO: 117870 - DNA, 60 bp, Homo sapiens; identical to SEQ ID NO: 86966
  chr2:88470136-88470196
  Hyper

SEQ ID NO: 117871 - DNA, 87 bp, Homo sapiens; identical to SEQ ID NO: 39584
  chr2:88573562-88573649
  Hypo

SEQ ID NO: 117872 - DNA, 229 bp, Homo sapiens; identical to SEQ ID NO: 86969
  chr2:88650232-88650461
  Hyper

SEQ ID NO: 117873 - DNA, 30 bp, Homo sapiens; identical to SEQ ID NO: 86970
  chr2:88650807-88650837
  Hyper

SEQ ID NO: 117874 - DNA, 103 bp, Homo sapiens; identical to SEQ ID NO: 86972
  chr2:88750914-88751017
  Hyper

SEQ ID NO: 117875 - DNA, 1607 bp, Homo sapiens
  chr2:88751271-88752878
  Hyper
ggttattcctccatccgctcccacccgcagcctggacaagaagactcctggcagatcttccagccgcacaccgacccctgcgccggcccttgcgacccgcgtccgccctccccggctgggaagcacctgccagcggccctcacctgggtcgtcctcgtcgcggggcaccttcttgaagcagtcgttgagcgacaggttgtggcggatggagttctgccagccggccttgctgcgctggtagaaggggaagctatcggcgacgaactggtagatgtggctgagagtgagtttgcgctcgggcgcgctctgaatggccatggcgatgagcgccgaatacgagtagggcggccgcaccatcttcatcaggtcctcgcggctggccatggacagccagcccagctccccgggccccgcgggcgcggcgggcgaggcgggcgcggcgggcgcgggctgcgcgaagggccgctgagagcagccgaagtgccggcggcaggcggtggctgcagaaagggcccggccgcggccccggggggcggcggcggcggcggagcgcccaggtacgcggcggcggctgcggcggcggcggagggcgggcctcccacgccgggcccgttgagccacaggtaggggttggcggcggcggccggcggcgcggcgtagtcggccagcccgtaaggcgccctggctgccgggggggcgcccggggcggcggcggtggcggcgggcgggggcaggccgggctgcgaatacactccgaagttgtcgccgcagtagagggccatgtcggcggccgtgggcggctgcggcgcggccgcggcgaggggcgagcggggctggtctcgccgctcgggcgagagcatccctttgggggccaaccctgcggctccgccttcacccgcgctgggcgcccggtgctccgggccggggtcgggcgggtgctagcggagcgcctgctagccggcctcttataaccgagcccggcgcggctcctcctgggccggcccggagcggggcggtggccgcgggcctgggctctccacgcccccgccacgccccacctgcccgcgcgcccaaacccggagcccgcccgccccgcccctaccgcccctctgcccgggcccgggagcgtctgggaggccggcgcctccaggtttcgggcaaaaagcagcaccccattcctagcccacgtttcttaacatcataataagtaaagccacgaatattaaagagaagataacccgaacagtacgaatgatttctaaaaagttaacttggggtggccgctcgggccacctgcctagtcatccttttggcttttctacctctttcctcctaaccttttgtgatcgagtcgcggaattcacgtccagtctcaaccgatcggcttccagtcgaaaataatcgatgtgatttacaacgctttggggtatacggtagaggttattaacaggcccgcttggcgtgtccccttctcctcggggattctgtgattggaggaacggaaatcagtgttgagtttttctaaccaaactgtaggttcgctcacattcgggaagcatttattcgttttctgtgcggtttgtacgggctttcgttgtgatttgtta

SEQ ID NO: 117876 - DNA, 45 bp, Homo sapiens; identical to SEQ ID NO: 86976
  chr2:88753098-88753143
  Hyper

SEQ ID NO: 117877 - DNA, 30 bp, Homo sapiens; identical to SEQ ID NO: 86977
  chr2:88755765-88755795
  Hypo

SEQ ID NO: 117878 - DNA, 232 bp, Homo sapiens; identical to SEQ ID NO: 39585
  chr2:88990189-88990421
  Hypo

SEQ ID NO: 117879 - DNA, 224 bp, Homo sapiens; identical to SEQ ID NO: 86979
  chr2:89006626-89006850
  Hypo

SEQ ID NO: 117880 - DNA, 976 bp, Homo sapiens
  chr2:89064550-89065526
  Hyper
aagccccaggtcctgcgctcagggcaggggtcaagagcagctggcaagggcggcgcagcctgtggggcccttgggcgcggcgggccgcagctccgggaagccacgtcagcccaccggcgctgcagctgcagccgccaccagcacacggaccaggggtcgccgaggattgggaatccccgaccaggactgcgcctccagccgtgcggaccccggggccagcggggcagcggcaagtcaggcagtctgcagcaggagcgctgggcatgggcttcggcccgggttgcaggaggcgtgcaccctccggccggataggcggcgcactcagggaccaggaggccatcccaggtgagccccgccagccccagccggagcccgagctgcagctgccacctgcaagtggtgctctggctgcagcggtggcaaccccggatccagtccttccgcctcgcgcccatcagcgcggacccgggggcgacgcagtggcgaagtcgggctgtgggcccggcggcggcaccaggcggagaagcgccactcaaccccatccctgggctgcagagggcccagcgcggagggctccgcgcgtcgggagccggtggaagaggagaagagcgcgcgggcgacagtcatacaggccttggggcagggcgcgcctcgcgctccagggagccacgccagcccgctgcgcctccgcagcaaccgccgcctgcacgtggcggggcgagagagctgctagggcggtttctccgcctcgggcctgttgggcggggccggctaaggtgcgcgtgctcgctggtcctaacggttctgttgggcgtttctgctgagaggcgggaggggctgagagtctgtgcgaaggtaggtggacagactgcattgcttgttgttgcgcttcggaggcggcgatccccgaaggcgagctgaaatacggctggagcgttcccaggctacagtttgtagccgacgattgtggaagact

SEQ ID NO: 117881 - DNA, 44 bp, Homo sapiens; identical to SEQ ID NO: 86982
  chr2:89071937-89071981
  Hypo

SEQ ID NO: 117882 - DNA, 30 bp, Homo sapiens; identical to SEQ ID NO: 86983
  chr2:89121162-89121192
  Hypo

SEQ ID NO: 117883 - DNA, 30 bp, Homo sapiens; identical to SEQ ID NO: 39587
  chr2:89371674-89371704
  Hypo

SEQ ID NO: 117884 - DNA, 30 bp, Homo sapiens; identical to SEQ ID NO: 86986
  chr2:89866048-89866078
  Hypo

SEQ ID NO: 117885 - DNA, 32 bp, Homo sapiens; identical to SEQ ID NO: 86987
  chr2:90003862-90003894
  Hypo

SEQ ID NO: 117886 - DNA, 20 bp, Homo sapiens
  chr2:90209634-90209654
  Hypo
ttcaccgtgttagccaggat

SEQ ID NO: 117887 - DNA, 75 bp, Homo sapiens; identical to SEQ ID NO: 86989
  chr2:90413666-90413741
  Hyper

SEQ ID NO: 117888 - DNA, 281 bp, Homo sapiens
  chr2:91635122-91635403
  Hyper
atttgcacctgccaccgcggagttttgccccgtatgcggcttccggcccccgccgccacggctttttatcacccccgccgctttttgcccccgccgccgcgggtttttgcccccgcccccgttgctttttacccccgccgccgcggctttctgcccctgccgacgagggtttttgcggctttatatccccgctgtcatggctttttgcggccgtggctttttgccccctcagccgtggtttttttgcggcttttggcacccgtcgccgcagctttttcagg

SEQ ID NO: 117889 - DNA, 30 bp, Homo sapiens
  chr2:91874180-91874210
  Hyper
gttctcgggagtctgcggcgcgccagatgg

SEQ ID NO: 117890 - DNA, 39 bp, Homo sapiens; identical to SEQ ID NO: 86994
  chr2:92261800-92261839
  Hypo

SEQ ID NO: 117891 - DNA, 189 bp, Homo sapiens; identical to SEQ ID NO: 87008
  chr2:95663943-95664132
  Hyper

SEQ ID NO: 117892 - DNA, 1791 bp, Homo sapiens
  chr2:95690747-95692538
  Hyper
aacgtcccttcctgtcgcatggattcaaggccgacctgccccagcaccaccaccagcagccttctgctggggccggcacagctgggagcaacctcctactctcaggcagacgcgcagcaccaagcagagaggcccggtgcaggatcccagcgccgaaccagcgccggctcagtggacgcggaaggggccggcggccgcggccggtcccatcccccactgcagacccccagcctgtggcggtggtccagttccgccaggaaaccgccgcctggagctgtgggtcgcgcacattaacgcatccagcggaaaaatgaaggagacccaaattcaaagttaaagtaatggtgacccgagaggtgccttgatgagaaggtttggggtcccggttactgatggttatcattcttacgagatgctggtcacctacgaagggagaaaggcacgaggagcgcctgaccaaagtggttttgccctgcttcccgcaagaggtggcacccacggctggaacgcaggagtcagacccacagtccccagctctggacgcccgcagcggggcctcgaagaggttcagggcggtgcccgcggcgctcgggccgggtctcccggggcgtggggcggggggcggggttgggcggcggccggggctcctccctcttctgccccgggctcccctgctcttaacccgcgcgcgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttgtgagtggctcctggccggggaagggacggggtgggctgagccgtgcgctctctcgggcgcccagcacagctgtcggacgggatccgctagctgcgcaggttctgggagcatcggggcagcaggcgcagggcggggactaagccagggaagtcccctcccacctccggtcctttgtgcccttctagaccaacagaatgaggggaacagtctacaggactatggaggaaaaactgggttcccaactggggtcagatgtaggcagcggggcagggggggacggctcttggttcgctggtcccaaagctgcgcgcggggcccacttgacgcgcgcagcgccaccgaagctcccgccgcgctttgcgcggttgggtagaagtgcgcagcttttacaagggagaaggtttcgttaaaaaagaaaaaaaaatcagcaagagaaacattagtattaccaaccgagatttggagatgagagggagctgaatccggtttattttcttctggccttttaaagtttctggcgagggaacgtatttgcgaccaattcgatctggaaatgaggccatcgtttgcttggccgcagtccttctgccccgtgtgcggggtgggggtggaggagatggggggtggggggtggggggtggcggcgagagcgatccgcgcgcctcgactgaccttgggcaggcccggggcctctgcacctgcggtcggtcccgccttgcacgcacggtctctgcctgaggctgcaggaaagcgcttcctactgagaactcctgataagcgctcacggtgtcgcgaagccgaagtgacctccctcagcctcaactccccgggggccgctggccttcacctgggaggggtgtgccctgtatgtcctgtgggtgcggtccgtcaccgcctgagggacacc

SEQ ID NO: 117893 - DNA, 30 bp, Homo sapiens; identical to SEQ ID NO: 87011
  chr2:95726475-95726505
  Hypo

SEQ ID NO: 117894 - DNA, 39 bp, Homo sapiens; identical to SEQ ID NO: 87012
  chr2:95736152-95736191
  Hypo

SEQ ID NO: 117895 - DNA, 40 bp, Homo sapiens; identical to SEQ ID NO: 87013
  chr2:95742095-95742135
  Hypo

SEQ ID NO: 117896 - DNA, 20 bp, Homo sapiens
  chr2:95745778-95745798
  Hypo
tggcccggacacaagcattt

SEQ ID NO: 117897 - DNA, 187 bp, Homo sapiens; identical to SEQ ID NO: 87016
  chr2:95873374-95873561
  Hyper

SEQ ID NO: 117898 - DNA, 223 bp, Homo sapiens; identical to SEQ ID NO: 39591
  chr2:95941629-95941852
  Hypo

SEQ ID NO: 117899 - DNA, 30 bp, Homo sapiens; identical to SEQ ID NO: 87018
  chr2:95958861-95958891
  Hypo

SEQ ID NO: 117900 - DNA, 99 bp, Homo sapiens; identical to SEQ ID NO: 87019
  chr2:95988527-95988626
  Hypo

SEQ ID NO: 117901 - DNA, 30 bp, Homo sapiens; identical to SEQ ID NO: 87020
  chr2:95989378-95989408
  Hypo

SEQ ID NO: 117902 - DNA, 32 bp, Homo sapiens; identical to SEQ ID NO: 87021
  chr2:95989755-95989787
  Hypo

SEQ ID NO: 117903 - DNA, 170 bp, Homo sapiens; identical to SEQ ID NO: 87022
  chr2:96011693-96011863
  Hyper

SEQ ID NO: 117904 - DNA, 242 bp, Homo sapiens; identical to SEQ ID NO: 87023
  chr2:96012441-96012683
  Hyper

SEQ ID NO: 117905 - DNA, 120 bp, Homo sapiens; identical to SEQ ID NO: 87025
  chr2:96192504-96192624
  Hyper

SEQ ID NO: 117906 - DNA, 202 bp, Homo sapiens; identical to SEQ ID NO: 87026
  chr2:96428959-96429161
  Hypo

SEQ ID NO: 117907 - DNA, 339 bp, Homo sapiens
  chr2:96781907-96782246
  Hyper
agagggagcgctgcccgcccagtgcgcaccgtggacgacagcgctgcccggctcggctagacaagagcgtcgcccctcgggcggcgccgagggcgctggagccccatggcctggacgagcggggcctaggaggtcgggaacacccaggaccagcagccgccctcctacatcctcctccaccggtgcccggggtccctgccgtccgccccagagaagtttcccaagttgtcccgccgccgtccccgtcccgcccgggaccggagaaagtcgcgccctcccgccacgcggatgccgtacgctctgggggcgcgggccgggctgggccggttcttaaaggag

SEQ ID NO: 117908 - DNA, 184 bp, Homo sapiens; identical to SEQ ID NO: 87029
  chr2:96784561-96784745
  Hypo

SEQ ID NO: 117909 - DNA, 34 bp, Homo sapiens; identical to SEQ ID NO: 87030
  chr2:96872240-96872274
  Hypo

SEQ ID NO: 117910 - DNA, 30 bp, Homo sapiens; identical to SEQ ID NO: 87031
  chr2:96970484-96970514
  Hypo

SEQ ID NO: 117911 - DNA, 300 bp, Homo sapiens; identical to SEQ ID NO: 87032
  chr2:96987012-96987312
  Hyper

SEQ ID NO: 117912 - DNA, 435 bp, Homo sapiens; identical to SEQ ID NO: 27356
  chr2:96990881-96991316
  Hyper

SEQ ID NO: 117913 - DNA, 30 bp, Homo sapiens; identical to SEQ ID NO: 87034
  chr2:96993641-96993671
  Hypo

SEQ ID NO: 117914 - DNA, 102 bp, Homo sapiens; identical to SEQ ID NO: 87035
  chr2:96996017-96996119
  Hypo

SEQ ID NO: 117915 - DNA, 39 bp, Homo sapiens; identical to SEQ ID NO: 87036
  chr2:97101384-97101423
  Hypo

SEQ ID NO: 117916 - DNA, 36 bp, Homo sapiens; identical to SEQ ID NO: 87037
  chr2:97135614-97135650
  Hypo

SEQ ID NO: 117917 - DNA, 30 bp, Homo sapiens; identical to SEQ ID NO: 87038
  chr2:97159065-97159095
  Hypo

SEQ ID NO: 117918 - DNA, 172 bp, Homo sapiens; identical to SEQ ID NO: 87039
  chr2:97174612-97174784
  Hypo

SEQ ID NO: 117919 - DNA, 637 bp, Homo sapiens
  chr2:97193015-97193652
  Hyper
ggcaggggaaggcctcgggagggacacgacggtccggcagcagagcctgcggggctggaggaggcgccctcctctcagctgctcttcctgcccctttcggtggcgaagatggatggggcccggggctttcggcggggcccgaggggccggcgaggctgcggccctggagccccctgcctggcagccatttgggccccagggaaatatcggcgctttggctaaccgaattattctttcggtttgagccagctcccctttttgagtcagatccggcggcagggccagaaaagcgctttctgaaaccccagcgcggtcctcggtgggggtggaatggggtggggtggggggcgcggccgcgccgctgggcgccctccccgccctcccccctccccacccccagtcctccctccgctgcccgccccccaagcccggtgtcgccccctccgccccctgccgcatccccggagccagtgcccacaggggccaggcagcccgcaggggtcgctcacggctggtgtaggggcttggtccaccacgctagtacttcgggcaccaaaatagaaaaagaataacgcttggaaagaatctgatgtttccgaaggagcatcgaaaatcgccgttacgggaaaagtaaaac

SEQ ID NO: 117920 - DNA, 169 bp, Homo sapiens; identical to SEQ ID NO: 87042
  chr2:97203376-97203545
  Hyper

SEQ ID NO: 117921 - DNA, 30 bp, Homo sapiens; identical to SEQ ID NO: 87043
  chr2:97275430-97275460
  Hypo

SEQ ID NO: 117922 - DNA, 639 bp, Homo sapiens; identical to SEQ ID NO: 87045
  chr2:97427454-97428093
  Hypo

SEQ ID NO: 117923 - DNA, 30 bp, Homo sapiens; identical to SEQ ID NO: 87046
  chr2:97435640-97435670
  Hypo

SEQ ID NO: 117924 - DNA, 30 bp, Homo sapiens; identical to SEQ ID NO: 39596
  chr2:97437788-97437818
  Hypo

SEQ ID NO: 117925 - DNA, 30 bp, Homo sapiens; identical to SEQ ID NO: 87048
  chr2:97553301-97553331
  Hypo

SEQ ID NO: 117926 - DNA, 30 bp, Homo sapiens; identical to SEQ ID NO: 39597
  chr2:97603228-97603258
  Hypo

SEQ ID NO: 117927 - DNA, 139 bp, Homo sapiens; identical to SEQ ID NO: 87050
  chr2:97605950-97606089
  Hypo

SEQ ID NO: 117928 - DNA, 97 bp, Homo sapiens; identical to SEQ ID NO: 87051
  chr2:97651788-97651885
  Hypo

SEQ ID NO: 117929 - DNA, 209 bp, Homo sapiens; identical to SEQ ID NO: 87052
  chr2:97652196-97652405
  Hypo

SEQ ID NO: 117930 - DNA, 62 bp, Homo sapiens; identical to SEQ ID NO: 87054
  chr2:98025655-98025717
  Hypo

SEQ ID NO: 117931 - DNA, 30 bp, Homo sapiens; identical to SEQ ID NO: 39601
  chr2:98263541-98263571
  Hypo

SEQ ID NO: 117932 - DNA, 89 bp, Homo sapiens; identical to SEQ ID NO: 87058
  chr2:98351134-98351223
  Hypo

SEQ ID NO: 117933 - DNA, 30 bp, Homo sapiens; identical to SEQ ID NO: 39603
  chr2:98354137-98354167
  Hypo

SEQ ID NO: 117934 - DNA, 145 bp, Homo sapiens; identical to SEQ ID NO: 39604
  chr2:98357736-98357881
  Hypo

SEQ ID NO: 117935 - DNA, 30 bp, Homo sapiens; identical to SEQ ID NO: 87061
  chr2:98614089-98614119
  Hypo

SEQ ID NO: 117936 - DNA, 215 bp, Homo sapiens; identical to SEQ ID NO: 87062
  chr2:98633480-98633695
  Hypo

SEQ ID NO: 117937 - DNA, 189 bp, Homo sapiens; identical to SEQ ID NO: 39605
  chr2:98702143-98702332
  Hypo

SEQ ID NO: 117938 - DNA, 154 bp, Homo sapiens; identical to SEQ ID NO: 87064
  chr2:98703234-98703388
  Hyper

SEQ ID NO: 117939 - DNA, 150 bp, Homo sapiens; identical to SEQ ID NO: 87065
  chr2:98957243-98957393
  Hypo

SEQ ID NO: 117940 - DNA, 2026 bp, Homo sapiens
  chr2:98962692-98964718
  Hyper
ggagagaacccagaacggaacgacggacttgtttgctttcttgcccctgactctccccgtcctccctgggagggttggggatgtgaactaatgacttctgcctctttcggaccgcctttgaggctccagagcctcaccttactttcccacggagagggaggccacaggctccttcagcagtcgccgagcagagtcctgggccgggagcgcgggggagggagcgagcggaactgcgcctaggaggccgagggaggaggcgctccgcagaccctggcgcgccgcggagaagctcaaactttggcagggtaaggatttttaggggctcttgagctggaattttttggggggcgccgggaggtgtgctggggccgcagaccccatacaggaggtaagttagagaaccacacgcaggggagggatgctgctgcttccaggggcgggcgcggcgctgtccgcagcccccggtgctgaaacgggccgcgggctggagagaaagtgaaaaaggatcggctacggcctcggctcccactccccggctcccatacccctccagtccagttcaaaggacaggaagccctccccgtgctccccaagccgatcgcacccccttttactcacgtcccacagccgcgctgggccgagcccgctgagccgtcggggcgggaggcagaaggagcagggctggctcccgctggggacgggtagggcttgcagccgcgaccccaccccatacatttcctcctgtcacgctgtccccggaccgccagtccgggaaggacccacttccccggctccaagtcgggagcgggcgccgcgtcttctcgagtccgcgccgcgccgggggaggttgagtcagtggcctggagggagcagggccgggggaaggcagcggcgaaggactgccccccaacccaggggactattttcccttggggattcaaagagaaaggtaggctgaggaggaggcgagaattaaaattcttttaggagtgcgcggttactttttttaatgataaaatcacacccgggatctcggacgcccggggcttagtgctcggtgatggaggagaaggggcggcgggctctctgatcctctgcaatcccctaaccggataaaggcgccgggctcccagccgtcaggcttttctctttagctcagcccgcggcccctcccgacgcccctgggggccttggcgcgcaggccctcgcagtcccgcaaccccgggccgggtgattcatttttctccctgtgtaatctccctactgagcggcgcagctgggactttaacttcggccctctgcagcgggggtctccggttggcgcggcgcgtgagggaggatgaatggcgctggaacctagaggacctggagccggcgccccggcctctttggcctgaaccaggtgcctctgacacgcagtccgccggctcaggcctcgccggaagctggcgggagcagtcccttgcagcgaagcccggcaccccgacggcagacgctccccatcacatcttccaaaggggcgaggctgggatcagcaggaatggcacccacccgggttcagactccatcccggagtggacagctcggtgcccctaacattatgcactgtccgccaccccctccccccaacacatacacactttcattcatgaaaaccagcaagaatagtgctgtctgggcacggagtccaatgtacagcgtgcgttcacgctgagaattcatgggggacgcgggtggttgggccgggagaggagagatggtcacttgtgtgtggtatccaccaactgggtcttctacgccagagtcccagttgtagaaaagtcggccaggtcagaggacccagatgggatttcactaagctggtgggagcttctttgcgttctttggggtagggggaaggacaggaactccccctgcttcgcaccaatgcccaaacaccgcacttcctcttcagcctcggttcagccacagagaggggcctcctcctgtgtagatgcccggaggggaggagcggtggttcttgggg

SEQ ID NO: 117941 - DNA, 87 bp, Homo sapiens; identical to SEQ ID NO: 87071
  chr2:99004128-99004215
  Hypo

SEQ ID NO: 117942 - DNA, 30 bp, Homo sapiens; identical to SEQ ID NO: 87075
  chr2:99264200-99264230
  Hypo

SEQ ID NO: 117943 - DNA, 512 bp, Homo sapiens
  chr2:99438995-99439507
  Hyper
tcggcacgaggacaccgagaacttcttcgcgcctcgcagctcggcaccgcccctctccgccttccgctctggcgccgccctctcggcgcccgccggtggcgcctcggctcgctcggccttggggcgctccggggcggcggcctctgcgtcgagggaaccggggccgggctccaccgggggagactccgcagcggcaagcggcggggacgcggcggggccctcgctggcggccgcgggccggtgtttcaggcagctcttgggcgccggcgggctcggggcgggcgccgtggagggctcggtcccaattctctcgggctcggtccccgctcctctctcgggctccgtctccgcttctctctcgggctcaggcgccggccctgggggccccttctcctcatccgggagcacgggcggcgtcggctccgcttccttcgggacactgcgttctggcccgtcgcgagcagagggcgcctctgaggtggcggcggggtcagtctcggggggagtcgtgt

SEQ ID NO: 117944 - DNA, 985 bp, Homo sapiens; identical to SEQ ID NO: 87079
  chr2:99552170-99553155
  Hyper

SEQ ID NO: 117945 - DNA, 125 bp, Homo sapiens; identical to SEQ ID NO: 87080
  chr2:99553419-99553544
  Hyper

SEQ ID NO: 117946 - DNA, 30 bp, Homo sapiens
  chr2:99553797-99553827
  Hyper
tcggctgtcggaggccgagagggcctggac

SEQ ID NO: 117947 - DNA, 38 bp, Homo sapiens; identical to SEQ ID NO: 87083
  chr2:99694705-99694743
  Hypo

SEQ ID NO: 117948 - DNA, 93 bp, Homo sapiens; identical to SEQ ID NO: 87084
  chr2:99795933-99796026
  Hypo

SEQ ID NO: 117949 - DNA, 152 bp, Homo sapiens; identical to SEQ ID NO: 87085
  chr2:99796326-99796478
  Hypo

SEQ ID NO: 117950 - DNA, 100 bp, Homo sapiens; identical to SEQ ID NO: 1551
  chr2:99798646-99798746
  Hypo

SEQ ID NO: 117951 - DNA, 101 bp, Homo sapiens; identical to SEQ ID NO: 87087
  chr2:99799327-99799428
  Hypo

SEQ ID NO: 117952 - DNA, 31 bp, Homo sapiens; identical to SEQ ID NO: 87088
  chr2:99951500-99951531
  Hypo

SEQ ID NO: 117953 - DNA, 72 bp, Homo sapiens; identical to SEQ ID NO: 84768
  chr2:100107653-100107725
  Hypo

SEQ ID NO: 117954 - DNA, 162 bp, Homo sapiens; identical to SEQ ID NO: 39613
  chr2:100108060-100108222
  Hypo

SEQ ID NO: 117955 - DNA, 88 bp, Homo sapiens; identical to SEQ ID NO: 84770
  chr2:100196908-100196996
  Hypo

SEQ ID NO: 117956 - DNA, 178 bp, Homo sapiens; identical to SEQ ID NO: 84771
  chr2:100339611-100339789
  Hypo

SEQ ID NO: 117957 - DNA, 104 bp, Homo sapiens; identical to SEQ ID NO: 84772
  chr2:100381776-100381880
  Hypo

SEQ ID NO: 117958 - DNA, 63 bp, Homo sapiens; identical to SEQ ID NO: 84773
  chr2:100403903-100403966
  Hypo

SEQ ID NO: 117959 - DNA, 186 bp, Homo sapiens; identical to SEQ ID NO: 84774
  chr2:100422787-100422973
  Hypo

SEQ ID NO: 117960 - DNA, 210 bp, Homo sapiens; identical to SEQ ID NO: 84775
  chr2:100616138-100616348
  Hypo

SEQ ID NO: 117961 - DNA, 73 bp, Homo sapiens; identical to SEQ ID NO: 84776
  chr2:100623015-100623088
  Hypo

SEQ ID NO: 117962 - DNA, 541 bp, Homo sapiens; identical to SEQ ID NO: 84777
  chr2:100720888-100721429
  Hyper

SEQ ID NO: 117963 - DNA, 30 bp, Homo sapiens; identical to SEQ ID NO: 84778
  chr2:100820254-100820284
  Hypo

SEQ ID NO: 117964 - DNA, 1387 bp, Homo sapiens
  chr2:100937789-100939176
  Hyper
aagcctcgggcccaccggccagctccccaccccgctgctgggccggacaggtgtaggggaggcggacccgccccgcagccgactcacccagctccagggcctggtcgcacctgagcagcgcggcctccggctgctgctggcgctgcaggctccgcgcctggcctgccagcctgcgcagccggcactcggccgggaagcacttctccagcaggccgctcagcaccacgttcacgcgccgcacctgcggccgcgcgggccctggctccacgcagcgcttgcagactgtgagcccgcagggcagcgtcaccggcttatgcagcagccgccggcagcgcgggcagccgagcaggtcgcggggcgcgcggggctccggggccggccctccctcgccgggcgcctcgggctcgccgcccgggttctccgcggacagcggccggtcgcgcaggcccacggcgcgcaccaggccgcccgccagctcttccagctcctccggccgcagcgccccgagccgcgcggcgccgcggaacgcgcccagggcttcggggaggcggccggcgcgggccagcgcgtcccccagcctcaggcacaggccgcggtccggctgcgccagcccggctagcatggagcgaaagagctcggctgccatctcgtagtcgcccgcgcggaaggcctcgtcgccctcctctaagcgctgggcgatcggctccgcgcggtcgcagccaggacactggggcggcggcggcggcgggaccggctcggggctcatcaccgcggggctgcgacgacgcgggtccggagcgaaggcgcggagcagggaggatgcgctgctgctgggaactggccggcgggagcgcggtctcagccctcgccagcagccacgcgcgtctgggggcggcgcgctgcgagcggctgagaccgcgggcgggggcgggcgcctggcttgggcagcgtcctcagcgcggtgtgggcggcgagccccgcagggctgcaatcgttccggggtgggggccgggacaggcaccgcgggcgcaatctgagcccctgcccacgcgcagcggcctctcagtcccgccggcttaggtaacccaggtcgctgcggtaacgcagtgaccgcgctccaggtccgcgtctcttgcgatgcttcccccactcgcctgagggctcctgcgcgactgcgcgcgcgtcctctgcctgccgcctccccgcagaggtgccggggccctgggagcaggtggccttggccgcgggctgctggcgcgccggcaccgcggcacctgctcttccccagaggcctggccgcccccacaacctgtggctccgcttaagcaagaacccaggaaaagtcaccaaacgcatcacgcatctctagcttcgacttaggaaattg

SEQ ID NO: 117965 - DNA, 30 bp, Homo sapiens; identical to SEQ ID NO: 84784
  chr2:100993554-100993584
  Hypo

SEQ ID NO: 117966 - DNA, 30 bp, Homo sapiens; identical to SEQ ID NO: 84785
  chr2:100995355-100995385
  Hypo

SEQ ID NO: 117967 - DNA, 30 bp, Homo sapiens; identical to SEQ ID NO: 84786
  chr2:101007539-101007569
  Hypo

SEQ ID NO: 117968 - DNA, 175 bp, Homo sapiens; identical to SEQ ID NO: 84787
  chr2:101009822-101009997
  Hypo

SEQ ID NO: 117969 - DNA, 718 bp, Homo sapiens
  chr2:101033591-101034309
  Hyper
caatatcaataattccgcgggtcacagcatcccgcacaaggacgccttcttattgcataattaacgcgaggaaggctcttcccgctactcccgcgaactagggaggtcttcaagtcgccaaaacacaccgggatgtggctcgccaggacaaaacccgcgggttccccggtttttccgtgcgccccgcggcggggagaggggcccaggcgctgaaacccacccgcctgcgcgtccccgagctcaccctactggagcggcgctcgtccgggtccttaggctcctcccctggccctgggggcgccgcgcgggtcgggcttcgccgggcctgtgggcgaagcgcgcggggtcctgggagctcgggaggcccgccccaccttgccccgaggcctccgcgccgcggcccgtcgggtcccgggatgtggcggcggcggcagcggaagtaaggaagacgcccggcgcgctagaccggctttgggggccagaacgccggcaccgcctcacgcggccccctcgcgcctatccggccgtgcgcgccgcctgcccgcgcgcgtccccgccgccgtccccggccgtgcgcgttccagcgggtcgcggggagtggggaggggcgcggccgcgggaccccaggcccggatcccgagtctccctttctgccgctgcaaaagcgttctttctgaccgagacctgcggccggaacaagtcccgctgggcctccatc

SEQ ID NO: 117970 - DNA, 125 bp, Homo sapiens; identical to SEQ ID NO: 84790
  chr2:101056687-101056812
  Hypo

SEQ ID NO: 117971 - DNA, 30 bp, Homo sapiens; identical to SEQ ID NO: 84792
  chr2:101228276-101228306
  Hypo

SEQ ID NO: 117972 - DNA, 429 bp, Homo sapiens; identical to SEQ ID NO: 84793
  chr2:101435684-101436113
  Hyper

SEQ ID NO: 117973 - DNA, 30 bp, Homo sapiens; identical to SEQ ID NO: 84794
  chr2:101436712-101436742
  Hyper

SEQ ID NO: 117974 - DNA, 183 bp, Homo sapiens; identical to SEQ ID NO: 84797
  chr2:101520526-101520709
  Hypo

SEQ ID NO: 117975 - DNA, 41 bp, Homo sapiens; identical to SEQ ID NO: 39616
  chr2:101835056-101835097
  Hypo

SEQ ID NO: 117976 - DNA, 30 bp, Homo sapiens; identical to SEQ ID NO: 39617
  chr2:101893777-101893807
  Hypo

SEQ ID NO: 117977 - DNA, 35 bp, Homo sapiens; identical to SEQ ID NO: 84809
  chr2:101959293-101959328
  Hypo

SEQ ID NO: 117978 - DNA, 48 bp, Homo sapiens; identical to SEQ ID NO: 84810
  chr2:101997524-101997572
  Hypo

SEQ ID NO: 117979 - DNA, 108 bp, Homo sapiens; identical to SEQ ID NO: 84811
  chr2:102003501-102003609
  Hyper

SEQ ID NO: 117980 - DNA, 320 bp, Homo sapiens; identical to SEQ ID NO: 84812
  chr2:102003834-102004154
  Hyper

SEQ ID NO: 117981 - DNA, 879 bp, Homo sapiens; identical to SEQ ID NO: 84813
  chr2:102090355-102091234
  Hyper

SEQ ID NO: 117982 - DNA, 212 bp, Homo sapiens; identical to SEQ ID NO: 84817
  chr2:102246999-102247211
  Hypo

SEQ ID NO: 117983 - DNA, 262 bp, Homo sapiens; identical to SEQ ID NO: 84824
  chr2:103235936-103236198
  Hyper

SEQ ID NO: 117984 - DNA, 30 bp, Homo sapiens; identical to SEQ ID NO: 84827
  chr2:103510419-103510449
  Hypo

SEQ ID NO: 117985 - DNA, 91 bp, Homo sapiens; identical to SEQ ID NO: 39619
  chr2:104014594-104014685
  Hypo

SEQ ID NO: 117986 - DNA, 40 bp, Homo sapiens; identical to SEQ ID NO: 84831
  chr2:104275911-104275951
  Hypo

SEQ ID NO: 117987 - DNA, 225 bp, Homo sapiens; identical to SEQ ID NO: 84833
  chr2:104726683-104726908
  Hypo

SEQ ID NO: 117988 - DNA, 28 bp, Homo sapiens
  chr2:104963628-104963656
  Hypo
cacggtggctcacgccgactgtaatccc

SEQ ID NO: 117989 - DNA, 165 bp, Homo sapiens; identical to SEQ ID NO: 84835
  chr2:104984754-104984919
  Hypo

SEQ ID NO: 117990 - DNA, 30 bp, Homo sapiens; identical to SEQ ID NO: 84837
  chr2:105147581-105147611
  Hypo

SEQ ID NO: 117991 - DNA, 1554 bp, Homo sapiens
  chr2:105458957-105460511
  Hyper
ttgggaagactcaggcgaaagagggagatgcccgtgtagagaaccgaggaggggggctggggtagaataatcagctctaaggttgcagatttagatctcaaggctgaaaaggataagcttccaccagagcatcctgtagcgcctcctgtcctgccctgccctgccctgcgcgcgcaccgcactcacacgtacacccggtcctcgcacgcgcacacacgcacactgttccccgccgctctaccctctagactgcaagggaaacggctcctctggggcgcgctcaccggaggtgaggcgacccagcccggcccaggccagcctggtacccagcgctggtcgctgcccctgtggggaggcagcgcggccttcggggctccagagcgcgcgggcccggaacgaggcgcgcggccgctggcacatgcggggactgcccagcgcggactggagaaggggagcgaaggggtggggagggggtgacgccggctgcccaccccgctccgcgcctccctctgtggccctctctcccttcttcccctcccaccctgccgctcccagccgcgtatggaactcgcgtttggaaaaggcacggagcaggcgggcagctgtgcgtgtgcgcgccggtggcctcggacgcagccagcgcgaggacctcggcgcggcggtagcgccccggcgggccctccaagtgccggcctgcagggggcgccggcgcgctcgcgccccgcgggttctccaccgccccgccttcgcccaccgaggaagggtcggagggaggacccggacgggagcaggttcccttcgcgcctctctggagggtcggcggggccctcaggctggtgctcacccgtaggaccgggacggtgttgtcacacttgtcaccaacgacggccggcgtggcgtcgcaagtccgctttccagtctcagcggctggaggaggcctcggggcggcagggggagtttgcctcccggctggctagcttcgctagactcagtcattactaaggggttgggagggggagcttgtctcttctctcctggcagagccgcgggaggcgtcggaaagtttcctaccacttgagggacgaaggtggatggatcgagagccttgtttccctgctgggatggccgaatgtaccagaagtctcgctggcgagcagcgccctcggcttccccggcaatcatcccaaacgcacacccttcccctggccgaaggaaccccaggttgcctaggaaacggccccgcggacctggcgggccctagggtggagacccgggcggggttggggggtactcgcgaatctgctgcgggcgcagcgttggggtgtctggtccctgcccagccggtaggccgcgtccgccgtcccactcagtggggctttgcgcccccacccatgggagttgcccgttccgcagcagagttcgaaggggaaagtgggggccacgttcccagaggaacagagttccagacctctcagggcactgatggggactccgtcggacccacgggttccgcaaacactccagaggggttcccagggccgaagatgcctcctg

SEQ ID NO: 117992 - DNA, 1431 bp, Homo sapiens
  chr2:105460921-105462352
  Hyper
ggagagggtgatacacgttcacacaccgcttgctaaatgcagtggcgagaggagggagcagcgtctacatgaagcgaacttttcaagcgcagagccctgactcccaggcgcgggggctcaccgggaggggcccgggcgagagagcgcgtgggtgcgtgagtgcctgtgtgcgcccgccctttgcttgctcggggtgtccgcctttgtcccccgccgcgggcctccacggtgggatctgcgcgcggccggtgggcagccctcgacccggggcgcgtccacagcgcccacccgcggcccccaaacacctcgagagcagatcttaggggttaaccaggcaccgacctgaggcgccctgcagctgccaaaagctcgaccggaaacctagaacatgggacccaattcatcggttttcctcgtccatacatgcatccatccatccctgcatgcgtacatgcatgcaatacaaatcccgggacgccggcacggagagctgcgcctcgcccttgctgcgggctgagagcgggtacccccccttccagctcttcctcctcccgcgcagccgcggccccctccccgaaggaagaacagctcaattacgaagaggagccaaggaacgaaatcccaggctcagaggcgcccgccgttgctcctctgttcccggtccctgtagtgcagtccccacccccaccgtccccagctcggggagggcggggacgcggcggtgcgaggggtcctgccctgctccgccggaacaaagcccgccgcaggagcccgcggccgcgcaccgaatcagtgacaaaggcaagcgggcggcgccgagctccaagccggcgctcctacggcttggcgggaaggaggcccagaagatggggtgcgatttgcacccggattttcctgggctgcagcatctcgctcctgtgtacccaatgacctgttagggtgactcagcgtttatctcttcgcctccctgctgccccatctcctctcttgtcctcttctgtccccagtctccttcaccgctccctgcatgttttaatccacctcactccttgtaccttacccgcttctcactttgccctatttacctctttccctttttctttcccatagaaaagcaatgctaattcgacttctgaaggccgctctagatgttcaaataacagtctgaaagaccttgctgggcagtgctcagagagaaaaggggagtaatgggatccttttaattttattatgcaaactgtgccctaaataaaataaaacgccgttagaatgcgatctaaggaagccgagcttagccctggggcccccaaaatggccggagattcgggagaagtcgcttctcgtgcccacaaatcacaggaatgttgggggtgggggtgagaggaggacctcgccgctgtggaatggggacctcagcgctggagactccaa

SEQ ID NO: 117993 - DNA, 2506 bp, Homo sapiens
  chr2:105468563-105471069
  Hyper
ttatatatacatatacgcatacgtaaatataaaaagcaacctttgggggccgcagaggaaaaaaatccgttctgtttggggtttggttaccaccgcctttggtatctataccttggcaataatggctttgctaaaacctacctacgatggtatctcacccggcaagcaggagctggacaagagcctacataaattctacgcgtctagtgttaatcttgagatcacgcgggggctgcctggctgcggctgggcaggagaactcctgctttcactgagttcacttaactgcgctcggcagaggcacgatacagcgggagagaagggcaggcccgttcacattttaatcggagcgcaccggcggccgctcctcggctgcgtcctgggctgccgctcgggctcgggactgccagatgcaggctctggctgggggcggcgggcgcaagcgggcgcacccgcagctaggggtgcggggtgcacgcacacgcacgctcattaagagccatgtatttattgaatgtccgagttgggttagttcattggaaatccccgaggagggctcaatttgcccttgttttcgttgccactttctcttttttcttggttcgctgaggttcctctgtgcagcgtttccgcttggccgcgtccccccaccccaccccaccccacccccgcttctctcgcctaccgggtgcactccccctcccatcccccttaactctttcagctgggttagagctgagaaagcatttgtcgccgccagccccatccaccacgcaaatccatctgagacagaaaggaaagaaaaaaaagcaccaccatgcctaagaatagagagcgagcaaacccccccaccgctaatcacacacacacacacacacacacacacacacacacacgaggaagcggtggagcagagaagggcgcggctagccgatcccggttctttcgcccggctcctgctgccacagggaattcctaaagccattggggtcgaatacacttacgatgaatctatgggggaaggtcggactgattgcttttcaaatacatcgcacggctccgctgaccggcaccctccaaactcacaagggcacgcacgctacttgcacgaatcccagaggagggaggagggaggaagggagggagagcgaaggagggagagagggggtggaggagccagggagcggcggcagcgagcggtccgtctcgcacgcgcgggcaccgcgctggtcctgggctgcaggtttcccagatgatggcatccgagaacttaaacaaagggggctgccgccggcgcgcaacggctgcggaaagttgcggtggcggatttccaaggagcgtggccacgaccagagctcttggcgatgcgagcccccgcttcccacccccgccgatcagagaagggggccggctggtgaagggaagaggaaactttgaaaccactggggacacatctgtctataggtattagcttgaatggtacatccgtgccgcgcgctttacaaatctctggcggggcgggggtaagggggtgagcaacccgacgcgtactaggtggggtgggcaggttgctatttttcatgtttcccccttcgttttccttctgattctcttcccccctctcgtccctccctcccttttatctcccctttcttccccccgcccagacctattgcgaacgcccagagccgccgagggaacgccaacgtctgggccggacactaagagttaagatgtggcggagggggcggcgggggaggggcggggaggggaaagtggtgagggggagggaggctggaggacgacagatttccagcttctacgacgctctgcctaaattaaaaagcaaccaatcggaacggccggaaggggggcctcgcgtcctgagccagtcattccgagcctgccaatcacccagcgggtagccaatcagcgggggccctggtgctcgacttccttgtatttgggaaagtgtggtggtgggtgcgcgctcgcggcggagggtaaacattcgacagtccccgctctgagagggagggacagagagcgaactgtcagatcggagcgagagcgggcgcccgagagagggagagagagagagggagggagaggaaaagtgagagagggaaagagagcgcgaacgagggcgcagagcgagctcctgctgcaactctgctccagcacggccagcgccagcgcccgccgtcggtgcactctacgagccgtgcagcgtgcccactggagttgttgtgtatcaaggatcgatcccctatatgcacacacacacctccacctccaccaatgcactcttcttcctcctccttctccagacaactgctgggaaaaaaataaaacaccaaccccaaccgtcagcaacaaggtaacagagcgattcgacatcattttttttcctgttcaattttttccttgttatatttgtttcctaatttctgcccaaaaggaaagatgtcgcatcagactgtgactgttgcgaggagaatgaaaa

SEQ ID NO: 117994 - DNA, 326 bp, Homo sapiens; identical to SEQ ID NO: 84849
  chr2:105471422-105471748
  Hyper

SEQ ID NO: 117995 - DNA, 240 bp, Homo sapiens; identical to SEQ ID NO: 84850
  chr2:105471808-105472048
  Hyper

SEQ ID NO: 117996 - DNA, 1706 bp, Homo sapiens
  chr2:105472108-105473814
  Hyper
gggcggcggcatgcagccgggcagcgccgccgtgacctcgggcgcctaccggggggacccgtcctctgtcaagatggtccagagcgacttcatgcagggggccatggccgccagcaacggcggccatatgctgagccacgcgcaccagtgggtcacagccctgccccacgccgccgccgccgccgccgctgccgccgccgccgccgtggaggcgagctcgccgtggtcgggcagcgccgtgggcatggctggcagcccccagcagccaccgcagccgccgccgccaccgccgcagggccccgacgtgaagggcggcgccgggcgcgacgacctgcacgcgggcacagcgctgcaccaccgcgggccgccgcacctcggacccccgccgccgcccccacaccagggccaccctgggggctggggggcggccgccgctgccgcagccgcagccgccgccgccgccgccgccgcgcacctcccgtccatggccgggggccagcagccgccgccgcagagtctgctctactcgcagcccggaggcttcacggtgaacggcatgctgagcgcgccaccggggcccggcggcggcggcggcggcgcgggcggtggagcccagagcttggtgcacccggggctggtgcgcggggacacgccagagctggccgagcaccaccaccaccaccaccaccacgcgcatcctcacccgccgcacccgcaccacgcgcagggacccccgcaccacggcggcggcggcggcggcgcggggcctggactcaacagccacgacccgcactcggacgaggacacgccgacgtcggacgacctggagcagttcgccaagcagttcaagcagcggcgcatcaagctgggcttcacgcaggccgacgtggggttggcgctgggcacactctacggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaagtgccccaagccctccgcgcaggagatcaccaacctggccgacagcctgcagctcgagaaggaggtggtgcgggtctggttctgcaatcggcgccaaaaggagaagcgcatgacgccgcccgggatccaacagcagacgcccgacgacgtctactcgcaggtgggcaccgtgagcgccgacacgccgccgcctcaccacgggctgcagacgagcgttcagtgaagccagggcgcagagcgaagagggccgccgccgccgccgcctccgcagccgccgtcagcaccgccgccgcccctgccgccgccgccgccgccgccgccgccgctgccgccgccgcgccgaccctgcacctgggccgctccgggctccagcccaggcccatccgccgccctcccctccacccagagacaggcatgcccgcccttggaggagaaaacgcgggagaaacggaccaaggaggcatttttgcagtccaaggaaggaggggccaaaaaataaaaagcataataaacacccagactgttttgtatacatatataacaaacaaaaccggaagagaaaaagg

SEQ ID NO: 117997 - DNA, 347 bp, Homo sapiens
  chr2:105474399-105474746
  Hyper
gaactgggagcagagcgggggcccagccagcgaggccgccgagccaggcccggccgcgtacccaggctttgacggctgccattcagggtggacgatgcctaaagattccaccgctaatattttttttattaatattttttattttttatttctggactgactcagataaaggaatttagaaagactgagcaccagccgctgcacttctctggacttctctcctcaatccgttgccaactttgattgaatgggtgctgtggatgtgattatataatactgccatttccaagcagtgtttttggtaggttttaataaacagacttttcaaaagacggcaatatagaatt

SEQ ID NO: 117998 - DNA, 30 bp, Homo sapiens; identical to SEQ ID NO: 84854
  chr2:105477283-105477313
  Hyper

SEQ ID NO: 117999 - DNA, 685 bp, Homo sapiens
  chr2:105478626-105479311
  Hyper
ctatgatgtcactgccggccagaggcggccgcctggccttctggcgggctgtgcgctgcgttcttgatgagtccggtcttcctcaaggaagagttggctctggaagtgacctcagaggggtctgggaagagggcaacagtcattctcttggcggcacgatgtgtgcgctagtgtgtgcgcgcgcgtgccgtgtgcatgtgggtgcgcgtgaggggagggggaagcggaaattcgcagtctggaccccgaagccctaggggtacaggcgacggggtcaggtgtaaggcctgcctccggtgaaaaccccggatcagaagaggcggagggggagggggacccgaggcagccgggcgtccaaagctcgcttctctccgggagggagggcagggctgggcgcggaggtggggcggtggcggtcgcggtggggcggccgggtccctgctcggcccggcacggccgggcggccagactgtggcagctgctgtgggtcccacaagttgttttcctcgtggcgaccattcagcaaaacgcacgaacctttctcaaagatttaaatttcgcggatgaattaccatacacccgttgcttagcaactaaattcaagcagggctaagaatatgcaagctttttgtattctcattaataaaaatgccactctgacacagcaacccgactttggatcact

SEQ ID NO: 118000 - DNA, 321 bp, Homo sapiens; identical to SEQ ID NO: 84857
  chr2:105479678-105479999
  Hyper

SEQ ID NO: 118001 - DNA, 107 bp, Homo sapiens
  chr2:105480530-105480637
  Hyper
tgcctgtgcctggcccggtgagggtcgctcccccaggccccgtctccgcccgaggactgcaggcctaggcctgcggggagatcctgagaccgcggtgtgcgggcgcc

SEQ ID NO: 118002 - DNA, 216 bp, Homo sapiens; identical to SEQ ID NO: 84859
  chr2:105483624-105483840
  Hyper

SEQ ID NO: 118003 - DNA, 337 bp, Homo sapiens; identical to SEQ ID NO: 84860
  chr2:105484041-105484378
  Hyper

SEQ ID NO: 118004 - DNA, 997 bp, Homo sapiens; identical to SEQ ID NO: 84861
  chr2:105488281-105489278
  Hyper

SEQ ID NO: 118005 - DNA, 420 bp, Homo sapiens
  chr2:105489615-105490035
  Hyper
ttaaaaacagggcagcggctgtgagcgctgggccggtaagtaagggcagagaaaggggctgtcgtgtgcgtcccagctctccgacccgcacgtccgggacccctttccgcccgcgcaccgcggtcacttgcagccggcgctggctgcttgagcccgcggccgggtcgcccggcttctctccgggagagtggccagggcctaggcgctcgctcaagagggagagcgaagggaaaagaagaaagttctccgccggccgcgcgcagctcctcccgtgagcgcgccccagccctgggccggcccgacccgacccgcgacggggccacgcgtagtgccaggcaactcctgtgccctgtggccagccccgcgcgcgcactcgcactcacacacactcatactcacaccccacggttctttttgttc

SEQ ID NO: 118006 - DNA, 30 bp, Homo sapiens; identical to SEQ ID NO: 84863
  chr2:105515638-105515668
  Hypo

SEQ ID NO: 118007 - DNA, 35 bp, Homo sapiens; identical to SEQ ID NO: 84864
  chr2:105719619-105719654
  Hypo

SEQ ID NO: 118008 - DNA, 441 bp, Homo sapiens; identical to SEQ ID NO: 84865
  chr2:105760563-105761004
  Hyper

SEQ ID NO: 118009 - DNA, 20 bp, Homo sapiens
  chr2:105761064-105761084
  Hyper
actgtcgcccatcccagctc

SEQ ID NO: 118010 - DNA, 30 bp, Homo sapiens; identical to SEQ ID NO: 84868
  chr2:105840269-105840299
  Hypo

SEQ ID NO: 118011 - DNA, 30 bp, Homo sapiens; identical to SEQ ID NO: 84869
  chr2:105840502-105840532
  Hypo

SEQ ID NO: 118012 - DNA, 84 bp, Homo sapiens; identical to SEQ ID NO: 84870
  chr2:105858316-105858400
  Hypo

SEQ ID NO: 118013 - DNA, 162 bp, Homo sapiens; identical to SEQ ID NO: 84872
  chr2:105972350-105972512
  Hypo

SEQ ID NO: 118014 - DNA, 171 bp, Homo sapiens; identical to SEQ ID NO: 27406
  chr2:106014945-106015116
  Hyper

SEQ ID NO: 118015 - DNA, 131 bp, Homo sapiens; identical to SEQ ID NO: 84875
  chr2:106015416-106015547
  Hyper

SEQ ID NO: 118016 - DNA, 279 bp, Homo sapiens; identical to SEQ ID NO: 84876
  chr2:106016119-106016398
  Hypo

SEQ ID NO: 118017 - DNA, 177 bp, Homo sapiens; identical to SEQ ID NO: 14440
  chr2:106060615-106060792
  Hypo

SEQ ID NO: 118018 - DNA, 156 bp, Homo sapiens; identical to SEQ ID NO: 84878
  chr2:106111050-106111206
  Hypo

SEQ ID NO: 118019 - DNA, 68 bp, Homo sapiens; identical to SEQ ID NO: 84879
  chr2:106143101-106143169
  Hypo

SEQ ID NO: 118020 - DNA, 41 bp, Homo sapiens; identical to SEQ ID NO: 84880
  chr2:106231824-106231865
  Hypo

SEQ ID NO: 118021 - DNA, 48 bp, Homo sapiens; identical to SEQ ID NO: 84881
  chr2:106305501-106305549
  Hypo

SEQ ID NO: 118022 - DNA, 147 bp, Homo sapiens; identical to SEQ ID NO: 84883
  chr2:106560596-106560743
  Hypo

SEQ ID NO: 118023 - DNA, 30 bp, Homo sapiens; identical to SEQ ID NO: 84884
  chr2:106571234-106571264
  Hypo

SEQ ID NO: 118024 - DNA, 30 bp, Homo sapiens; identical to SEQ ID NO: 84885
  chr2:106578646-106578676
  Hypo

SEQ ID NO: 118025 - DNA, 30 bp, Homo sapiens; identical to SEQ ID NO: 14441
  chr2:106672847-106672877
  Hypo

SEQ ID NO: 118026 - DNA, 562 bp, Homo sapiens
  chr2:106681722-106682284
  Hyper
taaggggaacagtggcgcggctggggcgggcggaggaagtgggggagccaaggagacaccccagcgctgggatccggcaagtcctccctctgagtggccagggggcctcgtcccttctcccgatgccttctgcccttccttgggtctccggaacccagcttgtcctaaccgctttcgctgcgggcagcgctggccacgcggcccccgccgccggcggttctccgtggccaagcatccttggccttggagcccaggggctgcgttccccttggggccggggcgggagagaggacctcggtggtactcgcccgtgcgctgggcgcagccgcttggccctcagccctctggcgcggcgcccacccgctgggtcccgccccggcagcgacgcagggataacccgcggccgcgcctgcccgctcgcacccctctcccgcgcccggttctccctcgcagcacctcgaagtgcgcccctcgccctcctgctcgcgccccgccgccatggctgcctcccccgcgcggcctgctgtcctggccctgaccgggctggcgctgctcctgctcc

SEQ ID NO: 118027 - DNA, 30 bp, Homo sapiens; identical to SEQ ID NO: 84889
  chr2:106730211-106730241
  Hypo

SEQ ID NO: 118028 - DNA, 30 bp, Homo sapiens; identical to SEQ ID NO: 84890
  chr2:106778483-106778513
  Hypo

SEQ ID NO: 118029 - DNA, 456 bp, Homo sapiens; identical to SEQ ID NO: 84893
  chr2:106959159-106959615
  Hypo

SEQ ID NO: 118030 - DNA, 143 bp, Homo sapiens; identical to SEQ ID NO: 84894
  chr2:106959900-106960043
  Hypo

SEQ ID NO: 118031 - DNA, 324 bp, Homo sapiens; identical to SEQ ID NO: 84895
  chr2:107103816-107104140
  Hyper

SEQ ID NO: 118032 - DNA, 21 bp, Homo sapiens
  chr2:107278930-107278951
  Hypo
ccaccgcgcctggcctatttt

SEQ ID NO: 118033 - DNA, 30 bp, Homo sapiens; identical to SEQ ID NO: 84897
  chr2:107459415-107459445
  Hypo

SEQ ID NO: 118034 - DNA, 386 bp, Homo sapiens; identical to SEQ ID NO: 84898
  chr2:107460030-107460416
  Hypo

SEQ ID NO: 118035 - DNA, 1705 bp, Homo sapiens
  chr2:107502427-107504132
  Hyper
aacattccccacacacgggtctcgctcctaaacacggagtgtaactccgcgcacagcagcgcggaggctgcagcgccaccaagaaaggcgtcgccaacccttacccagtgccctcccttaccagccttcttcccacgccgcgcctcgaagcgcacgacaccgtggtgctcggtgctccccctggcagcgcggcactggagtccaaggcgtgcgtgtcacattttattccccggcagccgctcgggtgcgcgcgctacgcgctcccacactcacgctggcgcccgctagagctgggaccctggccggggtccccgactcacgccgcggaacttgggggctgcagaaggcgagtgcgcggcgggagtcgtcctgccgcaggctcgagtcctcctcctgccaccgtggggtctcggagctgccccgcgctcccgtcccaggcggcctgcgggatcacctctccggggccagcgctgctccgcgccggcggcagctgcaagcgcgggcggcggggcacagcgggtggctcggcctcaaagccggcgggaggctacgctcagccccgcgctgcacgcctcattgtttcgggcagcgcggcggcggctcccgcggccagaggaaccgcggccccgagccccggggagaggcggcggttcccggcccacgcaccgaggctgcgccgcgccccgcccccgagctccgctcgccccagagccccctccctctccgcgatccctttcatccttcccgctccaggctcacctagctggcgggagccgggcactgggaagttgggctgccccctccccgcgcccccggcccggcagctcggcccgccggcgagcgcaggcggggcgctccctggctgcgcgcggatttctgcttgtcgcggagagtgactgcagacttgggctgcgtggggcggtgcggggcagcacggctgcctaaaaaggcgtgtttctccccggccgccgcctccatccagccctagttcttccgaaggttacctgcacagtacccgcctggcaccgcgcctggacacctccggggcactcgggtcccgggcggcggcaggaatgcaggaatgcgcacaggctgtgggcggccaggagggagtcccggcgcctgccccggcggaagtgagtctttgtgtaccctgtccaacacctccccccgccagcgcggaaggccgggctacctgcgcgcctggcagcgcctggcagccggctgggtggggcgcaggggagcgcagcatcctccccggctcgctagctccctttgttcatctcgctcaaccaggctccgcactgccgcctggccctcgctcccagagcttctctaaggatatgggatggacttgggagcgggccacctttcatttgggaagggtagctcgccaagtccggtgacggtgctccctggagacccccacctgcccgcccctccacactgccggtccccaaccccaagagggacggaaagttcttggggtagaagccggcgggacaagtggttgaagcagcctccggagccagtgggcggctgcgagctgggcagctggagcctgcgggcggggccgcggggaggtgcccatcgagtgtcggtctggtcgcgtgcggaatgtccacttgtcaccgcggcccttgcgttttctcgagacggcggcagctggtcctaggaccccaaaccgcgccgccctttgtttgct

SEQ ID NO: 118036 - DNA, 30 bp, Homo sapiens; identical to SEQ ID NO: 84905
  chr2:107872048-107872078
  Hypo

SEQ ID NO: 118037 - DNA, 24 bp, Homo sapiens
  chr2:108104796-108104820
  Hypo
tttttttttttgagacggagtccc

SEQ ID NO: 118038 - DNA, 47 bp, Homo sapiens; identical to SEQ ID NO: 39632
  chr2:108160878-108160925
  Hypo

SEQ ID NO: 118039 - DNA, 39 bp, Homo sapiens; identical to SEQ ID NO: 84908
  chr2:108310877-108310916
  Hypo

SEQ ID NO: 118040 - DNA, 573 bp, Homo sapiens
  chr2:108602842-108603415
  Hyper
cacacccaccctcctcgcgagggcagcgtccctagcacacgccctagcaccactctcctctgacgtccgcctccggatgtctgacgatcgcccccgcctgccgcccttataaaggggacttttcccaatactcgatcgattcccacctcgccctgcgccgcgcgccctccgccggcgccaacacctgtcaactctgcgcgctcccaggttcttggagacgccgagtgaggagccgccctgaccgcccggccccgctccgcactgcaccccgacccaccccgcaccctccctttctgcaccctcgcacccacacccctcgcggttccagggggcggcggccccgggcggagcgctttcgcgtgcagccaccactccaggtaggagcggagcgggcattcctgcgcctacgggcccgcaccctcggaaacgccttgggcaccgagcccgggcggttttagaggggagggacgcggcgtttttccctctcggtgggatgcgagggcgggtttgctgtctggcaccgttgctgtcagggtgcaagaggctacaaagtctgggcgcaggaaatgggta

SEQ ID NO: 118041 - DNA, 82 bp, Homo sapiens; identical to SEQ ID NO: 84916
  chr2:109335084-109335166
  Hypo

SEQ ID NO: 118042 - DNA, 30 bp, Homo sapiens; identical to SEQ ID NO: 84917
  chr2:109524351-109524381
  Hypo

SEQ ID NO: 118043 - DNA, 425 bp, Homo sapiens; identical to SEQ ID NO: 84918
  chr2:109648039-109648464
  Hyper

SEQ ID NO: 118044 - DNA, 1753 bp, Homo sapiens
  chr2:109744748-109746501
  Hyper
attcaccctcctctgcgcctccgtaggaaaaaattggagcgggggttcacgagactgcgccgcggcgggcgctagagcccctcgcacagcgtcgccaagggtgcggcgtggagccgggcgcctggcgccagggtgctggtcggcgggcagcggcgccagcctccgacccgcgactccggcgagccaaggctgcgccgggaggagtcggcgcgggccccggggtgcccccttcaactggagcgccttcccctcctgccttgcggcgcatccccacacctacaccggaacgaagctccggggctgtcacttctgcgcgcttctcggaaaggagtctgaactgggagcgctccggggggtcgtcggggaggatgcccgggcgtcggctgtgtccccaagctgctcgccggcgctggcgaggaaggcagtcgggataacgccgcccaaactttccttcgcagcagcgttggcaggaaacgtccctctctgaggctcacgaaaagccgaaaaagactcggacgcttggaggaggcagggccaagcctgcgcaggagaggttccccggagccctggagatgtcctaggggaccaggctaatcgccggcttgcgcccaagcgaagggaagtcctgcaggcacggcgcctccttccctgagccccgcagtgaccgtgacctccgcgcgcacccccgcgcacgtgctcgcggccgaggaagaggaacggtcctgctgaatcctctggaggacagcgactagcgagcaggccaggggcgcatggaggtgccgcgggggcggtgcggctcgccagctgcgcggaggagcgtgcacgccgcgccccggcctccccggggacctggccggccgctgcccgcacttcctgccgctggtctcccaggcgcgagccgccgcttgcagcacagaacccgttgagcttcgtgcccggcagcacccccggtcccccgcgcggggcggacttgcggcgggacaggtgtagcccgcagccgcaggcgctgcgctcaggactgggcgggctcggctggccggtccccgccacgcaggccggtccccgccacgcaggccggtcggtgagccacttcgcaccgccacagccctagcatcgggccaccagccggggtgaagaaagtcacggcggagcccggctccccagtcctgatgctggctgccggtggcgggctccacgccggccccgggacctaggcagccgcgcgagaccgctgcgggcgcctcccccatgctgctcggagcgtcctggctgtgcgcatccaaggcggccgccgctgctgcgcagagcgagggcgacgaggacaggccaggcgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccgcatcctggtgggctgcggcgtggacgaactgcccgccaacatcttgctggtgcgactgctggacggcatccgtcagcggccccgcgcgggcaccagccccggcggcagcccgcccgcgcgtcccatcccaggccagagtgcggcccccacgctcgcgggcggcgggggcggcgcggcaggcagcaccccgggttccccggttttcctctccg

SEQ ID NO: 118045 - DNA, 44 bp, Homo sapiens; identical to SEQ ID NO: 84921
  chr2:110015320-110015364
  Hypo

SEQ ID NO: 118046 - DNA, 114 bp, Homo sapiens; identical to SEQ ID NO: 84923
  chr2:110371704-110371818
  Hyper

SEQ ID NO: 118047 - DNA, 30 bp, Homo sapiens; identical to SEQ ID NO: 84924
  chr2:110433828-110433858
  Hypo

SEQ ID NO: 118048 - DNA, 67 bp, Homo sapiens; identical to SEQ ID NO: 84925
  chr2:110518226-110518293
  Hyper

SEQ ID NO: 118049 - DNA, 54 bp, Homo sapiens; identical to SEQ ID NO: 84928
  chr2:111438469-111438523
  Hypo

SEQ ID NO: 118050 - DNA, 193 bp, Homo sapiens; identical to SEQ ID NO: 84929
  chr2:111462929-111463122
  Hypo

SEQ ID NO: 118051 - DNA, 30 bp, Homo sapiens; identical to SEQ ID NO: 84930
  chr2:111483271-111483301
  Hypo

SEQ ID NO: 118052 - DNA, 373 bp, Homo sapiens; identical to SEQ ID NO: 84931
  chr2:111490316-111490689
  Hyper

SEQ ID NO: 118053 - DNA, 101 bp, Homo sapiens; identical to SEQ ID NO: 84932
  chr2:111874886-111874987
  Hyper

SEQ ID NO: 118054 - DNA, 39 bp, Homo sapiens; identical to SEQ ID NO: 84933
  chr2:111875378-111875417
  Hyper

SEQ ID NO: 118055 - DNA, 263 bp, Homo sapiens
  chr2:111876698-111876961
  Hyper
ggtccctgtctgagtcgcccgaccccgcggggagcgcggagcattgcggcgtgcggcgggcttcgggctctcagcccgcgcagcaagttgtgttgcttttccccgggtgcgacgcgggacggccgcgaagagcaaagttcgtccgcggtaggaacttcgaggcccggttaggaccgatctccggcctccgagtctacttagccgtgtccacgctcgtgccttttccctcttgcagcgaaataactgggcggggcccgacgcgc

SEQ ID NO: 118056 - DNA, 66 bp, Homo sapiens; identical to SEQ ID NO: 84934
  chr2:111898079-111898145
  Hypo

SEQ ID NO: 118057 - DNA, 75 bp, Homo sapiens; identical to SEQ ID NO: 84935
  chr2:111912943-111913018
  Hypo

SEQ ID NO: 118058 - DNA, 18 bp, Homo sapiens
  chr2:111928152-111928170
  Hypo
atagtcccagctactcgg

SEQ ID NO: 118059 - DNA, 515 bp, Homo sapiens; identical to SEQ ID NO: 84937
  chr2:112656577-112657092
  Hyper

SEQ ID NO: 118060 - DNA, 49 bp, Homo sapiens; identical to SEQ ID NO: 84939
  chr2:112779046-112779095
  Hypo

SEQ ID NO: 118061 - DNA, 98 bp, Homo sapiens; identical to SEQ ID NO: 84940
  chr2:112896008-112896106
  Hyper

SEQ ID NO: 118062 - DNA, 158 bp, Homo sapiens; identical to SEQ ID NO: 84941
  chr2:113013159-113013317
  Hypo

SEQ ID NO: 118063 - DNA, 185 bp, Homo sapiens; identical to SEQ ID NO: 84942
  chr2:113103246-113103431
  Hypo

SEQ ID NO: 118064 - DNA, 126 bp, Homo sapiens; identical to SEQ ID NO: 84944
  chr2:113190911-113191037
  Hyper

SEQ ID NO: 118065 - DNA, 61 bp, Homo sapiens; identical to SEQ ID NO: 84945
  chr2:113195104-113195165
  Hypo

SEQ ID NO: 118066 - DNA, 42 bp, Homo sapiens; identical to SEQ ID NO: 84946
  chr2:113341856-113341898
  Hyper

SEQ ID NO: 118067 - DNA, 36 bp, Homo sapiens; identical to SEQ ID NO: 84947
  chr2:113494765-113494801
  Hypo

SEQ ID NO: 118068 - DNA, 30 bp, Homo sapiens; identical to SEQ ID NO: 84948
  chr2:113555815-113555845
  Hypo

SEQ ID NO: 118069 - DNA, 79 bp, Homo sapiens
  chr2:114034462-114034541
  Hyper
gcttggcatgggcaccgggcactgcacattaggcctcagggatggtcctggcgatgtctggtatcgtaccacggtttgg

SEQ ID NO: 118070 - DNA, 611 bp, Homo sapiens
  chr2:114034802-114035413
  Hyper
gctctagagagaacccgagtgagaaatcttccggcgccccagggggttcccgctcccctcctagttgggccatggccctgggactggagactgcgccgcagagcccgggcccccgcagtgcgcttggctaaatagagatctcagcctcgctgcgcgcccgatccgaccctccttattataacaaatgtcccgtttgcagagcgggacatcatattcgcggagaattcattctgaaatattgatttcctctcacttcgccggcccaaatcgatagcgatgcgccctggccccataaatcgccttctctgcggccggccgggctccatccatcactgcgggccgcgctgcgcctccaccgctgtccgcactcgctgcgcgccgggacggctgcgcccaccagccctgaccctggagctccttcccagcaaagaccctgcccagccctggccgggaagggggaaaacaggcatcgcggcctgggagctcgagtgtgtttgaaggccctgcttccgggcgcaggtggggagggggttttgactccgcgagcggcttagtcctcaccagccggacgccccgcgcgcggcgcccggcctgcccggtgctgggccagg

SEQ ID NO: 118071 - DNA, 260 bp, Homo sapiens; identical to SEQ ID NO: 84950
  chr2:114256928-114257188
  Hyper

SEQ ID NO: 118072 - DNA, 36 bp, Homo sapiens; identical to SEQ ID NO: 84951
  chr2:114260005-114260041
  Hyper

SEQ ID NO: 118073 - DNA, 745 bp, Homo sapiens; identical to SEQ ID NO: 84952
  chr2:114260750-114261495
  Hyper

SEQ ID NO: 118074 - DNA, 81 bp, Homo sapiens; identical to SEQ ID NO: 84953
  chr2:114394608-114394689
  Hypo

SEQ ID NO: 118075 - DNA, 17 bp, Homo sapiens
  chr2:114469902-114469919
  Hypo
tttttttttttgagacg

SEQ ID NO: 118076 - DNA, 265 bp, Homo sapiens; identical to SEQ ID NO: 39640
  chr2:114515303-114515568
  Hypo

SEQ ID NO: 118077 - DNA, 24 bp, Homo sapiens
  chr2:114515808-114515832
  Hypo
gcgagactccgtctcaaaataaat

SEQ ID NO: 118078 - DNA, 26 bp, Homo sapiens
  chr2:114634729-114634755
  Hypo
tttttttttttgagacggagtctcgc

SEQ ID NO: 118079 - DNA, 85 bp, Homo sapiens; identical to SEQ ID NO: 84958
  chr2:114634995-114635080
  Hypo

SEQ ID NO: 118080 - DNA, 30 bp, Homo sapiens; identical to SEQ ID NO: 84959
  chr2:114737714-114737744
  Hypo

SEQ ID NO: 118081 - DNA, 176 bp, Homo sapiens; identical to SEQ ID NO: 84961
  chr2:114869802-114869978
  Hypo

SEQ ID NO: 118082 - DNA, 30 bp, Homo sapiens; identical to SEQ ID NO: 84963
  chr2:115099730-115099760
  Hypo

SEQ ID NO: 118083 - DNA, 150 bp, Homo sapiens; identical to SEQ ID NO: 84964
  chr2:115141250-115141400
  Hypo

SEQ ID NO: 118084 - DNA, 30 bp, Homo sapiens; identical to SEQ ID NO: 84965
  chr2:115159137-115159167
  Hypo

SEQ ID NO: 118085 - DNA, 2037 bp, Homo sapiens
  chr2:115918661-115920698
  Hyper
cttatggtttttaaccgacctttaggagttccaccgacgtgacccaagcagctggtaggagaatctgggctggattcggaaggcgcagctacaggacgcccgctgccccggatcggaaggcgcagcacctcaggccacaatctcagacacgccctcgggtcccgacaggtgttgcccgcctcccacggggctccgggaccccggtccccgggctgccccctgccttctggggcgctggagcgcgcgcagtggcggagctggagccacccagtgcttcgcacgggcgcgctccgcttctccgggttttagcggaagcctgcggggggcggggtaaccgcggaagccggcggccgtgggcgcgcgggttgggggctctcgcgccgctccgggctctccccccccccggctgcggttgccgaagagaggccggagcgcggcgcccggctgctccacctggcgcgctgagcaccgcgcggggagcccccgggggcgggcggtggggggcgcggactgcgggaagaaggcacgaggcgtcgccgcagctcggtcaggggccggggccccgccgctcgccgctgcactaacttgccgcttggtctcgcctcgccgccgcggctcgctgcgctttgggtggcggggggcggggagagcggggagtcagagggtctgcggtggccgagggagggaccctacgacggggagcccgcccggtgccgctcttcttcccctccccgcccctccgctccccccaccccgtcccttccgccgattccgggagcgacgggcgcccgtgacctgcgaacgctgccaagtgacggtccccgagtctgaagcgcccgcgaggaagcgagcgccagcgcgggccgccggcgatgacggccgcgaagcaggagccgcagcccaccccgggggccagggcgagccaggcgcagccggcggaccaggtgagagtcggcagccgcggccaggccctcccgggaggggtggctccagtgcgcgctccgcccgcctcccgcttcccaggctgggctcccgcgcctccctcttctcaccctcccccgccccgccccagttccaggctctcctgcttctccacggactctgcgggaagttagagcctctgcgtgcgctccggggcccggcgagaggatgcgcaaggtggagagccgcggggaagggggcagagaggtaaaggctgaaggtgccccggggaaccccggcgggcggcccaccgagggagggagaggcggccgggaccaaggaatggggcctcttggttccccattaacgcacgctgaagaaatctgctgcgctcctgacggccgctcaccgggttcgagccccgtcctcctatagccggggcgctcgctggccaaagcgacccgagcaggcgaatgacctttaggcggacggggttttccctctgctttcttgtttcttttgaggagacgggtgtgtgtttgtgaggtggggatgggggaagagtgtcccagacatccgtagtctgctgagcggaacggagcttggggagcggcgaggcattaacgattaagtggagccgggaaggcgctggctttggtgatgtgttgggtttggatgtgtcgcgtctgcacagatgaggtgccctgcgtgggctgagggttattcctgtctctttcccgtccgtctacacccgccaacccctttttgttttggtctttagaaatctgtagcataaccgtaccgtcgtggatccccatctcgtctctgtccctgatctggggtgattgggacttcggtgtcgctctttttccaaagttggagggtcgggagcgccgagacaccctggcgaggaggaggaggaggaggagggaggctgcgctgagccgggtgcaggtgcgctcacgtttgcatcaattaggaactccgggcagagagagctgcacttaggtcagggattaactgtggacccgcgggacccaagcgctggggtaggaggactggggatctttgttcggagtgcgctgcgaaggctgctggaggcggacaccctcccag

SEQ ID NO: 118086 - DNA, 36 bp, Homo sapiens; identical to SEQ ID NO: 84975
  chr2:116723692-116723728
  Hypo

SEQ ID NO: 118087 - DNA, 17 bp, Homo sapiens
  chr2:117052188-117052205
  Hypo
aacgcactgccatttct

SEQ ID NO: 118088 - DNA, 37 bp, Homo sapiens; identical to SEQ ID NO: 39642
  chr2:118628528-118628565
  Hypo

SEQ ID NO: 118089 - DNA, 1430 bp, Homo sapiens
  chr2:118981092-118982522
  Hyper
aacccagggcagcagcgaatcccacgccccacgctccctcttcccaaacctcaatatcgttgcttaaaatcttccgggcttattgtgaagccaagggcgcttggcatgggaagagagccgctcgtgatttatttgggagagggatggggttttggaaaggaaattggggggtttacaaggaggacgggtgggttttactcaacaacttattcttgggcgttttcgtggactggagaggagtttcgatcccgtctcgggctcacctgggaagccccctcctggcgcccgctttgtttggcgttcctttaaagcccggtgttggcagagcgacccacaatgaaacaaattctcattttatgacgtctttccccccgtaggagtccgaacaatgtctgggggcttggcacgcatgaagataaaagaattttattttaaatgcgatacatgtcaggattagacagcgtttcctttcagctaaactacagagcgaatcttcatttcctgtttcactgcttcccccgaaagaaacttttctttttctttttctttttctttttttttcttttctttctctcccccagcagagagtccgagagaaaagtgctgggcacagagctccccacgaggtccccggaaagcagacttagctcctgatcgttgtcaatctttgggcaacccggggcctcgcaacggctcgggtttagtgtgatctggggaggctgcagcccagttccggctaccgtgggcgcctgagcagagccggggcgagttgtaaacctcagagaaaggcacttgtccccagcaaaacgcttggagaggaccgtgcacgctgtgctgcccccgccccgagacgcgccgggccgccgggtcaccggttttccgaaagggacccggcagagacaaagtgccttcgccgctgcgataggttggttttactttgcaataaacagcccctaatgggaccgggcgccgggcggagagctcggcccggggcgcggcctttgccgcctggctctgcgggccgccccgccgggcgccaggttttggggggtggcccggccccgcgtccgccactgcaggccgctctcctccttcccgcgcacacagcggagaaaaaaggacgcaaacagcattttacacttttcccactttagcgggaatcggaggagccgggcgagaaagcccgaaaagggaggcggttatttacgaccggcgggttggagtctggcaccagatggtgggggtctgtcaggcccggccgccccgcccagcgccccgcaaacagcgcccggttggcagcgtcgcctgagcagcccccatcttcgcttccagcccctcccgtatattttctcccgtccaagtcgatcaaagacggactttaaaaattactcgcaattagacccaaaaaagtcattcgtgatctttgggta

SEQ ID NO: 118090 - DNA, 505 bp, Homo sapiens; identical to SEQ ID NO: 84986
  chr2:119067621-119068126
  Hyper

SEQ ID NO: 118091 - DNA, 331 bp, Homo sapiens; identical to SEQ ID NO: 84987
  chr2:119531997-119532328
  Hyper

SEQ ID NO: 118092 - DNA, 242 bp, Homo sapiens; identical to SEQ ID NO: 84988
  chr2:119566157-119566399
  Hyper

SEQ ID NO: 118093 - DNA, 1075 bp, Homo sapiens
  chr2:119590605-119591680
  Hyper
caccctttctaggggcgtgttgcctgctcttaggggctgtatttggcagacatgcaaatataaaacagcctcaccaaagtgcttactatggacacagcctcttggccaagcacggaaaaggttacaggggctggtgtaaggttggatgggaacgtgaatgagatccaggatatggtacatggggctcctggctctccctgtgtaatgtgccccaagttcccctggattccactgaaaatagggagtggaagggtgggtttggagtgaggataaccaggatcgtcacactcacataagcacagaacctcagggatcttcagggctgacaccctgaacgcccaccactttccctagcccccagtgtctcagctctccaggcggggcctctgaggctagaccgctgtctcgcccagggatgctcgcggactgcggcactagcgaacgcgcaattcccttccccagggaagccacgcaggggctttccccgacggcgtctcacagccaagtgagcttgtgaacacggagacggccgaggatccgagacaaggagctcgctcgctcggtttttcccgggctgtgtttgccattcgcgggaataaatgaagcatcggtaatctccataaaagagctttcacgcttcattctctgaaactaagttgaggcttagacggaaaggagaaaagagacttttaatttaaagtaatgatcatcaacactcaggtgctagagggtctctggggaaagggggtccctaccccacccggggtagcgggagggaggccgcctctctgcgcctagccgggcgggccttgacttgctaggattggtgggccaaatcccatctccggggagccttcaaataactctcccatggggaactgaggaggcgcgggagcctagggcggaaaaagctgaagagccgtggtcccggagaaaaggaagtgagcagtctcaatggaggcccgagcctctccaaggccaccctgcaggcagcagcgacttcttcctggggcaaaagtcgcgcactacctgcgggaacgtccgctgccagggcgccgcccgggaccccagagca

SEQ ID NO: 118094 - DNA, 98 bp, Homo sapiens
  chr2:119592208-119592306
  Hyper
cagtccctgccaggccgcggcctcctcgcccccgcctgcccggcctcacccttctggaagttcctccaggcctgggtgggggccgccagggaaggcgc

SEQ ID NO: 118095 - DNA, 1216 bp, Homo sapiens
  chr2:119592747-119593963
  Hyper
caagagcgcgcgcctcgtgtaaccattcaggaccagttgaagcaacacaaataaagtcaggtctcttcagccttgctgtccacccctccccctcttcctggtttgaccctggcctggccgctctgaggcccagtttgcgcagccgacattgcgtggctactctcattaccaggggaagggcgctccccttttccctggtaatactccgggagcccctactcggaagcccaagagtcaaagggatacaggggtgactggagagcagcgggggacagcgtggcctcacccaaggtcagcgctggtccccacgtgtcggccgggggaggggaggggagcggacagtcggagcgttcggatgtccagttgagccgcggcgcggggcagccgggggcgcaaagttggaggcagggctgggcgacgaggagagagggagggccgggagccgaagggacgcccgggtgcaccccgctgcagaggccgagtccgagcggccggagaaggctggtcgcagaagggcggcctccggtgcaaaaaacggaaaccttggagcagaggatgaggaggaatacggaggcggggagcccacagaaaaagatgttgaggaaagaagaggagaccccggcctaaacaaatcgaaactgtgcaatgaacgtggcccgggagaaccgggggtgaggggcgatggctggagctgcggcccaagcacagctttcagacgcttgcccggaccctggcgcggggaggcggccgggactgcctttctgcgcgcgtccctggagagcgggtgggcaggacctgcgccccgcggtgggcaagaagatttggggtttcgcagttcctggggtcgggggcgggggtgaagtgccctcagagacctcggcggagccccagttgcgctcccatctccagcccccactggagagagggggtccagggccgtaccctcctgcggcctgggctgcgctgaccggaagtgcctgtaagaagcgccctccgcggaccgtgccgggcgcgggcagctccagccgggttggagcaaggccaagacgcccggatggggcgggccgtttcggcggacccagtctggacgcaggtgcgggaggaaagtgtgaggggggaaactgctgattgtgcggggataggggcatcttaatctgggaaaagatcggaatctcttgggacgctaatctgagacccgggtcggaggtgtagagta

SEQ ID NO: 118096 - DNA, 30 bp, Homo sapiens; identical to SEQ ID NO: 27443
  chr2:119594194-119594224
  Hyper

SEQ ID NO: 118097 - DNA, 30 bp, Homo sapiens; identical to SEQ ID NO: 27444
  chr2:119594750-119594780
  Hyper

SEQ ID NO: 118098 - DNA, 1015 bp, Homo sapiens; identical to SEQ ID NO: 84995
  chr2:119599849-119600864
  Hyper

SEQ ID NO: 118099 - DNA, 954 bp, Homo sapiens
  chr2:119602464-119603418
  Hyper
actggggttttgattcgtaattagctgagcggggagaaatagcccaagaaatgcacacagccccaaaaaggccccactgcccgttctgcatccgggacatgttgaagtgttgttgtatgtgtgtgcagaggcacggactcttgtaataaaatcgttcctagtctcccggccagcccgagccgtgcagcctgacagctcaatcactctatccatcaggcgagtcaatcaaagcagcttttcggaggttcagggagcccgacgtgtcaataacggggctcgagatggcgggagctgatagtgcgcatcgatccgcgcccggccggcagctgtggggcggcgagagaccagccagaggaaagcggcgcgtggctacgttgttcccggccccctgccggaccgggtgtctggagtgctgatcttgggccaaagcttctgccgctctcccagacactgcgggccggggcgtcaggcaggccttggccttctctcccggagcccagctcaggtctcctcctcgggttcgccaagcgcgaggggcacacggaaaagtggtggaaggaaagccgagaaaaacaggcctacggatgccagaagtctgctggatgtgcgggtgaaaaaaggaaagcgccgcgcggggaggatgcgggaaccgttccgcggagaagctacggaggaaactggctctcatgcccttggacacgcttcctggcctgagcctgacctgttttctctcctctcccactgtttttcagctccagaaaaccaggggctgccagcacccacctttttggcaactgcctttccctggtttctacccacccgggtcagactcttttcgctacccagccgggggagagggacggctttcagacgctttcctccctgtcttcctgtgtttcccatgtttatcaatgtaaacggtctctccgcagaaaatatcgagatggtgtttgt

SEQ ID NO: 118100 - DNA, 459 bp, Homo sapiens; identical to SEQ ID NO: 84998
  chr2:119603634-119604093
  Hyper

SEQ ID NO: 118101 - DNA, 698 bp, Homo sapiens
  chr2:119604153-119604851
  Hyper
ttcccagctttagacgcgcccgcgccggcggcggctggctgggagccgtcgggtgggccacagttcgcgtccggggcgcacaggagcgaggcagcgcctggcgcccgggtgcccaacgggtggacagggtctctacctgcggcagtctggcctctgtcacgctcgacccggcctcctcctcctgcgcctcctctggccgccgcagccaccagaagctgcggtggcggctgctcctttttgcagccgaagtccggcctcaggatgttgtcgatgaaaaagttggtggtgcggtgcagctgggccgctggctgcggctggtgagcaggcgccgcgagatgctgaggcggcgggggcggggggtgtggggggaggtgcgggtggtgggccaggggcggcaggcaaggcgccgcgggcggcgaggggggcgcaggctgcggggacaccggcacgctgtctccatcgctgccgctgccgctgctgccgctggcgcccggactgaggctcaggctgaggccgcccggagtcgccgccgccgccgcgccgagggccgagtcgcgctgacttttaggttccggctgctgttcttccatgctcggccgccccgccgccccggccgccgcgccggcccccgcccccaccgcctcgctccccaccccactttgccagcggcccgtgggggtgcgcggaggaaggaggca

SEQ ID NO: 118102 - DNA, 28 bp, Homo sapiens
  chr2:119605271-119605299
  Hyper
gggagagcgcgtctccgccagcgccggg

SEQ ID NO: 118103 - DNA, 27 bp, Homo sapiens
  chr2:119605359-119605386
  Hyper
cacaaactctctcgcttaaaaaaaaaa

SEQ ID NO: 118104 - DNA, 30 bp, Homo sapiens; identical to SEQ ID NO: 27453
  chr2:119605745-119605775
  Hyper

SEQ ID NO: 118105 - DNA, 55 bp, Homo sapiens; identical to SEQ ID NO: 85004
  chr2:119606135-119606190
  Hyper

SEQ ID NO: 118106 - DNA, 1157 bp, Homo sapiens
  chr2:119606705-119607862
  Hyper
tggaggaccagtatccgactatgctgaagcctgcggtggccgagaaaggcgtcagcaaacgaggccttcgggggtgtcatcttagagctccagcggacctcctcgccctgaacgccctccgcaactgggacagtagagaaaggatccctttggaaatattgtctatttgtgacatgcgaaagaatccccctacctccagttttccagaaaagtcacagagggttaggctaggaggaacatgcaactaaacccacaacaagccgaaccaccaccacagtagctgaagtttctcaaaagggctggtggagagcaggaatttatattgctcaccgcatcttgggagcaggcgagggtcccccgatttccggggctgagttcccggctagacttgcgctgcagcctaggggagaaaacctctctccctaacgctgcgctgcagtcttctctaccttcccaagccgcctccaaccccaccttggagtctcccgagtcctcttcagtagcacacccaagggctccccgaaatctccaggcgcccccaccccttctccccgaaatgggggtgggattttatttatatttaagttcgcaaaattgaaatctttatcccgcaagcaagcgtgggtacttaattaaattctaattaggacactatcaatatcctatttagctgcgtagcttttgtgcgccgcggtccctttcagcgcggtaaatagggtctcgacgccttatctcgcctgcaggagacgcctcgagaagggctgcggaagataatttataggttttaattactcttcattccgcctgatcagcttggcgttcatcacaggcctgtgaataaaaccctggtcaaaagctctgtcacatcgcgctggcaagacgcttaatcaaagtgagcggccccgcgcgccgcgcggcccggctcctccacgtaatttccagccagctgataaagccagctgaataatacggcggccctttggagacaccatttacagaaatgactttattgacggcttaacgtcggtaattcattttacctttcatgtagtggagcccggatttgttacagtaatgggatgataaatgcacccgcggcccacgagctcgagctggattaggcggcactctgcgcgctggctcgtccccccacctcc

SEQ ID NO: 118107 - DNA, 30 bp, Homo sapiens; identical to SEQ ID NO: 85008
  chr2:119608197-119608227
  Hyper

SEQ ID NO: 118108 - DNA, 383 bp, Homo sapiens
  chr2:119610236-119610619
  Hyper
ctcctcttgactccccgcgggaaacggtggaaagatatcaatgatttctgtacattgcacccggtggccaggattcagaaagcgctcctggggccctggtttcctctctgagccccgccggctgtccacaggcccgcgccgggcgcagagggcgccagggtgcaaacacccgaactgtcgccgctcgcgggtttgcaggcggccttcgggctgcgcggggatgtccgggagcccgacgcagggccccttggctcggattacgggaagaggagccttcactggcccccctcggaatttcaaacctcgctgggactgtatcacacagccagacaggcctctggagctgagaattttagacttcgctgctccgggaagcaagagga

SEQ ID NO: 118109 - DNA, 125 bp, Homo sapiens
  chr2:119610844-119610969
  Hyper
ccccaaaaaattccccgaggtcggtgttctcaggcctaggggaccctctcccacccctggtccccacctgtccgagtggccgctctcgcctggatccggcttggcgcgttcggtgtccacacaga

SEQ ID NO: 118110 - DNA, 543 bp, Homo sapiens
  chr2:119611281-119611824
  Hyper
aaggagacaaaagttcgcgcacctggctctcggcgcctaggttttctgcctctgccggccccggagcccgatccaggccgcgcctccctgttgcccaaggggcgtgcatctttgggaccctcttcccggggaggtgcaagaaaagctccgggttccagcagaggtcggcgctgcagggcccaggcgggaagatgtggaaggaaaaagtttagtacagaaggtggggcggtaagggaacggaaagtctcaagagcctgggagcgggggagaggggcgagaacccgtctgtctcccccaccccgcccacctccttcctcgtattgaatcggatgcggggggcgggagggggtcactgcaatgccaaggccttctcgggccatcttccctgttcccctgctccagcagaaagctgggaggggaacgagtgtgtagccccgcgcgtgcgtgtttgttcgtgactcagaggctctgggtgggtgcgtgagtgagtccaagtgtgtgcccgagtgtgcacgcaaaaattgcgttcgttttgtctctcta

SEQ ID NO: 118111 - DNA, 30 bp, Homo sapiens; identical to SEQ ID NO: 85013
  chr2:119612029-119612059
  Hyper

SEQ ID NO: 118112 - DNA, 30 bp, Homo sapiens; identical to SEQ ID NO: 85014
  chr2:119612324-119612354
  Hyper

SEQ ID NO: 118113 - DNA, 122 bp, Homo sapiens; identical to SEQ ID NO: 85015
  chr2:119612692-119612814
  Hyper

SEQ ID NO: 118114 - DNA, 875 bp, Homo sapiens; identical to SEQ ID NO: 85016
  chr2:119613016-119613891
  Hyper

SEQ ID NO: 118115 - DNA, 71 bp, Homo sapiens; identical to SEQ ID NO: 85017
  chr2:119614130-119614201
  Hyper

SEQ ID NO: 118116 - DNA, 1076 bp, Homo sapiens
  chr2:119614551-119615627
  Hyper
gctctgggctccaagcgtggggacggcagcccccaagcttggcgcacccctcgggaagccccggaacggtcctcgccagacatagccggctgtcctggtccttagcttcaggctggcggcgcaaggccagagcggctgccttctaggcacctgggtggaggtctcgcatagcattccctgagaagcgaaactgcccttggggccgcagcgagcctgccacatcgaactggagaccctctgctttcgggatagatgggacgtttctgctctgtccttcttggagtcccggaatcgttctggggccgcgtgctgcctggaggcggtgaatttcagggtcttgagaagccgcgcacacacgggattctgggcgagcgtcccgtctcttaattcctattaagagacgggaaaatcgagggactggaggtcccatcattgtcgcgtgagcagcctcctgaacaccaagcgagacctgagggttccgctggggcctcgccctgacacccgggccctccgtgtggtcgagagtttgcgcccgctcccgctagggcagcgaggtcccacttgcggccggctggggcatggtggcaccggttgtctactccccacttgtgacaccgacagcttccaactcctcagacccaccccgtggaattctggactttgtgagggccgccggggtcctggccctggggtcagctgccatctgactaagccaggacggcggagctccaggccttgctccagcactgccggtgcgtcggggcccgcggagagcccagggcgggagctgtgggctgagccgggtggccgcgtggacacagatgcccggccggactgagcggcagccaagactctccgtccatcccgccgctggactcgactctcccagacccgccacggaacccagatttgagcacgcaagataaagacgccagaggcgagtgcgcggcggagaactggccgcgacacgggaagcttctggggcgcagaacgctggctccgactcgcgcggcgcagaccagcttctgtggttgcactcaattgaacaacaggcggatttacgttaaactttgttt

SEQ ID NO: 118117 - DNA, 1318 bp, Homo sapiens
  chr2:119615975-119617293
  Hyper
catgcccataccaagcgggaaacgaagcaccgaatatttccccagctcgtaggaagccagatgggggccagttccctcaggagacgctccaagtcgccctgcgggctccaggtggggacaggagttataaccttccctgcccttccccctgcaacacacgcgaggtctcagcgctcccaggcgctccagtggggccgcgttccccgccagggtgggtcaggggaatactctgcctgcgccctctccgagggtccgcgcagagcgagcgcctctttaggtggggcctctggctccgacccctgctcccaacagggatcttcgtttgcatcacccagaggagctggccagagagccgcgccggaggccgcatctccccttgttggtattgttgtcggcttgctttcttctggcttcccagctcagtgaccccggaaagggtcgagcatccgactccggcatgctggttggctgcccccggaggcggaggtagggggccagaaatgctgacctgggcaggcccccagccctgagctcctggggtggacatctcagggtcccgggcctccaagctcatggccggtctccgcggcggcggggtgacccaccaagggcaagactttttcagacttgcctatggtcaccaggcaatgactccgactggtacgtgagggagctcgggtcccaccttgaggacaaggcccagccttccccggagccgcacctcaactgtcagggtgcaagtggtggtgatccgggagcagtcgaggcccgtgacaaaaccaggatgacccagcgttttctaaccgcgctgaggcagtcgcctctccgggtcgctccactcccggactccggcagcctgttggccttcctgtcaccacctcgcatggagcaccctgccctaagccctggaactgggcccctggctcgcaaggaagagggtgggggtggggtagggaggaaaggccgggaagcctgctagagagaaggaggtgactgagggccagcatcgccaggaggcatagttccactagtccccagtcccatggttccaccttgaccccagttcacctgcagggcggcagggaactcctctgattcccgaacctgcagctggtgctgcactggaggggtttccgttggtccaacgcaccccggtgaagggaattccctggagaagagagaggaggtgccagaacctggctgtaaggggggtgcaggtgtgcagagagaagcgggttgtcccgggctgtgggtcctgcagcgcagcacctgagacttcagtttccttccttttccttactcccgtagtcttccggga

SEQ ID NO: 118118 - DNA, 308 bp, Homo sapiens; identical to SEQ ID NO: 85021
  chr2:119769161-119769469
  Hyper

SEQ ID NO: 118119 - DNA, 40 bp, Homo sapiens; identical to SEQ ID NO: 27467
  chr2:119914013-119914053
  Hyper

SEQ ID NO: 118120 - DNA, 2541 bp, Homo sapiens
  chr2:119914280-119916821
  Hyper
ggaagtgttatgaatcgagagtggcctttgccaaggagccgcgcccgggcggagaccgggcggcctgcagccaccccgcctcgcaccccccgcgcccctaatccgggtacagaagaaagcccgagaacgtgctgtacttgttattattgcctccgtgagccttcccgccatccagcttcacatacacttcgtcccctgaatccaagtgcagcaccacgctgttactggcgtagtcgtagttctggtcggcgtcctgtgcaatggcgctggcccggacctggggacaagcggtgggagcaggtgagccggggcacctcttcccgcgcctttgctcagcccacaccaggcgcgccactcacgggcctcccgcctgctgcttcagggtccacactcccaccccagctccatgttctctctccaacttagtcaactccttccaggtcccccctcctcctcgcgccgacgagtctgggaaatagggagaggggaagcttcatgaacactgacccagagtggaagggtgggagccaggggccagggccaagaggaaaggaggctgcagggcaagggggcgacctggagagaactaaagaactgaggtttccgagaagcccacggagaggcaggcagggacgcaagtggccaaggagtgtagtttaggtatgggggtctctgggctctcaaggcccaacatttggctctacgtcccggtgagcgcggcctcggcgcatcgggaagcggagatactgtggcaccgaggcgcgttcattcccggggctcgcagggtagcccgcgggtggagagaaaggaggctggttccctgggaggttcagggcgcgggcgagggtttacgggggccggtgagtgtaggggtcactgacctgcccgttcttgcagaggtccgcccacatgctggtgccgtcgccgccgcgcatgaggatgtggtaggtgaagaagtagatgccgcgtacctggcagctgaacttgcccgtggtggggtcatagtgattgccgaggttggtgaccacgtcatcgaacttcagcacctcatagccttcgtgggggctcttgagacccacatagaaggcgatcttggggccgctgaaggtggcgctcagcgcactggtcacttcaccctcggaatcgccacctaccccggccccgccgcccaccaccccgacgccgctggccgtgcccgccgtcagttgcagccctggcagcccgggccgccccgagtcgcccttctctcccggagggcccctgggtccaggcgggcccggctctccagggggcccccgcggccctggcttgcccggtcgccccgggtcgcccttgggtccctggatgaaaggaggaggagggttggcgctgaggtcctgcatgacttccagggcggcggtgctgggtccgggtggctgcgcctttgcacccgggggctccccgccgggcgcggcagtgtaagggtcgcagatcatgcggcaggtgcccatcatctcatagtgcgcggcgcctcggggcgccgcctgcagcagcagcggcacggcgatgagcagcccgagcgccatggccaagagtacgccgacggccgccaggcaggcacgccgccgccgctgccacagccgggaggcgaccgccaccagctcctccttgccgcccggggaggtaatggtggggcggcgcgggcggccccgctccccgcgctcggggaccggctccgcgggtcctggccgcgcccccgacgtggcgacccccagccccggctacccaactacttcagcgagaggcgccgggacctctgagcctgggcccaccgcgctggggctggtcgggagagccgcggacgcccgcgcgcatgacgtggggcacacaagacgaatccggcgccccgagggtccggcgccggccagggagtgcttgcgctggccggggagtctgcttgcggcgtccggcgctggctccgcggcgctgcctcccgccaggctccgctccgctgggtttagtggggctcctagcgcagtgagggcgccccggctccgcggcgcgctctgctgtgctctctcgctgttcgctggctcccgcgcggaggggggaccccgctaccctgacgtaaggagtccggggctgagcggcggaggcggcgaagcagcgcgcgctgccatcactcgggagacggagccctcatgtcatcagcctcctatctggcggcgtcctcggcagaggcggtgaaggcgcggttccccctggcggctcccaggagccacaagtgggcgcagcgggcgcggtcccaagccggggcacatcggacacacccacccgcggccacactcacgcgccccccaccgataacacacacagacacccacgcacgcagtggcggggcacgcacagccacccccacatggccacgaaagcagctggaatccaggtgtcagcagggctcctctggggtcacctaatccatcccctggcctgcaaagaggatcaaacctcaacccaccgagtccaggagagtcccgtgaggtccagcgggaaggagtttct

SEQ ID NO: 118121 - DNA, 50 bp, Homo sapiens; identical to SEQ ID NO: 85027
  chr2:119997993-119998043
  Hypo

SEQ ID NO: 118122 - DNA, 30 bp, Homo sapiens; identical to SEQ ID NO: 85028
  chr2:120000595-120000625
  Hypo

SEQ ID NO: 118123 - DNA, 404 bp, Homo sapiens; identical to SEQ ID NO: 85029
  chr2:120005365-120005769
  Hypo

SEQ ID NO: 118124 - DNA, 30 bp, Homo sapiens; identical to SEQ ID NO: 85030
  chr2:120160587-120160617
  Hypo

SEQ ID NO: 118125 - DNA, 337 bp, Homo sapiens; identical to SEQ ID NO: 27471
  chr2:120190015-120190352
  Hyper

SEQ ID NO: 118126 - DNA, 478 bp, Homo sapiens
  chr2:120281646-120282124
  Hyper
cacctgcatcctgcccgaggccggagaaagggcgagactgtcgctccctcgggtccccagcctgcagaagggcgcagtactcaccgagtgcgcggcgcaggcgagcagcaccggcagtagtagctgctgcagcggcggcgacaggtggggacgcatggtgcccgcacgttccccgagggcgccccgacgtccgcctgcccgtgccctctgcccgctcgggagctcagcgccccgcgcagggtcccgggctccggccggccgctgcgccccgaggagccatggctgagccacccgacctgcggcgggccccgggactgctcctcctcggaccaggtggccgcgcgcgctaagccgcccgccccattgatcaggacgcggctttgccggcgcgcctcctccacccggcagggactggcgcggggtcggcgcggaggctggcaggggaggaggcagagggagggcgcggggacccggagtc

SEQ ID NO: 118127 - DNA, 30 bp, Homo sapiens; identical to SEQ ID NO: 39644
  chr2:120441329-120441359
  Hypo

SEQ ID NO: 118128 - DNA, 30 bp, Homo sapiens; identical to SEQ ID NO: 85038
  chr2:120748913-120748943
  Hypo

SEQ ID NO: 118129 - DNA, 20 bp, Homo sapiens
  chr2:120769511-120769531
  Hypo
tgagtctggctttgtcgcca

SEQ ID NO: 118130 - DNA, 20 bp, Homo sapiens
  chr2:120769771-120769791
  Hypo
caccgcgcccagccaaatgc

SEQ ID NO: 118131 - DNA, 97 bp, Homo sapiens; identical to SEQ ID NO: 85042
  chr2:120973458-120973555
  Hypo

SEQ ID NO: 118132 - DNA, 335 bp, Homo sapiens; identical to SEQ ID NO: 85043
  chr2:120973770-120974105
  Hypo

SEQ ID NO: 118133 - DNA, 612 bp, Homo sapiens; identical to SEQ ID NO: 85044
  chr2:120979880-120980492
  Hypo

SEQ ID NO: 118134 - DNA, 36 bp, Homo sapiens; identical to SEQ ID NO: 85045
  chr2:120994230-120994266
  Hypo

SEQ ID NO: 118135 - DNA, 93 bp, Homo sapiens; identical to SEQ ID NO: 85046
  chr2:120995387-120995480
  Hypo

SEQ ID NO: 118136 - DNA, 156 bp, Homo sapiens; identical to SEQ ID NO: 85047
  chr2:121003489-121003645
  Hypo

SEQ ID NO: 118137 - DNA, 121 bp, Homo sapiens; identical to SEQ ID NO: 85049
  chr2:121101236-121101357
  Hyper

SEQ ID NO: 118138 - DNA, 102 bp, Homo sapiens; identical to SEQ ID NO: 85050
  chr2:121102132-121102234
  Hyper

SEQ ID NO: 118139 - DNA, 83 bp, Homo sapiens; identical to SEQ ID NO: 85051
  chr2:121102536-121102619
  Hyper

SEQ ID NO: 118140 - DNA, 390 bp, Homo sapiens; identical to SEQ ID NO: 85052
  chr2:121102965-121103355
  Hyper

SEQ ID NO: 118141 - DNA, 1564 bp, Homo sapiens
  chr2:121103677-121105241
  Hyper
ggcgcgcccggagcccggagcccggccctgcgctcggctcgactcggctcgcctcgcggcgggcgccctcgtcgccagcggcgcaccatggacgggctgcccggtcgggcgctgggggccgcctgccttctgctgctggcggccggctggctggggcctgaggcctggggctcacccacgcccccgccgacgcctgccgcgccgccgccacccccgccacccggatccccgggtggctcgcaggacacctgtacgtcgtgcggcggcttccggcggccagaggagctcggccgagtggacggcgacttcctggaggcggtgaagcggcacatcttgagccgcctgcagatgcggggccggcccaacatcacgcacgccgtgcctaaggccgccatggtcacggccctgcgcaagctgcacgcgggcaaggtgcgcgaggacggccgcgtggagatcccgcacctcgacggccacgccagcccgggcgccgacggccaggagcgcgtttccgaaatcatcagcttcgccgagacaggtgggtccggccctccggctgtctgccgcggtccccgctcgctcccgctctccctctccttgctagctccggctgccaccgccgccaccgcagcccgcgcgccctggggcagcctggactcccggcagagctccttcggccgtggccctgcgcgctccgcccgggttgcagtcctcttcccccaggccgcagacccttgcctgctgcctcaaccccccgccgccgatcgcctggccctccacccctgctctccggaatcgggccccagcgcctctgggcgcgcgtccccctcccggcagatgcgcgcggccctggctctgcgggcacttgcttggtgattgcttaatgtttttgtttcccacgatcggagtgtaggcttagcagtgtggatggagatgtgtgtgcttgttgatatacgtgggccggaggagagagagagtgtgtgtgtatctgtgtgtgtgtctgtgtgtgtgtgtgcctgcgtgagaggcccctggggccgcttccatcaccggcggcgtgggcttgccaggattgctgaagcctcgctggggagagctaggcaacctctcttccgattgtgtgggcaccggaatcgggcggaaggcaggcttctcaacaggtccatcatttacacagagaaagccgcggttcggggacagccccgtgcctctcggcttgcctggcagctgcagcagacccctcgcccgagaggcagagtcgtagttaacaaagggtatggctcctttctggaatccgcccccccccccggccccagattgcaaatctctaacactgtctaaatataaaaatcagggagagaaaaatctttcggaactttaaaagaaggagaaaaatgtgcccgcgccaaaatgctgcaagtgctttcgactccgctgtccttttcaggacttgaatgagccaggctggcttttgtgcctggagctcggccccatttgtgccgaggggactgcggagaaggtcgcagagggggaagccccggtgcagttagggcgggggcaagcgggg

SEQ ID NO: 118142 - DNA, 181 bp, Homo sapiens; identical to SEQ ID NO: 85055
  chr2:121199949-121200130
  Hyper

SEQ ID NO: 118143 - DNA, 64 bp, Homo sapiens; identical to SEQ ID NO: 85056
  chr2:121200390-121200454
  Hyper

SEQ ID NO: 118144 - DNA, 36 bp, Homo sapiens; identical to SEQ ID NO: 85057
  chr2:121200695-121200731
  Hyper

SEQ ID NO: 118145 - DNA, 30 bp, Homo sapiens; identical to SEQ ID NO: 85058
  chr2:121242474-121242504
  Hypo

SEQ ID NO: 118146 - DNA, 244 bp, Homo sapiens; identical to SEQ ID NO: 85059
  chr2:121344837-121345081
  Hyper

SEQ ID NO: 118147 - DNA, 248 bp, Homo sapiens; identical to SEQ ID NO: 85060
  chr2:121412072-121412320
  Hyper

SEQ ID NO: 118148 - DNA, 142 bp, Homo sapiens; identical to SEQ ID NO: 85061
  chr2:121492883-121493025
  Hyper

SEQ ID NO: 118149 - DNA, 861 bp, Homo sapiens; identical to SEQ ID NO: 85062
  chr2:121493409-121494270
  Hyper

SEQ ID NO: 118150 - DNA, 40 bp, Homo sapiens; identical to SEQ ID NO: 85063
  chr2:121494968-121495008
  Hyper

SEQ ID NO: 118151 - DNA, 30 bp, Homo sapiens; identical to SEQ ID NO: 39649
  chr2:121639825-121639855
  Hypo

SEQ ID NO: 118152 - DNA, 30 bp, Homo sapiens; identical to SEQ ID NO: 85065
  chr2:121731009-121731039
  Hypo

SEQ ID NO: 118153 - DNA, 20 bp, Homo sapiens
  chr2:121852396-121852416
  Hypo
cagaacgtccatcagccagg

SEQ ID NO: 118154 - DNA, 24 bp, Homo sapiens
  chr2:122013325-122013349
  Hypo
tttttttttttgagacggaatctc

SEQ ID NO: 118155 - DNA, 243 bp, Homo sapiens; identical to SEQ ID NO: 85069
  chr2:122042116-122042359
  Hyper

SEQ ID NO: 118156 - DNA, 337 bp, Homo sapiens; identical to SEQ ID NO: 85070
  chr2:122042645-122042982
  Hyper

SEQ ID NO: 118157 - DNA, 47 bp, Homo sapiens; identical to SEQ ID NO: 39651
  chr2:122088821-122088868
  Hypo

SEQ ID NO: 118158 - DNA, 315 bp, Homo sapiens; identical to SEQ ID NO: 85072
  chr2:122104569-122104884
  Hypo

SEQ ID NO: 118159 - DNA, 272 bp, Homo sapiens; identical to SEQ ID NO: 39653
  chr2:122495322-122495594
  Hypo

SEQ ID NO: 118160 - DNA, 36 bp, Homo sapiens; identical to SEQ ID NO: 85076
  chr2:122511837-122511873
  Hypo

SEQ ID NO: 118161 - DNA, 24 bp, Homo sapiens
  chr2:123285320-123285344
  Hypo
gggcgtggcggctcacgcctgtaa

SEQ ID NO: 118162 - DNA, 35 bp, Homo sapiens; identical to SEQ ID NO: 85082
  chr2:124439807-124439842
  Hypo

SEQ ID NO: 118163 - DNA, 1240 bp, Homo sapiens
  chr2:124782165-124783405
  Hyper
tgtctttcctctctccgtctccctgagacgccagtgaaccacctgggcttggaatccagagccccggaacaccttgcagtacttgcccgaagcaacgcgccaacagcgggagggagacgcagacgcgaagaccggcgagaggatgtgcggtgggagtagctgcggggtctgcaagcaggggagcgcgcacaacgttaaaccttgaaaccagaaatcccgatcctatcgagacccatcagcttttcccatttgggaacgagcgcaggggaaattaaatgcgtaattcaagctctgttttcccctcccctccaaaggtgaggtgggggaacgcgtctcgttagctcattacaaagctttccgtgggaaattccctcttcctaatgcgtctgtcttgcaactcctattagcatccttcgacagcggcctttgaaaatctcctttaaatttcaatacctctactcgtttcccaaatggggggaagggaagagaaagccggggggtagagagaatttccttcccctttccctcccaggtagccaaagcgcaccgcagcggcttggcttcctggaggaaaagcgcccgagcggggcaaagacccgcccaggctgctcttataggcgagcgcggggcgggcctggctgggggcggtgccgcgcggccccgctcgcctataaggagctgtccgccacccgggtgctgattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactgtgagtacgaggagctgggggcgggaaggtgaggtggaaaacgatcgcattcagaaagacaatcaactatctaagcgtactcgattgtgtctgctt

SEQ ID NO: 118164 - DNA, 90 bp, Homo sapiens; identical to SEQ ID NO: 85086
  chr2:125742056-125742146
  Hypo

SEQ ID NO: 118165 - DNA, 40 bp, Homo sapiens; identical to SEQ ID NO: 85088
  chr2:126236905-126236945
  Hypo

SEQ ID NO: 118166 - DNA, 39 bp, Homo sapiens; identical to SEQ ID NO: 85089
  chr2:126237005-126237044
  Hypo

SEQ ID NO: 118167 - DNA, 31 bp, Homo sapiens; identical to SEQ ID NO: 85090
  chr2:126347693-126347724
  Hypo

SEQ ID NO: 118168 - DNA, 24 bp, Homo sapiens
  chr2:126413299-126413323
  Hypo
aaatatagcaatggccgggtgcgg

SEQ ID NO: 118169 - DNA, 30 bp, Homo sapiens; identical to SEQ ID NO: 85092
  chr2:126700543-126700573
  Hypo

SEQ ID NO: 118170 - DNA, 30 bp, Homo sapiens; identical to SEQ ID NO: 85094
  chr2:127227218-127227248
  Hypo

SEQ ID NO: 118171 - DNA, 172 bp, Homo sapiens; identical to SEQ ID NO: 85095
  chr2:127374881-127375053
  Hypo

SEQ ID NO: 118172 - DNA, 265 bp, Homo sapiens; identical to SEQ ID NO: 85096
  chr2:127395350-127395615
  Hypo

SEQ ID NO: 118173 - DNA, 30 bp, Homo sapiens; identical to SEQ ID NO: 39659
  chr2:127397957-127397987
  Hypo

SEQ ID NO: 118174 - DNA, 102 bp, Homo sapiens; identical to SEQ ID NO: 85098
  chr2:127412026-127412128
  Hypo

SEQ ID NO: 118175 - DNA, 76 bp, Homo sapiens
  chr2:127413750-127413826
  Hyper
tcaggagcccgggagcgcgaccctcccccggcccggcctggcccggcctggccagtccccgcggtctctgcccggg

SEQ ID NO: 118176 - DNA, 207 bp, Homo sapiens; identical to SEQ ID NO: 85099
  chr2:127417883-127418090
  Hypo

SEQ ID NO: 118177 - DNA, 37 bp, Homo sapiens; identical to SEQ ID NO: 85100
  chr2:127422857-127422894
  Hypo

SEQ ID NO: 118178 - DNA, 336 bp, Homo sapiens; identical to SEQ ID NO: 85101
  chr2:127423014-127423350
  Hypo

SEQ ID NO: 118179 - DNA, 279 bp, Homo sapiens; identical to SEQ ID NO: 85102
  chr2:127427725-127428004
  Hypo

SEQ ID NO: 118180 - DNA, 208 bp, Homo sapiens; identical to SEQ ID NO: 85103
  chr2:127428985-127429193
  Hypo

SEQ ID NO: 118181 - DNA, 30 bp, Homo sapiens; identical to SEQ ID NO: 85104
  chr2:127430819-127430849
  Hypo

SEQ ID NO: 118182 - DNA, 127 bp, Homo sapiens; identical to SEQ ID NO: 39665
  chr2:127433244-127433371
  Hypo

SEQ ID NO: 118183 - DNA, 92 bp, Homo sapiens; identical to SEQ ID NO: 85106
  chr2:127435199-127435291
  Hypo

SEQ ID NO: 118184 - DNA, 202 bp, Homo sapiens; identical to SEQ ID NO: 85107
  chr2:127437938-127438140
  Hypo

SEQ ID NO: 118185 - DNA, 262 bp, Homo sapiens; identical to SEQ ID NO: 39668
  chr2:127438633-127438895
  Hypo

SEQ ID NO: 118186 - DNA, 30 bp, Homo sapiens; identical to SEQ ID NO: 85109
  chr2:127439943-127439973
  Hypo

SEQ ID NO: 118187 - DNA, 417 bp, Homo sapiens; identical to SEQ ID NO: 85110
  chr2:127453528-127453945
  Hypo

SEQ ID NO: 118188 - DNA, 21 bp, Homo sapiens
  chr2:127459661-127459682
  Hypo
ccaccgcgctcagcccaggaa

SEQ ID NO: 118189 - DNA, 30 bp, Homo sapiens; identical to SEQ ID NO: 85112
  chr2:127461007-127461037
  Hypo

SEQ ID NO: 118190 - DNA, 30 bp, Homo sapiens; identical to SEQ ID NO: 85114
  chr2:127529764-127529794
  Hypo

SEQ ID NO: 118191 - DNA, 775 bp, Homo sapiens; identical to SEQ ID NO: 85115
  chr2:127534404-127535179
  Hyper

SEQ ID NO: 118192 - DNA, 183 bp, Homo sapiens; identical to SEQ ID NO: 85116
  chr2:127638054-127638237
  Hypo

SEQ ID NO: 118193 - DNA, 137 bp, Homo sapiens; identical to SEQ ID NO: 85117
  chr2:127643980-127644117
  Hyper

SEQ ID NO: 118194 - DNA, 538 bp, Homo sapiens
  chr2:127783043-127783581
  Hyper
actcccccagcaggacgtttactgaatctggagggagtcgccctgcagatatcccgcggaagccggaggagacccaggtgcgccccaccggctagctgcgcctgcgggtgcccaaattggtgtccgggccatcctcaccgcagtgactcctccgcagcgccaacgcactccattttccttccaccctgccggtggggggcgtttgcttgttctcactctgcagccgcagccagtggcgccgctaccaaggtccccgcctcgccatccgggtcctgcctgagcatccttattggtgctcagggctaggcgtgcattgctgctaggggcgcggaaaggtttatcgtgggtggatgctgcccggggcttgagtggtttttagaggtcttgagtggctcactctccaatcagcgctttctagagacagcgtggtcagcgtacttgcttactttcaggattgcgagacgtctttaacccttgctgatcggctgacgctgcagcttcctgtggcttcctgctcatttcccgcaagatagcactg

SEQ ID NO: 118195 - DNA, 81 bp, Homo sapiens; identical to SEQ ID NO: 39671
  chr2:127801154-127801235
  Hypo

SEQ ID NO: 118196 - DNA, 55 bp, Homo sapiens; identical to SEQ ID NO: 85121
  chr2:127809256-127809311
  Hypo

SEQ ID NO: 118197 - DNA, 390 bp, Homo sapiens; identical to SEQ ID NO: 27493
  chr2:127863488-127863878
  Hyper

SEQ ID NO: 118198 - DNA, 452 bp, Homo sapiens; identical to SEQ ID NO: 27494
  chr2:127976374-127976826
  Hyper

SEQ ID NO: 118199 - DNA, 234 bp, Homo sapiens; identical to SEQ ID NO: 85124
  chr2:127977701-127977935
  Hyper

SEQ ID NO: 118200 - DNA, 251 bp, Homo sapiens; identical to SEQ ID NO: 85125
  chr2:128050739-128050990
  Hypo

SEQ ID NO: 118201 - DNA, 37 bp, Homo sapiens; identical to SEQ ID NO: 85126
  chr2:128158434-128158471
  Hypo

SEQ ID NO: 118202 - DNA, 30 bp, Homo sapiens; identical to SEQ ID NO: 85127
  chr2:128166372-128166402
  Hypo

SEQ ID NO: 118203 - DNA, 78 bp, Homo sapiens; identical to SEQ ID NO: 85128
  chr2:128292507-128292585
  Hypo

SEQ ID NO: 118204 - DNA, 53 bp, Homo sapiens; identical to SEQ ID NO: 85129
  chr2:128293399-128293452
  Hypo

SEQ ID NO: 118205 - DNA, 30 bp, Homo sapiens; identical to SEQ ID NO: 85130
  chr2:128351156-128351186
  Hypo

SEQ ID NO: 118206 - DNA, 71 bp, Homo sapiens; identical to SEQ ID NO: 85131
  chr2:128380851-128380922
  Hypo

SEQ ID NO: 118207 - DNA, 273 bp, Homo sapiens
  chr2:128421809-128422082
  Hyper
gaaggcctgccctgccgccgcagctttccggccattgtccccgccacccgccccgcccctggccacctaccccgtggctggcggcgggctctgccggtgctggcgccgccggtacagccccgacgcggccagcgcacccagccgggccgccatggcgcggggcagccgccttgaggtcgcgggcgcgggccgcctggtgcaggggctatgggaccacctcggaggggaggcgcggccgcctggggccagacaccaagacgggacgggcgtgtg

SEQ ID NO: 118208 - DNA, 375 bp, Homo sapiens; identical to SEQ ID NO: 85134
  chr2:128432249-128432624
  Hyper

SEQ ID NO: 118209 - DNA, 496 bp, Homo sapiens; identical to SEQ ID NO: 85135
  chr2:128433025-128433521
  Hyper

SEQ ID NO: 118210 - DNA, 30 bp, Homo sapiens; identical to SEQ ID NO: 85136
  chr2:128436077-128436107
  Hypo

SEQ ID NO: 118211 - DNA, 22 bp, Homo sapiens
  chr2:128601383-128601405
  Hypo
ttataaaagaggctgcgggctg

SEQ ID NO: 118212 - DNA, 151 bp, Homo sapiens; identical to SEQ ID NO: 39676
  chr2:128616477-128616628
  Hypo

SEQ ID NO: 118213 - DNA, 120 bp, Homo sapiens; identical to SEQ ID NO: 85141
  chr2:128847679-128847799
  Hypo

SEQ ID NO: 118214 - DNA, 30 bp, Homo sapiens; identical to SEQ ID NO: 85142
  chr2:128897581-128897611
  Hypo

SEQ ID NO: 118215 - DNA, 59 bp, Homo sapiens; identical to SEQ ID NO: 85143
  chr2:129128223-129128282
  Hypo

SEQ ID NO: 118216 - DNA, 47 bp, Homo sapiens; identical to SEQ ID NO: 85144
  chr2:129179600-129179647
  Hypo

SEQ ID NO: 118217 - DNA, 30 bp, Homo sapiens; identical to SEQ ID NO: 85145
  chr2:129384355-129384385
  Hypo

SEQ ID NO: 118218 - DNA, 30 bp, Homo sapiens; identical to SEQ ID NO: 85146
  chr2:129493732-129493762
  Hypo

SEQ ID NO: 118219 - DNA, 185 bp, Homo sapiens; identical to SEQ ID NO: 85147
  chr2:130482642-130482827
  Hypo

SEQ ID NO: 118220 - DNA, 171 bp, Homo sapiens; identical to SEQ ID NO: 39679
  chr2:130497037-130497208
  Hypo

SEQ ID NO: 118221 - DNA, 169 bp, Homo sapiens; identical to SEQ ID NO: 85149
  chr2:130542307-130542476
  Hypo

SEQ ID NO: 118222 - DNA, 178 bp, Homo sapiens; identical to SEQ ID NO: 39680
  chr2:130666498-130666676
  Hypo

SEQ ID NO: 118223 - DNA, 47 bp, Homo sapiens; identical to SEQ ID NO: 85151
  chr2:130680907-130680954
  Hyper

SEQ ID NO: 118224 - DNA, 521 bp, Homo sapiens
  chr2:130737136-130737657
  Hyper
ttattttgttttcaccgcaccattgtttttagtacatatgttttgtgtatttaaaaaactgtgttgaggcgccctggctcgccctgcgccagaggctcgcgcactcagcaggttgggctgcggcggcggcggctggggaagccgaagcgccgcgcgtgagagatcccggatacatctgcggtttgggctccgccaccctccgtctctctcccgcaggtctctgagccgggtgcggaaggagggaacggccctagccttgggaagccaaagcacacccctggctcctgccgacaccgccctccttcccttcccagccgcgggcctcgctccgtgctcggctactctgccgggaggcggcggcggctgccagtctgtggcgagccctgctgccctccagccgggctcctccagccgggctcctccaccggcccttgcaggggcgcagagagctcggcgcccgcccttccgctcgcctttttcgtcagccggctggaggagcatcggtccgggaggtctctggg

SEQ ID NO: 118225 - DNA, 365 bp, Homo sapiens
  chr2:130763468-130763833
  Hyper
atcaacaatgttgctcgcagtcccagcgctccgaacgacggtgcctccggttgacagcaacctgagcggacccgcgcctaggccctccgccaggcctgcgctgcctcgccccgggagaggaagactgagcccggctcaggcggctggagcgcgcgggcccgtttcctttcagcgatcagtcccctggcgtcccagcagcgccttccccgcgatcgcgcgtccccagcgcacgtcgcggctgccagctgctgccctgaccgccggcccagacgtgcccgcggacgccgctgacagcgcctgtgccatggggctgcctactctggagttcagcgattcctacttggacagcccggatttcagggagc

SEQ ID NO: 118226 - DNA, 87 bp, Homo sapiens; identical to SEQ ID NO: 85156
  chr2:130886777-130886864
  Hypo

SEQ ID NO: 118227 - DNA, 49 bp, Homo sapiens; identical to SEQ ID NO: 85157
  chr2:130897204-130897253
  Hypo

SEQ ID NO: 118228 - DNA, 195 bp, Homo sapiens; identical to SEQ ID NO: 85158
  chr2:130947958-130948153
  Hypo

SEQ ID NO: 118229 - DNA, 325 bp, Homo sapiens
  chr2:130970979-130971304
  Hyper
gctcatgagtgggcacgtcttgcccaccgccccgtcgccgaccaccacgcacttgagcatcagcgcgccaggcccgtgagccacgctgctgcccgccggcctccgggcatggtccccccggagcccccgccccggtccccgggctcagccccagcccgcctggggagtccgccgccgtcgccgccgctctgcgccgcaggccgccccccgaccggccccatccagcggctcccctcgccggaggggagggggcggcgggcccggggcgctgccgccgcggcggtcgccgccaggatccccgccccggccccggtcgctgcgcctg

SEQ ID NO: 118230 - DNA, 30 bp, Homo sapiens; identical to SEQ ID NO: 85161
  chr2:131018739-131018769
  Hypo

SEQ ID NO: 118231 - DNA, 81 bp, Homo sapiens; identical to SEQ ID NO: 85163
  chr2:131085026-131085107
  Hypo

SEQ ID NO: 118232 - DNA, 102 bp, Homo sapiens; identical to SEQ ID NO: 85164
  chr2:131089765-131089867
  Hypo

SEQ ID NO: 118233 - DNA, 84 bp, Homo sapiens; identical to SEQ ID NO: 85165
  chr2:131114416-131114500
  Hypo

SEQ ID NO: 118234 - DNA, 186 bp, Homo sapiens; identical to SEQ ID NO: 85166
  chr2:131477750-131477936
  Hypo

SEQ ID NO: 118235 - DNA, 759 bp, Homo sapiens; identical to SEQ ID NO: 27505
  chr2:131484847-131485606
  Hyper

SEQ ID NO: 118236 - DNA, 70 bp, Homo sapiens; identical to SEQ ID NO: 85168
  chr2:131486934-131487004
  Hypo

SEQ ID NO: 118237 - DNA, 929 bp, Homo sapiens; identical to SEQ ID NO: 85169
  chr2:131513348-131514277
  Hyper

SEQ ID NO: 118238 - DNA, 30 bp, Homo sapiens; identical to SEQ ID NO: 85170
  chr2:131525696-131525726
  Hypo

SEQ ID NO: 118239 - DNA, 30 bp, Homo sapiens; identical to SEQ ID NO: 85171
  chr2:131586487-131586517
  Hypo

SEQ ID NO: 118240 - DNA, 994 bp, Homo sapiens
  chr2:131594263-131595257
  Hyper
cggcggcccctgggccgggtctgtggacggctctgctgtgtgcctgtgcgtgcccagtcccgcgggtgaccaaagcccaggggcgggcagggcaggagcctggacctcacgtgcctccagtggccaggtttgcgggggcggagcgtccgggcgagggcgcgggggcggaccctagggcggggcgcggggtggcgtcggtggagccggctcggcggcgcggctcgtagtgctgcggccgggctccgggcgtcccggcggccaccatgctcagcgtcgtgcacttcctccggagcttcttcaaggtgagagccggcgtccgggacttgcggtcgggctcccggcgccctgcgcgggtggggaggagcacagcccgcgctggctgctgcgccccgggccgtcccctgggcacccggtgggtggggacaccctcgtggctccccgccgctcccaactttccgacgtgcagaccggaggcggcgtcctgcaaagtggggccgtctcgagcgcggggaaggacggggctccgttgggggcggtagggacggcggcccggggcgagcccctgagagggcaagggcgagcgcctgagccggcctccccgcacctggaccgtcctgggcgcgcggggcactcggagccgctgcctggaccggcctgggcgcgcagggcactcggagcctctgccgcttggcgcagtaccagctgttttgggaaggagggctggtgccggcccggtgggtacgggagaagtggttgctgttgttattccccaggctgagagtacgcgagggcgcagcagcggcaaggggctggaactggggtcggggctgttgggctcctgctcggggtgccccctctctggcccgatttccgggcccgctcaccatccgggacccactcagttgggacgcctccacctcgctgcccccacaggaaccccaagatgggccgggggctccggggcactgtcaggggtggccggccacaggttgcc

SEQ ID NO: 118241 - DNA, 30 bp, Homo sapiens; identical to SEQ ID NO: 85174
  chr2:131639301-131639331
  Hypo

SEQ ID NO: 118242 - DNA, 1603 bp, Homo sapiens
  chr2:131720738-131722341
  Hyper
ctgaactcttccacacgctttctaaaatcgtttggcatggactttcctcggccccttaatcaccacagggtgtgtcctgcccgggctgtcaggagggtcgcaggcgcccggtggtccacgctcaccgtgcgcctggctgagcgcagatgagggtcgtgtcccgtctgagcgcgctccccccgccggcgcgcacgcctgcccgccgggtctctgccctgggccgagcggggccacctgcttgcgtcctcgccctggatggcgtgggaggcgccgccaaccgtctgagctggaatccttgcggtgaaaaagtgggcgcccaccagccctcctcaccaccgcggctgcgacgagcctgggcgtcgcctcctaaggatggccctgtcctaacacacgcgtgcggacacaggtggcggcggcgcggccctgcggcaccgaggacgacccggagccccgcgcccgcgcccgccgccgcagccgctccaggcctgcgtgcgcgcgtgcgtgagcgcgtgccgaccgggcccgcgacccgcactggggtcgccgttgaggctcagcgcccgccgggcggccggtagtgggcagcgagctgacgcgctgcgctctgccgggagggcgcctggcctcgctccgagccgcgcgcgccccgcgcctgccaagggtcccagctgccgcggccacagagcccgagcggggggtcggctgagagcctccttaacggagccccatgatgtcagccggcccgcacgcccctcgccctccgactgcgaccccggcccgggctcgcgcgccccgtcccccggcagccccgcggccgccgcaccgccgcccccggcccagccttccccgagcctgtggctggagctcgggcccgcctgcgtgcgggcgcagcaatgccccagcgagtcaagcgggcagacgagtggcgatctcggcactagcagcagcagcagcgccgggctgtccccgggctccgactcggacagcagcggcgtggtgtgtggcggccgcggaggcaacgggggcatgcgcggcgccgtgtcccgctcctggagcctggagagcctgcgctcggccaccgccggtaaggacgccgccatccccgcgccgcacgcgccctccgcgcccgggtctgtgctcttgggaccccccgcccccctcctgcctttccttctcctccctcactttctgcctgtcgtttccatctcctggtcccttccttcccattgcttcgccctgctattccttttctttttctggtttccttctgattcccactgcctgtctctctgatccacgtctaccggtgggccacctgttacagccgggaccttgttggcccccataccagagcgcgctgtcaactgggaaactgattaaggtgagactagaatttggtgcccgatgcgctgtgttcctttccccaaactgttcttgaccagttgcacctgtctggctttacctaccgcagctgcttagcctctgtaaagccaggaggatggaagggggccgctggccgagggtggaacggattgcgccacctggctgtgagtgcgcttggtcctgaccgcaggactgcagctcccagcggaggcagctggtc

SEQ ID NO: 118243 - DNA, 1030 bp, Homo sapiens
  chr2:131792172-131793202
  Hyper
tgaagtgggggcctgcggccagtccttgtaaggaatcagagtccctggcccatccctccccaaagcgccggtgccaggcgttttggcctctgtatctctgaaacgaggaggtcccggggcatccccgagcgcccccgtggccatctgtgccactggccagcccagggccaggactgctgtgccggcgtggagattcccgaccctttccaaggaggtgccaagggcgcagcgcagcgcacgcccgagccgccgcggtccctctgagcctctccagcccgccgccgccgccgcccccgcccgcacagccggcttggttgccagggttgccagggcttggggcctgggaggcgccgcgcgcacggcgccggcttcgcgggaggagccccaggcccgcgagcgcaggcgccccgcctctccccgggcgctgcgggccaccggctcggccctgtgcggcgggatctcggggccgcacggagcgggaggccgggcgccatggcgagggccccgcagccccggcgcggccccgcggcgcccgggaacgccctgcgcgccctgctgcgctgcaacctgccccccggcgcccagcgcgtggtggtctccgccgtgctggcgctcctggttctcatcaacgtcgtactgatcttcctgctggccttccgctgagcggccgcgcagggcgccgcgccggggtgagtggcgcgggcgacggcactccagccgttgccacccgcggcctccgcactggtcgcggagggaaggcctccttccaccccatgtgctcactaccagggcctggtccgggggtgtcgccgagcgggtgcctgaggggcgtggtggcacgtgtgtcacagggtccttctgtcctctgtgccctgtggggagtgggggctgcgggggcgaggggggaggccaaaatggcgcgtctctgcgagtaaccgaggatgcggattcagctggggctccccggctgcttgtctggaaacggagtgcatgtgaccgctgggtgagcgacccgcgcttgcatctgtgt

SEQ ID NO: 118244 - DNA, 180 bp, Homo sapiens; identical to SEQ ID NO: 85182
  chr2:131813291-131813471
  Hypo

SEQ ID NO: 118245 - DNA, 261 bp, Homo sapiens; identical to SEQ ID NO: 14463
  chr2:131967115-131967376
  Hypo

SEQ ID NO: 118246 - DNA, 266 bp, Homo sapiens
  chr2:132088590-132088856
  Hyper
tcctgacactgcaagcgctccctgaaatccgggctgtccaagtaggaatcgctgaactccagagtaggcagccccatggcacaggcgctgtcagcggcgtccgcgggcacgtctgggccggcggtcagggcagcagctggcggcggcggcggcgggcgctggggacgcgcgatagcggggaaggcgctgctgggacgccaggggactgatcgctgaaaggaaacgggcccgcgcgctgcagccacctgagccgggctcagtcttcc

SEQ ID NO: 118247 - DNA, 402 bp, Homo sapiens
  chr2:132121322-132121724
  Hyper
agcccagagacctcccggaccgatgctgctccagccggctgacgaaaaaggcgagcggaagggcgggcgccgagctctctgcgcccctgcaagggccggtggaggagcccggctggagggcagcaggactctccacagactggcagccgccgccgcctcccggcagagtagccgagcaccgagcgaggcccgcggctgggaagggaaggagggcggtgtcggcaggagccaggggtgtgctttggcttcccaaggctagggccgttcccttcttcctcacccggctccaagacctgcgggagaaaggcggagggtggcggagccggaaccgcagacgtatctgggatctctcacgcgcggcgcttcggcttccccagccgccgccgccgcagcccaacctgc

SEQ ID NO: 118248 - DNA, 303 bp, Homo sapiens; identical to SEQ ID NO: 85189
  chr2:132152221-132152524
  Hyper

SEQ ID NO: 118249 - DNA, 635 bp, Homo sapiens; identical to SEQ ID NO: 85190
  chr2:132182618-132183253
  Hyper

SEQ ID NO: 118250 - DNA, 207 bp, Homo sapiens; identical to SEQ ID NO: 85191
  chr2:132218311-132218518
  Hyper

SEQ ID NO: 118251 - DNA, 49 bp, Homo sapiens; identical to SEQ ID NO: 85192
  chr2:132300662-132300711
  Hypo

SEQ ID NO: 118252 - DNA, 30 bp, Homo sapiens; identical to SEQ ID NO: 85193
  chr2:132301604-132301634
  Hypo

SEQ ID NO: 118253 - DNA, 99 bp, Homo sapiens; identical to SEQ ID NO: 85194
  chr2:132415272-132415371
  Hypo

SEQ ID NO: 118254 - DNA, 46 bp, Homo sapiens; identical to SEQ ID NO: 85195
  chr2:132416768-132416814
  Hypo

SEQ ID NO: 118255 - DNA, 201 bp, Homo sapiens; identical to SEQ ID NO: 85196
  chr2:132767329-132767530
  Hyper

SEQ ID NO: 118256 - DNA, 240 bp, Homo sapiens; identical to SEQ ID NO: 85197
  chr2:132767710-132767950
  Hyper

SEQ ID NO: 118257 - DNA, 120 bp, Homo sapiens; identical to SEQ ID NO: 85198
  chr2:132795881-132796001
  Hyper

SEQ ID NO: 118258 - DNA, 120 bp, Homo sapiens; identical to SEQ ID NO: 85199
  chr2:132796061-132796181
  Hyper

SEQ ID NO: 118259 - DNA, 453 bp, Homo sapiens
  chr2:133014570-133015023
  Hyper
acacggccacgggatcccaccgccacagacaggagggaggtaccgcagcgacccgcctaggatgccggacggccctcggcaccaccgagacccgcctcatgagccccaggtcccgccatcaggaccccgaggtgacctcagccacaaacctaacgccagggccacgttgctcgtttctcatccatcctccaacccggtcaagctccaggagaccggcatgccccccacttgggacgcttcccagggccaggcggcccaaccccgtgccacgcaaacacggtcgtcggcaccggtcgctgctctgcaggggagcgggcagagagccggctcacagcggaacgggtcacaagccggactgaacgccaggcacagccaccgctcacgcagcctcccaaccgctaggacgccggcccggcccggcgggattctcccctgactcggaaggggaaggcg

SEQ ID NO: 118260 - DNA, 180 bp, Homo sapiens; identical to SEQ ID NO: 85202
  chr2:133015296-133015476
  Hyper

SEQ ID NO: 118261 - DNA, 163 bp, Homo sapiens; identical to SEQ ID NO: 85203
  chr2:133015536-133015699
  Hyper

SEQ ID NO: 118262 - DNA, 30 bp, Homo sapiens; identical to SEQ ID NO: 85204
  chr2:133036010-133036040
  Hypo

SEQ ID NO: 118263 - DNA, 560 bp, Homo sapiens
  chr2:133062139-133062699
  Hyper
actttttcttttcatcgttgatagtgatttaacatttcattactttatcgttattatgattgtcattattttagacgaatgcacgaagtcaaaggacttccaaatgcacggacgtcaaaggctaccttcacccgggtagccttgcgaatggccactgctgcgagtggggctttctggggattgtagtccataggcctccttgcgcaagcgcgtggtaccagacgcaagctaggggcgacattgtttggaatgctgggttgagtcccggctggaccgcgcccctctcggaagtgtagccaggagtaggggtgtaggatgtgcagctgtgacccgtccctgtggactgaagtaggaggagtggaggaggggactggtgaccaatgaaaaggcctcgtgggtggggtaggctggggaagttcagcagcccctatctacccgggatggaatgggaagcgcttgggctcagtttggggagcagccctgggtttgacaaaacgtgcatcttcacgtttcgtgacagcgacttgcgctgtgccaccttgggtcgaggcttagggtca

SEQ ID NO: 118264 - DNA, 92 bp, Homo sapiens; identical to SEQ ID NO: 85207
  chr2:133174078-133174170
  Hyper

SEQ ID NO: 118265 - DNA, 144 bp, Homo sapiens; identical to SEQ ID NO: 27528
  chr2:133426223-133426367
  Hyper

SEQ ID NO: 118266 - DNA, 625 bp, Homo sapiens; identical to SEQ ID NO: 85209
  chr2:133426637-133427262
  Hyper

SEQ ID NO: 118267 - DNA, 181 bp, Homo sapiens; identical to SEQ ID NO: 85210
  chr2:133427471-133427652
  Hyper

SEQ ID NO: 118268 - DNA, 221 bp, Homo sapiens; identical to SEQ ID NO: 27531
  chr2:133427885-133428106
  Hyper

SEQ ID NO: 118269 - DNA, 47 bp, Homo sapiens; identical to SEQ ID NO: 85212
  chr2:134024354-134024401
  Hyper

SEQ ID NO: 118270 - DNA, 34 bp, Homo sapiens; identical to SEQ ID NO: 85213
  chr2:134024695-134024729
  Hyper

SEQ ID NO: 118271 - DNA, 30 bp, Homo sapiens; identical to SEQ ID NO: 85214
  chr2:134326018-134326048
  Hyper

SEQ ID NO: 118272 - DNA, 808 bp, Homo sapiens; identical to SEQ ID NO: 85215
  chr2:135475588-135476396
  Hyper

SEQ ID NO: 118273 - DNA, 321 bp, Homo sapiens; identical to SEQ ID NO: 85216
  chr2:135476749-135477070
  Hyper

SEQ ID NO: 118274 - DNA, 30 bp, Homo sapiens; identical to SEQ ID NO: 39689
  chr2:135832320-135832350
  Hypo

SEQ ID NO: 118275 - DNA, 30 bp, Homo sapiens; identical to SEQ ID NO: 85218
  chr2:136873990-136874020
  Hyper

SEQ ID NO: 118276 - DNA, 467 bp, Homo sapiens; identical to SEQ ID NO: 85219
  chr2:136874932-136875399
  Hyper

SEQ ID NO: 118277 - DNA, 264 bp, Homo sapiens; identical to SEQ ID NO: 85220
  chr2:136875881-136876145
  Hyper

SEQ ID NO: 118278 - DNA, 702 bp, Homo sapiens
  chr2:136876362-136877064
  Hyper
gtaatttcataatagcggtaaccaattcgcgaatagtgctttattatcctaaaagtatgctttattataagagtaatttagcgaccagtactttttgtaacagatcactaggaacttgcacagaatcactcattcattctcacaacaccgtgtgggtattaccatcacagagatgcatttagtccgatatttatagaaggacgaactgcgtgccacgcactgttctaggcgttggggatccagcgtgaaccagacaaggcccgcattcggagaaaccagcaaataagcccggagagatgaaatgccagggatgggcagggattccaagccgggcttgaacccaggtcttcggtccccatactcggcgtcttccacgattttgagcagaggacaagctttggcacgaatcagaaattaggttgaagaactgggcggggcggagtgggggtgggggtcagacgtttaaagcgatctcagactggctgaggtttgcagtgggcgcgcagacagtgctttccccctcgcgccacttccctccggcgcggagactgggtggggcgggggagcgagtgtggggcggggccgagaaactgcgtccgcaggcggggtggccgctgcggagatagctgggaccgaggcgcgtgcgtcgcgacacggaccccagaggcccccaccccgaaatggtcccgaggagagggattg

SEQ ID NO: 118279 - DNA, 92 bp, Homo sapiens; identical to SEQ ID NO: 85222
  chr2:137181222-137181314
  Hyper

SEQ ID NO: 118280 - DNA, 698 bp, Homo sapiens
  chr2:137522341-137523039
  Hyper
gcacccagctcccggcgtttcccggagtcaccacaatgtttccctttctctctcccccacgtatgctgctaggggtactccccagataggattttctttgtcttttctcctagtaacaccgaagccctctcgtgcccggggactgcagaggaacgccagaccatccggaccttgcgggatggctcggtgtgtgtgttttactgtgtgtcggagtgtcgcgcatgtgtgcgtgttggggcgcgttatcaacaggggcctagggcacccccactctttcttgctctcttcccccatcacttcatggacctccgaggcgcaaagcgctcgaccctctcctgggctcagtggcttgggtactccgggctgagctcagctggggagtccccttacccagcccgcaccggcaccccgaagcttcaaagttgcggcaaacagttgcggggagcagaggaactgaggtccaggccagcgcgcccgcggtcgctcgccttggggagcaggctgagccgagggtcgtgcgggtgcgcggcagaggcggtaggaggcggaggagaggggggagaaagagggggcggtggggaacagctgccggggtaggcgaggcgcaaggtggctccccgcggccccgcgccccgcggctctcggacgcaccaggcagccaatggctgcgcagaggtgtacagcagatggcgtctgac

SEQ ID NO: 118281 - DNA, 577 bp, Homo sapiens
  chr2:137523099-137523676
  Hyper
tcctcctcctccttcagtgctgaggagccagagtcgccgccgggttgccagacgctggaatgggtggtcttccgacacacaccaccatctttcttgcgctcgggaagctcggggctcagcggctcccagaggttacggcggcggctctggcgagacgggtgagtgcaagcacgcggagccccgagtcggggatgccgggccccctggccggccgactggggcgcggggtggcagcgccggggaagggggcgcgctgccggcgcagactttgctctttcctcgccggacagccatcgtcgccccttctcccagccagacgcgggaacttggaagcggatcttctcggacgcctctggcttggggctgcgggaagcgtgggctgcccggggcgcagtgtgcggagaccctctaggcgggcggggacgccccacgcggcgacctgagcaccgacctcatgcaacgggaccgaaccttgggacccgggcagcaggagctctgttcccttcacctccagcttggtttgagggatactgatgaaggaaaccgggggtttcccgtcctgcgcggagagcctcgg

SEQ ID NO: 118282 - DNA, 1229 bp, Homo sapiens
  chr2:139536937-139538166
  Hyper
catatagaacataggcgtatatcaggaggaggagagcgtggcgcctcgcgggaagagagaagagagtgacaacgcgaaccccaaaccacattttaatacgtttcttattcctcagcgcctccgagccacccagaccaggcgggcggtctccctgaaaagacagcttcgagatgcccgagagggggctcctgcgcggagctgggcatgaaagttatatcttgtgtccccagctggcagaaagccccatcccagtccctagcgccagacggaaaacgaagagaaatccaagctgtcccccaaatccgtattttgcctaagttttctcccagcaaggcgccactacctggctctgagaacgaggatgcatgcactatgctgtgctttgggagaagtgtctgtgtgcatctgggcaaaacaccacgtgaaaaataaacaccaccaagcctctcaaactgtgaacaggaggaaggtctttctgccccttctcatcctatcaatttactttccttcctctccttgaccgcttatcaataaaccgcttccttctcccggacctacttcccggccaccttctgcctactttaccccagcgctcaagtcccaacccgtgctaagcccctgagtcgcctgtagatcccgtctattccgttcttcaattcttccctttcgacctctaaggcaacccaaaactccttgccctccgcgcgcccccaaccccacttcccaagcaggcccaggctgggctccaagtcagccgcctgcgcggttttcccgccgaaacgcgtccccggcgtgtgggacggcgcgcgggccgggcactcaccagctgcagcaagccagggaccaccacgaggggcagcggccgcaggcgcatggtgccggctggcgcggcttttcacgagctgcgcgccctcgcctgcctctcgcgcatctccacttcgcggggcaggactgaggacgccagggacacagcgcggcgcttccctcccggaatccgagcgctgcgccgtgccgcgcagctctggccgggtgggcgggcagggaagggggagggtgggcggaccggaggtgcctctcccggccccccgcgcgcccctcctcggagggggccggcaaagagcctgcggggcagctcgagctccggcacgcggcggggggcttcagtcgcgccttggactctcccgcttggccgggcttggggtgagcgcgtggggcgcctgcgggaggga

SEQ ID NO: 118283 - DNA, 82 bp, Homo sapiens; identical to SEQ ID NO: 85231
  chr2:140650882-140650964
  Hypo

SEQ ID NO: 118284 - DNA, 39 bp, Homo sapiens; identical to SEQ ID NO: 85232
  chr2:141842488-141842527
  Hypo

SEQ ID NO: 118285 - DNA, 117 bp, Homo sapiens; identical to SEQ ID NO: 85233
  chr2:142022840-142022957
  Hypo

SEQ ID NO: 118286 - DNA, 663 bp, Homo sapiens; identical to SEQ ID NO: 85236
  chr2:142887903-142888566
  Hyper

SEQ ID NO: 118287 - DNA, 98 bp, Homo sapiens; identical to SEQ ID NO: 85237
  chr2:142889151-142889249
  Hyper

SEQ ID NO: 118288 - DNA, 45 bp, Homo sapiens; identical to SEQ ID NO: 85238
  chr2:143931476-143931521
  Hypo

SEQ ID NO: 118289 - DNA, 30 bp, Homo sapiens; identical to SEQ ID NO: 85239
  chr2:143948617-143948647
  Hypo

SEQ ID NO: 118290 - DNA, 39 bp, Homo sapiens; identical to SEQ ID NO: 85240
  chr2:144022361-144022400
  Hypo

SEQ ID NO: 118291 - DNA, 18 bp, Homo sapiens
  chr2:144081508-144081526
  Hypo
caacgggccatgtatcag

SEQ ID NO: 118292 - DNA, 30 bp, Homo sapiens; identical to SEQ ID NO: 85242
  chr2:144093577-144093607
  Hypo

SEQ ID NO: 118293 - DNA, 96 bp, Homo sapiens; identical to SEQ ID NO: 85243
  chr2:144108415-144108511
  Hypo

SEQ ID NO: 118294 - DNA, 81 bp, Homo sapiens; identical to SEQ ID NO: 85244
  chr2:144247835-144247916
  Hypo

SEQ ID NO: 118295 - DNA, 36 bp, Homo sapiens; identical to SEQ ID NO: 85245
  chr2:144667175-144667211
  Hypo

SEQ ID NO: 118296 - DNA, 1034 bp, Homo sapiens
  chr2:144694291-144695325
  Hyper
aaaggtagtaggcatcggtgtttctggttttgcttagtgcgtcttcatcgtattccctcgctgaggactgagcctggccgactcagggaaccgagttcaatgaaatcctcagacgcataaagcacagggtgccggcccaccgagctgcgctcccttcccgggggtgcccgagagagagcacgcgagcccggcgcagccaaacccgggcaggggtgggtccccaccgcgtgtgcgtgtgccagcctgggagtgtcggcgcgagcgtggcgggtgcgtgccggtgtgtgtgcgtgacagcgcgcgcgtggcagggagttcgcgcgccagggtgcgcgtgccagcgcgggtgtgcgagggagtgcgcgcgggtgggagcgccaggggctggcggggcccgcgccctgggacgagcccctcgtgctccggctctgcgctcccgcagcgcccacgcagccgagaggagtgggtgatgacttcgtgacctcaacgtcctcccccgtccctcgacatgttcccgcgcctgaaaggtgcagaaaactccccccaccgctctggacgagactgagctaggcgtcgagggcgggcgccgccgcagaccggagctcgggctcgctggccgctcaggcgcagcggtgtggagggaacggacgcgcggcaaggcgacccgctctgggcaacgcgggcgcagctgccccgacgcaaggcactagctggtcgggggctcgggcgagccggggccggcgtgccggggcgtgcgctctctcggcaggcgagcgccgggctccgcggaggtccctgcgcccactgcctgcttctccgcccggcgacccggagtccccaggctgcggtgcgccaggccagacctgaccgagggcggaagacccgagcggcagggaggcagaaagaaaagaggtagcaagccccagacaagggatccttaattacagataaaaggcaaacaaaaccgtacaccacattttccacgtgtcagctgacggccgcgacaaaaggaaacagaacgctggggggtgggg

SEQ ID NO: 118297 - DNA, 94 bp, Homo sapiens; identical to SEQ ID NO: 85250
  chr2:145174483-145174577
  Hypo

SEQ ID NO: 118298 - DNA, 35 bp, Homo sapiens; identical to SEQ ID NO: 85251
  chr2:145204264-145204299
  Hypo

SEQ ID NO: 118299 - DNA, 2564 bp, Homo sapiens
  chr2:145273327-145275891
  Hyper
acacacgcacacacacgcgtacacacacacaaaacctagagagagagagagagagagagaaaagcatcatttgtctctaatcaaaattctctcgtctttgtgttttgctccttccagcacctcacactgcgcccccagccgccccctccccgcgccgcgcagctctggggcaggccgggggcgcgcacaattgtcttctctagaggaaagttgctccaagtgggcccgggcggtccccgcgaggcgcgggctggggctgcggaggccgggaggccgggtgggcgctgcgtcccagcgcctgcctcgggagcgtctacgcggccccgcgccgggtgatcgggctgagagcgaggggagcgagaagtttcctttccgagtctgggctggcgctcgttcgcttgtttgttttcgggggttggtttctttctttttaaactcagttatcctccgtcagctcccccacccccccccggcaccctcgctagtccccagccctctcccctcccccaggcgccttccgcgctcttgccaatcacttttctcttttattcccacgattttgtttggggtaatacctagggggtctctctctcactctcttcctctctctctgtttctctctgtccccccgcgtcccttctctggctgtctccaaaacggacctaccaaactctcacccccccctttaatatcccacctctgatctgcgtgtgcccctcgaacccccatctcctttctccttcctccttcctgactcagcctggataacgggctcctccagaccatgtagaaactgccgggaaaagtctcgctgcgccctgcgactccttcagtccccggcctgggggcagagcctgctggagaggagtcatccgtccccgagccatcatcgaccccaccggaccccgcgcggggccggccgactccctcccaccccggggtctgggcgcgatgggccgggccccgctgcccgcggaccgttacttggcgcaccgagaagcggccgggcgactccggcaagaaactttaagcctcgctgaggcgcagacccggttcccctctcctgccttcgcagtctctctgccacccccgcccccgccccgggatcctgcgcgatccagcgcctgggcccccgccctgccccaggcggacgctcccgaagcccggccggagacccggcgggccgggcgcgagcggagcgggaggcggaggcggagggagggcggaggcaggggctcgaggggggcagcggggctgggggcgcggggccccggccggacccccgcgctcggacccccgggtgcctgacgctcactttgcccggcacttccccaacaccccccggtccagccgccgcgcgcgccgggctccggcgccggccgcggagggaggctcgccctagagccctgggcgccgccgccgccgccgcctcggttccttttccctttccccctccttctccctgggtctcgagccgcgtagtggcccggaaaagtttggttcgggctgcttcttaccgtttttcctcctgggattggcttgtttgcgcctcttgcaccgggggccatccgccatgatcggctgcttcattgataagagcggatcagatggcagttcgcatggactcggcgccctgcttcggcagcacgcaggctcgatctagcaaccaaacacagcgacaatgtgggcatcgcccgcgcccattgaaacgcgcgcgggccgcccaggggagccgggccagggccccggcgagcacccatccgcgccccccaacgccaaagcgaaacttcggcggccccctccccgccccccacccccagccttggccccgaggcgctttgtgtttgttactgtttggtgtgttgcacccgcgaggggatcagagagacaagaattacatcttcaaaatgagtcataactcctgaccgtatgagggaatgcacacggcggtacagtaagaccgcttgactcagggctaggcggaccctttccttcgaaaagtcctcagcccccggctcgggaacttggggtgaggcgaggttttcttttcgttctcatcttttctcatccccccaccccccaattcccagaggaaacaaacaaacaaacaacgcgaaacagcccctggatgaagcacactcgggcaaattgataatagtaattataggaagcccactcgcccagcgccccctcccctccccttttggagtttatcgaggcactgtctcttcctccccccaccctcgcccccaaattaagatttcccgttttacgccgcaatgataaatataattataagcctctttggacactgtcctttaccccaccccccctcgccactttgacaatatttacttaagtatttccccccacctcactcacacacatgctcccccacactggttcccttaaatagttccagtagaattttttttttcccttaagaaaggaaagagaaagtccaaccactacggcaatacttttaagctctactaaatgatcgtatcctttctggcttcgaaacttttgtacctaaaaatcgagagaggcgctgcattttttca

SEQ ID NO: 118300 - DNA, 457 bp, Homo sapiens; identical to SEQ ID NO: 27553
  chr2:145277493-145277950
  Hyper

SEQ ID NO: 118301 - DNA, 1065 bp, Homo sapiens
  chr2:145281202-145282267
  Hyper
tctagaggaattattcgaccttgtgttgtgactcaggaggtgggcaacttcttttggagttgcaagcaaagggtgataaaggggacccctggactgggtgtgtgtggaggaggtggggggcggcaggggtccaagccaagccaaacggttttctcacgtgcagactcgcaatccaatccattcggagttgagcctaggataggaggggaaagtctattaaaaaaaaaaaaaatcaggagcatctctctgagaagccctttcaaacaaaaccaaaacaggaccagagaagctcagaccgtccctaacatccctgctgcgagacccgcaggctgtggaatctcgcacgtcacctggccccagcagggcggccagctgaggggttgattttattttatttttttgaagtaaaggctgaatctcggcttcagggcttttgccaacgtctccactgacaggaaccagcaaacttcaggacccaaatgagcatcttaatttattgatgctaaacaggtctggttgttgtccccaattttccgcgcgctctgccactcccccccccacacaccccgccccaacccccgccgccagcttcggtccctgcatttgatctccaggaagggccccgctgcacaggcggaggagcgcgtcgcgggggggggcggtgttcggccccctcccaccagaccgccctcccccagacctgtccccgcccgggatcctgcgacccccgcccgccgcccggtcagctgacctggctcgctcgcctgctccccgcccgccgccctgtttccggtccccggggtccgcgagccgcgctccgagcgggcgcagccgcggccgggaggtgatgccgggggctgattaccatgagaaaggctgtgcctggaaaagcctcctccacgcgactgtcaatctcactaaggcttggggggcggggagcggggggggggacggaaaggggccctgtaggagtcaccagaaaacttggagtaagttggatgcgacgcaggcccgaggaggtggctttcgcctcaacttggaaggctggggcgttgagggcgcgga

SEQ ID NO: 118302 - DNA, 26 bp, Homo sapiens
  chr2:145286967-145286993
  Hypo
gccactgcacccggccagaaattatt

SEQ ID NO: 118303 - DNA, 188 bp, Homo sapiens; identical to SEQ ID NO: 85260
  chr2:145569755-145569943
  Hypo

SEQ ID NO: 118304 - DNA, 36 bp, Homo sapiens; identical to SEQ ID NO: 85261
  chr2:146299343-146299379
  Hypo

SEQ ID NO: 118305 - DNA, 84 bp, Homo sapiens; identical to SEQ ID NO: 85269
  chr2:148600063-148600147
  Hypo

SEQ ID NO: 118306 - DNA, 62 bp, Homo sapiens; identical to SEQ ID NO: 85270
  chr2:148601287-148601349
  Hyper

SEQ ID NO: 118307 - DNA, 160 bp, Homo sapiens; identical to SEQ ID NO: 85271
  chr2:148776716-148776876
  Hypo

SEQ ID NO: 118308 - DNA, 113 bp, Homo sapiens; identical to SEQ ID NO: 85272
  chr2:148958934-148959047
  Hypo

SEQ ID NO: 118309 - DNA, 267 bp, Homo sapiens; identical to SEQ ID NO: 85273
  chr2:149255724-149255991
  Hypo

SEQ ID NO: 118310 - DNA, 86 bp, Homo sapiens; identical to SEQ ID NO: 85274
  chr2:149256171-149256257
  Hypo

SEQ ID NO: 118311 - DNA, 30 bp, Homo sapiens; identical to SEQ ID NO: 85275
  chr2:149309923-149309953
  Hypo

SEQ ID NO: 118312 - DNA, 103 bp, Homo sapiens; identical to SEQ ID NO: 85276
  chr2:149514585-149514688
  Hypo

SEQ ID NO: 118313 - DNA, 1504 bp, Homo sapiens
  chr2:149632642-149634146
  Hyper
atcctgtccttcccccggcaggtagagtgactacaagtcccgggatgcgcagcgctcggagtcgggcgggggccgggcggacctctacggtgacgtcaccgtcccggggcgggccaggggagggcggggcggaggggcgggtctcaaggcggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcggggtaagtggctggggcgtctgccttccctgctgctccgcgccgcagctgggcgccccgacgccccagacgcagcggaggtgtttaggccgccccctcggacattcccgcggggctggcctctcgggtggacctgaccagagacccctcgccccgcgcactatggttccctcccgggcgggtggagaggcggccgggagcggcgggccgggcgggggtggcgggggtggggatggggggcgaagacgggctcggcgccgccattgttcgccgggtgggggcccgggtgggcccattgttccccacgctcgcctcgccgcgtgggtagtgtgttcgggtgaccctcaagccgggtgcccaggccccctttaaagtgtgagctctgcaacccgcaaatgcttctgggcatcaatcaattcgatttaccaaacgccttgcctcttcttctcacgaccctagcaaaaaagaaagaaaaaggggtacaggaaaatttctagtcgcgtctcggagctcccgcggcagtgtagacgcggctccccgcggtgttacacctggctccgcgcgcggaaggcggagggttgggggagtactggtggcctcggtgtcccctggaggcctggtgtgtctcccgcttcctctcacgcctggctgccctggatgtggagtcccggcttgatccctcccctctgggatgacctccctcccatgtctgcagaccctctgatgcgcctcacgctgggtggagaggaggctgtgtccacatctgtggggcgagggggctcagagcgcagtagccccctgtgccaagagcagaagttacttcgtgcggctcggacc

SEQ ID NO: 118314 - DNA, 491 bp, Homo sapiens
  chr2:149645496-149645987
  Hyper
aggctggaccctccccgcccctatcactaccccttacccccgcagcaagggctgcgaccccgcgggtccccgctgagcaccgcagcaattaagtacgtgcaagccatttgcggcagcgggtttgagatgcgttcgtagtgggtgacattgagaacccccagaggcgacacgggcgcctggtctctgagaggtggcatgctgcctgccgccctggtgcctggctgccccggaaggggcccccagtcgccggccccgggaaggtgctccaggctcgcggctcctcgggggtcgcctctgcaggcggcctgtttccaatttccaggcgaggagcgacgccgtgatgcaaatctgccacttaccttctgtcaccattctgtcgctaacgctaggaatgatgaaacctcctgttctggaaatgcatttccctttagcaccagcgccttctaatgaggtccctctgccccgcaggacaaaagcgcccattagggggc

SEQ ID NO: 118315 - DNA, 137 bp, Homo sapiens; identical to SEQ ID NO: 85282
  chr2:150186851-150186988
  Hyper

SEQ ID NO: 118316 - DNA, 30 bp, Homo sapiens; identical to SEQ ID NO: 85283
  chr2:150394715-150394745
  Hypo

SEQ ID NO: 118317 - DNA, 39 bp, Homo sapiens; identical to SEQ ID NO: 85284
  chr2:150422336-150422375
  Hypo

SEQ ID NO: 118318 - DNA, 41 bp, Homo sapiens; identical to SEQ ID NO: 85285
  chr2:150706992-150707033
  Hypo

SEQ ID NO: 118319 - DNA, 30 bp, Homo sapiens; identical to SEQ ID NO: 85286
  chr2:151342707-151342737
  Hyper

SEQ ID NO: 118320 - DNA, 52 bp, Homo sapiens; identical to SEQ ID NO: 85287
  chr2:151343072-151343124
  Hyper

SEQ ID NO: 118321 - DNA, 47 bp, Homo sapiens; identical to SEQ ID NO: 85288
  chr2:151343590-151343637
  Hyper

SEQ ID NO: 118322 - DNA, 172 bp, Homo sapiens; identical to SEQ ID NO: 85289
  chr2:151795349-151795521
  Hypo

SEQ ID NO: 118323 - DNA, 58 bp, Homo sapiens; identical to SEQ ID NO: 85290
  chr2:152118660-152118718
  Hyper

SEQ ID NO: 118324 - DNA, 30 bp, Homo sapiens; identical to SEQ ID NO: 85291
  chr2:152234018-152234048
  Hypo

SEQ ID NO: 118325 - DNA, 79 bp, Homo sapiens; identical to SEQ ID NO: 39697
  chr2:152266023-152266102
  Hypo

SEQ ID NO: 118326 - DNA, 708 bp, Homo sapiens; identical to SEQ ID NO: 85293
  chr2:152954512-152955220
  Hyper

SEQ ID NO: 118327 - DNA, 42 bp, Homo sapiens; identical to SEQ ID NO: 85294
  chr2:152955741-152955783
  Hyper

SEQ ID NO: 118328 - DNA, 32 bp, Homo sapiens; identical to SEQ ID NO: 27565
  chr2:152956018-152956050
  Hyper

SEQ ID NO: 118329 - DNA, 29 bp, Homo sapiens
  chr2:153044296-153044325
  Hypo
tgagccaccgtgcccggccggatatgttt

SEQ ID NO: 118330 - DNA, 30 bp, Homo sapiens; identical to SEQ ID NO: 85297
  chr2:153192735-153192765
  Hyper

SEQ ID NO: 118331 - DNA, 133 bp, Homo sapiens; identical to SEQ ID NO: 85298
  chr2:154079386-154079519
  Hypo

SEQ ID NO: 118332 - DNA, 2355 bp, Homo sapiens
  chr2:154333308-154335663
  Hyper
cctagggagcattaacgtcactaacgtcactgtgtaccttagcagctacttttcctcgcattttataattccccttccctccgccccccggccccacccgtgggcagcatcccaaagccgcctggctgacgttggttagggtagagacgccctccctaaaggctgtccaagccgtctcttcctttcattagcggtgtaatcctgtgttcccgccggagcctggcacggaagtgtaatcttcccgcgggggcccttctgtcgtctcgcctacctgagagctgagactaaatgaaatataaaatattcacgataagaggaaacaaaggatgctgcctccaggacggctactgtgcctgaggctgggctccttctcagtcatcccagggcctctccgtctggccccaccctcgcccctccaggggatccacaagttgaatcgcagctctccagggttaattgccctggccgggagccagactcctcaccgccgccccgttcccccctgctggggagcgcagaatgaccaccaggaggccaggaacaaaacgcttaaatgttgcatttattaaggaaatgttaaataagaaaaaaacaaaaagtcaaaacggtgtcacggatgtcaagagcacttttgtggcgtaaaccgtgcagtcacgagctacgagttctattctgggtctttgtcccagggccagcaggaacgctagacgcctcccaaaagacccagtgggaaatgcactaaaagaaacaactcaccccgttcaaattcgcaggctccccctccccccaccccttctcccacaatgacaaaactgtaactcctcaggcaggcaaacaggccactggggcagaaaaagacttatcaaacatttgtattcaagcaaacaaacacaaaacctcttaaaacggcacgttacaatcaaaggtatttatcgcccctcccctccagggcagggggggagcaggagaagagtgggagcgcacccggacacggatttgtgagaccccatgagtctgctgcgtggcttttaacaggtcactcttccggtcacaaggcgatcagtgccgctgggtctctcccctgcccgccctctccacctgcccccagagcttggcccacctgcgggtggagaagggccttcgcaccgtcggtctccccgcattccaagtaagtagcagcttccaaagttctgcgccctaatcgccctcttcttgccactttctgctgagttcagagtctgggcgctctcctccgactgccaggcatgaggactttcagagggcgagggagaaaccggtcgcttctttccgaaaggccgaagtcgagagaaataattgactccgacaggtttgcttcgcccagtctctgatagtgaggggcacagccgggctagcaaagtgggcaggcgtgggagcggttgccgcgggggcagagggcgggtcagtagggccccacgaccaccgcctccacctccttagacggcctccggtccttcacgaggaagttgatcatgccctcggacttgatgagcagattgcagccgaggaagaagatgccgaagaccacggtgagtgagagcacgcacatgaccgcgatctgcaccacgcgcattatgtacaggctacgctcgtccgggcctccctccgcgaagccgtcgtcggtcaccacggacgcctgggtgcagcagcgcacggctcgctccagcgcctcgctgctgttggccaggaacaggcccgccacgtccgtctggttgcctagggccggattcatcgcaggaacgggcgggcgccgcgagcggcgcgggtccgaggggtgggaaggcggcggcgctggaggaacaggtgccgggctgagcgctcactcgcagactagcgcgtgcgagggctcctcgctctgctttcgaaagtccctgggccgtgggagtttcccaggagcctctccgacgcgcgcagcagctaggctcttctaaagccgtccgctccagccctggtggtgctcgttcccggcgctcgctcgagggggggctgttggaacttggcggggctggaccagcccggccgtgggaggtgcgggccgcggcggctgcagcggcggggtggctgcgctgagcaaacagcggccccttccggccgcaccgccgcgctgcgcgctgctcttgggaggtggaggaagcaaaggggcgaacctggtcttgctttttattgcttgcttcttttgcaaactccaaaggccaggcagaggtcactgtactcttctagcttgatggatgattaaagagtttgtcgggggagggtgcggtcagctgaaagtttcagaggaactgggacacacgagctctgcgtgtcctttgcctg

SEQ ID NO: 118333 - DNA, 563 bp, Homo sapiens
  chr2:154727902-154728465
  Hyper
cctccgtcctttctgcggagggcgccgaagcgtcaagtaccccgcagcatctctcggctggagagccgacggcaagggtggggttgccggcgctttccccgagggcagtctctgatcctccagctcccctctaagaggctccctggtgcattgggcgaacgcggtgcacgcaggccggctttggcgttgtggggccccaaagcggccaggggtcgcgaggcgccctccggcgagaggagctgaccccagggttgctcttgggggccgtgcctgccaagtatcgcgggacttgcgcacatcgcagaagcgccagctccagaagcagctggagcgcgctcggtgcgcaccgccccagcccggggaggagcgggagcagggagggaggagggctgggggtgctggttacgtaaatgatactagcccagtgagaggcctccaggctggggctacgagaggaggagggaccacgcgaggaggagggaccgggaggcggcgggctggggtgggaggggggcgggggccggggagaagtgaccaggcggcggcggctctgctgaggtgac

SEQ ID NO: 118334 - DNA, 382 bp, Homo sapiens
  chr2:154728885-154729267
  Hyper
agagtgccggggctaggtgccgcaaagtcccgcggcgagtgccggggcgcggagccgagcgccccgggccggtcccagggcaaaggcaggggcgcgggcggacctggcgacgcggcctcccgggagctccgagtgcgctcgcttgcggggctgcaggtgttgcgggaggaccgcgtggcgcggaactttctgccgccgcccaccttctgctctgcttttctggctaccccggtgagttgttggtggcgggggggggggggggagcggctctggccccctctgcgttctggtgacgttcctccgcgggggtggctcggcctccaagcccagacaactttctcgcaccagctgcaggcagccccggctgcgttgcgggcgtttc

SEQ ID NO: 118335 - DNA, 540 bp, Homo sapiens; identical to SEQ ID NO: 85306
  chr2:154729521-154730061
  Hyper

SEQ ID NO: 118336 - DNA, 30 bp, Homo sapiens; identical to SEQ ID NO: 85307
  chr2:154870172-154870202
  Hypo

SEQ ID NO: 118337 - DNA, 349 bp, Homo sapiens; identical to SEQ ID NO: 85308
  chr2:155555158-155555507
  Hyper

SEQ ID NO: 118338 - DNA, 2018 bp, Homo sapiens
  chr2:157176340-157178358
  Hyper
gtagagaagaaggagcgctcccagccgcgggaagataagcgtacaggcggccccaaggcccctacaggcgcagccctgatctggccacttgactagacgctcgctccagcgctcgcaggcctagggctcattacatgcgttgcgaggagacctgaaagcagggcgggaacgcacaatctatcttcagagctttgggtcgtgagcacacgtgtggagcatggttgtggcatgggcgtctgggcccctctcctagacctccacgaggtgcggacgcgcctctgccccgcccttttgtgcgccctcaccactagaaaaagagttttccccagtgtcgcgtgggaggtcgccccagtccagctcagcgttccaagagaccagagactgaccggaaatcgttgggtgcagggagaagcaggagacgcgctccgcctcctgtgctcgtgccctagcgcaacagacgcgacctagaggcgacggcagcctgttgcagccttcgccctgagggtggggggcgggggggtgtagaacagctgaggaagacgcagggagcagctggggaggaaagggagggacaccgaggaaacaaagttcacccaagtgaatgcgtcctaattgctccaaggctctctccgcaaagtctacgactgcaagccgcaaagtcaaactacgtctccaaaacgcagtgggcagagcaggagggcttgtgtctccattttcgccgcagggcggatcgcggacacaagtcctctccagtaattccgaagcctcgaaataagactatgctgggaggaggggttggggggtgactaataagaaggcgtgggggtgggggtggggagtacgcggcaagaaccctgctttctggaattctcccgccactgtctgcagggcccagagcgcacttcgcggctagggaacaaaattgccgctctcttcgagcgcccccagcgtggggtggggccctgctttcccgcgtcaggaccgccccaccaggcgccctccgacggaagctggacttttcctaaggaaaggcaaagtcaaagtcggaggaaagatctttcttgcggccccagctgtcgctcctaatggtctcggggaacatactaaaggaaaatgactttaaatcacagtcttgccatcctaaatagttatgtgcaatattttggtttctagcaaaatttaaaagtaaaatggggatttccatatgttcattttattattaaaaacgaattactaaaaagtgatgacctgtttggaattcatatcttgctttacgagcagtcagccagtatcgactgaacacaataaatgcaggggtgcgaaacgtgattgctcgggttcgagttctgtcggatgcaccgatctaagcagaacctttcccgaagacttggaattgggtgcgcttttttttttaagttgtggctgagccctatggggaagaagggttaactgggcgtcggctgagaccccaaaccctcttcctcctccatgagactccaaaattgagtcagtcccagcccatagttgcctgggaagcttggaatcctgagaaattccggggtgcggccactatgcaagcattcctattctgacagcggggacaaatggagaggggaccttacaacctcctttggagaagaatatatgagaaactcacttccagacctctattcaatagtgaaaataatactgagaaaaagttttaaaatctccaagaatagatactctcctttccccttccaccttgagggaaacggtctccatttttgacctggatttgagagcatcggggcttgagacaagcgcgtcttccacagagagaggcgaggcccaggcagggagccccccagcctttactctcggcacctcggcgctgccgcgcggcggatacaaaaggaaacggacgagcgtgcgacgcgaggcggggaactggtggctcgaagacgcgcaacacgcgcgatgcctagaagtgctctggtgtcactcccctgtataggacctggcgagatggaattgta

SEQ ID NO: 118339 - DNA, 201 bp, Homo sapiens; identical to SEQ ID NO: 85312
  chr2:157178715-157178916
  Hyper

SEQ ID NO: 118340 - DNA, 82 bp, Homo sapiens; identical to SEQ ID NO: 85313
  chr2:158454042-158454124
  Hyper

SEQ ID NO: 118341 - DNA, 48 bp, Homo sapiens; identical to SEQ ID NO: 85316
  chr2:159744614-159744662
  Hypo

SEQ ID NO: 118342 - DNA, 226 bp, Homo sapiens; identical to SEQ ID NO: 85317
  chr2:159825736-159825962
  Hyper

SEQ ID NO: 118343 - DNA, 30 bp, Homo sapiens; identical to SEQ ID NO: 85319
  chr2:159964688-159964718
  Hypo

SEQ ID NO: 118344 - DNA, 33 bp, Homo sapiens; identical to SEQ ID NO: 85320
  chr2:160141926-160141959
  Hypo

SEQ ID NO: 118345 - DNA, 737 bp, Homo sapiens
  chr2:160760635-160761372
  Hyper
gtggggaatccttggcgctgtgggtggaggctcctcttggccctgtggccaaggtgaccaagggccgaaggaaaagcgagaacgggagggacgggacgcaagagggcagatggggaaccccatactccagcaacattatataagagaggcgacgatggagcagcgcacccggccaaaaaagcctccgtgcgcctactctacggtgcaccgcgtcccctctgcaccagaagggccctgtcctcccacatccaccgcgccctcctccgggcccccgagggcactggggcgcttcctctgccagacctcccctgcgactcactcttccggctccagagcccccccgccccaacagcaaagcagccgtgacctgccccaggggcgcagccctgccccaggctggaaggcagcagagctgtggcgtcgaggcacccagcggactgcggggctggcgtgcccgcggttacctgcgcggccagagggctccgcgagatcgaagaaccagaagagcagcatgaggagccccgccgggcggcgaggggtcgcccagcctgtcctcatcctgagctggcgcaagccttccggccgggtcctcgggcgcacgcggctcccgccccgcctgctgagcgcggcctgccccgcccgcacctctgtctaggcctctgggggcgccccggccccgcccccgccgccctcggccaatcagacgtgcgtctcctcggccccggggcggagcgggc

SEQ ID NO: 118346 - DNA, 487 bp, Homo sapiens; identical to SEQ ID NO: 85326
  chr2:160918575-160919062
  Hyper

SEQ ID NO: 118347 - DNA, 83 bp, Homo sapiens; identical to SEQ ID NO: 85327
  chr2:160919402-160919485
  Hyper

SEQ ID NO: 118348 - DNA, 151 bp, Homo sapiens; identical to SEQ ID NO: 85328
  chr2:161253372-161253523
  Hypo

SEQ ID NO: 118349 - DNA, 174 bp, Homo sapiens; identical to SEQ ID NO: 85329
  chr2:161264166-161264340
  Hyper

SEQ ID NO: 118350 - DNA, 217 bp, Homo sapiens; identical to SEQ ID NO: 85330
  chr2:161264622-161264839
  Hyper

SEQ ID NO: 118351 - DNA, 30 bp, Homo sapiens; identical to SEQ ID NO: 85331
  chr2:161349208-161349238
  Hyper

SEQ ID NO: 118352 - DNA, 51 bp, Homo sapiens; identical to SEQ ID NO: 85332
  chr2:161350175-161350226
  Hyper

SEQ ID NO: 118353 - DNA, 45 bp, Homo sapiens; identical to SEQ ID NO: 85333
  chr2:161560571-161560616
  Hyper

SEQ ID NO: 118354 - DNA, 85 bp, Homo sapiens; identical to SEQ ID NO: 85334
  chr2:161987588-161987673
  Hypo

SEQ ID NO: 118355 - DNA, 30 bp, Homo sapiens; identical to SEQ ID NO: 39698
  chr2:162087925-162087955
  Hypo

SEQ ID NO: 118356 - DNA, 66 bp, Homo sapiens; identical to SEQ ID NO: 85336
  chr2:162094291-162094357
  Hyper

SEQ ID NO: 118357 - DNA, 245 bp, Homo sapiens; identical to SEQ ID NO: 85337
  chr2:162094615-162094860
  Hyper

SEQ ID NO: 118358 - DNA, 81 bp, Homo sapiens; identical to SEQ ID NO: 85338
  chr2:162095165-162095246
  Hyper

SEQ ID NO: 118359 - DNA, 186 bp, Homo sapiens; identical to SEQ ID NO: 85339
  chr2:162095461-162095647
  Hyper

SEQ ID NO: 118360 - DNA, 40 bp, Homo sapiens; identical to SEQ ID NO: 39699
  chr2:162166372-162166412
  Hypo

SEQ ID NO: 118361 - DNA, 55 bp, Homo sapiens; identical to SEQ ID NO: 85342
  chr2:162271455-162271510
  Hyper

SEQ ID NO: 118362 - DNA, 32 bp, Homo sapiens; identical to SEQ ID NO: 85343
  chr2:162272302-162272334
  Hyper

SEQ ID NO: 118363 - DNA, 995 bp, Homo sapiens
  chr2:162273084-162274079
  Hyper
ttaccagggggatgacgaatcagtcagatacagacaattttcctgactccaaggactcaccaggggacgtccagagaagtaaactctctcctgtcttggacggggtctctgagcttcgtcacagtttcgatggctctgctgcagatcgctacctcctctctcagtccagccagccacagtctgcggccactgctcccagtgccatgttcccgtaccccggccagcacggaccggcgcaccccgccttctccatcggcagccctagccgctacatggcccaccacccggtcatcaccaacggagcctacaacagcctcctgtccaactcctcgccgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggtaatactacatttttggctgccgctgctctaggcgcagccggggacaagtgcacctaggctgtgactgccgcggcagcgacgatttggggtcgggagcggagtggaaggcgccctagagttggctagttttggaaagggggaaagtggaagggataaccgccagggtgatgttggtgggggggaccccgttctaggaacatagtgggagagccagtcagtggccagaggaaggcaagaaaaaggaagagccctggccagcggctgggcgatgggagggacgcatcaacactggcatgcacggacaggtggagacgcaggtcgccaacctcgctctccacctgggcagtgataactgccaccttcccactccagctcacccgccgctctccctgatttgggttgcacttcttttcttctcccaccaccctttttctaatccagcaaatattcgcctatttgctgca

SEQ ID NO: 118364 - DNA, 138 bp, Homo sapiens; identical to SEQ ID NO: 85346
  chr2:162274300-162274438
  Hyper

SEQ ID NO: 118365 - DNA, 970 bp, Homo sapiens
  chr2:162274832-162275802
  Hyper
ggtcagtggctcaagcgctcgtgttttctctctctctcaccccttcctccctgacatccagttcgtcagtgtaaagcagcatatggaactggatacacgtttctttgcttcattaaaaagacttaaaaattgtatttccaccctccaaatttatattaaatctgtaaagttgttctcattggcaacacctccgtcggcccaattttggagtgcccgaccttcccaagtactaatactgattgattttgagaagaaaccccacaagatctgcaggttgtggaaatctttgttcctccttacaggaggactaggagaagggccctgaggatcgggcggtcggcttcccccttttttccggtgccccggcttatcttcgctcccagaggtgcgaaagccggtctgccccagccagccagccgccagccaggcgagtcccgcggtcagttagcctggaaggcgggctgcaggctgcctccgccggcccgggcgcgcagccgggcgcacacagccacgcgcacagcgaccgcgttaacacgccacccggcgctcccctttcttcccgccggacagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatgtaaggagacctaggggctgggggcgaggcgggcggcacagacatctctcccaccctctcacattctcccgccatgcaaggctagggtactagcagcgctaacatcagcaacagctggctccgctgtgcgttttaaggcttagggctcggggcctgcccacggcacctttcctaaataccaagccggtgggaaaaagctttctatttgttttcgtcgctggtcacccgggccacctttgag

SEQ ID NO: 118366 - DNA, 1221 bp, Homo sapiens
  chr2:162279820-162281041
  Hyper
accccaagggacctccgcgccacccctcggctctctctctctctctccctaccccgcaggatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctgcccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttggttttcctacttactcttcttctgtggagttatcctcctacaattcccctccccctcgtctttctcttacc

SEQ ID NO: 118367 - DNA, 30 bp, Homo sapiens; identical to SEQ ID NO: 85353
  chr2:162282190-162282220
  Hyper

SEQ ID NO: 118368 - DNA, 30 bp, Homo sapiens; identical to SEQ ID NO: 27591
  chr2:162282450-162282480
  Hyper

SEQ ID NO: 118369 - DNA, 738 bp, Homo sapiens
  chr2:162283365-162284103
  Hyper
attaaaatgaaaattcgtgggaggataaaactaacttgccttccctggacaattccgccactagacggcgttccgtggagttttgtctgccacataaaaaagcgaggactgaatttcctttgtgtttctttcccctcctcacatctaagaactaagtaagaggacaaaagtacaagacacggtgcatgtgtggcgagtgaagtggagcagtgcattcgtgtcatcacccacccgaccccggctgcgctcctccgaccccgccgcctactcccgccgaggaggaggagcacgtgcggtcggtggggcgcagggccggggagccaggggggtgccggggctcgaggccgcggggccgcgggggccgcgctctgctctccgcccaggctgggccactggagcgcgggagccctggagcccggcgctgcccggcgctacccgccgccctcgggacagtcaccgtgagcaaaagagtcggtgtcatgtgcgtaaacgaagctcttaggagccgaggatagatttcacaggaacgtagtgccttgttctgaaagacgcgctttggttgatattaggaagtatttttaaaaaattggggaggtcgtttcccttgcagctccgccaccatctgctgcgtggactgagtcagcgtgaggtaaatttgcagcttcgcgctcctctcggaggcattgtgctgtcttgtccctttaaaacatgatcatttctcctcgcttccaagaagtc

SEQ ID NO: 118370 - DNA, 255 bp, Homo sapiens
  chr2:162284325-162284580
  Hyper
ttttcaaaaagaggacgaaagaagaagacgagcgtgcggctagcactgtattctggctcgtgtcttcccgccactcgcaatccgcgccatcttaactaactttcaatgtccctcggggctgagcgtgccggcggcgggtgctgctcgggctgggagatgctgcggcctgggttctcaaccttccgggtggacgccgcccgtcggggtagacagaggcgggaacaaagcgcgttgcggcggcgggaggcaggccgg

SEQ ID NO: 118371 - DNA, 32 bp, Homo sapiens; identical to SEQ ID NO: 85358
  chr2:162311722-162311754
  Hypo

SEQ ID NO: 118372 - DNA, 463 bp, Homo sapiens
  chr2:162930196-162930659
  Hyper
ttcagagcacattagcgttggtttctctacccctgcccgggttcgggcgtgcgttctgtgagtggctctccgggacattcaaagctcgacgccagggtcctagcagaagccagggtccgaaagctaagcgagagctctgggacgtcccttcacctgtcagagggtggccttggggcttccgcctaaggggagtccctggtccggtttcgccagcttttgggccatttggggagtttggcgaagaggtccccacagctcgccccggggacgtacgtggcgcggcactcaccttcatcgtcggcgtctcctcggaagtgagcgttcagagaaggagcgcaggcagaagtcaccgcgggcggcggagacgcgcgtcctgcaccgctgctccgggcggtggagtcactcgccgctggcaagtttcggccccgagttaaacattagtgagcgccgagcccgctgggta

SEQ ID NO: 118373 - DNA, 49 bp, Homo sapiens; identical to SEQ ID NO: 85362
  chr2:162930921-162930970
  Hyper

SEQ ID NO: 118374 - DNA, 689 bp, Homo sapiens
  chr2:163694871-163695560
  Hyper
tccccaccttggaagcggtggacgccaagtgcactaacaaggcagaaagcgagggcgagagaagagaacaaacgaacttactttgcccttcaaatttccgaatgatggtccccagaaatgtattttgtggtgccacatgccccctgcgcacaggcatgttggccccggtcttccgaggagcgctcccccggagctctggagttctcccgggatctctcctcggctagagcccaggccagcgcgcgagccgctctttgtggcagagcatcctcttttgaaaccagaattctcttcccattagcaccacttctagacacccgctttccccaccggagtccaatccattcccctcaccttccggagggggcctcgcaccggactgccgcgggtgagagggtttgggggtggggaacgggaaggaggcggggtgaggggaggtggcgggggagggaaagagggagggagctgtgggggtggggtgggaagggggcggggagtcacaagggcaatcgatctgtttctcttctcccaaacagcgccaatttcccagtgcaaatgggcttaacctggcggttgcccagagcagtaaggaatggctgaggggggatggaagacttgtgccggttttgctggaaggagagagagaaaaggaggctgggggtcggcggggttgacgtttctatccccgc

SEQ ID NO: 118375 - DNA, 224 bp, Homo sapiens; identical to SEQ ID NO: 85367
  chr2:164591881-164592105
  Hyper

SEQ ID NO: 118376 - DNA, 783 bp, Homo sapiens
  chr2:164592629-164593412
  Hyper
agagggagaaagagacggaggctgccgtgagggagagaagacgggaggcagtggcgagaggcgggcagtggagagagacgggcagcgggaggaccaggagggagagggagaggcgcacggagcccgcggagctggagggggagaaagggaggcgggaggcgagccggcgagcgagctagagacgcgccagagattcatgggcagggagggctcaatggccgcgccgcgccggccggccggccgctcgggtcatgttacacggccggggccgcggcggccgcccagcctcgccgatgcgctcacgcggcccggagggggccccgaggtcatgattacgcgcgcggggactcgcagctctccctgcacgcactctctggcggcccagcctggggaaaggggagcagcgccgtagggggaagggggctttctttcccacgcgtgaccagccggcccctgcgctccccggcctgcgttggagggcccgggacagagccgcgctgctccccggcccgcgggctcttccctgccggttcccggccctctcgacagctgcggcccgtccgcccttccccaccccctctgcgcacgggacgggatctggtctcgagagcctggacctcaccggcaccctccccggggcccccagcaccagccagaaaacgacttgatctgcttagaagaggcaacttcggggagaaaattcgcgttcgcccagttcccctcccccgcctccctgtgaataaataaaatcctaagtgtctaggtgtgcggtcccctctcgcg

SEQ ID NO: 118377 - DNA, 33 bp, Homo sapiens; identical to SEQ ID NO: 85371
  chr2:165477563-165477596
  Hyper

SEQ ID NO: 118378 - DNA, 185 bp, Homo sapiens; identical to SEQ ID NO: 85372
  chr2:165478170-165478355
  Hyper

SEQ ID NO: 118379 - DNA, 38 bp, Homo sapiens; identical to SEQ ID NO: 85373
  chr2:166650068-166650106
  Hyper

SEQ ID NO: 118380 - DNA, 54 bp, Homo sapiens
  chr2:166650427-166650481
  Hyper
gccctgtccccaacacgtgaacccctgcggccgtcctcccgcctgctctaacgc

SEQ ID NO: 118381 - DNA, 30 bp, Homo sapiens; identical to SEQ ID NO: 85377
  chr2:167232024-167232054
  Hyper

SEQ ID NO: 118382 - DNA, 80 bp, Homo sapiens; identical to SEQ ID NO: 85378
  chr2:167232373-167232453
  Hyper

SEQ ID NO: 118383 - DNA, 30 bp, Homo sapiens; identical to SEQ ID NO: 85379
  chr2:167232714-167232744
  Hyper

SEQ ID NO: 118384 - DNA, 57 bp, Homo sapiens
  chr2:167233037-167233094
  Hyper
ggctttgctcacaaccgcgagtggggcggtgacgctcaagaccggtatctaggctat

SEQ ID NO: 118385 - DNA, 293 bp, Homo sapiens; identical to SEQ ID NO: 85381
  chr2:168148971-168149264
  Hyper

SEQ ID NO: 118386 - DNA, 53 bp, Homo sapiens; identical to SEQ ID NO: 27606
  chr2:168149503-168149556
  Hyper

SEQ ID NO: 118387 - DNA, 1186 bp, Homo sapiens
  chr2:168149776-168150962
  Hyper
ggaccctggctgcagcgtccctgtggcccgcgcgccagcccagcggccggagaccacgcgccccgcgggtaaggttctgtccggcagcgcccgcgacgcccccgggacggctggcgtggtctttgggggttacgaggcgcgtggtggccggggcatcccgacgaaggtgttgggacccggactgcgtgtcccgacgctgggctgtgctactgcccgcgcccgtgcggctccagctggtgcgttctcccttccgcgctcacagactttgacagcgcggggatggcattgtgtgagtgtggatgtggatgcgtgtgtgcgcgcgcgcggcttggggcactttgcagcgagaacagtgggtcccctctgcgtggcccgacgtccttcaaggacccaagctgggctggagtgagtaggatgctgttggctcggcgggaggtagaacgcacggagcgcacgggaaagtccaccgtggctcgtaaagagccgagcaaattgaactttattgcggtgattaaaaggagctgtggacctggcgcgccaggggagaggcgcgttccacgaggctccccaaagtcccactttgccccggggacttcggaggggaagggaagagagggaaaagtaactgttggtccacattgctgaagaaaaggaggaaagagaagttgggggtgggggtgggggtggaggttactcttgggggagtggcgacttttaggtgtctgaagccccgcgtgggaggcttgctacacttttctggagcgcagacttgaggatggagagtcccactctgaggtactggtagcggctcctcctgcctggtggcggcgtagggcgcagcgggacagcttggtggaggcagagcggggctccgacgcccgacggcccggcgtccaggtggggccactgcctccccaggccgctttggcccgctgacctcccaggttgagacccggcctggtgcgcctctggcagctgccaaatgcctggcggctccgctttccgacaaagttcaggcccgctggggtctggtccatcagacctaggacacgttaaccacgcagagtaaccaggttagggtacccagctgcctccagagcgtttttgtttcatattagattatcttatttgataaagctgttgagagttccacccgtgctgcaaagccttccgcagaaggcgaatt

SEQ ID NO: 118388 - DNA, 35 bp, Homo sapiens; identical to SEQ ID NO: 85385
  chr2:168310888-168310923
  Hypo

SEQ ID NO: 118389 - DNA, 33 bp, Homo sapiens; identical to SEQ ID NO: 85387
  chr2:169103498-169103531
  Hypo

SEQ ID NO: 118390 - DNA, 63 bp, Homo sapiens; identical to SEQ ID NO: 85388
  chr2:169312818-169312881
  Hyper

SEQ ID NO: 118391 - DNA, 30 bp, Homo sapiens; identical to SEQ ID NO: 85389
  chr2:169948461-169948491
  Hypo

SEQ ID NO: 118392 - DNA, 502 bp, Homo sapiens; identical to SEQ ID NO: 85390
  chr2:170218359-170218861
  Hyper

SEQ ID NO: 118393 - DNA, 429 bp, Homo sapiens; identical to SEQ ID NO: 85391
  chr2:170219129-170219558
  Hyper

SEQ ID NO: 118394 - DNA, 648 bp, Homo sapiens; identical to SEQ ID NO: 85392
  chr2:170219911-170220559
  Hyper

SEQ ID NO: 118395 - DNA, 105 bp, Homo sapiens; identical to SEQ ID NO: 39700
  chr2:170282975-170283080
  Hypo

SEQ ID NO: 118396 - DNA, 34 bp, Homo sapiens; identical to SEQ ID NO: 27613
  chr2:170335909-170335943
  Hyper

SEQ ID NO: 118397 - DNA, 300 bp, Homo sapiens; identical to SEQ ID NO: 85395
  chr2:170336157-170336457
  Hyper

SEQ ID NO: 118398 - DNA, 134 bp, Homo sapiens; identical to SEQ ID NO: 85396
  chr2:170419323-170419457
  Hypo

SEQ ID NO: 118399 - DNA, 164 bp, Homo sapiens; identical to SEQ ID NO: 39701
  chr2:170551729-170551893
  Hypo

SEQ ID NO: 118400 - DNA, 30 bp, Homo sapiens; identical to SEQ ID NO: 85398
  chr2:170571327-170571357
  Hypo

SEQ ID NO: 118401 - DNA, 30 bp, Homo sapiens; identical to SEQ ID NO: 39702
  chr2:170584782-170584812
  Hypo

SEQ ID NO: 118402 - DNA, 197 bp, Homo sapiens; identical to SEQ ID NO: 85400
  chr2:170681712-170681909
  Hypo

SEQ ID NO: 118403 - DNA, 180 bp, Homo sapiens; identical to SEQ ID NO: 85401
  chr2:170682149-170682329
  Hypo

SEQ ID NO: 118404 - DNA, 30 bp, Homo sapiens; identical to SEQ ID NO: 85402
  chr2:170807951-170807981
  Hypo

SEQ ID NO: 118405 - DNA, 84 bp, Homo sapiens; identical to SEQ ID NO: 85403
  chr2:170860076-170860160
  Hypo

SEQ ID NO: 118406 - DNA, 380 bp, Homo sapiens; identical to SEQ ID NO: 85407
  chr2:171568331-171568711
  Hyper

SEQ ID NO: 118407 - DNA, 30 bp, Homo sapiens; identical to SEQ ID NO: 85408
  chr2:171569116-171569146
  Hyper

SEQ ID NO: 118408 - DNA, 30 bp, Homo sapiens; identical to SEQ ID NO: 85409
  chr2:171569757-171569787
  Hyper

SEQ ID NO: 118409 - DNA, 910 bp, Homo sapiens
  chr2:171570047-171570957
  Hyper
gggagaaggtgggcccggaggcatcgcatccccgacccctgatggaagtgcggagggcatccttatacagtccagattccgagtccgttgtagttaggctaacctctgacgctgcatcgggagataggtcaccccgtccgtcccggtcgcagtgcggttcccgtgaggaagacgggcagagaggccgggcgcgaactgattaggggctcccccacggccggcggcctggagagtggagactgtgtccgacgggaggtgggtgggggagaggagtaggccgagctccggcggccactccgcagtgcgctctcgcgagccggggccgcgaggcctccaacgcggttccgcacccctaatgccccagggcggtgagcaccccgcggttccccgcccgcctcttcctccttccccgcccgcgcgcccgggagaggcgatccccgcgtccgcagtgccggggcaggacgcgccctgcgccctgggccaggaggaggcaggtggccctcctcggcaggaggtgagccgccagggagggatgggggtcacccaagcccctgcaagcgcgaccctgcccagagcaaagcacgccccgcgcctggtgaggaactttttctttccaaaggtggcaggaacaagtctgtactgacttttctcccgccttcgggatcctctctcgtatgatttgtggtttgtgggaccacaacaaccaggcttcctcgaccgcgccttttttccagtagctcctggtctgccaggcttgcgagagggcgcgctggcttggcggggctccgggcgagaaatcaccagcagcgctggggctttcggccccccacagcccagcccgggcctcctgggtggcctggggagaagggggcgggacagcacagcttcttcccctcgggtgggcatgacg

SEQ ID NO: 118410 - DNA, 44 bp, Homo sapiens; identical to SEQ ID NO: 27618
  chr2:171571200-171571244
  Hyper

SEQ ID NO: 118411 - DNA, 44 bp, Homo sapiens; identical to SEQ ID NO: 85414
  chr2:171571476-171571520
  Hyper

SEQ ID NO: 118412 - DNA, 61 bp, Homo sapiens; identical to SEQ ID NO: 27619
  chr2:171571846-171571907
  Hyper

SEQ ID NO: 118413 - DNA, 374 bp, Homo sapiens; identical to SEQ ID NO: 85416
  chr2:171572347-171572721
  Hyper

SEQ ID NO: 118414 - DNA, 31 bp, Homo sapiens; identical to SEQ ID NO: 85417
  chr2:171624030-171624061
  Hypo

SEQ ID NO: 118415 - DNA, 895 bp, Homo sapiens
  chr2:171669846-171670741
  Hyper
aatggaccttagctccgacttaagcagaatgaaaggttaagtaacgcttcccccagttctcgtctcgggagacagacgtttaaccggtgagcactgccattttttttttcctttctggtcataaattagacacttaaaatagattttaaggagccagctgaaacgaaccaataccatggctctaaattacgtttcctggaggctaaaaattctaattgcgtcaaaaaaaattgacgtgtcctgtctactcaccttgactgaccacgttttaggcgtgaagatctccccgcagcccgtttgggcgctccttcaacgcctcacgctcctcctactcacccgtttttccctttgcagaaaaggcttggccccaaatccggttggaatatctttaaacaatcccccacccacccacgacggggaaaggaataaagggcattgtgggcggagggtcgtgttcccaagtcccagcggtggttgacctaaggaaacgttatcctcggcagacagggtggagtagccggggctgcaagctcgcaaatccctaatgccggagagagactggaggggtcgcatatcgccccctccttcttctgcctttgagcgccgcgttcccatttcttcaaagcgcttcaaatacaatcgaaacagctgggcggacaccactcccttccgggccacccctcatcaccggttcgagtccccggagaggatatcttttttccacccccattatcccaagaatcctcccccaggaatgataaaagattaaaggaagagtgaaagacataaacaaaaatataggtttcaaatgttgtttagagccgaatgacaaccacggccactcttagttcaaattcctaccggagagaagagcagtgggcgaaatacctcaccc

SEQ ID NO: 118416 - DNA, 672 bp, Homo sapiens
  chr2:171671306-171671978
  Hyper
agattccttctccaacgagattatttcattggctaaaacgttaggggtgttttgaactctggggtcaaaggaggaagtggttggaaatgtctcaatctcgtgccacaggtgaagtaaacgaatcttcctttccagggaatcacgggttttgggaaaaggttgaggcgagcgggcgtctatgctggacaatgaagaacgaggggcaccgggagatgtgttgcctcctccttcctgtctcctgccccgtgcgtcttgaatgatttagcactggcacctggctccctgattggtgcgagcgtctcgtttagggaaggctctaggagggccggtggatggaattccgagcttcacctggttgtatgccgcccacttcaagcagcgcagagcagctgccggttgagtggtttggggggacgtttcctacgtggagcagacacccccagcctgtccagccccaagcctcagtgcccggggctgcagtcaccgcgcgccccgccgtttaggatgttttttgtgtccttaaaaagtgccggggatttcatcgtcaggtggagacaaggcgacaaaacagtagtttctttagtaccaaaggcaacgcgattatttcaaaccccacagcgagatccctcttgctgatcaggccatgtctgcccagggcggacccttcgatct

SEQ ID NO: 118417 - DNA, 238 bp, Homo sapiens; identical to SEQ ID NO: 85422
  chr2:171674091-171674329
  Hyper

SEQ ID NO: 118418 - DNA, 967 bp, Homo sapiens
  chr2:171674698-171675665
  Hyper
tcccccacacccttgcgtcttgtactggccttggacccccaccccgaccccgaccccgcctcgtctcggcgcttcactccaggtcgcgccgatgcaccgccagactcgagagcggcccagggctacgctccctgcgccccagtaccggagctagcgcgcacgtctcctccgctgcccccacccctgcgcacccctaccaggcaggctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaagtaggtcccgccccaattttctatcaaatgaactgcagggaagatgggggcgctgggacgtcgggaggctgagctggcggaaagggaagggggagcgcggagataatggaggctgggaaataaatggggctctgaccccgtccctgccagaggtcattcggctgtcagggacgctaggtgactcccagggcaccggaaagcgaggaccacgcaaggtccgagcagcggcgatcgttgagggcttcgcggaggaggaggggcgcgcagccagggtgttgtttttattctgttgtgtgtggtttctttgctccgtgggacgacaggggtcagcgcagggggcggaatgaagagctaggagccccagcaggaataagagttttcagtccccggctttcgttgagccaagatctgacctcctcctttccccctgggctgtgttcaaagtctataatcagcggaaatttcgacgttaattgcagctt

SEQ ID NO: 118419 - DNA, 169 bp, Homo sapiens
  chr2:171676684-171676853
  Hyper
ggggtggggggttagcgggcagttgtgttaatttgccctccactcccggcgcccttacggaattcccggtggccgccagtcgccggcgcaaatgccaagtcaccggtaggagacacaacagaggcgatgacctgaatccgcacgtggcctggttcgcctggaagctgcc

SEQ ID NO: 118420 - DNA, 30 bp, Homo sapiens; identical to SEQ ID NO: 85426
  chr2:171677372-171677402
  Hyper

SEQ ID NO: 118421 - DNA, 399 bp, Homo sapiens
  chr2:171677989-171678388
  Hyper
gtcttccccactccccggtctgactgaagagcagccatgcgagcccgatcatctagtcaaatactatttttcacccaattaattcttgaactcttccacgaccccatttcatgccagtttattttaagctgccactaggctggagacccgccaagaaattatgagacgtttcggtcccagatgcctgtgttccctttctgggctgctgtggtcgccctttgagtctgcggggcccggccagtgggtgttgggcagctcgatcggagcctggccctttgcgtgtgggtcagccttcacccaactccgaccccacctccggagctgccgggcgggggtcgcttacgggcccggaggggcgccgggtgccccgcctctcagagacaccgttccatatttgaa

SEQ ID NO: 118422 - DNA, 247 bp, Homo sapiens
  chr2:171678790-171679037
  Hyper
gacagccagcgaccacgctcccctacaggccctgaccctcctctgcccgccccagacctggtccccaggggtcttttcctctggagtccccaatccccaacacccagtggagcgaacgccgggtgccctgcctgggcgcagaagcgggaggaaagcgcccccgcgcggcaaccccgccttcctagccctgcgcgcaagcagctcccacccggtgccgtgcactctgcctgcgcgtcccaaaggtcgc

SEQ ID NO: 118423 - DNA, 30 bp, Homo sapiens
  chr2:171680056-171680086
  Hyper
ccagcgcaggacgcccgtggggcaaggcca

SEQ ID NO: 118424 - DNA, 21 bp, Homo sapiens
  chr2:171718764-171718785
  Hypo
ccactgcgcccagcccatttt

SEQ ID NO: 118425 - DNA, 23 bp, Homo sapiens
  chr2:171769313-171769336
  Hypo
catctaatcgctttggtaacttc

SEQ ID NO: 118426 - DNA, 58 bp, Homo sapiens; identical to SEQ ID NO: 85433
  chr2:171822509-171822567
  Hypo

SEQ ID NO: 118427 - DNA, 120 bp, Homo sapiens; identical to SEQ ID NO: 85434
  chr2:171906270-171906390
  Hypo

SEQ ID NO: 118428 - DNA, 35 bp, Homo sapiens; identical to SEQ ID NO: 85435
  chr2:172129409-172129444
  Hypo

SEQ ID NO: 118429 - DNA, 74 bp, Homo sapiens; identical to SEQ ID NO: 14471
  chr2:172367021-172367095
  Hypo

SEQ ID NO: 118430 - DNA, 28 bp, Homo sapiens
  chr2:172372678-172372706
  Hypo
ttttttttttttaggcggagtttcactc

SEQ ID NO: 118431 - DNA, 146 bp, Homo sapiens; identical to SEQ ID NO: 85438
  chr2:172378945-172379091
  Hyper

SEQ ID NO: 118432 - DNA, 191 bp, Homo sapiens; identical to SEQ ID NO: 85439
  chr2:172379532-172379723
  Hyper

SEQ ID NO: 118433 - DNA, 44 bp, Homo sapiens; identical to SEQ ID NO: 85440
  chr2:172382315-172382359
  Hypo

SEQ ID NO: 118434 - DNA, 30 bp, Homo sapiens; identical to SEQ ID NO: 85441
  chr2:172396680-172396710
  Hypo

SEQ ID NO: 118435 - DNA, 41 bp, Homo sapiens; identical to SEQ ID NO: 39709
  chr2:172411125-172411166
  Hypo

SEQ ID NO: 118436 - DNA, 30 bp, Homo sapiens; identical to SEQ ID NO: 85443
  chr2:172428262-172428292
  Hypo

SEQ ID NO: 118437 - DNA, 43 bp, Homo sapiens; identical to SEQ ID NO: 27633
  chr2:172945124-172945167
  Hyper

SEQ ID NO: 118438 - DNA, 387 bp, Homo sapiens; identical to SEQ ID NO: 85445
  chr2:172945896-172946283
  Hyper

SEQ ID NO: 118439 - DNA, 30 bp, Homo sapiens; identical to SEQ ID NO: 27635
  chr2:172946606-172946636
  Hyper

SEQ ID NO: 118440 - DNA, 30 bp, Homo sapiens; identical to SEQ ID NO: 85447
  chr2:172947265-172947295
  Hyper

SEQ ID NO: 118441 - DNA, 720 bp, Homo sapiens
  chr2:172947773-172948493
  Hyper
ggtcccctgtgctaccgcaaaagtctttgatccttttccagctgtggacacagagcacccaagagactgtcgcgatgtgcggccgtctctccccttcccccaccttgcaagtctctggaatacactgtccctaggcggcccggccgtcgggtttcctcacgccttgccctgagctccgggaattaccaattccgctttccccggtcccaaccccgaccccgcgcccgccgcggcgatcacttacttgggcaaggccctcagggcacgcgcgagagacctggggcccggcagtatccgagcgactgtgctgggcacacggcgtggcactccataccctaaaacaggcactaggaaggagcaattaaaaccacaagtgcgacacagaaatcaggacgagccgagcggctcccggagttgcctggtggcggaatcattagctggctgttgctacaaagcctcaccgtgtggttcggtgattaagaaaaaaaaaatcttttaaacgttggcaaacccgttattggtttggcgtattgggttttttttgcttttgcttttctttttgctccaaccactctgcctgaaatatttctgcccccagcattgtgcccttaaaccaaaggagaggaattctgcgggcagcagcagctggtacagaagttaaaaaaaaagagaaaccccctctactaatatctgtaacgacagcaccgatgtaatttgttt

SEQ ID NO: 118442 - DNA, 1343 bp, Homo sapiens
  chr2:172948890-172950233
  Hyper
taatttgggattcaccgtggggctggcgggatggggaaccaacatccacttacagccagggtggtgtacgccacaccgcgagggactggctgtattggtagtagtggcgatggggtgggggctcttgtgcacttttttgtacctagcaccccagaagacagaaggagcagcggcagatcttgcctccactagccctgccccctaggcctggtggcgcgcgctttggccactggaggtgaggaagatcctgggtggcaacgagagacgtctacacatagataagggagcctaccacaggcctgggtttgctgcgggtttcggtgtcccccagggactcctaaactctggaagtcgcgctagacctcaggaggccggaaaatgaccacctggcgtcggtggctccagcagatctgagcccctaggccccctgggctccacgctgagccgcgctctcggggcgagtgagcccggggctctccgcgcatggggagtggagaagggagggggaggaggaggaaggctgggagggaaagaggatgtgtgtgttgggggagggggcggtgcagccgcctttcctgggaggagaagcgcgggttcctggctctccacgcgcactgctttaatcagacccgtgcagcctcgagctggagtggccagctgggcctggagcaatgcgagcgggccccagggagcgacagcggcgttggcgcagcggccgagtgagtgagttcgcagggagggcccctaagccccgactccagggatgcggcagagcgtaccggggaggcgcggccggataggcgctgcgctaggcacaaggctcttaggagaacctctgtctgttggccgcctcgggcgcccccagtgcgcgactccgcgctccagaggcagaggtcagtctcctcctgagccgccctagctctgcgccgaactgagtggcagcgacgagaagcggtcccgggtgtccggtgttagggaccgctgaagggtggggacagtggtaggggggcggcggcgcggagccgctggttggttcctggggaggaaagcgcgcgagggaggcgggaggccgatgagccgcgggccgcaggggccccggcgcagacgccgcagcccattgtgcttcctgcccggcgcgctctgttgcagaggagccccggccgggaagtgtggatgcgtcttacccgaggccgggccgcctcgcccgctctagtccagcggagcccgagcgcctcggaccaatccccagtgattatgcaagacagcggaccaatcagctccgccagctcatgaatatttatgaccttcgctgagtcaaagctttgaaccgagtttggggagct

SEQ ID NO: 118443 - DNA, 30 bp, Homo sapiens; identical to SEQ ID NO: 85452
  chr2:172950463-172950493
  Hyper

SEQ ID NO: 118444 - DNA, 558 bp, Homo sapiens
  chr2:172951115-172951673
  Hyper
ttaaacctcaactaccgcctgcaaaaatagcaaactttccctgcaaaggcaggagctgagctcctgggaacggctctatccctcctgcagcgtcccgggacaggccctcggattttgggggacccttccctggctttcagagtttcttgaacgttctctccctggtgctgcctccgccacccttcggtagccactcgctctcggctgttcgcactaaaggcggcccctcgtattaacaacgggccctacttctgctgtccctccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagagggcggagctcgcggcctctttgggactcacacagactcaggtacctcgccgctgccgctccgttctgccacgcaggctttccgcggccggcctgcgcccgggtcttcatttgttgctcgctgggactcaggg

SEQ ID NO: 118445 - DNA, 603 bp, Homo sapiens
  chr2:172951948-172952551
  Hyper
ctcggggcctgggtccgcgcctcagcctccctcctcctcctccttcttaccggttgggggtggggggagatcctttcctccgccctctcacctctcaagtcccagaccttagagaagaaacgggaccttccttcccggctttctgtaagactccggggagcccgtgagcgttcctgacggcggcgggcgcgggtttccgacgtccggtccgggatttggagcagagctggagaaagcaaacagacactagtgcaagaatggttttgaatccaaagagaagttcagcaaaaccttgaggcctccttagtccgtcccaactcaagggcagaaaagatggcgcatagaaaagttgggtcgcgttgcaaataaatttcctccactccttcctaggttttcgattctttttattgatgttgatattggaattgctggctcggtgttatgcaggcgctgtatcttccgcaggcggtagccacggtcggactgagcccctggcaggctaaggcctggatcccggttctcccctcatcacaactcctccctggctctctgagagctgcccccgtgggctgacggcggcgggaggttcggccttcgagcctt

SEQ ID NO: 118446 - DNA, 295 bp, Homo sapiens
  chr2:172952776-172953071
  Hyper
tgaagcagggtggggcggctctggagggtagtgcgttggccaacggtcgggccctgtctgctggctccccacccgtgccgcccggctggaaccctaactcttcatccgggaagggctcaggaggaaacgcgggctcctatatccccagctacacatcgtggtacccttcagcgcaccaagaagctatgcagcaaccccaacttatgtgaggttgcccgcccgtctccttcttgtctccccggcccaggtccctcccgcctccaggtccatccatcccgtccggaaaagaaggacc

SEQ ID NO: 118447 - DNA, 151 bp, Homo sapiens
  chr2:172954811-172954962
  Hyper
cagctcttgagaggccgggaggttgggaggctgagaggcctgaaagcagagacactgctttgcctctagccttcctccggatcaggcctccctgcttttgcatgcccggaggcgctggattccgtcgcggaaaagacgcagccagacgcca

SEQ ID NO: 118448 - DNA, 520 bp, Homo sapiens
  chr2:172955367-172955887
  Hyper
atctcgcagccgagccgaggcagtcccggagagctgcgggcccagacaggctgccaagcgctgttcctacttctcccgcactcgccttccagcgctgctgcccgcgggagctggccctccacctttggggggtcttttcaggcgcgcggtggggagcagagcccggaaggcagtgatctgtgttgtgacaagcacccatttttcaattggtgctggtgaaagatcagatgcgccaggctcttccgacgccctttgggaaggggaggaggaagtggtggggctgctgggggtggggggaggcggtgtgatggaagcagggaaagtagtcgggggtgggggaatgatgccggggacctccaagccccttccaggcctgagattgggacttctccgcagcacctagaagaaccagcgctgatgggagagatcagacctcagaaaccaggatgtgggcagtcagatgggcctcaaagctgaggaaagaatgaatttcccagctcccgcgcggggtagggggtct

SEQ ID NO: 118449 - DNA, 359 bp, Homo sapiens; identical to SEQ ID NO: 85460
  chr2:172957707-172958066
  Hyper

SEQ ID NO: 118450 - DNA, 43 bp, Homo sapiens; identical to SEQ ID NO: 85461
  chr2:172958308-172958351
  Hyper

SEQ ID NO: 118451 - DNA, 30 bp, Homo sapiens; identical to SEQ ID NO: 85462
  chr2:172958565-172958595
  Hyper

SEQ ID NO: 118452 - DNA, 99 bp, Homo sapiens; identical to SEQ ID NO: 85463
  chr2:172959209-172959308
  Hyper

SEQ ID NO: 118453 - DNA, 148 bp, Homo sapiens; identical to SEQ ID NO: 85464
  chr2:172959765-172959913
  Hyper

SEQ ID NO: 118454 - DNA, 1258 bp, Homo sapiens
  chr2:172960759-172962017
  Hyper
cttttgacttttgagcgagttcgggggacgccaggagtgggggagttgcactcgagttttactgcccgtaagaacgactttttgagaggggacggggcttcttgctcccggacattgttctcttgggcggaggggaccacttcagagcttctctttgcacccgcctcttctgcccctcgtcttctaccactgaactgtttgtaaacaaagttccagtcttcccccgctctctccgcctccaccaaaccggtatttctcccaaattcgctccatcagtctgggatcgttacacagggcggatattcacaattttcacaagtgatcctgaaagaaggcctaggggaagcctcctaaacggtcccacattgcagcagggctggtgaggcctgggatccattctctctcttttctgcccttcccatcccggagtctcggggccggcggcgggaattccgcgcagccggaggggggtctgcgcccagcggagcgccgtgctggggcgaggtggctgtgggcagagcgtgcaccggggttggggggagaaggggattgaaggggcggggggcgcgggagtacctgggcggcaggcagttggccctggagctcagtgcccgcgttctgcctgagttgggagagccctgccagagggtggagcggagagggccgtgcacccctcactcttcagcttccctccccctgcttcccagcgcttgtcatatcctgtctctggcctgatatttcacgcgagcaattggaaggagattacaatggagatttatgtgtgttctgagcactgctagtttcccagcgtagagagccgagatcgctgcttcccatttccatttttcattcgcgctttggggagctcagtagagcacggggggagcgtgtctgcgcggcggcgggctgatcacaggactccgcgtctccgggcgggccgggagactgtgagaaaggcttgccagcgcgtcgcccccggcggggctggagccggcccccgcctccaggagccaggctttgtttcctcccttgcctacccctccccctttccgccccctcatttctgggacctgggcgcgtccttgcaaccccttctctttgcccttctcgtggtctgcggaaacacccccttcctctggccccttcaccctcctgctctcggcttcgcaggctccctggggaaaggcacaccgtggcccggcccgaccctgtcgtcactgggtgccgggtaaggtgactccggcgagtctgtggggcc

SEQ ID NO: 118455 - DNA, 484 bp, Homo sapiens; identical to SEQ ID NO: 85467
  chr2:172963608-172964092
  Hyper

SEQ ID NO: 118456 - DNA, 2315 bp, Homo sapiens
  chr2:172964747-172967062
  Hyper
caggaaggaaagaagcggcggggccgcccgggtcaaggggccacgtgggggagggcgggcaggcgggaccgggaggtcaataactgcagcgtccgagctgagcccaggggagcgggcgaggagaaagaagcctcagagcgcccgggaagcctcgcgcgcctgggaggcttccatctcccgggacccagctctcagcccggggcgaggaaggcgccagacaggctcacccggaggggagggaaggcaagtccgaggcggggctcgaaacagccgagacccggggctcaggtcagaaatgcggccttttagggaggcctttgccaagctgctgtccggttcccccgagagaggggcccgtttggtggccccgggagtgagcagggcctgagacgggccactgcaggtcgcagcctgcaggagaggtgggtggcggcagcgggccgggaggagggaaccccggctcggggtaagcaatgaggataagtggtctctgctctcagtctctggcgagttctccctggggttagaaaatcgtccccgcgctcaccggggcgcccccgccgccgtgatggtggtggtggtgatgcggctgcggggtctgagtggggtgcagcagcggcgccgtggcctgcaggtgtgaggcggatcccgaggtctggtggtaccaggggtagttgcccagaaaagccgaggccgcgctgctcgggctggagcccgagctgccggcgccgctgccgccactgcccggaccaccgccgcccgccatccgctgcggcacaccaaagtcccaggaggccggcgctgagactggcggcgaagcacaaggtggagaagcgctggccccagggtgctgctccgaggggatctcaccacttttccacatcttcttgaacttggaccggcggttctggaaccagattttgacctttgaggaaaaagacctgagcattagtggaggaacctagtcttggggcagtaggggttcgaagaggagaaaaaagaaggcagagaaaaaccgctggctagcggtgggcagcgagcgccctggggagataagaggatcacgggcggcggccttcgaggctctgccggttcctgctccctggggaggtaattgccaaaaggccaggactgctggtgtacgtgcactgtgatgatggtgacagcgggagggtgaggagggccagttatttcacccgcttaatcagtagcgagaggtacgggatttctgtccacccggtccctttccttccctcccacggcggccccttgggggtttccagctttgggcctagaagcttacttagggccgctcgaggcgcaggcctggaaatccttaaaagtacttaaaatgaactttaaaaagcattgtcctaaacccgcctgcttcccagccatctcaggcccgcgctctcctcgcccctgcagggcgcgagccccacctgagtctgggtgaggcccagagaggccgccagctcggctcgctccggcaaggccaagtattgagtcttttggaaacgccgctgaagagccgccagctggaaactggagtagatggtgcggggtttccggactttctttggcttcccgttcactatccgaatttcaggctcaaggtcctccttctctgcaacgataaagaatcgtaagaacagcgcaacccaggggtcctggagttcccgccctcctagagggcccggcgggggggacttggcttgagcaaagaggtgggtgcactgaactgtggcgccacgggcaggcgcaacttcgcagcgtgcgatcggagccgccaccgaccccgggagctgtaccctccagggaagggggagacaagtgcacacccaagagaaagaagctggtggcaaggagatgcccttatgaggcaggcagagcacgcccacttggctcttgaggccaccaggtcctaccaaaggagagagggacgtaaccggcgacctgcggcagattggaggctggggagggtaaagggcacaagcgggcggtgagcaggcagcgtgaaaatccagagctttcgaaggccccccgccccaaacacgtttacccatccatcccattaactagaccgactcggcactcttgacttcagcgttatgcataccaggctcgttgttggctggggacgaactggttccatagggagcgtaggaggtgtaggcggcggtgtagcccaggtcatagctgctcttggcggagtaagggacgttgttgaggccgctggcttggtactggtaggaacccatgtgcgcgtagggcgagcccccgccgccgccgccgcccgccgggtgctgctggtt

SEQ ID NO: 118457 - DNA, 1136 bp, Homo sapiens; identical to SEQ ID NO: 85472
  chr2:172970558-172971694
  Hyper

SEQ ID NO: 118458 - DNA, 520 bp, Homo sapiens
  chr2:172972735-172973255
  Hyper
caatcacatggttaccgacgcgcagcagagtccgacctcgaactcagatctgggccatggaggcaaggccgctgtcgctctgggctgtttccggccaggggacgcgagagaaggcggcaccacacttacttctcccgggcctggtgctgccagctccgcggaacagattggaaggggcattggccgtcctgagggcgaccgcgcccctctctccccaaagagagtcctggaaggggggttcccctgggagaggaggaggcccgcccggctgcgcagagggtagccccgggaagattcctgaacagactcgagcctctgcggagagggcgggatgcgggtgccccctggcttggcacgtgaagccaagcttgaggacctgatgttttgttcccgctgggattccgccccaagttatctttgctccctgctggggtgtaagtaaaccccaggggcttgaaccgaaatcatcggttactcgacgcttccagccgtggcctttccgcggcgctgggcttctggt

SEQ ID NO: 118459 - DNA, 260 bp, Homo sapiens; identical to SEQ ID NO: 85475
  chr2:172973998-172974258
  Hyper

SEQ ID NO: 118460 - DNA, 30 bp, Homo sapiens; identical to SEQ ID NO: 85476
  chr2:172984274-172984304
  Hypo

SEQ ID NO: 118461 - DNA, 28 bp, Homo sapiens
  chr2:173036676-173036704
  Hypo
atgtgagtcaccgcgcccagcccaataa

SEQ ID NO: 118462 - DNA, 121 bp, Homo sapiens; identical to SEQ ID NO: 85478
  chr2:173037688-173037809
  Hyper

SEQ ID NO: 118463 - DNA, 749 bp, Homo sapiens
  chr2:173099681-173100430
  Hyper
gttgtcggcggtgggcggcgccgggggagccgcgctcggggacagctggcggctcaacggcagcatcggcagcatcgagaaaggtgacgagttctgcaaataacagctgcggagcaatcgttatgtttggacaacgtgggaagggccattgttcacaaattgttctcttcaacaacacctgcatgcacagataataatccattgtcggtctccggcttcaaagacaaaaggcagccgcggagggaggagtcagcagagcctggagataacaggaccactttgcaaccggggagagtgcaaacgaggactccaagtcgcgtcccgggtctgccgcgacggtcgctcaccgcaggggtctccttcctcttctggcagcgagtgcgacctcttttatcctagcaggccaccaccttcgcggcaacaaacatcatttcctatgcagttgcaaagcatgctcccttgcaatcagcgatcaatactggcaaagtggctccaggataggaaaggtcgcacgtgtgttggtaaatggaaaggtttatgaggcgcaggtggtcgtgctccgcggagattgtggtattagcatgtcaaagacaaaacggaaccaaggtatacaggcacagagtctcttcctggggctccgggaaagcttggcacgaccctcttgagccttcagtttaaaatgaaacgctggcgccagatgtggccaccacattgctgataagtccagtaccttccgtttgtgcaaagct

SEQ ID NO: 118464 - DNA, 30 bp, Homo sapiens; identical to SEQ ID NO: 39711
  chr2:173291566-173291596
  Hypo

SEQ ID NO: 118465 - DNA, 49 bp, Homo sapiens; identical to SEQ ID NO: 39712
  chr2:173422685-173422734
  Hypo

SEQ ID NO: 118466 - DNA, 855 bp, Homo sapiens; identical to SEQ ID NO: 85483
  chr2:173600535-173601390
  Hyper

SEQ ID NO: 118467 - DNA, 20 bp, Homo sapiens
  chr2:173927306-173927326
  Hypo
tccaataggccggtgcgttg

SEQ ID NO: 118468 - DNA, 85 bp, Homo sapiens; identical to SEQ ID NO: 85485
  chr2:174219158-174219243
  Hyper

SEQ ID NO: 118469 - DNA, 80 bp, Homo sapiens; identical to SEQ ID NO: 85491
  chr2:174932189-174932269
  Hypo

SEQ ID NO: 118470 - DNA, 21 bp, Homo sapiens
  chr2:174932048-174932069
  Hypo
tgtagtcccagctaccgggga

SEQ ID NO: 118471 - DNA, 1697 bp, Homo sapiens
  chr2:175190771-175192468
  Hyper
gaagaaagagaaactcgcgacaacagagttgccgaaagagaagtgttggcgcctcaaacttgaggatcagcttcttgggccccactccagggtgtcgcgggggtcgggttctttccgccgccccccgaaagattctcagctaaccctttccccgccgagaccaagaggccctcactctgacaccactccgggagccaagctactgtaaggagctgataccacccctcgccggcgcgaaccgcccatctccccagacccgcccaccccctgctgcgaatccctgacgttctagcccggcgaaggtcctcttaaattaggaaacaatagctatttaagaagaagcgcaaataacccgcgctctgcgcgcccaatcgtgggattcttgggagttccccgcgggcaaggaagtctgctgctccccgcagctgcggaggagaggagggagcctgcgtgctggggcagggtgtcgcgaacttggggcaacccacctccagagccccgcccccgctttcccgcctgccggggacctgccgaacgcggaaccaccctccttcctgaggcaaatttgggaggggagaggtccagaagctgtagagtcggggcgccaagcgccagattctgccgctcggaagttgggggcagtccccagtcccgcctcaggcccccgcgctcacagggcgctccgccgagggcgcgggccaggcgcgcggtgtcacctccacgaagtcatttacttgccctgaaggagctggccctcgaccccttggaggatggagattcctcccattccctcctccgcctcccccaggtcggcgaagagacgtggaattgagctggaccgatgattccgcgagctctgtaattatgcacacactgaaatcttcaccgttgacttaagttacttggcgctgcgagggctggggccctgcatattgattaaatgcagcctctatttacctaaacaataaatgtagagattagcaacgttcacttgatcacaataatgggattgacaattaaggggcaatgcatcccagatgtagcggaacctatgggctgcgtgcagcaggcagagggcttctcagagaggggcgctgggcagttgcggcggcggaggtagtgcagagcaggaagcagcgcggaagcacagcgggaggcggagggggacgcccagcctcgtcaaggtcttcggccaccccgcccgggaggctcgaaactggctttggggtacctgaatgcctcgactcccagggagacatcgggagctcggagccactctccctgtggcgatggcacctgcctcaaggccgtctcgcttgctgatgcctggccgggaaggaggatggacgccgctggcatgtgccctggtaagtgtgtctgtttgtcatcagtgtacattctgcatgtggcagcagggcgagggggaggcgcacgtgtctaaagtgcacggagccttcctctacccctatgtatatacccttcagtcaatgttccaagaagcgggtcagggcggagggtatccatctggactctggaagggcgtgggtttgacatcggtaggtgtgacaggaaagtccagcctgtcagagttgggctctacagtggccgaaatcaagaaaggatggacgtgtcggcccagggctggcctgtttccggatatgtcacgggggtgcctcgttcctcgaggggagttttag

SEQ ID NO: 118472 - DNA, 873 bp, Homo sapiens
  chr2:175193089-175193962
  Hyper
ttcagagctgaaggccgactgtgggaggaggaggttaaacaaagggaatcctcctcctctgggacgggtgaagtgcgtttgtcttctccttgcaggctctggaaaaactggcaggaatttccttgtcgtgagaagatggacgagtgtgtctgcagccgaggagacaactacaaacagactttgggcagggaaggcgggcgggcgggggtgggggtgggggcgggggcctgctttgatcgctccagctctgttgtaattttgtcttcgccagatagattagctggaaccgccagccctagcttggagttccgttccacggagtaccctccctccccacccccagcgtcatctcgcgcctggagccgggtcgccgctccttccgaagtctcgctggaaacttcaagggctgatggttctgtgttcttgacgtaattaggaggccacgcagctctccaacactccgttaaacaaatatgtaagtcgtcctccccctctctggggacagactctagggaaggaggcagctgggcccgctccgggtggtgtccttggctagcggagtggcgtcgctgtgaccttccgccgcccctcggggccttggtctttctaagctctttcttaggaagcggagagaggggcagaaaacgtgcacctcgccacccaccggacaagccgagaggaccttgtctttgcttgaaaagttttctagataaatcgctcgggtggttctaagctatgacgaactagaggctgggcccggttcttctccagaacagcgtgtggatgtaaaggagatgaaatcgtcctcccccactgctttctttttcttccccatataaatcagtcatataattcattcgcattgtttaaggt

SEQ ID NO: 118473 - DNA, 41 bp, Homo sapiens
  chr2:175195883-175195924
  Hyper
ccagcctggccaaggcgagcaccttccgttcctcctcccct

SEQ ID NO: 118474 - DNA, 30 bp, Homo sapiens; identical to SEQ ID NO: 85497
  chr2:175196266-175196296
  Hyper

SEQ ID NO: 118475 - DNA, 61 bp, Homo sapiens; identical to SEQ ID NO: 85498
  chr2:175196514-175196575
  Hyper

SEQ ID NO: 118476 - DNA, 298 bp, Homo sapiens; identical to SEQ ID NO: 27669
  chr2:175196967-175197265
  Hyper

SEQ ID NO: 118477 - DNA, 149 bp, Homo sapiens; identical to SEQ ID NO: 85500
  chr2:175197915-175198064
  Hyper

SEQ ID NO: 118478 - DNA, 306 bp, Homo sapiens
  chr2:175198594-175198900
  Hyper
ggttaaacaaacagccgagcaagctgcagcttcagcggaggtggaggtgggggcggacgccgctcgcgccggtctctgtttccaaagttgttacagtgagaaaataagcggcttcgtgcagcgtgttgtatgggctgatgcctcccacccccatgccagcccacagcaaaacccggcagataatcagcacatcccactgtttagtcatatttgacaactgggttaacctggtatctaagcgctggcgaaaccgtacaaagggtgccctcaattaccaccagaagcctctagcgtgagtggcacttg

SEQ ID NO: 118479 - DNA, 567 bp, Homo sapiens
  chr2:175199368-175199935
  Hyper
ggggtgcttgtggctcggtttcattggtacttaaacctggcttggtgcgtgagtgtaaatttttaattgcactgtaatttcttcagtccccagcccgccctcgccccccccccgcaagtatcccccactactcccccccacccccgcggccctagctagctgacttgactggcacgcgccgggagcccgggctcgggcccctcggagcgtctgattggctgcggggcagctccggtctgctctgcctgcgccctcattgggcgagaggcgcagccagcggcacttcaaagcgggtgctcctcgcacttaggctgagtttagccggcgggagcctggagtccgctcggcacgagcgcggggacgcgggagccgcgcgggacccaagcagtttttccgagcagccgccaggctcagccccgctcccagcctcgctgcgcagccagagacctgctatggccacgtctatactcggggtaagtcgcaagcgcggcaacgcatttgcttgttttaaccggagtaatttttcgttatggcttctggggtctgcggctccggagaaactgttgc

SEQ ID NO: 118480 - DNA, 2539 bp, Homo sapiens
  chr2:175200172-175202711
  Hyper
gaaaacagtcttaatcgttttgcagtccatctagtcacgctaataaacatttacatttccgcggctccccaattcgcccatgactttgaaatctgtctctggccgcttatcctcggattattgttttcataatcgctgtttttgtgtgtatgtaaactttaaaaccaaacgttttctattaaaaaagaaaagtcaagtcgtagccaccctgggagagctgcaagtttcgcccgtccctggcagctgtttcggccgcctccgccctcacccggtgtttgttgtctctggtctctgtgtttaccttcgcgcttcaccccgaagggcgacttggggtcttctgggagatgagccggtttacggcgacaacccaagtccggttgtaggcagggttgcagcggggaacacggaggcatctttgatttatagcctcagcgaagtgcaactttccggcgcctggaccttcgcccgggtgatcgcccctgctccgcgcccggtgcggcgactcctccgcgggcgcgtggggaggaggcgcgaggcggggagccaggaccccccgggagcagccgcaggggacgaggctgctcacgggtgcactttgtttcttcccccacttcctcttgccctcctccttcttgctccctcccccatcccacccactctaggaagagccgcgcttcggaacgaccccgttggccatgctggcggcgacctgcaacaagatcggcaacacgagcccgctgacgacgctgccagagtcgagcgccttcgccaaaggcggctttcacccctggaagcgctcctcgtccagctgcaacctcggctccagcctctcgggcttcgcggtggccaccgggggccgtggctcgggcggcctggcgggcggctcgggcgccgccaacagcgccttctgcctggcctccacgtcgcccacgtcgtccgccttcagcagcgactacggcggcctcttctccaactcggcggctgccgcggcggcagcggccggggtgtccccgcaggaggcgggtggccagtcggccttcatttccaaggtgcacacgacggcagccgacgggctgtacccgcgcgtgggcatggcgcacccgtacgagtcctggtacaagtcgggcttccattcgacgctggcggccggcgaggtgaccaacggcgcggcgtcgtcgtggtgggacgtgcacagcagcccgggctcgtggctggaagtgcagaaccccgctggggggctccagagctcgctgcactcgggcgccccccaggcctcgctgcactcgcagctgggcacctacaaccccgacttcagctcgctcacgcactccgccttcagctccacgggcctcggctcctccgccgccgccgcctcccacctgctctccaccagccagcacctgctggcccaggacggcttcaagccggtgttgccctcctattcggactccagcgccgccgtggcagccgccgccgccagcgccatgatatcgggcgccgcggctgccgccgccggggggagctcggcacgctctgcccgccgctactcgggccgcgccacctgcgactgccccaactgccaggaggcggagcggctgggcccggccggggcgagcctgcggcgcaagggcctgcacagctgccacattccgggctgcggcaaggtgtacgggaagacgtcgcacctgaaggcgcacctgcgctggcacacgggcgagcggcccttcgtgtgcaactggctcttctgcggcaagcgcttcacgcgctcggacgagctgcagcggcatctgcggactcacacgggcgagaagcgcttcgcctgtccggtgtgcaacaagcgcttcatgcgcagcgaccacctgagcaaacacattaagacgcacaacgggggcggcgggggcaaaaagggcagcgacagtgacacggacgccagcaacctggagacgccccgttccgaatcccccgacctcatcctgcatgactccggcgtcagtgccgcccgggcggcggcagcggcggcggcggcagcggcggcggcggcggcggcggcctccgcgggaggcaaggaagcagcgtctggccccaacgactcttagaggccgggcgagaggcgcgagcacacaagcgagtagagacaccgagaacgaacgagaggttcggagggcgagcgagcgggaggcgggagggcaggggcttcagtgacgcccccagggcccgggctgggcgcgaggtggagccgctcagggctcccgggctgcggttcgcccgctgtgcgaggagctcccctctgccttccgcgcccggataagaatcgaacgcgtggtccggaaacaaaagcgaaccatcctccgacacaaacactttaaaaactgtactcccagacgtacacatacaccggagacctacaaccacaagcacgcacactcgcgcgcgcacacacataccactcgcccaaacttctcgagcgaagagcaatacatagaaaggctccctctttgcccactctccacctccctccaacacccgtctctttcctttt

SEQ ID NO: 118481 - DNA, 309 bp, Homo sapiens; identical to SEQ ID NO: 85511
  chr2:175203142-175203451
  Hyper

SEQ ID NO: 118482 - DNA, 175 bp, Homo sapiens; identical to SEQ ID NO: 85512
  chr2:175204088-175204263
  Hyper

SEQ ID NO: 118483 - DNA, 1382 bp, Homo sapiens
  chr2:175204492-175205874
  Hyper
gataatttcgcaattcgaaaaaaatgttaatttagaaaataaagtacatatttacagaataaaaatatttctaaaagatttcccacacaagaggaaatacaagcgaagtcagcaccaacatattttttttttccatttttgattactgtccgccttgggaatttgagcgaagattttgatttttaggaaagaaaaaataaattcttgttattaacaatcagcaaaatgttttctcggaaactgttctgaaacaccaagtcgcaaagtagcgataaaacagaacgaaggtccccagcagggagtttgcagcgtgacattcaatggcttcttccttctccttcttgagctccccgcggccaggctgccccgctcttcttactcgagtttttcttcactttggccattttctctccccgatcaagctgttcataaccgggagccccccactccctaagcgcctctggtcgggggatggtcttccggagagccggctggcagggacgcgttttccggaggggcttcgggccggggcactggaggcccagagggtgcctggcgcgtttgggggccgcgggctggcggcgcggagtagagggtgtggtgggtctccccaggaacgcgggcgcccgggcgtcgggcccagggagctttgtttctcgttgataataaaggcagatcaaagggcccggtcgtgcaggtcccgctggccgcgcggctccctccgcaggccagtgatcaaggcctgtgtgcgctgcctctgccccgcgggtcagcggacgtccatcacccaggctcccgggagcggcgggcggcggccccggaccgagcgtccagccgggagacagcagtccgcggaacctgagcccagaggcagcggggccccggggccccggccgaagccaacaggcgaaaacagggcctaggccccctgcccggcctcccccaagccctaggcgcccctgggggcgcggggaaccttgacctgagcgggtggcgaccggccggccggtgatgaccaaattggagacagcgcgcgtgggaggcgagatcccgccagttacaacacgagttcggtccccaattgcggtggggcctcgcctccccagggccacctcggggccccagaggcctgtgcctttccggctcaggggccagaaggagctggaggcggtggtcaggggcccaagctcagaggcgggtagcggcctggaggtcggtgggggcgggggacgcggcctgggggcccagagtctcgcccgggcccggtaagggcagtgcgatttcgagtcccccggtttccctggcatttcctgtcccatagcttccagcgcaacagaggaacgaaaagcaagttttcctcggccctgcgcccacccagccac

SEQ ID NO: 118484 - DNA, 936 bp, Homo sapiens
  chr2:175206717-175207653
  Hyper
ttgagagggctgaagcgttgtcggcggcgacgtggaccccaggatgtggggatccagctgtggacgcagacccctctgactctgcatccgtggctcccggcccgcgaggcccgcgtggactacccggggcccggctggaaccaggccgattcaaacaggccaccaaaccatcccacccccctaccccctcgtgggcaatcagggaggcaagggacccgccgctttcgcagccccaacccgaggcgggccggagcagccttctgcattgccttcgtcctccggcggacaccccagcccgagtggggcgcggggggcggctgggcaggcaggagccgggccggtcgcgcagggcccccgagggcggcgagaagcccccaaattccccgctcgaggcctccccaaagggtgcgcacaccctcctggagcaaaccgaccccttttgtcctctccttttccctttgaaacccaaatctgaaatcgggtaacagttgggggcgttggccgattttctctcctctcagcgtatcgtcctccccctgccgcccctttccctcctcttccagtccactatctccccgaccccagcccgtcttcatactgcgtggagtgacttcctcctcctccatttttgtgccccccacccccagcgcgtatttattgtattttaatttaaaaagcgacaccttcaaaccctgcgcccgaggcggcggaggcgccgtcacccgcagccgcgagagcccggccaaggcgcctgggtgccgggctccctgaactcgcgccggggagaagcagtgcgtttccggggactcgcagccacctttgcggcgggtaactcggctgggtttgtatttgctgttttaatacaaaccccgccgcactgcctatttcaaagatgtgctaattactacttggatagcagggcgcaaagtccttgtc

SEQ ID NO: 118485 - DNA, 1154 bp, Homo sapiens
  chr2:175207981-175209135
  Hyper
cccacccttcccagacgctggagtgtatagaaatatgtatgaggtaaatacatacagacatgcctcccccatatattgttgatgtaaatatagactgtgtgtttgcatctccagttaaggaaagggtttcagaatgtccgtggggacacgtccctccagggccggctgtcgaggacccggaaaaccacagcccctaagagttccagattttccaagacccttatactctcttcctgtagaatttcatactgggggttttgcattgttttgcaggcatgtaaccatttctgggtgattcatttatctataaaggaaatgcaaagtggcagggtgtctgccccagtccgcattctgcttgcagattgctgacgaaagttgatatcttcatgtttgtcccaggagcttcataaagcgccctcttcacctgtggagcccgagcgaccagaaaaattcgctcgctttcctaactgctgaaggcgagtccggcccgcgcgggggactgcgcccgaggcccggcaagcttaggcggggactagcagggccctcggcgggcgggcccccagcgaaaaggcctgagaattgcttctggggggtggcttgggccaacgggggcgagggagccgcgcagagggcaggccccgacccttccccgccgcaccttgtgggtcgggtgttgggcggcctcctggcgcgggaggcgcatctgctaggaagggtgtgcgctccccccttctcggcctccccatttcggtttggggtgttttcgcaaggttgccagacggtgcatccagaaggaaaccaccagagcacgcaggggggcgtcgcctcaggatgggaaggggcgacctcagccaggattcatcccatcaccctactccacccccattccggcttcctttaggtttagggcgacgtcctcctgggaagccctgctctgtcaacccaggagccctcggacctccacttctgtccaccccctcgcgaagcccttcaagcccaagggactggagaaaggcggctccggggcagctcgggccggagggtgcgtttcttttcattccaggcagctctccgcgttcgtcccgcacatcttcgtcattactgctacattctgggcattctgggggtgataagtgtggcgtgaagggaggaga

SEQ ID NO: 118486 - DNA, 60 bp, Homo sapiens; identical to SEQ ID NO: 85518
  chr2:175351002-175351062
  Hyper

SEQ ID NO: 118487 - DNA, 1280 bp, Homo sapiens; identical to SEQ ID NO: 85519
  chr2:175546788-175548068
  Hyper

SEQ ID NO: 118488 - DNA, 30 bp, Homo sapiens; identical to SEQ ID NO: 85520
  chr2:175791881-175791911
  Hypo

SEQ ID NO: 118489 - DNA, 24 bp, Homo sapiens
  chr2:176030420-176030444
  Hypo
ggagtctcgctgtgtcgcccaggt

SEQ ID NO: 118490 - DNA, 79 bp, Homo sapiens; identical to SEQ ID NO: 39714
  chr2:176430829-176430908
  Hypo

SEQ ID NO: 118491 - DNA, 30 bp, Homo sapiens; identical to SEQ ID NO: 85524
  chr2:176688101-176688131
  Hypo

SEQ ID NO: 118492 - DNA, 34 bp, Homo sapiens; identical to SEQ ID NO: 85525
  chr2:176914363-176914397
  Hypo

SEQ ID NO: 118493 - DNA, 474 bp, Homo sapiens; identical to SEQ ID NO: 85526
  chr2:176940167-176940641
  Hyper

SEQ ID NO: 118494 - DNA, 589 bp, Homo sapiens; identical to SEQ ID NO: 85527
  chr2:176943178-176943767
  Hyper

SEQ ID NO: 118495 - DNA, 5003 bp, Homo sapiens
  chr2:176944072-176949075
  Hyper
agaaaggtgttggaccgaaaaggaggcggcgcaacggccaccccttccagcacctcggctttgtccttcccggggaaggcggccacatccctacccgccttgctcctgaacgtagtaaacaatctcacaaacaaccaccgctgcccacgctctccatccgtcctcccggccttatcagacctccgttctcccgcactcttcgggcagggtccctaataagctcaggctgaaagaacgtttgccacctcccccaccctcgttgaaagaaaaggaagaaaaacagcagcagcgagaaacctccggggcgactcctcccccgcccccaagcaccagcgcacagcatccccctctgtctttgttgtggttctccgttgcttcgggccacgccgttcagccaagcaacccggacctgagagtgcacagccaggactagcttagggggcgaggggttggtctttgggaaaccaagcgctcaggacagaggtggaaagtgggtcccgggagccagaaaagagagagaagggcagacggctgggtggcaaatacaaaaatagaaataatttagggggatgcccgccaggcttttgcgcctgctccttctcccccaattcggagcaggttcccttcggcctcccgcgccccggggcgccccctggcggcagcggcagcagcgggcaacgcgcggagggctcagggggcgcacaggggactcccgggcacactcagagaggcgggcgcggccccctggcggtggcgacgtagttatctggtgagcggagcctcgtccctctggtccggcgggctcacggccgtcttactaagcaccgcggccgagtagggcaggaagccgctctcggaacgcggcgccgccgcgctgcagccgaagtccgagcctcccccggccccggcgcccccgccgccgccgccaccaccaccaccgccgccgccaccgccaccccgggaacccagggctgcggcagctgctgccgcggctgccgccgccgactgactgctgtggcaactgaggcacgagcagggtgcagagccgccgctggggggcgcgccggccgccgccgccgaggaggccgcagccgctgcggctgccgcggctgccgcggcagaggccgcgctgttgagccccgcggcggccgcgggagcctggtagagaccagggtggcggaagctacacagcagctccggccgagagtaggggtgcgagagggcgcggaaggtgtccagtggccggatggaagtagcgaagggcgacgaagccgcggccgccgcgcctgaggctgcagccgcggccgccgccgccgtgacgcccacgtgcgggtagtagtgcagcggcacgtgcgagtggaaggggtagggcaggcttccggtggcggccgcgtgcgtcatcatgtaggtgtagaagctggggtcggctgggtgcggccaggacatggccaggcgctgccgcttgtccttcatgcgccggttctggaaccacacctgcggggagagacgcgccgcagcctgggttagggagcgccccgtgttcccagctcctgtcccaggacctctgccccttccggacctctgaatggcttggtctacttctctccgaccaagcccaaccccgagtaccctgtggtctcccagctgggaaagtgtggacggcagtgtgtggaccgccgtgggcacaccgtcctcaacgaagagggtcctctcccccgcgtccggctgctgctgctcctcaggcttttattcccttacttcttgctgcacttttttgtcccaatccaacctttcctctccctcccgccacccaccagtgccggtctcgctgagcacccgtctctcaatcccaggatttgtacggggattctgggcagcctttgaagagaggctgccgctcagcttttctgagaggtcgccgcgcgaagtcttgagccctccgaactgcaaggacctgcccctaggggcacgggtccgattttgatattgaagggatgattttgttggaatcgtttgccttaaatgagtgggtagagcaatgtctccataaacggggaaggggacgtttccacccctcccaacactatctaataaagacatcattcgtcacaactctaaattaaagaaagcccgatcaaaccagagggagacttccacactcctcccctaccccgtggagattttttcttttttctgcagtgtcgaacgctccatgaagggctcaccaaatcgcctaacctcccggctatctctcccagacgtataataaaattaataacctaaagttatatataaataaggacaatttcgttgcatttttccccgcaggaggttgcccttttttcgttgcccaagaggaaaatgttcaggaaactactgtctcaaaccaatcgattttaaagatacagtatccttttctccgtgtaacgatttatgcggaaaataaatctccaagctcaagagcaaatgaaaagtttcacctctggttcctgcttgaggaacaaagaccaactgggcttgccgcctaggggaaagtggggccgtgggtatgggcgagggggcatctggccaggcgttgggcacaatggagcaggggcgagtgctttcagcattggagtcaccattcgggggccttcttagatccgtcaggccggacaaccgttcggattcggtggccgggaaataaataagccaattcctttggtgactaccccccgcggatttccagacccttagctaaatctagccacccagaaaggggaaaggggaaaaagaaacaatcaacccagatgcccccggggaggccagagcaggcatgcactggaattgataccttgatggtggtttcgggcaggttgagtgccgcggccagctcgcaccggcggggccgcgacacatagttctcccggtagaactccttctccaggcgcgcgatctgctcgcgggtgaacgccgtacggtagcgccgcacttgatccgcgccagagccggagccacccagcgccgcgctcccgccgctgcctccgctgcctccatgcaggcttccgaggcctgagcccgacgccgacgtcgtggtgccggcagccgagccgctctctgcgtaccctggcaaacaaacgaccaacagcgcatgagtggctgtaggaccaacagcccggcgctggcgctgcgcgcggatcggggaagccccgtcaggaaggagagtcgctgccggaattgatggggtctgtcatgcttacaaattgctgccgttaatggaatcaataaagtttggggagcccttcataagcaaataatagaaacggaattaggagatttcttttttaataattagaaattttcaaccaaggaggaaaagtggccgagggaaaatgcctacctctgggcgcagtttgggaagctctgggtttcccatggtctggagaccgcagggcagctttttatacggcctctaacctttatctgagtcttcggggtttcaaatattttaagagttccaacacagcagtagctcaaacccaagccaatagggggtgaaatatacttttcaactctttctcccgctgacctaaacagagacgccggcgaggcttcctccgacttacccagaagaatgccccctccagccctgagggcacaggggcaggggagttcagagtagttgcccagggtacctttcccaaaagcaactcggctgctgactaggggtctaccggctcgctcgggctcttagacacgagcgcagaaacattttctcggactcaggagcgagggcgggtgggcctggtgttccaggctccgcaggcctgagcctggcgggaaagctcaaggagcagaactggaaggcacggtcccagacatgcgtcccgcccccgcccgtgctagctcggtgtagcttgcctgtggagggtctgagaggggaaaaggcaccgggaaaggctggcgggggccgcggaggagcaaagaggatgggactggagagcgcggtgcggccggcgcggttacctttgccattgttttccttaagctgagcggcgccgaggcccccgggggagcgaagcgcggagcagcccacctccacgtcgctgctcatgtcggcctcagcggccgcctctgaataatggcccggcttcttgcggctctcggcggcggaggagatttcggaggagacggtgctttcgctgcccgtgtgctgcaggttgaacaaagtgtctatttcgaatttgcccttggcggggagttctcccagagcgctgtgcaggggggcagacggcaggcgcgggcttaggcgagccgggtgctgcgaattttccagggcctcgagcacagcattgccagccgagttggacaaattggagaatctcttgcccgccgtagggctgtgcagccctctctccatcagaatcatctcttttcttattctttccatcatctcagctttcttaaaaatgtcacagtggccctgctgtcccgtcctaatgataggctgcgcctagggctaattctcattcagccccagcgaacgcctctaaatattattatcgctttcggagggaggcggaaaaattgtgggatgccagagcgagggaatgactggtcaaaatgacccatacatccttccgatcccgagatgtcattcatcaaaaagtagcgcccgctcgtcattaaggtacgaatgacgctgttcgaataatcatttattgtaacaggtttataagcaaataaatacaccctcctgtcagtgggtaatgaaggcagcttcagagcagacaaatagatccaggtaggaggcgagaagagacaagtgaggaggaaggctccggtcctttgcccgctccgagccagttctgctcgcccgggggtttggcctcgggggtgaaattgacagtctgattaatagagcgcgccgcggcacatttcccccttcatttaggggcatcattacgctctcagtttgctaggttgccccttaggtcctaatcatgcagcgccttcttcatttt

SEQ ID NO: 118496 - DNA, 1109 bp, Homo sapiens
  chr2:176949372-176950481
  Hyper
gctctcctcccaccccgggagagagagagagcggaagagagggagagagggagagagggagaaagggagagggagacggagtgagagaaagagagagagagagagagagagaaatagaaatatcctagagttttgaaagcgctttcttgctacgtggccgcggaggtgcattgggcccgcgcctccaaacggaaatcattaggtcctctctgattttctaacaccgtctgcagagtgagatctgaactcgaagtccccggttttttacttttataatcctgctgatagaaagccttctcgcctacgcattttcctgaggggaaacgaactaggctggacgatttgatagcagaattcgacagctaactttaaacacagtggagatttacagcgccatacgggcgctccgaatccacgctcacgttgccagattttcccctccctcctcaaatagaattatttgcggcaaaggcgctggatttcgaggtcaaaagaggaaagaggagacagccttcttcccctacctccccgctgccctcccttcccctttgcttttcttccttctctctttcctcccctcatcaaccccagccccttacctgcggccacaggtattcccagcgttgggtccgggcgcagagagtcgccgaacagccttacagcagctctctgcggcctgggcttggaggctgagcctcttggcgacaactttgatagtcataatgacgccggtggcaaccattttaacgaagatcaatcttcactccaggccgctcctcatctcccgcggttgcgcccacccttccctgaccctccaagcactgtgcccacccgccaacggcccagccggagagagattcgcggacacaggcggaggcgagggaggacggggatgggacgcggaggtccgcccgtgagcttctgaagcggctgagagaccctgacaatctgggcgctgggcgcgggtcctgcatccccacatttagcctcaatccgaaccccaaccagggccccctcttctttctgccgacacacccagaacattggggtgtgttagggggcaagctcgagatctattcgcctatagctcttggcgctttccttttaac

SEQ ID NO: 118497 - DNA, 586 bp, Homo sapiens; identical to SEQ ID NO: 85538
  chr2:176952724-176953310
  Hyper

SEQ ID NO: 118498 - DNA, 2307 bp, Homo sapiens
  chr2:176956330-176958637
  Hyper
cccttgaagtcagaccgtttctctgggctgctcctatcacaaaatccgaatttgcttggaacaagcgccctcttaatttgcccctctcagttctctgcagttgacagcttggaaaaggaagcgaaacaaaggtccctgggaaagtgaagttttcaattaatttggtgtgagaaacgggcgggagtgggtggtgactgcaaaatgcgaggccggtcggctgctggagagacacagaagtttcacggtgggaggctgagtggctttctcccccggcgccgttctcagggtctttctgcgggtcgaagaaggacccgcgggagctgagaggcccaggtcggaagcactcccggctggcccaagagtagaggcgaagagcgttgagtaggcatccatggacttttctttctgggacagattgtcaggctcactgcgccgatgcctgtctttcatctgtttaagtctctgccgccagccccaagggcgcttcatgggcattttccgaacggacagcgtgtgtgtataggaagggtctgctccaatgcctcttacctgtgtgaaatgcctttgccgggtaccagtgcacaaggtagggcaaattagctcactcggatttggggtctagaagtcgactaactgagggattcagcaacaggataaaaaaatgggcctgttttcacatcattctgatcatctctgtccttcgtcttcattttgctgtgcaactcggggagccgaggagaggtggcaaaaacagcggttgccgagacaaggcgcaggccttggcgcccgcctcagtcgcagacagggcctgggatgggccgtcgcgcaatcaactcgtgggggtggctgcagcgcgtacgcctgggtcgggggggagggcgggaatgggaggtggaccctgcaaggggcaggagaggggtgggggccggagtgggtgggtccagccaggcctgggccgggagccaggctcccccgcgttcctacccccacgtggccgcgcgcagccaatggcacgcccccggcgggggccctcggggcgggaggcggccccccgaccggcccaggccccctcccaacctgaacttcgtttttataaacgtcccgcgatgagctaacctgttggagggcaggcgggccggaggcgggaggctcacagagggagagagggctagaggaagagggcgggagcgagcgaaccagagagaaaggagaggagggaggaggcgcgccgcgccatggtgtcctgcgcggggccagggccagggccggggccgggccaggccgggccatgagccgcgccgggagctgggacatggacgggctgcgggcagacggcgggggcgccggtggcgccccggcctcttcctcctcctcatcggtggcggcggcggcggcgtcaggccagtgccgcggctttctctccgcgcctgtgttcgccgggacgcattcggggcgggcggcggcggcggcagcggcggctgcggcggcggcggcggcagcctccggctttgcgtaccccgggacctctgagcgcacgggctcttcctcgtcgtcgtcctcttctgccgttgtagcggcgcgcccggaggctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacatggacgtgtcaggcctggcgagcagcagcgtaccggccaacgaggtgccagcgcgagccaaggaggtatccttctaccagggctatacgagcccttaccagcacgtgcccggctatatcgacatggtgtccactttcggctccggggagcctcggcacgaggcctacatctccatggaggggtaccagtcctggacgctggctaacgggtggaacagccaggtgtactgcaccaaggaccagccacaggggtcccacttttggaaatcttcctttccaggtaggggcgatggagaaaagggaccgacacgagggagggggagagagaaggagaaaagaaaggactaagagtatgcgcccctacttgggagtgggagttgtgcctgtgctccacacgtgaccagggttaacccagtggaaatttgtccagttcgtgtgaaatctgtaaattcctcctctgatttcaactgcctccgtcactgccctttctttcctgtgtgcagcgcagacacgttttt

SEQ ID NO: 118499 - DNA, 564 bp, Homo sapiens
  chr2:176958947-176959511
  Hyper
gcttgttaagatgccggtttgagaaactatgataatcaatcaaattaaccattgttgttaagtgcaaataatccttctttaataacaggtaagtgttatgtctatgtacataataaagaccaaacagcatggcattttttaaaaatttcctgcacccctgcaaacgcacacacacacacacacacacacacacacacaatcctcagctaggtgctccgaatatcccagcctaatttttcttgtgcttttgtttgtatcaggggatgtggctctaaatcagccggacatgtgcgtctaccgaagagggaggaagaagagagtgccttacaccaaactgcagcttaaagaactggagaacgagtatgccattaacaaattcattaacaaggacaagcggcggcgtatctcggctgctacgaacctatctgagagacaagtgaccatttggtttcagaaccgaagagtgaaggacaagaaaattgtctccaagctcaaagatactgtctcctgatgtggtccaggttggccacagacagcttagaagccattcggttgtctccaaaa

SEQ ID NO: 118500 - DNA, 30 bp, Homo sapiens; identical to SEQ ID NO: 85543
  chr2:176961663-176961693
  Hyper

SEQ ID NO: 118501 - DNA, 37 bp, Homo sapiens; identical to SEQ ID NO: 85544
  chr2:176962204-176962241
  Hyper

SEQ ID NO: 118502 - DNA, 30 bp, Homo sapiens; identical to SEQ ID NO: 85545
  chr2:176962587-176962617
  Hyper

SEQ ID NO: 118503 - DNA, 610 bp, Homo sapiens
  chr2:176963158-176963768
  Hyper
gcaggaggaagaggccgattgcgttccccagagccacccaattggtcgccataactcacacaataaagtggcagcgcggcggtcagtcttgccctccggcggcgcctgtgtggtctcagtgcaggagcccgcgatctaaccaattccagcttggctcggagaccgagggtcctgctgcaggctgagactggcgccggtcaccgggtctcccagggtcttgggatcagaggcaggaggggaggacccctagtcctctggccggactaggcaagagggccagcgacggggtctgagcacaccgctcccggctaagaactgctgcctttcccacttccctgtttgtcagacccgtgaactccctatccccggcacccctgggggcgctgaggcaaggaactctgctagccagctgcctccgaacgcccgctgttccccggccaggtggttctggctcttctgcctttccacacccagtcgggggagttcgtcctgctttgccctccacttggtggatggggacacctcggagttctggtttgcagtgtgtagtcctggagaggactcctgaagataaaaggaatgtagcctttggccacgattggtggatcga

SEQ ID NO: 118504 - DNA, 1472 bp, Homo sapiens
  chr2:176964050-176965522
  Hyper
agctcctggtgccgccggaccgcgccctctccggataagtcgagaggcgccggttaatggaaaatgcctccgctgcaacttaaagccggtagaagcaagccgggcccagaaagcctgcggaaaacgaatcgcaaagccaatcacgaccaagaagagtcccaggggacacttgggcagagtcaccctcttgcccgatgtccccagctgctgaagccgggcctggaaacccgcagacagttagtcttcgctcaacctgatttggctctgctggcagcctcgtccttcgccatcgaacattgcgggtgttatcataatactctgaagggggggaaaacgggtcggggggatgtaggcggtgctgaaatgaccggctttgaagaacctgcaggcaaagtttcgtccaatcgtctgagcctgtcctcttattcccggttgtaactaaatactgttgcgagcgcagccgaagccctttgttggagatgtgtgagcgcagtctctacagagcgggctatgtgggctcgcttctgaatctgcagtcgccagactctttctacttctccaacctgaggccgaatggcggccagttggccgcgcttccccctatctcctacccgcgcggcgcgctgccctgggccgccacgcccgcctcctgcgcccccgcgcagcctgcgggcgccactgccttcggcggcttctcgcagccctacctggctggctccgggcctctcggcctgcagcccccaacagccaaagacggacccgaagagcaggctaagttctatgcgcccgaagcggccgctgggccagaggagcgcggtcgtacccggccgtccttcgcccccgagtctagcctggctcctgcagtggctgctctcaaagcggccaagtatgactacgctggtgtgggtcgtgccacgccgggctccacgaccctgctccagggggctccctgcgcccctggcttcaaggacgacaccaagggcccgctcaacttgaacatgacagtgcaggcggcgggcgttgcctcttgcctgcgaccttcactgcccgacggtaaacggtgcccatgctccccgggccggtttgggccgggatgggaggtggggttcaagggagagtgtaaggggaggtgaaccgcctgggggcgggcaatagacagagtacgggctgggttgacgtgggttggggctgtgttgcaggcctgccgtggggggcggccccggggagggcccgcaagaagcggaaaccctacacgaagcagcagattgcggagttggagaacgaattcctcgtcaacgaattcatcaacaggcagaaacgcaaggaattgtccaataggctgaacctcagcgaccagcaagtcaaaatctggttccagaacaggcgtatgaagaagaagcgcgtggtgcttcgggagcaggcgctggcgctctactagccgcgcgcgtggccagggccgggttggatctgcc

SEQ ID NO: 118505 - DNA, 265 bp, Homo sapiens; identical to SEQ ID NO: 85552
  chr2:176968485-176968750
  Hyper

SEQ ID NO: 118506 - DNA, 809 bp, Homo sapiens
  chr2:176969099-176969908
  Hyper
cccagtcagcttttacgagagctgccagacagtgtctgttcacgttctccagataccaggggcgccctgacaaagttaaggtcaagttagtgtcttatcttgggtgactcaaaatcaccgcatcgcgtcctggcgctgtgcggaaagctctttctcgcggagcggctggctgcgccccgaaggcctggtgcgctccctgcgtttcgggtggggccgcgcaggcaaggacaaggccacagagtcggggtcttcacggtaggttctcgagcgggacgcgcgggtccggaggctgcggttttccctgggtttggggaatgggggtaggaactaggagggagctggggccaaagagccaagcgggctgggactggaatgaaagcgctctgggttgtggagtgggtcggggggcaagggtccgcgctaaggagccgaaaggggccggccgcccccttcccctatgcaccggcgcgccactgcagatggctcaccctcccccgccaaatcgctgctcccgccggagctgccgtcgccatgtcgttgaacttgaatggttcgtcctccccttttccctcttcggcggtcagcaggctccatactgggggcgccgggctgcctgcaccccaccccgtgccgccagtagagagaaggtgcgagaattttgcgaatccccagacacataaagacccgggttgaagtcctcgcagctgccctgggtcctgagctaccgcagggccagtgtgcagcgtccagggagccattttaggagagagatccaggggcgtcgaccacgagcccgaaagggagaggct

SEQ ID NO: 118507 - DNA, 68 bp, Homo sapiens; identical to SEQ ID NO: 27718
  chr2:176970219-176970287
  Hyper

SEQ ID NO: 118508 - DNA, 30 bp, Homo sapiens; identical to SEQ ID NO: 27719
  chr2:176970603-176970633
  Hyper

SEQ ID NO: 118509 - DNA, 213 bp, Homo sapiens; identical to SEQ ID NO: 85557
  chr2:176971223-176971436
  Hyper

SEQ ID NO: 118510 - DNA, 276 bp, Homo sapiens
  chr2:176972712-176972988
  Hyper
gggcgaccccaggaccggggctggtggcggcgggggcagtccctgcaccaaggcgacccctggctcggagcccaagggggcagcagaaggcagcggtggcgacggcgagggccccccgggagaggcgggggccgagaagagcagcagcgcaggtaggcaccgggtactgggcaagcggtgggcccgggggccgcgggggagggggggggggcggaggcctccctctgcttgcgcctttttatgtgctactttataagcattcgaagaggtttatac

SEQ ID NO: 118511 - DNA, 79 bp, Homo sapiens; identical to SEQ ID NO: 85559
  chr2:176974033-176974112
  Hyper

SEQ ID NO: 118512 - DNA, 311 bp, Homo sapiens; identical to SEQ ID NO: 85560
  chr2:176976029-176976340
  Hyper

SEQ ID NO: 118513 - DNA, 147 bp, Homo sapiens; identical to SEQ ID NO: 85561
  chr2:176976597-176976744
  Hyper

SEQ ID NO: 118514 - DNA, 35 bp, Homo sapiens; identical to SEQ ID NO: 85562
  chr2:176976975-176977010
  Hyper

SEQ ID NO: 118515 - DNA, 788 bp, Homo sapiens
  chr2:176980718-176981506
  Hyper
ccagaggtccggccccgcagaggtcagggtgtggttcctctgagagccgaagcctcgtgtagccctccggggcgcataggaacccggagccaggcaggaggaccgagcgggaggacaacgcagggaccaacccatccatggggatccgggcccggccagctgcttggcctcccggccctcgcggccctttttgcctccgccctcctagagacaccttggccgcttcttagccccaagggatctttcctttggacccctggggtgggatgtctcagggcccgcggaatccgactcaccttcccgctgggctgcccgggactaaattaaccagcctgcgcccccacccgcttgtcctggacccggccctcttaagcgcgttctgcctggttgtgtgtggggggaatgcttctgtgcgctggcgccagggcactctggcttccctccccgtccgtgcgtgtccacttggaggcccctagagctgagactttccttccgccggttgggcccaggggccgaagcgggggacgcgagtggggcgggctggccgagcgagccctggagaggcggacaggagggcggcggagagcgctgggccggttgtctccagcgcgcactatcgcgggcgcgtagtagatgtcgctgttgtccgtgcttacccggccggccggccaggctctggagcacgtgacccgagaggaggctgcggctcaaggccattttcaaatctcattggcttggttgtcatgtggtcggcagaggcatccacaattacacggggaatgttttcc

SEQ ID NO: 118516 - DNA, 422 bp, Homo sapiens
  chr2:176982293-176982715
  Hyper
aaggaaagcaaaggtcggtatgagcagagttgccaccccagcggggcgcgcagcccgggaacccggcagagagggagtgccggggtgcccagcgccgagccggagcccgacttggcaggtgctgctccgcctggttttagaggggtgatctcagccctgagatagtccccgcttctcccctgctgccctggccctctccgccagtcctggccccacgctgatggcgcccgggcagaggaaaagcttgccggttttatttttcctgagctagacctgaacacaacaaaagagcgcaaaggagacctgcggctcataaacacgaccacagagcctcttttctcctgctcagatttgcagttccagttttgccttgagcccaatgatcatgttaaggtgatccagggcaccgtgttcgtgttcaa

SEQ ID NO: 118517 - DNA, 83 bp, Homo sapiens; identical to SEQ ID NO: 85567
  chr2:176983753-176983836
  Hyper

SEQ ID NO: 118518 - DNA, 1867 bp, Homo sapiens
  chr2:176986559-176988426
  Hyper
ggttctgccctgtggcgtgttctcttccagggcctttccagcatcatcggagaagacgaagcaccctggccgccactgtccgtgctgcgccaactcgcccggccgcccgcccttccgagggcaggcagaagcccctctgtgtcctccaccgccgcgccccggctcgcccctcgggccgcggcgtgtgcccagcctcacgtcggggtgtgtgtggccgcgcgggcgtgtgtgagtgtggcagggggagggggccctccgatctgctccatccgtccgttttattagggacacattaatctataatcaaatacacctcataaaatttttattgaaaggcataatatcattacagaggtcttccacctgttttaaacaacacgacaagctgtgagcaagcgtgtgtgtggggatgtgtggggaggggtgggtgtgagtagggagagaggcgaggggagaacagctcccctcgggcgctaggggccgccccgagggcccgcctgcctcgggcgacaccggcctggcgcccccgcggccgctccgtgtgccctggactcgccgcccgcggctcggaagctggagagtcagcgacggggcccgactgcgggaccgagggctgcaagaagaagcgaacaaatagtccccagcgcctcctctggatgcggtcgcgtctgtggtcctggcagccgctgggcgggccaggccaggtcgggccgggccgagccgggcacatggacctgggcctgcgggctctaattgcggcgcttatgttgatgattttttttttaatcacagcagcccccagtttagcggactgatttactcccggtattggtaaatatgatcacgtgggccgcgcgaccaatggtggaggctgcagcctgcgaactagtcggtggctcgggcgccggcggggagctgctcggcggcggacagtgtaatgttgggtgggagtgcgggacgcctcaaaatgtcttccagtggcaccctcagcaactactacgtggactcgcttataggccatgagggcgacgaggtgttcgcggcgcgcttcgggccgccggggccaggcgcgcagggccggcctgcaggtgtggctgatggcccggccgccaccgccgccgagttcgcctcgtgtagttttgcccccagatcggccgtgttctctgcctcgtggtccgcggtgccctcccagcccccggcagcggcggcgatgagcggcctctaccacccgtacgttcccccgccgcccctggccgcctctgcctccgagcccggccgctacgtgcgctcctggatggagccgctgcccggcttcccgggcggtgcgggcggtggcggtggtggtggaggcggcggtccgggccgcggtcccagccctggccccagcggcccagccaacgggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcagcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaagtaagtgcaaaagaaattgccccctgatttattgctgaaacctgtaaggctcgaatgtgcaaaactgatagttttactaacctataaaaacgtctagacgcctacccaagcct

SEQ ID NO: 118519 - DNA, 53 bp, Homo sapiens
  chr2:176992935-176992988
  Hyper
atatttcagtccacccggacacaagtcaggatcgcgctcgcaggctgggccaa

SEQ ID NO: 118520 - DNA, 1173 bp, Homo sapiens
  chr2:176993464-176994637
  Hyper
gctttgggaaaaattcgtaactttgaggcctgcgcgctctctcggcagtaatttcacaggcttggcggaggaagtaggatcgttagcataagatgggccgcctgcagctgcctggaaccggcgcgatctgaacgccggctgggaggctcctggggggaacttgcggtcgtctgccctccgcactcctccgggaaccgcagccggccctggttcgctgcgcgccggggctgagacccgggagccgcgtcctgcccgaggaaatgtcaccctccccagcgcgagccctttttcccgcctcagaacgtttctgtccgctcttctatttactctctcagcaagcctaatgccccctcctgcattcttcagcctccccctgcgcccagggctgacgtctatcaagggtgaaatgatggaaactatattcatgggcatgatttccattaaatatcaattaacctgagagcctcggccaggcttgcggtgcgtcaagggtaaatgtacatctcatttccacagggcccgctcggctggaaaagaaaggctttgatttgctttgataacgccaggatctggggccacactcgcggcttttaattaaaccacttcgatatgccccaactcaaatgcacggtccggtccgtcaacacctcttgtccacgttccctgggctgcacccgcgtgtccagagctgcaaaagccacgggcaacctctgcttttgcagccaggggctcggggaggcagtcatttgctccgcagcctcctgggagtggcctccttggctcccccaagtctaaggctccgccgcggcccctccctgccggctgcgatccgcattcccgcggccccggggcacacggagcccttggcagtgcgtctttatgggccccctttaaggccggcggaggcatctcgggccgggcgcggcgctccgtccgtcggccgtagcgactgaactgcgcgcggatccctccgcggggctcctcgtccccgtcacgctgactttccgtgcagtgctgtggtgcgaaaatgcctcgccggtgcgcaccgggtcggcagcctcggcggcgggggcgagattggcgggaggggggcgcggggggggcgcggtaagaggtggcggcgggcagagggtgttttttttcttttccctccagagccggggtttgtaaacc

SEQ ID NO: 118521 - DNA, 753 bp, Homo sapiens
  chr2:176994915-176995668
  Hyper
gcctggcctcagaagcgacgcgcgagcgcgggcgggcggcagcagcgacgtagcccggcggtcccggcggcgagagcagccgccccacaggcccccgcggcagtgcggccgagtcgaggctcgctctctggctgcttagcgccgcccgcccgcccggggccgccgccgctgacgccccaatgagttcgtacttcgtgaacccgctgtactccaagtacaaggcggcggctgcggcggcggcggcggcgggcgaggccatcaatcccacttactacgactgtcacttcgcgcccgaggtcggcggccgtcacgccgccgccgcagcagccctgcagctctatggcaacagcgccgccggcttcccgcacgcgcccccgcaggcgcacgcgcacccgcacccgtccccgccgccctccgggactgggtgcggcggtagggaaggccggggccaggagtacttccaccccggcgggggcagcccggccgctgcctaccaggccgccccccctcctcctccgcatcctccgcctccgccgccacctcccccctgcggcgggattgcctgtcacggggagcccgcgaagttttacggatacgataacttacagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccac

SEQ ID NO: 118522 - DNA, 38 bp, Homo sapiens; identical to SEQ ID NO: 6554
  chr2:176996261-176996299
  Hyper

SEQ ID NO: 118523 - DNA, 185 bp, Homo sapiens; identical to SEQ ID NO: 27734
  chr2:176997536-176997721
  Hyper

SEQ ID NO: 118524 - DNA, 215 bp, Homo sapiens; identical to SEQ ID NO: 85576
  chr2:177000663-177000878
  Hyper

SEQ ID NO: 118525 - DNA, 34 bp, Homo sapiens; identical to SEQ ID NO: 85577
  chr2:177000938-177000972
  Hyper

SEQ ID NO: 118526 - DNA, 842 bp, Homo sapiens
  chr2:177001206-177002048
  Hyper
tttatgacctatttgcggtcgtcattggctgcggctggtcatgtgcaggcgccgctcgccttcacggcctttttcctgatttccccggcgaatttccccccgcattctgctttcccagagcctcaccccctctttttctaacctttgtctctgcagaggtgggctccagtcaccggctgcgggattgcggagtccgccgcggcctcggctcccgcccggcgcccggcctggccccaccgccgctcactcggtccgcatcgccgccacctccggagctggtggggagcccggcgagggagggcctggaaggggccctgggcgccgagtcccccgccggcgccgacaccgcctgccaggagcagccggcctgctcgaggtgactgcagccgcgcggttctggcgcggcttcttcaccaacatgagcgggtctctgcgtccgagagtgagcgcagccgggcagcgcctagtggattacagcagacgcccggaccgaccgccgcctgtagctcggcagccttcgggtaagaatcgccccctccccgctccccagcatgccaccaagaagcctggggcgccgacccccttgggcagctcagtccggctgctcccctacatttcccggggaagtggggggtcgctgtctaagccccttcccccaatcacttcgttcctagggcgtcccctggggcctggggtggagtccggctgggttcagaagtctaagggggcagtattatttcaaaaattctgagatacgggtagccacagacaggatcccactgcctagatggagagcccctcaatcctaccctaggaaagtgtatagacgggttactactgaa

SEQ ID NO: 118527 - DNA, 30 bp, Homo sapiens
  chr2:177003159-177003189
  Hyper
aggtcattctttgatcggggtaaaaaacat

SEQ ID NO: 118528 - DNA, 344 bp, Homo sapiens
  chr2:177003719-177004063
  Hyper
catagatcagggagccgatagcatgtccgggccttggtgacgacgggtcaggccatgaactgggcttgagatctctggcgaggaccaggagaaagacgaagctcgaaattataaatgtggccaagcacgagagctgaaaacaaagcgtattttcccgtcagatgtttctacaaataaatttcgccagagttctgttttctgaatcagagaggcaagggaaatcgaacaaagacagtatttcaccctgggctggcaggcagctgttagaggtatttacggccttgccgcagtgcggcggccaggcagccgggtagggtatgcgggggcaccggaagctggggaga

SEQ ID NO: 118529 - DNA, 269 bp, Homo sapiens
  chr2:177004437-177004706
  Hyper
tcctctgcatccaggcgtagaagcagtgcgcggtaccttatccgcactgcgcggtgcaagccggccgcacagctcacggtcccgcagcgcccgccacacacccgcgccagaggtccagcgcatgtgcagtgaaatggcctagcccgggaattcgatcggcaaagcacgggtgtgggggcgggggggtgggggggggcgagtggactcgagcaggaagatacacccgatctttccattctccctccgtcaaggctcgctactcatcttgc

SEQ ID NO: 118530 - DNA, 697 bp, Homo sapiens; identical to SEQ ID NO: 27742
  chr2:177004982-177005679
  Hyper

SEQ ID NO: 118531 - DNA, 1024 bp, Homo sapiens
  chr2:177042532-177043556
  Hyper
ctccattgttcacagcgctgccctacaaataccatatccgtccccacctcctctgcaagggtcgagcggaagagtaggtctggtgagctgagctctagggagctggtaccatcttccctcaatccccctcggttaccccttggggcagcaacgacgccatcccagccccttccagagaacacacaaaggaagccccacccgtccttagacctgaggacacgctcgggagcgggctgacgtggaccccgtttcagggcgccccgggcccctgcggggaacaatagccgccgcctcctgggcggtctggcgggcgcgcggcacaaacgtccgcgccgccacgtgatgcgcgcgctcgttccgcgctctccgcgcctcagcgagcggccaggctgcgggcggggtgggctggcgctcctgatccacctggaacacttttgcaaagacagacggtgagttaatcaccctaccggctggcggccgcgtcccctctcgcccgcgaggaggactggagaaggggctggggtggaggttttctctgtgtgtgtctagggttgggggcaggagaggttagttctattaagagttcatcaatcacccggtgtgcacttttcgctcgacagcggttcctcctacttcagagcaagtctgggccagctgggatccgaccagaaatcgcaagcggaggagacgcagtagcgcaggctgagcgctaactgaaggcgcgacctgagcccggcgcctgctggggagctgcgcagccaggacagcggtcggcagcacagggcctgggcgcagggcccgccgtcaccacctcacgtcggaagccagcactgctgcccgccagccctgccgcctgccctcggacttcccagggcgcccagggtcctcccaacgcgcctgcacccacacccgcccctgagccacagtgaccttgcattccccgccccctgccacacctcctgcgtgcccgagtgtcacccttaaataccgctctacacccagagagggacgaatacacctctga

SEQ ID NO: 118532 - DNA, 152 bp, Homo sapiens; identical to SEQ ID NO: 85588
  chr2:177052592-177052744
  Hyper

SEQ ID NO: 118533 - DNA, 1400 bp, Homo sapiens
  chr2:177052963-177054363
  Hyper
gcagtctccaccggccgcgcgtcacgctcccatttaaccttttccatgccgcgacgcccacactccgccctcgagggactagccccccccacgatccagagcagaagcggctcgccccgctgcatccacgggccctcacccaagcgtccagtcctgcctttctccccccacctcgcccaatacctgtccgagagcaggcgttctgccctctcgccccgcccttgcccaggcagcccccggtcgcgacggctctcctcggggctcgggggcgctgggcggcggccctgggctgctttggctaacttggctgcggggcaggcgcgaggagcggcgcgccgaccgggccgagcggagaggccgcccattggccggccagcgccacgtggccgcccccgccggtatattaggccactatttacctccggctcactcgccatgggttggagagggcagctcgggtagagagggctggcggagcggcgcagacggcggcagtcctgctcagcctctgcccggctccgtactccggccccggcctgcgccctcagaaaggtggggcccgaaccatgagctcctacctggagtacgtgtcatgcagcagcagcggcggggtcggcggcgacgtgctcagcttggcacccaagttctgccgctccgacgcccggcccgtggctctgcagcccgccttccctctgggcaacggcgacggcgccttcgtcagctgtctgcccctggccgccgcccgaccctcgccttcgcccccggccgcccccgcgcggccgtccgtaccgcctccggccgcgccccagtacgcgcagtgcaccctggagggggcctacgaacctggtgccgcacctgccgcggcagctgggggcgcggactacggcttcctggggtccgggccggcgtacgacttcccgggcgtgctggggcgggcggccgacgacggcgggtctcacgtccactacgccacctcggccgtcttctcgggcggcggctctttcctcctcagcggccaggtggattacgcggccttcggcgaacccggcccttttccggcttgtctcaaagcgtcagccgacggccaccctggtgctttccagaccgcatccccggccccaggcacctaccccaagtccgtctctcccgcctccggcctccctgccgccttcagcacgttcgagtggatgaaagtgaagaggaatgcctctaagaaaggtaagtccgcgggccttggatggggccacctggggttggggacggagcctcccccgcggaaatgcgctgggagcgtggtgtcgctgcctttccagacagcggtttgggttttgtggaggagacgcgttcccgggcgaattccatggagtctgcctcgagtacagattcggaaaatgtgccag

SEQ ID NO: 118534 - DNA, 130 bp, Homo sapiens; identical to SEQ ID NO: 85593
  chr2:177133417-177133547
  Hypo

SEQ ID NO: 118535 - DNA, 101 bp, Homo sapiens; identical to SEQ ID NO: 85597
  chr2:177498024-177498125
  Hypo

SEQ ID NO: 118536 - DNA, 695 bp, Homo sapiens; identical to SEQ ID NO: 85598
  chr2:177502225-177502920
  Hyper

SEQ ID NO: 118537 - DNA, 155 bp, Homo sapiens; identical to SEQ ID NO: 85599
  chr2:177502980-177503135
  Hyper

SEQ ID NO: 118538 - DNA, 210 bp, Homo sapiens; identical to SEQ ID NO: 85600
  chr2:177580925-177581135
  Hypo

SEQ ID NO: 118539 - DNA, 30 bp, Homo sapiens; identical to SEQ ID NO: 85601
  chr2:177842306-177842336
  Hypo

SEQ ID NO: 118540 - DNA, 192 bp, Homo sapiens; identical to SEQ ID NO: 85602
  chr2:177895144-177895336
  Hypo

SEQ ID NO: 118541 - DNA, 32 bp, Homo sapiens; identical to SEQ ID NO: 39717
  chr2:178089350-178089382
  Hypo

SEQ ID NO: 118542 - DNA, 220 bp, Homo sapiens; identical to SEQ ID NO: 85604
  chr2:178119023-178119243
  Hypo

SEQ ID NO: 118543 - DNA, 30 bp, Homo sapiens; identical to SEQ ID NO: 39718
  chr2:178131780-178131810
  Hypo

SEQ ID NO: 118544 - DNA, 238 bp, Homo sapiens; identical to SEQ ID NO: 85607
  chr2:178972992-178973230
  Hypo

SEQ ID NO: 118545 - DNA, 137 bp, Homo sapiens; identical to SEQ ID NO: 85608
  chr2:179058613-179058750
  Hyper

SEQ ID NO: 118546 - DNA, 688 bp, Homo sapiens; identical to SEQ ID NO: 85609
  chr2:179278181-179278869
  Hyper

SEQ ID NO: 118547 - DNA, 19 bp, Homo sapiens
  chr2:179317038-179317057
  Hypo
aaagcgatttgttgttttg

SEQ ID NO: 118548 - DNA, 71 bp, Homo sapiens; identical to SEQ ID NO: 85611
  chr2:179413207-179413278
  Hypo

SEQ ID NO: 118549 - DNA, 30 bp, Homo sapiens; identical to SEQ ID NO: 85612
  chr2:179440837-179440867
  Hypo

SEQ ID NO: 118550 - DNA, 38 bp, Homo sapiens; identical to SEQ ID NO: 85613
  chr2:179564040-179564078
  Hypo

SEQ ID NO: 118551 - DNA, 30 bp, Homo sapiens; identical to SEQ ID NO: 39721
  chr2:179672126-179672156
  Hypo

SEQ ID NO: 118552 - DNA, 195 bp, Homo sapiens; identical to SEQ ID NO: 85615
  chr2:179893525-179893720
  Hypo

SEQ ID NO: 118553 - DNA, 1539 bp, Homo sapiens; identical to SEQ ID NO: 85619
  chr2:180725172-180726711
  Hyper

SEQ ID NO: 118554 - DNA, 183 bp, Homo sapiens; identical to SEQ ID NO: 85620
  chr2:180886727-180886910
  Hypo

SEQ ID NO: 118555 - DNA, 30 bp, Homo sapiens; identical to SEQ ID NO: 85621
  chr2:182059306-182059336
  Hypo

SEQ ID NO: 118556 - DNA, 39 bp, Homo sapiens; identical to SEQ ID NO: 85622
  chr2:182116902-182116941
  Hypo

SEQ ID NO: 118557 - DNA, 195 bp, Homo sapiens; identical to SEQ ID NO: 85623
  chr2:182155914-182156109
  Hypo

SEQ ID NO: 118558 - DNA, 30 bp, Homo sapiens; identical to SEQ ID NO: 85624
  chr2:182303713-182303743
  Hypo

SEQ ID NO: 118559 - DNA, 1738 bp, Homo sapiens
  chr2:182321357-182323095
  Hyper
gcaactgagtgggtgcgtgaaaaggggggatcatcaattaccagctggagcaatccgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggtgagtagagttggactgatgcgccctcagcagctcagagcggcgtgagaatggcgccctagggattccctgcccgattcaaactttcctccctcccaaggaggcaggagggaaacgctgcgagagccagctcgctggaaatctgccagggaaactaacttatcttggggcggcagcgccccgggtgcgttatggtgcaaggtcttggagcttcgagtcgggggtggtgggcggaggaggaggtggggaagctgccctgctgcggactgcacatctgtggcgacagggagctcagtgggcagcacagctcacgtctgagcgcacgtgcacgtgtctcgctttaggctcctagtgggtgcgcccactgccaactggctcgccaacgcttcagtgatcaatcccggggcgatttacagatgcaggatcggaaagaatcccggccagacgtgcgaacagctccagctgggtgagttgggtatgggaccaggagttagtgacctcccgaccccccatgtgg

SEQ ID NO: 118560 - DNA, 160 bp, Homo sapiens; identical to SEQ ID NO: 85628
  chr2:182387465-182387625
  Hypo

SEQ ID NO: 118561 - DNA, 30 bp, Homo sapiens; identical to SEQ ID NO: 85629
  chr2:182388455-182388485
  Hypo

SEQ ID NO: 118562 - DNA, 89 bp, Homo sapiens; identical to SEQ ID NO: 85630
  chr2:182395490-182395579
  Hypo

SEQ ID NO: 118563 - DNA, 148 bp, Homo sapiens; identical to SEQ ID NO: 39723
  chr2:182422221-182422369
  Hypo

SEQ ID NO: 118564 - DNA, 271 bp, Homo sapiens; identical to SEQ ID NO: 85632
  chr2:182521375-182521646
  Hyper

SEQ ID NO: 118565 - DNA, 37 bp, Homo sapiens; identical to SEQ ID NO: 27763
  chr2:182542469-182542506
  Hyper

SEQ ID NO: 118566 - DNA, 470 bp, Homo sapiens
  chr2:182542848-182543318
  Hyper
gcggcggaggcttaacgtggaagacatgggagctgtccatggtaccgtaaggcggactgggcagcccaggcgactggtaggagtaggggtgtacagggaaggaagcgctggccgtcggcaggtgggggggcatgtcctggttctgctcaggcagaaaagtccgaggattgagttgcaggcagcccgcaaccaggttggtggtgggttgggataagcccttgcaaagcgtctgaacgaaggagaccaggtctgggcttttgcctgagcgcaggatctccgacagagcccagatgtagttcttggccaagcgcagagtctcgattttggacagcttctgcgtcttagaatagcaaggcaccaccttgcgcaggttgtctagcgccgcgttcagtccgtgcatgcggttccgctcccgggcgttagccttcatgcgtctcaatttaaaacgctccaggcgagccttagtcatc

SEQ ID NO: 118567 - DNA, 344 bp, Homo sapiens; identical to SEQ ID NO: 27765
  chr2:182543758-182544102
  Hyper

SEQ ID NO: 118568 - DNA, 188 bp, Homo sapiens; identical to SEQ ID NO: 85638
  chr2:182544428-182544616
  Hyper

SEQ ID NO: 118569 - DNA, 892 bp, Homo sapiens
  chr2:182545193-182546085
  Hyper
taaccctggggcctccggacgccgcgcctcctgcgtgggcgaattcctcgtgtcgtggccgcgcgggcgctcaggttatatagcccagttagtgatgctaagcgcgggcggggccgctagctgaggggctagcaggtctatgcgcctgacgcctgcgcacgcgtccaggctgtgcgctccccgttctcccctcctccccacttctccccacgccttgctcgtctcccgccctcctccgacaaccgctcccctcaccctccacccctacccccgcccctcctccttcctccccggcatgcgccatatggtcttcccggtccagccaagagcctggaaccacgtgacctgcccatttgtatgccgcggagcgctccattccggcccctttgtggccagaagaaagtggcccatctgtcgccagttagagactccgcggacctgtttttacccgcaggagagattaaccctttcaggcggcagaagggacggggatagaggggggaggggatttgagggaaggaagggaaaagctaatgttaactaggtctagatcagagcgagtggcctgctttcgcgccggaagtaggacagaggtgaaagaggcagaagcggggagactgaggcacgcagtgaagagtcctcgctcctttcgatttcttgtcctgacactggcatccagagcagcatgactccttgccctctctgaaaggcccatcccttggcttcttctccttggcagacgctttgatcattggcgccaaaggatggcttctcctaatctccgtcggcccctctaagcaaacatatacgccatataaaagcggcttcatctgtaaacgcagcgttgagattagttccccaacctccctaaccggatcgtcctctcccagtt

SEQ ID NO: 118570 - DNA, 258 bp, Homo sapiens
  chr2:182546292-182546550
  Hyper
tggggacttctttgacggttgtattctgccttttaaccatggccactgggttgctggaaagggcaccctcactcagccagtccagggacgcttctggttccctggccagcccgccctggacggcctcggctctctagtccaggcattgaccacaagtacggtggtggacacctcgccacagccggacctgcgctcttgctcccctcagtctcgggtctgtataagatacttgattcagacaagcgttttcaaagagaa

SEQ ID NO: 118571 - DNA, 2346 bp, Homo sapiens
  chr2:182547199-182549545
  Hyper
acttggctgacaaagcgcataggggaggataaaataattcacccaggagcctgggcccaggatttacccctgtactgtctgtatcttcagtgttgggctaaaactcgagggcgtcggagtactagcccttagaagatagtacacagcccgacgtttgcggcagggccaggttaagtactgcccctcacccggcagctgccccgactggcagcacactatgccgcaggcatatgcaactcgtgcctaggctctcatttttccaactttggggagttccggaggagaactggggacggagtgggagaaaggactccagctagcttcgaggtcaggggtagcctagaggtccctctgctaaatccttgtcctcacccccagaaagcagaaacctccagttcgcgacatcctgtgcaatacaggagaattatggtggagtcagatgttcttgagcaagagggacgcccgagtgttttgccagacggagactcaaatgcgtaaagtgcgggaattactagtctgtttcctccctctacccttgataaattcatctctaatcccactgcgcgttgttcgctcaggcctggagatttgtacaaaggaaaggccactccaggatgtttcagagacagggctgaggttgggtctcacggtagctgtccttgggcttcccatcccgcagcgctccgatgtgaccctcctctgcgcggaaaatttcgacccggggcgccggcatcgcgacgctcagccagtgcccgcgaggctcccaggagatgcggggtagtaaggccctaaaaagaggagcctggacacggcctggattgaggtgcgttttgtttggggttgaaggcgcgagaaattggggcgagagaagagagtcagccggatcccggagaggacagagctgaaggcgcggcggggcttagcactgaggaccttctccgcggccccgctcctcctccttattttcttctctttggacttgtttggacggttgcacacttttccccctcctgattccctaagttttttgtctctcccctcgctgcccgttagctgtactcccccagctcccgtccctactgggcgctgcaggctacccagcggcacgcgaaccgcacgcgcggacaacaaaagcctctttcatgactcactgccctcgagcaatgccccaaatctgccgcctcccgggtccccgctctgagcgcgcggcgcgggccgggcgtcccggccgttacagcggcagccggagcgcccgcgggaaggggggcgggaggaggcgtgtggccaggggtggggagaggggagtgtggcctgggccgggcggaggggaagggggaggcatgtgggaggatgggggtggggaagggatggaggcgtgtggcccggacgtagggggtgggaagcgtgtggctggaggcgaaagcggggagcgggaggtcgggggcgaagcattcacagggccaagataaagcgcaggggccgggccggcgtccctggcggtgacctgtttctcagggaaacagatgctcgctcttgcaaagggaggtttgcgttcaatgaaaggatcaagtgtggccagggcagcccggccgacctcgagaggttcccgcgtcctctccccgccctgcctaggagtggggtgtcggggcctgggcgcgggagagcggagtgagggggccgggtggctgaggggcccgcgagaccgtggggctcaggggccgcaggaacggagggctgagagctgcaggtcctgcacaggctgggtagctcggaggctcttgagagcttcgggggatgaaggggggttgatgcgggttctgaccagaccgccgacgcggcgcctccgccccgggggaggcagttgggctcccgggtcctggcctgaggctggagctgcccaggctcgacaggcaggcgacccgggagagccaagagcaacgagagacgctattaaaatgcctcgccgtcgccccgagcgcaaaacccatcctccccaaatctcctgggcttgcggcataatcttaattaagataattgattcatattgcacctgcgagaacggaaaaaattgatttcaacccccaaccccacaaatcgcttagagctattggatggagcacgacgcgactgtgatttagggagtgatttagtgccgggcttccccagctcggcctgcctgggcctttttatttattatttatgccctcccggtcccgacggggctttggtggctcctttgtcggctcccacaggccttggaaggacttgtctctgattccctgtcaggatccaggggctttccttaaaccatccaacactcagaatcaacaacgtaaaatcaactca

SEQ ID NO: 118572 - DNA, 248 bp, Homo sapiens
  chr2:182549876-182550124
  Hyper
cgcacacctgtttcccggggatcgaggaacagcttgctgtccaaaggggatcgcagggccagggaactgacaagcacacgctatttgccaacctttgccttaatagaaagaagcaagcaaacaaaaatcctcggtagctgtgtgtagcttcaggagtggagagccgagacacaccgacggcgccggagcgtcgcaagaacaatggttgctgcagtgggttgggagagaggacccggacaagttcctaa

SEQ ID NO: 118573 - DNA, 319 bp, Homo sapiens; identical to SEQ ID NO: 27778
  chr2:182819030-182819349
  Hyper

SEQ ID NO: 118574 - DNA, 933 bp, Homo sapiens
  chr2:183731173-183732106
  Hyper
tcacaggctgcagcccgagccccgggcacccggagcaggcagagagcagccagggcaagcagcccggcccgcagcagcagcatccctcccgggctgccgcagaccatgatcccggcaggatggggcagggtgcagccgcgcagtggacgccaaaaggcccgctccgccgtctccgcctcccccgctgcaagtggacacaaggatctgggagcttctcctcccccggcaatcaccgcttccttggatcaaattcccccaatggggtcccacgagctttaccgagctccagccaccgcccctgccgcccaggctgctctttcccaacgtctaagccttcggaagcagcaacatctatttattcctctccctctggcagaagcatcagacttcgcagatcagtcagataagagggacacgagaggaggcgaggaagacataaaaacaaaagtagaattcagctgagagctagttggagctctggggtgtctcctcccctagatcacgcacacaaaaagatgctaaagaaagcattaaattccccaaagtgaggaggacagaggggttggggggaaggagggaggaaaagctcctaatgggagagaagggtgcagtaagagtttacaagtcctgtgtgggctaagagctgcggccgccgctgcggctgcgaccctggctggcaggagggacgctcaggaggagccccgcagggacgtctgtgcctctgcccgggcggctctgcactttcctacctcccgcctgagagggagctccgcccctggggcagtctctgccctccagtgccggctgctcttcccgagaatggagtgggcgcccggggaagagaaggcctgggagtcgcaggcggtggggtgcgaagccgtgcgagtgcgagaccccaagacagcgccgagtcgagcgcgccctcacactagg

SEQ ID NO: 118575 - DNA, 17 bp, Homo sapiens
  chr2:183991037-183991054
  Hypo
tgcgccttctactgtgt

SEQ ID NO: 118576 - DNA, 220 bp, Homo sapiens; identical to SEQ ID NO: 85653
  chr2:184406833-184407053
  Hypo

SEQ ID NO: 118577 - DNA, 1197 bp, Homo sapiens; identical to SEQ ID NO: 85655
  chr2:185462620-185463817
  Hyper

SEQ ID NO: 118578 - DNA, 210 bp, Homo sapiens; identical to SEQ ID NO: 27782
  chr2:186603443-186603653
  Hyper

SEQ ID NO: 118579 - DNA, 141 bp, Homo sapiens; identical to SEQ ID NO: 39725
  chr2:188235961-188236102
  Hypo

SEQ ID NO: 118580 - DNA, 146 bp, Homo sapiens; identical to SEQ ID NO: 85660
  chr2:188418955-188419101
  Hyper

SEQ ID NO: 118581 - DNA, 91 bp, Homo sapiens; identical to SEQ ID NO: 85661
  chr2:188809066-188809157
  Hypo

SEQ ID NO: 118582 - DNA, 36 bp, Homo sapiens; identical to SEQ ID NO: 85662
  chr2:189075849-189075885
  Hypo

SEQ ID NO: 118583 - DNA, 210 bp, Homo sapiens; identical to SEQ ID NO: 27783
  chr2:189156634-189156844
  Hyper

SEQ ID NO: 118584 - DNA, 30 bp, Homo sapiens; identical to SEQ ID NO: 85665
  chr2:189157587-189157617
  Hyper

SEQ ID NO: 118585 - DNA, 32 bp, Homo sapiens; identical to SEQ ID NO: 85667
  chr2:189764815-189764847
  Hypo

SEQ ID NO: 118586 - DNA, 75 bp, Homo sapiens; identical to SEQ ID NO: 27784
  chr2:190445180-190445255
  Hyper

SEQ ID NO: 118587 - DNA, 35 bp, Homo sapiens; identical to SEQ ID NO: 85669
  chr2:190446074-190446109
  Hyper

SEQ ID NO: 118588 - DNA, 431 bp, Homo sapiens
  chr2:191045074-191045505
  Hyper
ccaaggcaggccccgcgggggagaggccttggagggcagcgccccctctcaccagggcggagctcaggagagttcgcagcccagggggccgagaccaggggcagggccagcgaaatgcctcgctggctcttactttcattgacctctgcgatgcctcgctggcttctgctttcattgacctttgcgggtctgttcccgctgcggcgccggcagctgcttggtagttgcggggggcgtgagggcggtggcccagaccaaccggctggcagcccagctccgctccgcccgcccctgcctcggaccctgcgcctgaggaagtatcgaggcaaccctctgccacccgaagttcgtgggtcgctcccagagggcgcgccctggagccgagcgcccttgggcggccatctggaggccaggtgcgggccgcgaacccg

SEQ ID NO: 118589 - DNA, 55 bp, Homo sapiens; identical to SEQ ID NO: 85673
  chr2:192015371-192015426
  Hyper

SEQ ID NO: 118590 - DNA, 126 bp, Homo sapiens; identical to SEQ ID NO: 85674
  chr2:192110177-192110303
  Hyper

SEQ ID NO: 118591 - DNA, 1935 bp, Homo sapiens
  chr2:193059011-193060946
  Hyper
ggtctgtgctggatacgcgtgttcttctgcggagttaaagggtcggggacgggggttctggacttaccagagcaattccagccggtgggcgtttggcagtcacttaaggaggtagggaaagcagcgagcttcaccgggcgggctacgatgagtagcatgacgggcagcagcagcagccagcaaaagccctcgcaaagtgtccagctgctgcactgccgcggggactcccacagcaccatgactagttcgtgcaactctgcagcagcaaacggcttccgaggaacacaggatcgcgggggccgggcagcgggctactgagcatcccgcggacggcggcagcagaggcggcggcggtggcagtggcacccggcggggaagcagcagccaaacccgcgcatgatctcgagagtttcagcaacatccagggactgggctcagccccggagcgagagggtcgtccgctgagaagctgcgccggagacgcgggaagctgctgccataaggagggagctctgggaagccggaggacaggaggagacgggagtccaggggcagacgagtggagcccgaggaggcagggtggagggagagtcaaggcgccccgcagcccggcagccgcctctcgagctctgccgcccgcatccctctggcgtttgggaagcagcaggtcctcagcccgcccggggtcacgtgggaagaggcagtcgggctctgattggtggagcaggatgcaggtcccgggagggaggggtcgacgaggaggtgcaaggatgcaaggaggaggcggccgcggaagccacagatgggctcgctcgccaggcgctggcccgagtggggctaggcggggatggctcaaatgagaagctcgggcttcagggtgggctacccgcacactcatataccattcgcctcactctccgctccaggacgccccctaccgaaggcggggtccggactagcgcccctcttccgcgcgtgaccccgggccgcgagtgcgggccgcggctgggtggcgtctctccgagctggagatggtgggggcggaggtgtcagaggagcagcagcagcagggcagagaggggcgagtcggcgcgggagagggcgtcctgctggcgaccggcgctccagcgtgcgggagcgcgccgcctaggctgtagggggatgcaggctgggaatgtcgcggcggagaggccagggacgtttctctagggatttacaggaaagagggtgagaggcgatggtgttagaaccgctcttgccgacctggaagcaacagcagcatctcccacaagagcgtgcaaccccaaggctgctcgccgaggcagctcagccatcccggcaggcgctctccttccttctctcttctcccctctctcctcccaggccccccgcagctccgacccagcccaagcgttcgcaggtttgaatccctctcctcatcacccgctcctctccagcccgtagcctattagtgtgtccacctgggaggtgcggtcagatgtgtttggaaggtcagattggtcgggacaagtggtctgagagaaagagaaaggctcctctgcatacgccgcgggtgggttgccgggagcatcggccgggcagcggcgtccgggaaggggagagcgggctccatttgttggcccaggcagtgaccctgcgttccttactcgggtctttgccggatggccggtgacctggggcgacgagagaaggtctaactcggcaggagtctctggctctgcgcgtttctttcattctctccagcgggaagggcaaacggcatagcgggacccgccttccgtctgctgcattcttcaggcagttagacacactctttagcctaatggaattttagtcgccagtaacgggaccaagagctttcggggacaagggtggagaggaacatctttcttccatgaccggggtcactattgc

SEQ ID NO: 118592 - DNA, 40 bp, Homo sapiens; identical to SEQ ID NO: 85679
  chr2:193061440-193061480
  Hyper

SEQ ID NO: 118593 - DNA, 97 bp, Homo sapiens; identical to SEQ ID NO: 85680
  chr2:193363553-193363650
  Hypo

SEQ ID NO: 118594 - DNA, 36 bp, Homo sapiens; identical to SEQ ID NO: 85681
  chr2:193363710-193363746
  Hypo

SEQ ID NO: 118595 - DNA, 75 bp, Homo sapiens; identical to SEQ ID NO: 85697
  chr2:196302358-196302433
  Hypo

SEQ ID NO: 118596 - DNA, 78 bp, Homo sapiens; identical to SEQ ID NO: 85698
  chr2:196319761-196319839
  Hypo

SEQ ID NO: 118597 - DNA, 33 bp, Homo sapiens; identical to SEQ ID NO: 85700
  chr2:197298088-197298121
  Hypo

SEQ ID NO: 118598 - DNA, 1352 bp, Homo sapiens; identical to SEQ ID NO: 85701
  chr2:197457183-197458535
  Hyper

SEQ ID NO: 118599 - DNA, 30 bp, Homo sapiens; identical to SEQ ID NO: 39728
  chr2:197503336-197503366
  Hypo

SEQ ID NO: 118600 - DNA, 26 bp, Homo sapiens
  chr2:197503796-197503822
  Hypo
tccacccttggcgacagaggaagacc

SEQ ID NO: 118601 - DNA, 185 bp, Homo sapiens; identical to SEQ ID NO: 85704
  chr2:198174643-198174828
  Hyper

SEQ ID NO: 118602 - DNA, 37 bp, Homo sapiens; identical to SEQ ID NO: 85705
  chr2:198317068-198317105
  Hypo

SEQ ID NO: 118603 - DNA, 88 bp, Homo sapiens; identical to SEQ ID NO: 85706
  chr2:198456603-198456691
  Hypo

SEQ ID NO: 118604 - DNA, 142 bp, Homo sapiens; identical to SEQ ID NO: 85707
  chr2:198651498-198651640
  Hyper

SEQ ID NO: 118605 - DNA, 35 bp, Homo sapiens; identical to SEQ ID NO: 27793
  chr2:198670222-198670257
  Hyper

SEQ ID NO: 118606 - DNA, 30 bp, Homo sapiens; identical to SEQ ID NO: 85709
  chr2:199113318-199113348
  Hypo

SEQ ID NO: 118607 - DNA, 115 bp, Homo sapiens; identical to SEQ ID NO: 85710
  chr2:200321883-200321998
  Hyper

SEQ ID NO: 118608 - DNA, 113 bp, Homo sapiens; identical to SEQ ID NO: 85711
  chr2:200322498-200322611
  Hyper

SEQ ID NO: 118609 - DNA, 30 bp, Homo sapiens; identical to SEQ ID NO: 85712
  chr2:200326625-200326655
  Hyper

SEQ ID NO: 118610 - DNA, 92 bp, Homo sapiens; identical to SEQ ID NO: 85713
  chr2:200326868-200326960
  Hyper

SEQ ID NO: 118611 - DNA, 555 bp, Homo sapiens
  chr2:200327239-200327794
  Hyper
cgtctggggactgaccggagcgcagggcgggggacacttacttcgttatccgcacgccttcctcgttggcatcagagccggacaaatcccaacccgcgccaggcaaagataaatgactcctggctcccccggcagctcagggggtctgggcgggggcggagagggaaggaagccgtcggccgccggaggtagagactgtggaggtcctcctcccggccccaagcgaatgagcccctgcggcccgagcagagagatacgcctcagagggacgactgatggggaaggatggtgggcaacgagtctgcgctaggcggtgagcctagcaccccagaggcccgagggtctggggctagtggggccgaccgttcaggagccgggtgggcgggaagggaattgccaaggtcggcccaggagctgcctcaggcgaggacggggagctttctgcactgggcttcccggggtaggagatgggcgtcgggtgtgggcactgcctgccctgggggaagaaagcgaggagataggtttcagagctgggggagtcgttggtgggagatc

SEQ ID NO: 118612 - DNA, 222 bp, Homo sapiens; identical to SEQ ID NO: 85717
  chr2:200328171-200328393
  Hyper

SEQ ID NO: 118613 - DNA, 1078 bp, Homo sapiens
  chr2:200328667-200329745
  Hyper
gaggctatgggcccacgccggtcttgaaccaagcggagagggcgaaaaagcccgctgcgggacccacggtcccagacacctactggagccagggacgaggggggcagtgtatccggcggcccaaactcgtaaggagtgggggccaacttagagggcttcccgagctggcgcctcgcctgttttctcggtatcacgaatcccctcggacaccgtttcagtccgtcaagaccttggcctccgggaaaggcccaagtgactgtgacggcggcgactcgggctcagttctcccccaccccgtggtgccttccctccccgccctacagccaagcccagaggaacagggcatcgcctcgcgcggtcccggagccacatccggacttgggaaccccgtgtcgggcttagaggacttcactgggcgggttggggtttattttcaataaattcagctgttcacatacacccccaccaccatttccacgcgcgcgcgcgcacacacacacacacacacacagagggacttgtcaactattgagacagcgacccagaaaggtgtaaattcacctggtgcccacccaattgcaaagctcccagacccacacaaaacactagcgagccctggaggtctgagacgccccgcgcccgactcacggcgcgaacaccagcgctccggccgggtcgcaggggccggtgcccagcgggccggggtctggcgagccaggcagcgggccggctgagctcctgcgccccgcggtcgcgtggcctactcgcctactcccttattattggctgggacctgttcctttccaaagtgtgatgcccggtgtcctaccctaggccacgcggagctctctcccggcgtgtcgggccctgcgcccctgcccagtggctcacctcggctcgctgcgcccgccttcgccccaagtgcccaggacggagcgaggggctgtgggtcggcgcagggacgctggctgctcacctccaggagccgacagaaggtgccttcggcgtcacgcgtccaaccctggggctgatttaaataactaataagctcagagaaattttacgaggggaacttttc

SEQ ID NO: 118614 - DNA, 259 bp, Homo sapiens
  chr2:200330766-200331025
  Hyper
gggctccccttagttcgtctcgttttatgctgtaagacccaaagtctgctgagggctgcccctgccaggtaacttccggagacccggagttacttggagacagacccggccctttgcacattccaagtgaaggacgtctcgcgcattcttcccagagctaccacacacctaacctcttctggacacccaacagctggggcactggagcacctgaccctactcaagatcatcccccagcccttgccggcacttagggaca

SEQ ID NO: 118615 - DNA, 30 bp, Homo sapiens; identical to SEQ ID NO: 85721
  chr2:200331923-200331953
  Hyper

SEQ ID NO: 118616 - DNA, 100 bp, Homo sapiens
  chr2:200333734-200333834
  Hyper
gaagggactggtctgcgtgcctcaccgggttccccagcctggctccgaggaaaggccgcgcggaggcgagaaagggcccacatctcgagtctccagtctc

SEQ ID NO: 118617 - DNA, 252 bp, Homo sapiens; identical to SEQ ID NO: 85724
  chr2:200334149-200334401
  Hyper

SEQ ID NO: 118618 - DNA, 267 bp, Homo sapiens; identical to SEQ ID NO: 85725
  chr2:200334964-200335231
  Hyper

SEQ ID NO: 118619 - DNA, 989 bp, Homo sapiens
  chr2:200335437-200336426
  Hyper
acaccagtgggtacccggagcagcacccacttggcagaactgatgactgcttgggcccagcggagtgcgcattgcgctaacacgcgcacgggaattgcacccttgccggagcctccgcaccgtgcgcccttcaaagagctggcgaccccgctcacgtgtaagcaacctcccactttgaaactaattcgcacccgggtctttcaccccaaaggactttgctgcggacgctgctctgacccaagacgcgggagagaagtcccaaaggctacagccaggggctgggggactcctctgctcaccttagtccttgatttcgaaggccccaattaactatctgttgtgtcagaatcggcgagtgcaaagtagctgcgccccgctgacgcgctctctcctgggtccgggtatcccagggcatccggagctggggagggttgtgcggactacccaaggcacgcgcagataccgggcagggaagaagggctccgtgttccaaggatggtcgtttacctctcctgagatcagccctaatcccttggtaacttaagcgcctctgaactcggggagcgcttggtggggcgcctccctgcatccacccctacccctggctccttcccaggcccagcatctttcccaccattctcacccccaccacccccacggccccgcccgtttagaggcgtgcggtgggcacttggtttacagaaccggcgtttcagatgtttatttgcaactaatttcttgtgctggaaaatgcttgttacccgggcggagcgcttccgctctgcgcggtccggcccggcgggcggtagctcgctgatccctccggcgaagcctccaaggagcgggcggctgggagaggttgtgccacccgggaccaagccatcggcgctgctccggactcccggtagggggagccgccgcgggcgccaggccggattgtgttctggcctcggggcggccctgctgccagcggccgggactctcagcac

SEQ ID NO: 118620 - DNA, 311 bp, Homo sapiens; identical to SEQ ID NO: 85728
  chr2:200523986-200524297
  Hyper

SEQ ID NO: 118621 - DNA, 159 bp, Homo sapiens; identical to SEQ ID NO: 85729
  chr2:200524603-200524762
  Hypo

SEQ ID NO: 118622 - DNA, 30 bp, Homo sapiens; identical to SEQ ID NO: 85731
  chr2:200699425-200699455
  Hypo

SEQ ID NO: 118623 - DNA, 29 bp, Homo sapiens
  chr2:200775707-200775736
  Hyper
gaaacagggagcttcgtatactcaaaagt

SEQ ID NO: 118624 - DNA, 28 bp, Homo sapiens
  chr2:200818848-200818876
  Hypo
agggtctcaccctctcgcccatgctgga

SEQ ID NO: 118625 - DNA, 588 bp, Homo sapiens
  chr2:201450490-201451078
  Hyper
caatgtttgctaagacgcaagagggtgtgacacagacgctaagcgccactggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccccgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgagcgcccgcgggcttcctctgcccccagacctgcggccagggccggggcagagaggagcccctgccgttcgtcccatcctttcgtgcccgccgtttaaggcactcaggcacggactggctttctcccgtaacagcggctttgccttcgcattcccacccctgcctccggggcagctaaaggctgcgttttcagggactg

SEQ ID NO: 118626 - DNA, 30 bp, Homo sapiens; identical to SEQ ID NO: 85737
  chr2:201652312-201652342
  Hypo

SEQ ID NO: 118627 - DNA, 35 bp, Homo sapiens; identical to SEQ ID NO: 85738
  chr2:202041399-202041434
  Hypo

SEQ ID NO: 118628 - DNA, 65 bp, Homo sapiens
  chr2:202097078-202097143
  Hyper
gaagcaccagaacccggaagagaaatccagtcctctgctaggccttgcaccgtccctctggcgcc

SEQ ID NO: 118629 - DNA, 16 bp, Homo sapiens
  chr2:202490069-202490085
  Hypo
gcgagactccatctcc

SEQ ID NO: 118630 - DNA, 132 bp, Homo sapiens; identical to SEQ ID NO: 85742
  chr2:202897471-202897603
  Hyper

SEQ ID NO: 118631 - DNA, 390 bp, Homo sapiens
  chr2:202899687-202900077
  Hyper
tgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaacc

SEQ ID NO: 118632 - DNA, 234 bp, Homo sapiens; identical to SEQ ID NO: 85746
  chr2:203129128-203129362
  Hypo

SEQ ID NO: 118633 - DNA, 16 bp, Homo sapiens
  chr2:203206750-203206766
  Hypo
ccgtctcaaaaaaaca

SEQ ID NO: 118634 - DNA, 30 bp, Homo sapiens; identical to SEQ ID NO: 85748
  chr2:203231652-203231682
  Hypo

SEQ ID NO: 118635 - DNA, 41 bp, Homo sapiens; identical to SEQ ID NO: 85749
  chr2:203484358-203484399
  Hypo

SEQ ID NO: 118636 - DNA, 37 bp, Homo sapiens; identical to SEQ ID NO: 85755
  chr2:205205376-205205413
  Hypo

SEQ ID NO: 118637 - DNA, 81 bp, Homo sapiens; identical to SEQ ID NO: 85761
  chr2:206546689-206546770
  Hyper

SEQ ID NO: 118638 - DNA, 1451 bp, Homo sapiens
  chr2:206550029-206551480
  Hyper
cagctccccaaaatgcgatctcaagccgtgagctgctcaggctttcaggcggagcaaagcactggcaccctgggagccggcagcgggtggccagggcgaggccaagccacatacctctgactcacccggtgtgcgccggccgggaagggggcctggttcagccgccgccgccggcgacgagaaccaattctgggaaggagcaagatggggcagaaggtgcgcgcgggggagcaactgagcaaataacacggcggtcgcggcgcgcggcaccttgggctggcgcgtggctgggaggccgcatgggcgacgcgcaccaggctgcccctctcctcactgcgccgcctcgccagaccgcagtgcagccgctagcctgcctccctccctgccccgggcgcccccgccagtcccctgcgctccgctctgcgcggcaggctcgccgcgacccctagagagacggctttgagtggcgggaggccgaggccggctggcttgggaatccaagcgctggcccaactaggtgagaggaaactggggtgggatttcggagaggagggcggagagaggcgggaaggaaccagcttgagccccaggaatgcgcgcaacttgcacagcctctagaagcgccgcgcgcccagcgcccgccggtgcgcaggaacaggtgaagagcacgcggcgtgcggccatccacgtggtggggacgtgatagcccctcagctctcctcctagccctccctccccttccccgccccccagcgccttctctaacgccgcatcgatttgtttgggctacgcagcagaaacagagcccagcgatccataaacattctattaagcaaaaatattcccagcgaaagcaaaaccgaggctgaagcctccgcgaagttggccgcctccaactactccatgcttgtgccctcctcctcctcctcctcctaaggacacccccagggaaaagcctgcggcatttcttcaacgctgccctatgccggaaagttaggtctcggctgcagcgctggtctctggagaagcctctgcctgcagccgccggcgagttcccgcctcccctccccagccgcctcgctctttgcttttccacgtgagaaaaagaaatgttcacggccgatgcttcattttcactgattgatttctttttaatatcaacacaagttaatggaggcaaggcgcgctctgattgaagggctgcccccgcccttcgactcgggctggctgtgccgggggtctttcccaccgggtcgcaggcgtccagcggctgggtggcgggcgccggtagccctagtgtttggaggtgggggagggatttggaatagacttgtcgcccctctgggaatcatctgggttggggaaccttcgggaatcagctttccagaccaagttttaggggatcttgcccatatgcgttgcggcttctgcggctccggctgaatttcttc

SEQ ID NO: 118639 - DNA, 187 bp, Homo sapiens; identical to SEQ ID NO: 85766
  chr2:206585987-206586174
  Hypo

SEQ ID NO: 118640 - DNA, 106 bp, Homo sapiens; identical to SEQ ID NO: 39732
  chr2:206757186-206757292
  Hypo

SEQ ID NO: 118641 - DNA, 30 bp, Homo sapiens; identical to SEQ ID NO: 85768
  chr2:206830630-206830660
  Hypo

SEQ ID NO: 118642 - DNA, 30 bp, Homo sapiens; identical to SEQ ID NO: 39733
  chr2:206859091-206859121
  Hypo

SEQ ID NO: 118643 - DNA, 1285 bp, Homo sapiens
  chr2:207139050-207140335
  Hyper
tagctctcttagccccgttttcttttctacattcatacgttgctttgaattggcaagcagtttttatttggaccctcaaacgctaaaaccttggtctctacttcgcgtcccaactgtgcttatgagtctagtcatttttgttggaacgcgatagatttcccaagctccggagtggggccctgaccagggaggaagtgtccgctttaagagcttctggaggggaggaaggggctcctccgcccgggtgggagagtgagtgagtgggtgggcgggcagggggcggtcccgccgctcctgcgtcagaaggggtctggttttcgcaccttccctgacgtcaaacctccatcagggttgcaacgccacgttgccttggatgcctgcgtgagtggagtcgcgactcggggcccgcgtcctgagagacgcgctcccgcgccgcttctcgcctccggaccgcaggggccgaagtcgcctatttctggctccgcgggcagcggggccgtggcgctcggacggtctgggattcgggcgccgccgcggaaccggaataagaagggagagcgcccggctcggtcctcggtctccaccgcggcccggaaggaatccgggcagcctccgcggaggtgagtgccgcggcgggggcggggcgcggccggggcgacgcccgcgggcggggcctgctcgccgggcgcccggggcgccttcttcccgagggacgccaggaccgctcgctgggctcccgcggccgcctcgcaggtcctcggcttccccccaccccgcgtccctttctgcccctgctgcgtgagaggtgtcggcggctccgggccgggatcgaggtggcggggcgagggaaggaggtggggcgcaggctgcattgcgcttctgtccggggccctgggtcagaggggccggcggacgaggcctcgggtccgggcttggggagggggcggtctgcggggtcggattgagggccgggaacccgcggagtcttgcccctgggcacctgtggggccgagatcccgagccacctgtccacacacccccttcccccagtgccctgcgttgggtccagctggccccagacctaggcctttcccagcctcgggcgattatagtttatttgaaaacgtttgatttttgtgttaatgattcttttactaccgccgtgcaacagttgtgtaaatgtggtcgtgttacgccatcgtttttacttgctcctaagaagggccttaccagctcctgcgattatctcacgcgatgattcttggtagctcgtgaaaaaaatgca

SEQ ID NO: 118644 - DNA, 1497 bp, Homo sapiens
  chr2:207307463-207308960
  Hyper
tctgtattgcttccccgccagaatgtcgaagtccttcccgaatatgcccagtcatactttctgaacttttgagcaaacaccgtccggcttcttgtgctttcctcaaagaccccaggcaccggcagggaggacacaggccggggcagagcgcccctgcgcgggggattcctgccactccgcgccagcctgcggcgcaaacgctcttctcagccgcagtcccacccgctgctggcaatctgaatgaggagccgcgctatttttacctccccggctgcaatcctttatatttacatgcaggaagcaaatatataagggattaagaaggagatgcgtggccttagtttatccagagcaggaagaggttggaataggagagggtatgtgaagtctggggtggtggaaaaggcaggtggacttcggctggttgttttctcccgatcatccctgtctctggcctggaaacccccgtactctctttcttctggcttatccgtgactgccggctccccctccaccgcccccatcttttgaggtaccacccgtcacctccgatgctgcttgggctgctgcatcactctgctgctttacccccttccccgccccccaacaaagcatgcgcagtgcgttccgggccaggcaacagcagcagcacagcatccagcaacagcatcagcacccgaagccccgctcgggcgcgctctcggggggcggggcgcacgcccgctccgcgcgtccccgcgccgctcgctcccgcgcgtccccgcgccgctcgctcccgcgcgccgcctcagcatcctcaggcccggcggcagcccccgcagtcgctgaagcggccgcgcccgccgggggagggagtagccgctggggaggctccaagttggcggagcggcgaggacccctggactcctctgcgtcccgccccgggagtggctgcgaggctaggcgagccgggaaagggggcgccgcccagccccgagccccgcgccccgtgccccgagcccggagccccctgcccgccgcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcggtgggtatggccccgtgccctttgcgttggctttcccgcggggccctgcagaggaaagcgaagggcgcgcgggtccgtgtgctccgggcttgtccccggctcggcctttccttccctccctgcctgtctttccacccttctcgttcccaaaccccc

SEQ ID NO: 118645 - DNA, 39 bp, Homo sapiens; identical to SEQ ID NO: 85774
  chr2:207309199-207309238
  Hyper

SEQ ID NO: 118646 - DNA, 30 bp, Homo sapiens; identical to SEQ ID NO: 85775
  chr2:207398286-207398316
  Hypo

SEQ ID NO: 118647 - DNA, 619 bp, Homo sapiens; identical to SEQ ID NO: 85776
  chr2:207506691-207507310
  Hyper

SEQ ID NO: 118648 - DNA, 107 bp, Homo sapiens; identical to SEQ ID NO: 39735
  chr2:207557814-207557921
  Hypo

SEQ ID NO: 118649 - DNA, 514 bp, Homo sapiens; identical to SEQ ID NO: 85778
  chr2:208029820-208030334
  Hyper

SEQ ID NO: 118650 - DNA, 106 bp, Homo sapiens; identical to SEQ ID NO: 85779
  chr2:208031833-208031939
  Hyper

SEQ ID NO: 118651 - DNA, 58 bp, Homo sapiens; identical to SEQ ID NO: 85780
  chr2:208140340-208140398
  Hypo

SEQ ID NO: 118652 - DNA, 87 bp, Homo sapiens; identical to SEQ ID NO: 27827
  chr2:208546197-208546284
  Hyper

SEQ ID NO: 118653 - DNA, 240 bp, Homo sapiens; identical to SEQ ID NO: 85782
  chr2:208574906-208575146
  Hypo

SEQ ID NO: 118654 - DNA, 30 bp, Homo sapiens; identical to SEQ ID NO: 27828
  chr2:208633276-208633306
  Hyper

SEQ ID NO: 118655 - DNA, 153 bp, Homo sapiens; identical to SEQ ID NO: 85784
  chr2:208635621-208635774
  Hyper

SEQ ID NO: 118656 - DNA, 30 bp, Homo sapiens; identical to SEQ ID NO: 85789
  chr2:208694549-208694579
  Hypo

SEQ ID NO: 118657 - DNA, 24 bp, Homo sapiens
  chr2:209094651-209094675
  Hypo
gatgcaggctgggggcggtggctc

SEQ ID NO: 118658 - DNA, 234 bp, Homo sapiens; identical to SEQ ID NO: 85791
  chr2:209225159-209225393
  Hypo

SEQ ID NO: 118659 - DNA, 352 bp, Homo sapiens
  chr2:209271264-209271616
  Hyper
ctggaagacccagggcgcccctagagacagggccctggaacccgggacagagtggagggaagcagaaacattgcgaatcgggggtggcggcagcagcgacatgagatcctttgccctccgccccctgggctgcgggacccagtgacttcgaggaggagcgcgagcgcagccgcgcggggcgcacccggatccgcctggggcgggagccgcccccttcccgccgcaggcggcgcggggctgcgagtcaagtccaggactcgggccagtctctccggaagacaagaccaacctcgcgccgcggcgcagcagcacgcgggttctgagaagcgcgtggctccggcgacaagacccc

SEQ ID NO: 118660 - DNA, 20 bp, Homo sapiens
  chr2:209313347-209313367
  Hypo
gaatccgtctcaaaaaaaaa

SEQ ID NO: 118661 - DNA, 197 bp, Homo sapiens; identical to SEQ ID NO: 85794
  chr2:209876323-209876520
  Hypo

SEQ ID NO: 118662 - DNA, 30 bp, Homo sapiens; identical to SEQ ID NO: 85796
  chr2:210359777-210359807
  Hypo

SEQ ID NO: 118663 - DNA, 733 bp, Homo sapiens
  chr2:210636329-210637062
  Hyper
ctcctgagtgcagctcggagcggggaaagccgaattccgggggctgaagaggccgcgcaggggacgagcgcctgcgatgcggagcgtggacttcttgggccgtacccctgcggctcaagctgccccggattcgcttctccggccgtgcagcccggcgcgggccgctgtccacagtgggaggtgctgaaagcagggagcgggtgcgggggcggcgaggcggaccgctgctccgagcgcccccctcctcgctccgcggctcctccagccctcccctcctcccgcagccatgttccacgcgcggggaggggtggggggaggggagaggcacgggggatcagggcggagagagccggctctgcctcggggaaggaggggatgagagttgggagcagcgggaggaggcggcggcggcggctagcgaggagacagagctgggtcctgcagtaggactcccgggagccaccattatggtgaagaggaagagctccgagggccaggagcaggacggcggccgcggcatccccctgcccatccagaccttcctgtggcggcaaaccaggtgaggggcgcagagggcgcaccgcgggccgccctgggctgggggcgctcctggggccgcccgggtcgccgctgccgccgccgccgctgaggccgcgccacagcctgcagctccctctctggggctggaaaacaagccctctgcaccagcttaaaaacacgcattaaaatatgt

SEQ ID NO: 118664 - DNA, 564 bp, Homo sapiens
  chr2:211089509-211090073
  Hyper
acacagatcgcagcccgcgctcctgcagccgggcccagggggtgaccacctcctcccaaaacgcaggctcccgggtcccactgcaggccgctgaactagacgggttggattggggctccggaatgaacttctggagaaatctttcggctttccccgacgtgggctcggcggtctgttctcggggcggcacggctgacacccctttttcctccgcccagatgctggttgcacccagtccgcgggatccaggaaaggaggccagctctagcccggcgccggagttggggagcactcccagccgcgcgcgcaccgccctgcttcaagccagcgacaggagtgactcgctgccccaccccacagcctcccggcctgcagccgcggaagtcccggctggcactcaccgcgcggcgggcagctggcgcggcgcacggtggccgcccaggacgcgtagggaccctcggagaaggcgtgcggccatgtccgaaacacaggggcggcggggcgacggaggcgactctgcggctactcggcgactcggggcagggtccccgggagggaggacga

SEQ ID NO: 118665 - DNA, 831 bp, Homo sapiens
  chr2:213401179-213402010
  Hyper
tgaacaagtgaggctcgcctttgtgcccccagaatttcaagtacagagtcacacacggaacaacaatggcacgctaatcctcgcgctctaaatgggctcacttgtgggtctgacaattcgcccagggaaacgagaagagacgaagcgagggcgcgagctagtgtcgcctgagacgaggaagaggacagctgcagaactaatttggattacattccttgcagaaattctgaaaagggcttttcggcatagctcaactcggagccgcacagttaataccaaattgctgcggactcggagcggggtcccccagtggcagaggctgaaccagacagcccccagtaggtcgcctcgtagaaattcctctcggctaagcctgcatgtcggtcgccaatgcctttgaatgggtcaatgtgcataatcaacccattgagggaaaatatgaagggactcgaagtggggagggagataaaaagagatgtatctaagaggccgcttggaatgtcaagtccgtgttggtgtgattccggaggtggctggagcgcgggacctggtatgcgtgaagaatttcggagtaattgggagggtgcaaacggccagcacaaacgcctcacatgtgccattcgaaggtcattttgaaagactcgataattgtaacttgttatttactaggcaaaggaggcggcggcggcggcggcggcggagcgggaaaactacagctagccgttttcttggtgaggtcagaaggacaccctccgggggcctaaagcgctccctatcgccactcccgggggctttatcacctcaagctacttcccacgctccagtcaccat

SEQ ID NO: 118666 - DNA, 1402 bp, Homo sapiens; identical to SEQ ID NO: 85806
  chr2:213402608-213404010
  Hyper

SEQ ID NO: 118667 - DNA, 16 bp, Homo sapiens
  chr2:213586068-213586084
  Hypo
ccggcctgccactcta

SEQ ID NO: 118668 - DNA, 175 bp, Homo sapiens; identical to SEQ ID NO: 39740
  chr2:214080302-214080477
  Hypo

SEQ ID NO: 118669 - DNA, 79 bp, Homo sapiens; identical to SEQ ID NO: 85809
  chr2:214149050-214149129
  Hyper

SEQ ID NO: 118670 - DNA, 30 bp, Homo sapiens; identical to SEQ ID NO: 85810
  chr2:216162594-216162624
  Hypo

SEQ ID NO: 118671 - DNA, 209 bp, Homo sapiens; identical to SEQ ID NO: 85811
  chr2:216300169-216300378
  Hyper

SEQ ID NO: 118672 - DNA, 197 bp, Homo sapiens; identical to SEQ ID NO: 85812
  chr2:216300975-216301172
  Hyper

SEQ ID NO: 118673 - DNA, 370 bp, Homo sapiens; identical to SEQ ID NO: 85813
  chr2:216301417-216301787
  Hyper

SEQ ID NO: 118674 - DNA, 243 bp, Homo sapiens
  chr2:217236010-217236253
  Hyper
cacccctgctgcagtcggcaaatccgtggcgccctcccctcggttccatcaaaggtcccttcggtcgaggggcaagagccgagagaagggcaggtccgggcgggcgagtggcctcgccttctcctcctcttcctcctctgggtcgcggtcgccctcctcctccggctccgggtcggcccgcgcccgcagctgctgctgcggcggcggaggcgactgctgctcggcgtccgggtgtctccgggg

SEQ ID NO: 118675 - DNA, 41 bp, Homo sapiens; identical to SEQ ID NO: 85818
  chr2:217236563-217236604
  Hyper

SEQ ID NO: 118676 - DNA, 201 bp, Homo sapiens; identical to SEQ ID NO: 85819
  chr2:217236943-217237144
  Hyper

SEQ ID NO: 118677 - DNA, 699 bp, Homo sapiens
  chr2:217497788-217498487
  Hyper
cggccacaggggaagcgcgcaaacgaagtcctcgcgaactgaactgagagcagacaaaagcacgcgctcttctccaccgccacgccggtcctacccaaacccgcgagttatccgtattctccttcaggagtcatagtcaggccagaagagtgcggagggacggggcccgggaagagcagggaacccccagagcccgcagccaacgcggaggtgggcgagcgggcgtgcgcgcactcacttgccggcgcgagggagtgtcgggggggaagggagtggtctccaaaagggggaggggagaaggcagggggcggggagaagccggccctttaggacccggctgcggcggcgagggaggaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccggg

SEQ ID NO: 118678 - DNA, 49 bp, Homo sapiens; identical to SEQ ID NO: 85822
  chr2:217556962-217557011
  Hyper

SEQ ID NO: 118679 - DNA, 71 bp, Homo sapiens; identical to SEQ ID NO: 27846
  chr2:217557250-217557321
  Hyper

SEQ ID NO: 118680 - DNA, 652 bp, Homo sapiens; identical to SEQ ID NO: 85824
  chr2:217558904-217559556
  Hyper

SEQ ID NO: 118681 - DNA, 173 bp, Homo sapiens; identical to SEQ ID NO: 85825
  chr2:217675049-217675222
  Hypo

SEQ ID NO: 118682 - DNA, 152 bp, Homo sapiens; identical to SEQ ID NO: 85826
  chr2:218339252-218339404
  Hypo

SEQ ID NO: 118683 - DNA, 30 bp, Homo sapiens; identical to SEQ ID NO: 85827
  chr2:218664369-218664399
  Hypo

SEQ ID NO: 118684 - DNA, 30 bp, Homo sapiens; identical to SEQ ID NO: 85828
  chr2:218665208-218665238
  Hypo

SEQ ID NO: 118685 - DNA, 48 bp, Homo sapiens; identical to SEQ ID NO: 85829
  chr2:218697889-218697937
  Hypo

SEQ ID NO: 118686 - DNA, 213 bp, Homo sapiens; identical to SEQ ID NO: 85830
  chr2:218806147-218806360
  Hyper

SEQ ID NO: 118687 - DNA, 37 bp, Homo sapiens; identical to SEQ ID NO: 85831
  chr2:218874667-218874704
  Hyper

SEQ ID NO: 118688 - DNA, 16 bp, Homo sapiens
  chr2:218955815-218955831
  Hypo
cttttttttttgagac

SEQ ID NO: 118689 - DNA, 314 bp, Homo sapiens
  chr2:219232545-219232859
  Hyper
ggacgtggtcaccttcgccgccgagttcttcggccccttcgacccgtggcgtccgtcgtcaccggccttgggctcctcccaccggcccaaccctttccgctccctggagccggagggagacgcccgctcgggggcggcctaagcggggcccaggcccggacagggcaggaaaccaggggtcgggctgggacgcgggcgggacgcgccggggcgggtgcgctttccgggctgcggttttgggggaataaatggggccctcccgcttctctgcagcgcccgtcgacagcgtccctggctagcgtctagtgtctcgg

SEQ ID NO: 118690 - DNA, 92 bp, Homo sapiens; identical to SEQ ID NO: 85836
  chr2:219250043-219250135
  Hypo

SEQ ID NO: 118691 - DNA, 30 bp, Homo sapiens; identical to SEQ ID NO: 39743
  chr2:219251809-219251839
  Hypo

SEQ ID NO: 118692 - DNA, 96 bp, Homo sapiens; identical to SEQ ID NO: 85838
  chr2:219253096-219253192
  Hypo

SEQ ID NO: 118693 - DNA, 36 bp, Homo sapiens; identical to SEQ ID NO: 85839
  chr2:219255964-219256000
  Hypo

SEQ ID NO: 118694 - DNA, 23 bp, Homo sapiens
  chr2:219282664-219282687
  Hypo
aaactccaggtgggccgggtgca

SEQ ID NO: 118695 - DNA, 185 bp, Homo sapiens; identical to SEQ ID NO: 39744
  chr2:219284495-219284680
  Hypo

SEQ ID NO: 118696 - DNA, 39 bp, Homo sapiens; identical to SEQ ID NO: 85842
  chr2:219294028-219294067
  Hypo

SEQ ID NO: 118697 - DNA, 203 bp, Homo sapiens; identical to SEQ ID NO: 85843
  chr2:219431996-219432199
  Hypo

SEQ ID NO: 118698 - DNA, 34 bp, Homo sapiens; identical to SEQ ID NO: 85844
  chr2:219586056-219586090
  Hypo

SEQ ID NO: 118699 - DNA, 30 bp, Homo sapiens; identical to SEQ ID NO: 39746
  chr2:219611841-219611871
  Hypo

SEQ ID NO: 118700 - DNA, 399 bp, Homo sapiens
  chr2:219646417-219646816
  Hyper
atgactggcccccctcgctccgaactgactccgggatcaatccggaaggccattgggagaagccgagggcagcttagccacggccggttcccgttccctccaggacgcgagggtcgccttgggtggggaaccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcg

SEQ ID NO: 118701 - DNA, 117 bp, Homo sapiens
  chr2:219647021-219647138
  Hyper
ggccaccggagctcccggagccgggcctggtgtccggcggcggcaacggagcttagaggagattccacgtctaggacagctgcgcttcttctttcagctgttcgttcaaggctatgc

SEQ ID NO: 118702 - DNA, 252 bp, Homo sapiens; identical to SEQ ID NO: 85846
  chr2:219723919-219724171
  Hyper

SEQ ID NO: 118703 - DNA, 361 bp, Homo sapiens; identical to SEQ ID NO: 85847
  chr2:219724722-219725083
  Hyper

SEQ ID NO: 118704 - DNA, 30 bp, Homo sapiens; identical to SEQ ID NO: 85848
  chr2:219725453-219725483
  Hyper

SEQ ID NO: 118705 - DNA, 820 bp, Homo sapiens; identical to SEQ ID NO: 85849
  chr2:219735785-219736605
  Hyper

SEQ ID NO: 118706 - DNA, 35 bp, Homo sapiens; identical to SEQ ID NO: 85850
  chr2:219745580-219745615
  Hyper

SEQ ID NO: 118707 - DNA, 49 bp, Homo sapiens; identical to SEQ ID NO: 85851
  chr2:219757965-219758014
  Hyper

SEQ ID NO: 118708 - DNA, 108 bp, Homo sapiens; identical to SEQ ID NO: 85852
  chr2:219773253-219773361
  Hypo

SEQ ID NO: 118709 - DNA, 230 bp, Homo sapiens; identical to SEQ ID NO: 85853
  chr2:219773687-219773917
  Hyper

SEQ ID NO: 118710 - DNA, 104 bp, Homo sapiens; identical to SEQ ID NO: 85854
  chr2:219823873-219823977
  Hyper

SEQ ID NO: 118711 - DNA, 239 bp, Homo sapiens; identical to SEQ ID NO: 85855
  chr2:219824213-219824452
  Hyper

SEQ ID NO: 118712 - DNA, 1153 bp, Homo sapiens
  chr2:219824786-219825939
  Hyper
aggtgacacccaagccggcatccacgggccccgaccccctggtccagcaacgcaaccgcgagaaccttctccgcaagggccgggatccccccgacggcggcggcaccgccaagcccctggcggtgccagtgcccaccgtgcccgcggctgccgccacctgcgagccaccgtcggggggcagcgcggccgctcagccgccgggctcgggcgggggaaagcctccgccgccgcctcccccagccccgcaggtggcgccgccggtgcctggcggctcgccgcggcgggtcatcgtgcaggcgtccaccggcgagctgctgcgctgtctgggcgacttcgtgtgccgacgctgctatcgcctcaaggagctgagcccgggcgagctggtgggctggttccgcggtgtggaccgctcgctgctgctgcagggctggcaagaccaggccttcattacgcctgcaaacctggtgttcgtgtacctgctgtgccgcgagtcgctgcgtggggacgagctggcgtcggccgccgagctgcaggccgccttcctcacctgcctctacctcgcctactcctacatgggcaacgagatctcctacccactcaagcccttcctcgtggagcccgacaaggagcgcttctggcagcgctgcctgcgcctcatccagcggctcagcccgcagatgctgcggctcaacgccgacccccacttcttcacgcaggtctttcaagacctcaagaacgagggcgaggccgccgccagcggcgggggcccaccgagcgggggcgcgcccgccgcctcctcggccgccagggacagctgcgcggccggaaccaagcactggactatgaacctggaccgctagggatacccaggggccgcgcccatcccccgccccagcccctgacacacactcggaccccccgggaccacaaagccaccgccgctgttaccgccgctcagcgccccggctgggcggaggaggagacgcccatgcccctcaggggaaagtggagaccgggacaccagaggccgcggtgtttggatttgctgggcgtggagtggggacggaagatgagcgcgggaaaggcactccaacctcactcttcccgtctgtctgcgcccccatttctccatttctgccggggtctccccctt

SEQ ID NO: 118713 - DNA, 196 bp, Homo sapiens; identical to SEQ ID NO: 85858
  chr2:219826727-219826923
  Hyper

SEQ ID NO: 118714 - DNA, 237 bp, Homo sapiens; identical to SEQ ID NO: 85859
  chr2:219827646-219827883
  Hyper

SEQ ID NO: 118715 - DNA, 1219 bp, Homo sapiens
  chr2:219846397-219847616
  Hyper
atggccccccaagtgcgaggctgcggccacggccccgaagggcccgggcgggggctgcaagctgggactggggtagagcgcggcggtggcggcggcagcggtggcggcggggcccgggcccggccagtaggagaagccggcgggcgcgaccccggccgaggcggccatgaggttgagtttggagaggccggggaagggcagcggggcgaggccggcgggcagcttgtagagcgcgccgtcctgggcggccgcggcggcggcagcagctgcggcggcggcatgagcgtgcgcgggcggcggctggcaggcctgcgccaggccctggaagtcgaagcggtaggcgtagcgcttgccatgcaccttgctcatgatgttcttgtcgtagtagtagcgcagggcgcggctcagcttgtcgtagttcatgttgggcttgctcttgcgctcgccccaccgccgcgccacctcgtccgggtccgtgagcttgaactcgccgtgaccgccctcccacgcgatgcagccggcgttcgcgcggtcagccagcagctccagcagaaactgccacagctggatctgtccgctgcctgtggggaggggggcggtcagccacaggcgggagcggggaggcgggaactggggaagagtgctggcgggaaactgacccaccccggcaggaaccggcactgggggaggaaaagtgcaagtcaaactgcagctgcgttcggcgggagaggccggccccggaggggctgatcagcagagtggtgtgtagccttaccgcgcttttgcacaatggaaatgcggcttccactgaagagcacgtagctttccagatgcacggttttgtggaacttgggggttggggggaaggggaagcattgcctccccccacgtgagcgcagcggcgcaccaaggcacttggctttccaaggcgagcaaggacagatatccgccgccactctccatctcagccgggcgcccttatttagggaaaagacgcacaaccgtacagggcggccttgggcagaatgatcggactgccccatcccagctggaccacatccagaggtgggaagggacaggcgtgcagcaggacgaccccaaccactgctggacaaggcccagctagtcccgagtccccaaagacgtagttggacaggctactcctgaggtggagtggtggctggctcccttgggacaccacatccgacaggagtaggaa

SEQ ID NO: 118716 - DNA, 668 bp, Homo sapiens
  chr2:219848809-219849477
  Hyper
tcttcccaaggcctccgcacaaccaggccaggactccgggcttcagtgtgaaccctgggtccacactgctcccacctactgtccgcctgtgccctgaccccaaccaacctcgcctccgccgcccagcgcgccggccatctcacctttctgaaccgcggggctcagcggcccccagctcgggttcttcccgtccttgaagagaccgtctccgacgggatctgcaagcagcagaagaaaagaatcaggagaaccccgggcggaagttgtgggcttgacaaaagggccccgggccaaggcttaaggggggtgctgtggtccccaggcgcgaggctgggggcccgggccacccggctcctcctcccggagcctggtccaggcgcgctgcgcggagcccctccatagagcccaagtcaggaaacgcgtccaggaaaaaggaaatccgctttccgaaggggccggctggagccttataaagccgagcggggaactgcgccagccgagctggagcgcgaagagaagaggagggtgcctggagggccggcctgaagctcgtagcaggaaggtgaggagccgtgagagcgcaggggagacgcccgcggaccacagccttctggtacggctcggccacagagtactccaccacgccagagacccgtgcttcccctctc

SEQ ID NO: 118717 - DNA, 414 bp, Homo sapiens; identical to SEQ ID NO: 85865
  chr2:219849858-219850272
  Hyper

SEQ ID NO: 118718 - DNA, 30 bp, Homo sapiens; identical to SEQ ID NO: 27865
  chr2:219850482-219850512
  Hyper

SEQ ID NO: 118719 - DNA, 742 bp, Homo sapiens
  chr2:219857726-219858468
  Hyper
caatcactcacacgccgttttccaccttgaccgagcgcaccctgggcaggcctccgcgctcgcagacgttcgcacagtcgcttagcagccgacagcgacggccctggaagtcctcctcgtcccagagcgtgaggctggcgggcgccgggcccggcgcgggggcgctgctcatgccgctgcggacaggaagggtggcaccacgcgctcagcgtctcaagagccccgtttcgagccacacacagcctgcccaacctgggtagcggatgaagaacccgggggctggacccggcctagctctggacccggctgccaggggctcgcagtcttcccgcgctcccctcccttccccaccccagcagagggcattcaccgggtgggtgagcgcggcacgcgagggaaatggaccggctgcgaggctgcgcgcggccgggcgggccgagctttatacctgggccttgtccccctgtccgcaccctttccctcgggggtggggtcgctgagtcagcaggcaggctgcggtcggctctggtctccgctggggagccgaggcctctcccgcagccgccgctgtggccccagcccgcgggaaagacaacagaaagtgctgaggcgcgcaccccgcgcccgccgcagcccaggctgactccgcgctttctttctttccagcctgagccaggcagggcacgccaggcctcggggcagaacgcgccctccctgtcccggccctcggggacgaagggac

SEQ ID NO: 118720 - DNA, 36 bp, Homo sapiens; identical to SEQ ID NO: 85869
  chr2:219858715-219858751
  Hyper

SEQ ID NO: 118721 - DNA, 245 bp, Homo sapiens
  chr2:219866368-219866613
  Hyper
ctcacgcgagccgaacgaacaaaacgctcaggtccggtttgtgcgaggggctcgtcgcggggcgggagcggagggcccggggcctggcggtcgccctcggtgatctcctggtcctggtcttccgcgagctcagtgctgcacagcgccccgctagcctccgccctcacctgaacgcatctgcggctgacacgtcggcggccgcggcggccaccgcaggtgcgcacctggcccgcccctcctttccc

SEQ ID NO: 118722 - DNA, 430 bp, Homo sapiens; identical to SEQ ID NO: 85871
  chr2:219867582-219868012
  Hyper

SEQ ID NO: 118723 - DNA, 98 bp, Homo sapiens; identical to SEQ ID NO: 85872
  chr2:219923137-219923235
  Hyper

SEQ ID NO: 118724 - DNA, 42 bp, Homo sapiens; identical to SEQ ID NO: 85873
  chr2:219923695-219923737
  Hyper

SEQ ID NO: 118725 - DNA, 30 bp, Homo sapiens; identical to SEQ ID NO: 27869
  chr2:219924566-219924596
  Hyper

SEQ ID NO: 118726 - DNA, 465 bp, Homo sapiens; identical to SEQ ID NO: 85875
  chr2:219925148-219925613
  Hyper

SEQ ID NO: 118727 - DNA, 315 bp, Homo sapiens; identical to SEQ ID NO: 85876
  chr2:219925828-219926143
  Hyper

SEQ ID NO: 118728 - DNA, 197 bp, Homo sapiens; identical to SEQ ID NO: 85877
  chr2:220080662-220080859
  Hypo

SEQ ID NO: 118729 - DNA, 87 bp, Homo sapiens; identical to SEQ ID NO: 85878
  chr2:220083558-220083645
  Hyper

SEQ ID NO: 118730 - DNA, 30 bp, Homo sapiens; identical to SEQ ID NO: 85879
  chr2:220096000-220096030
  Hypo

SEQ ID NO: 118731 - DNA, 30 bp, Homo sapiens; identical to SEQ ID NO: 85880
  chr2:220150841-220150871
  Hypo

SEQ ID NO: 118732 - DNA, 30 bp, Homo sapiens; identical to SEQ ID NO: 85881
  chr2:220161540-220161570
  Hypo

SEQ ID NO: 118733 - DNA, 47 bp, Homo sapiens; identical to SEQ ID NO: 85882
  chr2:220173293-220173340
  Hyper

SEQ ID NO: 118734 - DNA, 572 bp, Homo sapiens
  chr2:220173772-220174344
  Hyper
ccctttcctccgagacgccctctcaccttcctcatctcgcatgcctcccccaacccatattctccccgagcttcatgacatttcaccctcacccccaccgagtttcgctccaggccccaagctgctccccgccccccaccacccgccagcccaagtttcctcctgaccgtgggcactaacggcgctgcagccccccgggcggctgctcagcagcaggaggcagaggagcagccggagacccccggatcccccgagacccccaggccgccgcgggcgccgcatctttccgagctccgggcgctcgctcccgggccggagccgcagcgacgctggcgggagcctgccagaggggctgaggcggggcttgccgctccccacctccctacgaggcggggtctacatgcccctctcgctgcaacgcggccaaccgcaggcgggtgctgacgacacctccacccccggctcgtaagctaatttgcgtcacatatggcgtaagagccctgtcggagcgggggacctacctagcccatccctcctccatcaaatagtaggcgcctcgctagaattcccac

SEQ ID NO: 118735 - DNA, 41 bp, Homo sapiens; identical to SEQ ID NO: 85885
  chr2:220180029-220180070
  Hypo

SEQ ID NO: 118736 - DNA, 481 bp, Homo sapiens; identical to SEQ ID NO: 85886
  chr2:220196354-220196835
  Hyper

SEQ ID NO: 118737 - DNA, 413 bp, Homo sapiens; identical to SEQ ID NO: 85887
  chr2:220197187-220197600
  Hyper

SEQ ID NO: 118738 - DNA, 870 bp, Homo sapiens
  chr2:220222920-220223790
  Hyper
ccccgctgtcatcagcgctgacgccctggacccacacagcggcggggtttggtttgacgtggctcccaaaggcgagggcggagctggggaaggtgagagcacccaggcatccgcacaggcgtgaccctctgcccaccaggcaccctgcccacacagcgcgccgcaggaagccctccgcattggtgtccaagctcgagcaccaggtggaggaacccgtggccatcgggtgtggggtgtgcagggtgcggagaaggctaggattcctcccaatcctctgctgcgccctcccccagccgcctccccaggttgaggggaggccccggcccaggactgggctcttcccgaggtggggactggatgcccgcgctccggactcctgccggagatgccaaccccccagcgctgggcaccttgccttgacccctcagcgcgtctcacatggcccggatctcggtcccttgggcactccctcttgcccaactccgaattggagttcttgtagttctagtttccaccccgtcttccgacgtttaagaccccgcttccaagacgccctctggctttctcttcccatcccgcacacttccctagcttctgagctgtgtgcacccaccaacccgcagccctccctcaggatcgcccctgcccttcccccaggtttcctcctgacggtggggactaatggcgtcccagccccccgggcggctgctcagcagcaggaagcagagaatcagaggcacccccgctgggccccgagccccatgcgcgcgcaggggcccccgcatcttgttgggcgcgcgctgccccgcctgcaccgcagcgaccgcggccagagccaggccaggcggctctgcgcgtccctctctccgc

SEQ ID NO: 118739 - DNA, 687 bp, Homo sapiens
  chr2:220283066-220283753
  Hyper
ggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccactcggctccccgctgagttcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggct

SEQ ID NO: 118740 - DNA, 668 bp, Homo sapiens
  chr2:220299468-220300136
  Hyper
tgccccctccctccacggctccctcgcaacccgagccggggggcctaaaaatagcccccaggcgcaatcgccggccgccccggtgaccttctgggtagcacaggccgaaggcgggcgggcagcaggaaggcaggccgccggccccccagacttgtctcctagggcaccgtcccgcgggtgcccccgtggccgcccagttccggcgtccccccagcccagctctcagtggccatgcagaaagcccggggcacgcgaggcgaggatgcgggcacgagggcaccccccagccccggagtgcccccgaaaagggccaaggtgggggccggcggcggggctcctgtggccgtggccggggcgccagtcttcctgcggcccctgaagaacgcggcggtgtgcgcgggcagcgacgtgcggctgcgggtggtggtgagcgggacgccccagcccagcctccgctggttccgggatgggcagctcctgcccgcgccggcccccgagcccagctgcctgtggctgcggcgctgcggggcgcaggacgccggcgtgtacagctgcatggcccagaacgagcggggccgggcctcctgcgaggcggtgctcacagtgctggaggtcggaggtaaagggcaggtgggggccgcgcccggcaggggcggggtgctcagagg

SEQ ID NO: 118741 - DNA, 30 bp, Homo sapiens; identical to SEQ ID NO: 85895
  chr2:220309719-220309749
  Hypo

SEQ ID NO: 118742 - DNA, 33 bp, Homo sapiens
  chr2:220313798-220313831
  Hyper
tcctgccctgggccacgccgggcctggagggcg

SEQ ID NO: 118743 - DNA, 41 bp, Homo sapiens; identical to SEQ ID NO: 85896
  chr2:220316287-220316328
  Hypo

SEQ ID NO: 118744 - DNA, 803 bp, Homo sapiens
  chr2:220348994-220349797
  Hyper
agagcccaagccccacgctgctgtctttgccagggtggcctccccacctccgggagcccccgagaagcgcgtgccctcagccgggggtcccccggtgctagccgagaaagcccgagttcccacggtgccccccaggccaggcagcagtctcagtagcagcatcgaaaacttggagtcggaggccgtgttcgaggccaagttcaagcgcagccgcgagtcgcccctgtcgctggggctgcggctgctgagccgttcgcgctcggaggagcgcggccccttccgtggggccgaggaggaggatggcatataccggcccagcccggcggggaccccgctggagctggtgcgacggcctgagcgctcacgctcggtgcaggacctcagggctgtcggagagcctggcctcgtccgccgcctctcgctgtcactgtcccagcggctgcggcggacccctcccgcgcagcgccacccggcctgggaggcccgcggcggggacggagagagctcggagggcgggagctcggcgcggggctccccggtgctggcgatgcgcaggcggctgagcttcaccctggagcggctgtccagccgattgcagcgcagtggcagcagcgaggactcggggggcgcgtcgggccgcagcacgccgctgttcggacggcttcgcagggccacgtccgagggcgagagtctgcggcgccttggccttccgcacaaccagttggccgcccaggccggcgccaccacgccttccgccgagtccctgggctccgaggccagcgccacgtcgggctcctcaggtg

SEQ ID NO: 118745 - DNA, 206 bp, Homo sapiens
  chr2:220361419-220361625
  Hyper
gtttaggggtctggccggtccagggggcaggtaggagatggtgcgctcgcggtaagggctgtggccgggcctgtcttaggaactctgggccctgactcggcccgcgggtaggtcccggaaggagctgcgcgagaaggggccgccgcgggtgctggagccgctgaaggacgtggtgctgatcgaaggcagcgcggccaagctcactt

SEQ ID NO: 118746 - DNA, 523 bp, Homo sapiens
  chr2:220361826-220362349
  Hyper
tcctcgtggaaggtacgcgcgccccgggcgcagcgccagggcgcagaccagcaccactcagccagagcccgcagcccggtccagctgcgcgtgtttacctctgggcctagctacagggtccccgccagcccagctctgggcacggcctggggcgcatcgccgcgccagccaagtgcgtccttccctacctcgggatccagctccacccgggctgagcagtcagctgtggacttccatcacgcggctccgggtccccaaggtcacacagcaagccagaggcagagccagggttggacccgggtcttctggctcccaactctggcaatttccactacccggagcggtctctgaggcaccgcgagatgtgtgaacattcaggggctttcgcccgccttatctctcttgatcctctattcgaccccgagaagtaggagaggcagggataagtccctttaacagccaaggagatgaaaccagagaggctaatgatttgctcaacgtcacactgcgagtttaaatgcat

SEQ ID NO: 118747 - DNA, 67 bp, Homo sapiens; identical to SEQ ID NO: 85901
  chr2:220362553-220362620
  Hyper

SEQ ID NO: 118748 - DNA, 246 bp, Homo sapiens; identical to SEQ ID NO: 85902
  chr2:220379093-220379339
  Hyper

SEQ ID NO: 118749 - DNA, 38 bp, Homo sapiens; identical to SEQ ID NO: 85903
  chr2:220383596-220383634
  Hypo

SEQ ID NO: 118750 - DNA, 42 bp, Homo sapiens; identical to SEQ ID NO: 39750
  chr2:220384416-220384458
  Hypo

SEQ ID NO: 118751 - DNA, 267 bp, Homo sapiens; identical to SEQ ID NO: 85905
  chr2:220387586-220387853
  Hyper

SEQ ID NO: 118752 - DNA, 1406 bp, Homo sapiens; identical to SEQ ID NO: 85906
  chr2:220416306-220417712
  Hyper

SEQ ID NO: 118753 - DNA, 865 bp, Homo sapiens; identical to SEQ ID NO: 85907
  chr2:220435389-220436254
  Hyper

SEQ ID NO: 118754 - DNA, 92 bp, Homo sapiens; identical to SEQ ID NO: 85908
  chr2:221861740-221861832
  Hypo

SEQ ID NO: 118755 - DNA, 24 bp, Homo sapiens
  chr2:222034371-222034395
  Hypo
gcgagactccgtctcaaaaaaaaa

SEQ ID NO: 118756 - DNA, 84 bp, Homo sapiens; identical to SEQ ID NO: 85910
  chr2:222435773-222435857
  Hyper

SEQ ID NO: 118757 - DNA, 984 bp, Homo sapiens; identical to SEQ ID NO: 85911
  chr2:222435977-222436961
  Hyper

SEQ ID NO: 118758 - DNA, 54 bp, Homo sapiens; identical to SEQ ID NO: 85912
  chr2:222437367-222437421
  Hyper

SEQ ID NO: 118759 - DNA, 30 bp, Homo sapiens; identical to SEQ ID NO: 85913
  chr2:222438857-222438887
  Hyper

SEQ ID NO: 118760 - DNA, 36 bp, Homo sapiens; identical to SEQ ID NO: 27894
  chr2:223104874-223104910
  Hyper

SEQ ID NO: 118761 - DNA, 30 bp, Homo sapiens; identical to SEQ ID NO: 85915
  chr2:223154920-223154950
  Hyper

SEQ ID NO: 118762 - DNA, 423 bp, Homo sapiens; identical to SEQ ID NO: 85916
  chr2:223155765-223156188
  Hyper

SEQ ID NO: 118763 - DNA, 1694 bp, Homo sapiens
  chr2:223158730-223160424
  Hyper
ctttcagttccatgtcgttactcaggcgcagagacaccgcgcatgaagggaccttgatccgagctgggcttggctgccgtcagatcaccaatgtcagctagccgatgccctccaagtcacccagcaagtgcgccgcccaaggcgccaccgcttacctcgctcgctcaggatgccgtcgatgctgtgtttggccttcttctcgctttcctctgcctccttcctctccaagtcggcctcctcctcttcacctttcccgaatttacttctcaggatgcggctgatggaactcactgggggcgggaggaggaaggaagcaagggagcgcacatggttgagacaagcagggctgtgcgggaaggaccccccacccccaaacaccagccagggccctagagccgctgccctgcactgctcgcgggtgtctcctcctgcatctctggacatcctcatccttctccagccctctcatcctgccactcaaacccccctccctattatctgtatctcggtactgaaagacggaggctgggaaaaccgtgcctccaagttagggccggatgccatctttgtccctcgattctgggcaggaagcatttcccttcctggactccgaagaccgggctctaggtctgcaatctaagagaattctcccaccagcccaccgggtaccctccttcctccccacctgaatgcatggatcctgcggttcgccttaagggaggaagaaccaaagccgacttgtccgcgcccccccccacccccccgtaaatcaagtttcttttttttcctttcttcccttttttttttttttttaaggctataaagggtttaaatttcaactgcagaatcgtttcctattgtaaaaatcaaaagaaaatgcactctctcccacttattttttccagattccagtctggtaaacaaatccatgctctgaaatatgtttctcacagagggaaaaagggagtttccttttaattaaaaacaaaccctcccgtgcgccctctcgctggccccgtgcttgcccctcttctccctccgcctcccccaggctgccgtggcggggggctccggaccgtccctgagactctcggaggaaatcggggccgttgtggaagcctccacggctttgcgcacacggcaaagtccctcccggcgcgggccccatctcccttcggttggggttaccaaaacatttgtttctctttaaaagggaacatcaatattaataaacgctctgcctccgcctcacgtttcctgccctgcctcctcgacagaaatcttctttggggcgtcctcagcggtggtctcgccaccctccgtccccaggacaagcagctcacccctccctccataaagtgccaagaacaccgggttggcaaatattgcagggcctcgggagaggccacctcccaatagctgagatcgataattggggtgattacgtctgggtcgacgtgccggggtaatagcgactgactgtcgcgcctcggggagaggttaatgggcctagtacctgacggcacggtgtttcgatcacagaccgcgtccttgagtaatttgtctcggatttcccagctgaacatgcccgggttctctcttttgtattcctcaattttcttctccacgtcaggcgttgtcacctgctttaagagaacaggcgggcaggcgttggtacccggtaccctgggcca

SEQ ID NO: 118764 - DNA, 30 bp, Homo sapiens; identical to SEQ ID NO: 27899
  chr2:223161247-223161277
  Hyper

SEQ ID NO: 118765 - DNA, 810 bp, Homo sapiens
  chr2:223161526-223162336
  Hyper
cagggcgcgtgcacacgtacacacacacacgcgcgcctttacgcaccttcacaaacctcagaaataactcattggagagccccagatgtcagccgttaccccccgcccggtcttccccaacacaggggaccacagtctgggagccaggagggcaaggcccgcccgctcaccttgggcttgctgccgccgatggcaccaggacgtatggagccagtctcctggtacctgcacaggatcttggagacgcagccgtgggacacgcgcagctggcgcgagatgacgcagggccggatgccgtggtgggccatctccacgatcttgtggcggatgtggttgggcagcggcctgccgttgataaaaacaccgccgagctggttgacgcggccctggccgaggggagtggacactgtgggaaggtgaaaaagagaagcaagggaaaagtcactggaggaaaataaaaagcaaagaacagcagcacgtaatttcgcagtcttctgtcctatcctcatgttacagcaccgacgctgaaactgctcgacatcggactcccagacccagacctcctttcaatcacatttgttcaaattattcagcaatatagcgcatgtaatcttgtgtaaagacagcaaatggggcaaaataattctccccagagaaagcgtcttccccttcgggcccggggagtggcaacttaggagaccctgcagctggtagagagtctagcttgctctagaaacagcctcctggcgaagagaagttcacccaggagctggccttgatgaactctgctcccaccgatccctgtccaat

SEQ ID NO: 118766 - DNA, 1438 bp, Homo sapiens
  chr2:223162565-223164003
  Hyper
gaagggagtgggtggcgggggcgatgagcatctctgctggggcgccctaacctggaaaaccattgaaaacggctcaggcttgcaagacttcctgcctccccgggattcccagaatcttcaagtggacggaaaggcgattcctaaacaagttatagaaacttctagatgctatttgagatacatagaattctaatttatttaattattctaaaaattccaatcacaatggcgcggcgttagccaccacaactttgcagggcaaaaaaaaaaaaatacttcctgaactaacatatgtttcacaagtgtgggcgcagccgggacaatttcgagacaacttcgagacaatttcgaatggacaaattgcggagaagttgcttctgccgctcagaagccggttcacctccttctccaccgcggcatttccaaaacaacagggacaagtctccccggctcgccgcaggcctgaccgcccagctccgccaggatttgcagagagcagcgcgctccatttgcagaaaggaaatcgagtaggtcctcgcccccgactggtgcttcttggggtgtggggtgcccagggaatgggcttcctggaagcaccaaaggagcctgcggagcctggggatggggtgaggcagccggtcccaggccctgggatccaggcggcgcgctgaggccctcccttaccttccagcgggaacccgctacgcgggtagttctgccccgggcccggccgcatcatcctgggcacagcgccggccagcgtggtcatcctgggggcagcttcgctcggaaattatatccaggtgaaggcgaaacggaaaggcgagtgcggcgcggatgaccctcgggaactatccggagcgtggagagcccctccccaaaacggctggagagagagggagggacgcggggaggggggctgtcggttcctagtccagaggccggagctggaacccgggaaaggggaggacggggaggccccggagtccaggatcccgagcccagggcggaaaagtttggtacgagtctgggcaaatgttccagcgactggggtccctgaaaagggggctcagagagccacggcgagccggggagcctggtgaggctggagcgcggcctgcctgagtctcctcctgtggtgacaccgagtgcggggatccgggctcgggagcatttattagttcttttacccaaagcttggtcaggagccctgagctgcgattggccgacgggtagaccgtcccgggtggcggagacacgcgctgattgggcaacagcgaccactttctcttcccatctctggtggtgccgaggcctctgctggccccgagggggacccgcgctgcgccccttgcccaggagagaaggttggcccggtggaaactgagagagacagccccagggagatggcagttgctgagggcggagaagttcctgt

SEQ ID NO: 118767 - DNA, 511 bp, Homo sapiens
  chr2:223164384-223164895
  Hyper
gaggagtccagggtgcgctgatgttcttttgtcttctccgtccgcaagcggggctaatgtgaagcacaggcagccgtcgctaggcccaagcactcgttagttgaaggctgggggtatgggggagggtgcagaaaaaaacctggctcctcttcttggtgtaaaaaccgctctggcaagctgcggttctaaatctctacatatagatccccgatgcgtcgacagagatgtgtctgtatgttaaagttttgcccgggttcagcgtttgttctcaggaatttattatggcattcagactaaactgctggaaaaataaaaggaacgaagtcttggctaggagctgaagtgtccccagcaggatatgacgccaggagtgttgtaaagactgtctgtccttagagaaggtaccattgtgcatagccttttatttataacttggtaagtgccagcgaactcgcctcctttacacccccgagtgccagccccgcgctctgcactgcgctttattcgctcg

SEQ ID NO: 118768 - DNA, 1416 bp, Homo sapiens
  chr2:223165434-223166850
  Hyper
attttctttttaaggcgttggggccaccaaagcctgtgtccgtacgttttaagccacttctcagcgatagcattttgagagctagactttttccaagttttcttcttcccaaaggttaagcagagtcgacagagcactttctggggtcagcggtaattgctgtgtgaaggaggtaccagaagtgtaatttcaagaaggcaaaagtaggctcaactctcagctaaaataaactcttggaccccgcgagcagttaaagaacatctagagctgagtctcatttgtttttgagccggaggcttggtctccaagccctcccagcgtccacccgtctctctcctgccgggagttttctctcctaagagccggcagatgctggagggaagcgcttgctgcaagattccttctcccggtcccgtagattgcagagtccgcgggaccgttgaacggaggtactgccggctgagctgggtcttaagtgcccatgggttcataaactagctgtcacttgctataaacatgtacaaatggaggccacaaggatgtgggggtgctggggacctaaagctccggaatcaggaggcgactcattttctctcctttccggcctctttcttttctgccgagcgctctgagattcatatgtacccagatgatcagcccggcccttctcaccggccagtggccagaggtccctggacacccggagaggggtgggagggcacccttaggctctggacagctgggccacatccaaagacttaatgaatctaaatttcttgtggcctgtgtccccgaagtccgacctgggatggccaggacagcaaagttggctgaggctgcctggcctagggcgcccgcacgccgccaaacctaacccggctcagagccgtgactccgcagaacagggcgcaacaggtctcaggaatgccgggtgattccagccactctttctctgtctccgagtcttgggcctcccctttatttctttctgaagtctctccggagcccaagccaccccacacccaaaccccgcagctggatgggagtccaggccacttccctatccgcagccggtgggccaaggagtcctggtgccaaatttggccgcggtacaggcgctaattggtaaagggatgacccagcggtggggcttggaaggcgagggcccgcgccctgcatccttgaaccctggtttgggaggcagtgacttttacctgggctaacaaattacccagaaagcatcagtgggactctccacaacggtgttgtgaacgagtgtagggtccactcacgctctgtgcacgttcgaaatgaaacgggagccttgaagacgatatttggataatttgacaaaaaaaaaaaaaaggtgggcgggggagatagcttctattgtcccctctgcgcctctgcccccag

SEQ ID NO: 118769 - DNA, 477 bp, Homo sapiens
  chr2:223167154-223167631
  Hyper
tgacctagtggggagcgggggtggtgtctgccacccagacctttttcctcccgtctgaagggccgagctctggcaggctgacacggtcgagcagagaagttcctggccacccgcccggccccaggcgtgattctcaggatgcagtaaaagttgggcaaacgccgagaaaccctcaatcccacagaaaggctgccgggggctcacggggaggacatcaaaacgccaggttcgtgatcatgagcttccggtccggatgtgatgatacaggattggtgaatgcccgggttaaacccgtggtccttcgcagccgctgcctcagtgacagtcattaggccccccgcagttatttgtcaaaagcattggcgccgctcttctccccatcgaaaaatcagtcgggatgagttcggattaagggactagatgaggatgtggacatcccattgaaacatggtgtaggccagccgaagtgggtttgct

SEQ ID NO: 118770 - DNA, 2006 bp, Homo sapiens
  chr2:223168205-223170211
  Hyper
aaaatctgatctgtgcggaggcaggtgaaggctgtgagtgaggtgggggcgggaacagagctggaggaagtgaataaaagaaaccttggggtccgttggtttccttgactcgtggagcaaaaaagtaggcgagtgaccactccaggaactcctgcctccgggcgccggtacataaagagctggggctgtgtgtcctgctcttgggggaggagggtactgggaagggggaactaacaggtctttctttcgctcggatcaggactggactccttctgactccacgcggccccagctcctgaaccagcgcagtgagcctcagccgcttctcaaactgggtctcagaaaatttctcctcgagatggatttcagcggcaggaaagaggggccagtgacgcgaggagcaagaaaagagtaacatgggagatgaatgttcaaacccagatctcctcgctgagcctggaagctcgccaccgtgggatcacgggaaccagaggcaagaggctgcgaatgagtccaacacccgcgttcctcgagttttaaaagcacacctggggccagagactgcacagccaactaaacggagtaaacgcaacaggtggaggaggcagagttgtcaggggccaagcccggcgcgatctggccagttcttggggagcgcggacctgggactgcagagaggcgttttgaagagtgctgcgcgcacctgcctctcggagatatccaactccacccgggcgtctcctgagagcgcacagtccacagaccccgggagggctgcccgccctaggacacgtactctcccgacccctcactctttcaaaattggggaagaggcggaggagatgaaaaagaagaaagagagaaagagaagaaaagagagaaagaaggaaagaaattttaaaaaataataaaaggagggaagaatggaggtaaaacgcgggggagagaagaggggagaaactctcctcaccacaaccaaagcaggaggcctaagcttcctgaatttctacacatgacttgcattaagttccttcctagaacttaaactttttcatctcccgtcacccaagaaaacacccatttcctcttttaaataaagtttctttttctggagatgaacctttaaataagtcgtacgtttgggagcgagggacaggagaataattttgatccagaaccttggagattggagaagcaggtggaaaaattctaaaaagatgaaaactgaccatctccgacacagaaacccatcgaaaggggccaccgagacccgttgattagctggagggagcatgcggcagaagtgcagacccctcgctaacccgccaacctccaagagccctcttgcagaaagctgcccggctccccacggtggccctgcgcgcgcaccatcctcgcggtctcgcttcttcgccccggaaaactctatgaggggcaccccagcctcagccgggttaagacaagtagccccaagaggaaggagcctcagagagcctttcttcctgttcttcttcgtcttcttttttttctaaacgaaatctaatactatctggctgcaaaaatatattatcaccggctctcagcctaagagactaacatttggatatgtaggaaatgtaatctgcatggctaattgattctcagcgtatcagtttaaaggataaagatcgatatctacatgatggatattgtattaataggggcataaataaaggtcgaagagtcgttaccaaaacctttgaagccgcttttcggctctcgggccctccacgcggccagtgggtctctcccacctccccgcccccagctgctgctgggcagggagcatttgcttccccctccaacccgggaccagggtggaggagtctatggttaaagcgaaagtgtttcactgcggcaacgctggggaaaggaggttcttttttcctgggctgcagcaggtggacagtaaggcccgagaaaatgtaatattttaacaaaacgcaccactccccgaaacacacgta

SEQ ID NO: 118771 - DNA, 1285 bp, Homo sapiens; identical to SEQ ID NO: 85934
  chr2:223170271-223171556
  Hyper

SEQ ID NO: 118772 - DNA, 432 bp, Homo sapiens
  chr2:223171840-223172272
  Hyper
gcctgcccaccctcacgtcctcgggcgcccttggctcgagggcctttcggagcctccgcgggaagcagaaagtcgcacctcacactgagcctttccttcgagcgctctgccgggagctactgagccccagcacgcagccttgggcacccggtggcgggcgaaggaacctgccccattgtgctgctgggctgcactagcggagacgagagtgcgtgtgggagtggcccactagcaccacccgccagggtttagcagcgcctggagcacctccctcttccctgctgtttccttaatgctggagctgggcacactccgatgtcccgcattctcacattcaatcattcattctccctctgaaagttctcaggctcctttgctcacgggtcgtctctggacctgagacacctgcgaaccttgcggatcaccagattg

SEQ ID NO: 118773 - DNA, 185 bp, Homo sapiens; identical to SEQ ID NO: 27915
  chr2:223173045-223173230
  Hyper

SEQ ID NO: 118774 - DNA, 1582 bp, Homo sapiens
  chr2:223176096-223177678
  Hyper
gaattctaagcttctcgccttcctgttacagccgatctgctctgcatttggaatgcggcgtctttgcgggcgttctgagtcattcctactccgctgcaagccccgcagagaacctcgccttcttcccgaccgccaagtctgattgtacagacttcatagaaggtctggaataaggactgtgttgctgcagaggccgggtcttgggcccctgggcgtgaggacgcaggctcggcccctgggaagaaatgtactaacgcacctcaagactcctaaggtgtttccaagtcccccctccaactttcgtgtccaggtcacgctgccccgccctcggacaatgagagggtgtgtcaagatgctctttgcatctttggaagccgagggggaaataggagactttcgacggggagcaggttttccggagccgtttggggctgagattctcgaacccctgctgggggccgaaagcgccggagaaacctgggactaaacgaaggcgactccccgcagggcgcaggcaccgcacccggcgtttgttttattcttaatttacttttttgggcacctctgctattgttacaaataaatgcgaacgcggagctttcgggcgggctctgggagcggcccgtgggcatcttggaatattaaaaacgtcatccggttgtaaataacctactccccagcccttgaaatccgggacgtcacaggtgaggctgaataccaggttcgcacaaaggcaaaccaaactcagccgggatgccgagtgatggggttggcaagatagtgtggcctctggttccctccacgcgtgataagtgggatcatgacagcgtccttgtgccttcgatttgtccccaagccctcctctgcctttccgatctcaaactaacccgtaatggagctggcaagtgggacgaacgggacagcctaaagcgtcgttggcccggccaagaggggctcaacgcctgtcaccccgggcggccttgggtcctttgcagtcggagaggctgcaggggaggaggaagacccagccagctccagggtgcaggattctgcccttccacccgagagcctcccccggtgtcccagtggcagtggctgccccgggctgcggtcgcagagtaagcaggggctccagtcctcggtccgcgcgccctgccccttgggctcagctgcgagccaccgccggcgtgcgcacccacaaggagagaaatggaggtaatcccccgcttcccaccgactgccggaagctcggcctctgtgcaaaccgaagtatacctgcacccaagagcgtggaaataatttacacgctgaatggctactattaaaaaggatctttttaacagatctcctggcgagtattttaaaacaggactctgcgctagatcagctcgcccgtcggcagctgtcagcgaccagccgacaagctgagattcccctttcagctgtcactggcgatgacacccacatctatcactggcgatgttttgttaatttaacctcgagacttccctgattatccgcataatccgtcctcaaatcccctcgttgtcactgcattttgatgacacgggggacttggaaa

SEQ ID NO: 118775 - DNA, 325 bp, Homo sapiens; identical to SEQ ID NO: 85940
  chr2:223185130-223185455
  Hyper

SEQ ID NO: 118776 - DNA, 473 bp, Homo sapiens; identical to SEQ ID NO: 85941
  chr2:223536200-223536673
  Hyper

SEQ ID NO: 118777 - DNA, 130 bp, Homo sapiens; identical to SEQ ID NO: 85942
  chr2:223753473-223753603
  Hypo

SEQ ID NO: 118778 - DNA, 18 bp, Homo sapiens
  chr2:223764729-223764747
  Hypo
agtcgctctggttcaaac

SEQ ID NO: 118779 - DNA, 130 bp, Homo sapiens; identical to SEQ ID NO: 85945
  chr2:224909475-224909605
  Hypo

SEQ ID NO: 118780 - DNA, 75 bp, Homo sapiens; identical to SEQ ID NO: 39754
  chr2:225394300-225394375
  Hypo

SEQ ID NO: 118781 - DNA, 158 bp, Homo sapiens; identical to SEQ ID NO: 85947
  chr2:225906010-225906168
  Hyper

SEQ ID NO: 118782 - DNA, 1216 bp, Homo sapiens
  chr2:225906404-225907620
  Hyper
tgggtttttaccctgcggtgggagggctgttccaagtacatctatttctgcgatagttaacgtcggggggccccagctctaaccagggcgaggaccacggactgcatccctctctctcagcgcactggtctgtttactggagggtgagagggacgcgcagacctccggactcaggggttctgttctgtagatccccccaccccacccggggtctctggcactcgtatcacttagcaccagtgtgactggcggtgcattccggccccctcgcgccccattaaagcccctgcacatcctctcccacgctgcgcttctgctacccacgcagctgctcctctgagcgtcccgcgtgcacaaacgcgcccccggtccttacgcgtcggtggcgctgcctcgctgaggtggcgccgggggagcccgcagaggcggcgggggagggagtgcggaggagaggacccgtgagctgcggggacctgggcccgccgagcttttggggaagctgggctccgttccccccgggcgcctggggcgcgcgggaaggcgcggaggacgcgccgcactcacccgctgctgctgccggctgctgactgccaccgcggcggcggacgcggcgctgtgccggagctcggccgcctgcccaggtctcaacaggctccgggtgaacctgcgggtccgctcaccggccatcgccggtcacgccaatcgcgccgcgggcccggggcgcgcctcccgccggtcttccccgcgccaaccttctctatccacccgccgttcaggaagcggaactcggagccttcccccccctcttcctcgctcaactcgcaagaggcgggtttttctctcttgcacccccactcttcccacccccttccctcctctgaagcttctcgaagactttccaaactctgcgctcccccgggcgcgcgcggccaactcggctggcggccgggccctgcagcggcgcatctggagcgggcgtcgcgggacgcgtgtggggcggctcctgcccgcgccgcccacacgggctcagctggccggccggggctgtccacgccgcccgggggaactgcaggctgcgggggagggcggggggcggccgccgaggggctccgggcggggcctgtccaaggccgtcgcctgtccaaggccgtcagcctcatttggaggttgctgggagagttggagccctggatgcatttgccgtttagacttctat

SEQ ID NO: 118783 - DNA, 30 bp, Homo sapiens; identical to SEQ ID NO: 85951
  chr2:225975877-225975907
  Hypo

SEQ ID NO: 118784 - DNA, 32 bp, Homo sapiens; identical to SEQ ID NO: 85952
  chr2:225987036-225987068
  Hypo

SEQ ID NO: 118785 - DNA, 24 bp, Homo sapiens
  chr2:226298377-226298401
  Hypo
aaaaaattagttgggcgtgatggc

SEQ ID NO: 118786 - DNA, 30 bp, Homo sapiens; identical to SEQ ID NO: 85954
  chr2:226845723-226845753
  Hypo

SEQ ID NO: 118787 - DNA, 433 bp, Homo sapiens; identical to SEQ ID NO: 85955
  chr2:226895900-226896333
  Hyper

SEQ ID NO: 118788 - DNA, 96 bp, Homo sapiens; identical to SEQ ID NO: 85956
  chr2:227663424-227663520
  Hyper

SEQ ID NO: 118789 - DNA, 88 bp, Homo sapiens; identical to SEQ ID NO: 85957
  chr2:227820585-227820673
  Hypo

SEQ ID NO: 118790 - DNA, 349 bp, Homo sapiens
  chr2:228029273-228029622
  Hyper
ctgggtggggagggacgaaccgcgcgaccgagccctacaaaacccgccccggccgagtggcgaggcgagctttccagccgggctcccagagccgcgctgcgcaggagacgcggtggcctgagagcctgagggtccccggactcgcccaggctctgagcgcgcgcccaccatgagcgcccggaccgcccccaggccgcaggtgctcctgctgccgctcctgctggtgctcctggcggcggcgcccgcagccagcaaggtgagtgggggctgcgcgacccccacccccgcacttccatccctcctccacgcgtccgggggacgcgctggccccacccgcagcggcgcggta

SEQ ID NO: 118791 - DNA, 30 bp, Homo sapiens; identical to SEQ ID NO: 85960
  chr2:228146693-228146723
  Hypo

SEQ ID NO: 118792 - DNA, 30 bp, Homo sapiens; identical to SEQ ID NO: 85961
  chr2:228253378-228253408
  Hypo

SEQ ID NO: 118793 - DNA, 27 bp, Homo sapiens
  chr2:228264615-228264642
  Hypo
aaatagccaccgcgcctggcctataaa

SEQ ID NO: 118794 - DNA, 92 bp, Homo sapiens; identical to SEQ ID NO: 85963
  chr2:228466753-228466845
  Hypo

SEQ ID NO: 118795 - DNA, 40 bp, Homo sapiens
  chr2:228582794-228582834
  Hyper
cacgctttgcatatgcgaatccgggcgtccagacctttca

SEQ ID NO: 118796 - DNA, 32 bp, Homo sapiens; identical to SEQ ID NO: 85966
  chr2:228589295-228589327
  Hypo

SEQ ID NO: 118797 - DNA, 49 bp, Homo sapiens; identical to SEQ ID NO: 85967
  chr2:228735796-228735845
  Hypo

SEQ ID NO: 118798 - DNA, 429 bp, Homo sapiens
  chr2:228736154-228736583
  Hyper
tagctcctctgaggtcgcccttagtgaggacacgaggtgccctcacctctttcactctagacacctccagaacactcgccccccgcgcgccggagccccgggtcgccaccaaccgcccgcggagccagacctcccagctctgcgccccaggaccgcgcggtgcaacctgcgcatgcgcacccgcgtcccgctgctgtttagccgtttccaaggctacgaagcccatcggccggggataagagagcaagaaaatgaagctcaagagcctcctgctccggtattacccgccaggtacgcaccagcccggccccgtcatccccacgtgggaccctgggctcccagactgggagggtttggggcggaggagggcgcagccactgaaaggcggcggggtccccaggtggggcaggaagtcgggcacttcccaac

SEQ ID NO: 118799 - DNA, 35 bp, Homo sapiens; identical to SEQ ID NO: 85970
  chr2:228882048-228882083
  Hypo

SEQ ID NO: 118800 - DNA, 215 bp, Homo sapiens; identical to SEQ ID NO: 39759
  chr2:228888319-228888534
  Hypo

SEQ ID NO: 118801 - DNA, 64 bp, Homo sapiens; identical to SEQ ID NO: 85972
  chr2:229044914-229044978
  Hyper

SEQ ID NO: 118802 - DNA, 30 bp, Homo sapiens; identical to SEQ ID NO: 85973
  chr2:229045852-229045882
  Hyper

SEQ ID NO: 118803 - DNA, 671 bp, Homo sapiens
  chr2:229046107-229046778
  Hyper
cccctgtagctccagcgaggctgggccggacttatttacaagtgcagtgacccctgtctcctcgctgggagccccgtgcaaaccgaagcgctctggggcaagttggtgagcgactcacaacgcggaacggagtttgatcgacatggtattgggcatagaaagaagcgggtcttaccttggtaccgagagcagggagttgccatccattgttggtgggcgcccagagaagaaagacggaaagtgcaggcgaaggataagtctgtggtgctaggacccagctcccagagtgccagactggcgcgcgccaggagagaggcgcgcaggctggggcggcggcggcgcccacggagactagctcctccctggccagcaagctctgtgcgctgcgaccgcccgctgtcccctcccgccgtcctctctgatcttgcaggagcgcgtggccaacgctcccacctttctgcctggctcctgcctcctgcaggcgggccccagtctcagttgctcgaggatcctgctctatcgctcattcgtgcccagaagcataggtgactccgacaaaattcctctctccccaaccaccatcgtctcccctccctttctcgctggcgtacagtaggtctgagccctgaagttgttcacgcactttcccacattcacgccctcactcctgg

SEQ ID NO: 118804 - DNA, 157 bp, Homo sapiens; identical to SEQ ID NO: 85975
  chr2:230135693-230135850
  Hyper

SEQ ID NO: 118805 - DNA, 25 bp, Homo sapiens
  chr2:230174052-230174077
  Hypo
ccatcgcgcccggccaggaaactgg

SEQ ID NO: 118806 - DNA, 1131 bp, Homo sapiens; identical to SEQ ID NO: 85977
  chr2:230578047-230579178
  Hyper

SEQ ID NO: 118807 - DNA, 256 bp, Homo sapiens; identical to SEQ ID NO: 85978
  chr2:230579495-230579751
  Hyper

SEQ ID NO: 118808 - DNA, 117 bp, Homo sapiens; identical to SEQ ID NO: 85979
  chr2:230600571-230600688
  Hypo

SEQ ID NO: 118809 - DNA, 73 bp, Homo sapiens; identical to SEQ ID NO: 85980
  chr2:230785500-230785573
  Hyper

SEQ ID NO: 118810 - DNA, 100 bp, Homo sapiens; identical to SEQ ID NO: 39760
  chr2:230795535-230795635
  Hypo

SEQ ID NO: 118811 - DNA, 217 bp, Homo sapiens; identical to SEQ ID NO: 85982
  chr2:230932847-230933064
  Hyper

SEQ ID NO: 118812 - DNA, 65 bp, Homo sapiens; identical to SEQ ID NO: 85983
  chr2:231170246-231170311
  Hypo

SEQ ID NO: 118813 - DNA, 40 bp, Homo sapiens; identical to SEQ ID NO: 85984
  chr2:231170527-231170567
  Hypo

SEQ ID NO: 118814 - DNA, 33 bp, Homo sapiens; identical to SEQ ID NO: 85985
  chr2:231188088-231188121
  Hypo

SEQ ID NO: 118815 - DNA, 34 bp, Homo sapiens; identical to SEQ ID NO: 27934
  chr2:231191860-231191894
  Hyper

SEQ ID NO: 118816 - DNA, 30 bp, Homo sapiens; identical to SEQ ID NO: 85987
  chr2:231268620-231268650
  Hypo

SEQ ID NO: 118817 - DNA, 30 bp, Homo sapiens; identical to SEQ ID NO: 85988
  chr2:231276161-231276191
  Hyper

SEQ ID NO: 118818 - DNA, 67 bp, Homo sapiens
  chr2:231281248-231281315
  Hyper
acttgccataacacacgtgactttcttgttttggatttactgctcagctgaccgggacactctaaac

SEQ ID NO: 118819 - DNA, 188 bp, Homo sapiens; identical to SEQ ID NO: 85989
  chr2:231620583-231620771
  Hypo

SEQ ID NO: 118820 - DNA, 391 bp, Homo sapiens
  chr2:231693118-231693509
  Hyper
cccgcggcctgtccacgcgtccggcacccggagctagggcgtggccaggtcggaagccggcttagcgcgcctttcacccctggccccacccagggctcagcccagcgccgcggcgggcccgggctcccaggtctgcggctttcactgggccgcgtccctgcagagggccccggcgactggggaggaggccgccctttccttccggcccgcgaccgccccgggctgtccctacccaagggagactcccagcggcccggagcctcagactctccgggagccaggcggcggcgccccagggctggggccttggagcctgggaaagcaaccgggggtctctggggagtcctgagcgcaggcgcccgcccacggccaagaccgtggcccagccctc

SEQ ID NO: 118821 - DNA, 132 bp, Homo sapiens; identical to SEQ ID NO: 85991
  chr2:231714877-231715009
  Hyper

SEQ ID NO: 118822 - DNA, 179 bp, Homo sapiens; identical to SEQ ID NO: 85992
  chr2:231902993-231903172
  Hyper

SEQ ID NO: 118823 - DNA, 105 bp, Homo sapiens; identical to SEQ ID NO: 85993
  chr2:232243072-232243177
  Hypo

SEQ ID NO: 118824 - DNA, 279 bp, Homo sapiens; identical to SEQ ID NO: 85994
  chr2:232276822-232277101
  Hyper

SEQ ID NO: 118825 - DNA, 76 bp, Homo sapiens; identical to SEQ ID NO: 85995
  chr2:232283697-232283773
  Hypo

SEQ ID NO: 118826 - DNA, 18 bp, Homo sapiens
  chr2:232330287-232330305
  Hypo
aaaatcacctcaggccgg

SEQ ID NO: 118827 - DNA, 30 bp, Homo sapiens; identical to SEQ ID NO: 85997
  chr2:232379667-232379697
  Hyper

SEQ ID NO: 118828 - DNA, 562 bp, Homo sapiens
  chr2:232394918-232395480
  Hyper
tgacccgagaagttgcgaggctccccggtggcggggacggggggcaccccgacggagccctcggacccttcccgccctaggacgaccctgcccgcaccgagccccggcccagctgccgcgccctagcccacgccggcgcctgcgcacctaccatgcggcccgcggcccgcgagaccccggcttccaccctccgagcgacggacacagacgcggcgcgggagccagtggactgactgacagcggccccagcccgcgccccgacgccccgcctgtccggccgggaacgccgccagggggcagtgcagtccccgcagcccgggcggcgccccctcccgcactggcggaggacgcggccgttggaggcgacacctccacaagcagcgtggaggcgacacctccacaagcagcgttatctgacggaaccctcacaacaacccgttttacagatgagaaaactgagcctcagagagccgcagaggaggagcccgagagacctggggctcacatgtgattcccgccctccagcgtgctgagtttagcttaacgccgtcacggtgtccct

SEQ ID NO: 118829 - DNA, 169 bp, Homo sapiens; identical to SEQ ID NO: 86000
  chr2:232479285-232479454
  Hyper

SEQ ID NO: 118830 - DNA, 68 bp, Homo sapiens; identical to SEQ ID NO: 86001
  chr2:232485651-232485719
  Hypo

SEQ ID NO: 118831 - DNA, 79 bp, Homo sapiens; identical to SEQ ID NO: 86002
  chr2:232506690-232506769
  Hypo

SEQ ID NO: 118832 - DNA, 18 bp, Homo sapiens
  chr2:232526119-232526137
  Hypo
aaaatttctactggccgg

SEQ ID NO: 118833 - DNA, 579 bp, Homo sapiens; identical to SEQ ID NO: 86004
  chr2:232526660-232527239
  Hyper

SEQ ID NO: 118834 - DNA, 63 bp, Homo sapiens; identical to SEQ ID NO: 86005
  chr2:232527687-232527750
  Hypo

SEQ ID NO: 118835 - DNA, 57 bp, Homo sapiens; identical to SEQ ID NO: 86006
  chr2:232541188-232541245
  Hypo

SEQ ID NO: 118836 - DNA, 29 bp, Homo sapiens
  chr2:232544635-232544664
  Hypo
tgagccactgcgcccggcctaaagccctc

SEQ ID NO: 118837 - DNA, 27 bp, Homo sapiens
  chr2:232546676-232546703
  Hypo
attaaaagagctggccgggcgcggtga

SEQ ID NO: 118838 - DNA, 28 bp, Homo sapiens
  chr2:232570350-232570378
  Hypo
cctgcatgggaataacgtcagaaaacag

SEQ ID NO: 118839 - DNA, 131 bp, Homo sapiens; identical to SEQ ID NO: 86010
  chr2:232790653-232790784
  Hyper

SEQ ID NO: 118840 - DNA, 93 bp, Homo sapiens; identical to SEQ ID NO: 86011
  chr2:232791047-232791140
  Hyper

SEQ ID NO: 118841 - DNA, 576 bp, Homo sapiens; identical to SEQ ID NO: 86012
  chr2:232791530-232792106
  Hyper

SEQ ID NO: 118842 - DNA, 33 bp, Homo sapiens; identical to SEQ ID NO: 86013
  chr2:232827152-232827185
  Hypo

SEQ ID NO: 118843 - DNA, 196 bp, Homo sapiens; identical to SEQ ID NO: 86014
  chr2:233165754-233165950
  Hypo

SEQ ID NO: 118844 - DNA, 30 bp, Homo sapiens; identical to SEQ ID NO: 86015
  chr2:233198553-233198583
  Hypo

SEQ ID NO: 118845 - DNA, 648 bp, Homo sapiens; identical to SEQ ID NO: 86016
  chr2:233283249-233283897
  Hyper

SEQ ID NO: 118846 - DNA, 79 bp, Homo sapiens; identical to SEQ ID NO: 86017
  chr2:233285052-233285131
  Hyper

SEQ ID NO: 118847 - DNA, 242 bp, Homo sapiens; identical to SEQ ID NO: 86018
  chr2:233285766-233286008
  Hyper

SEQ ID NO: 118848 - DNA, 30 bp, Homo sapiens; identical to SEQ ID NO: 86019
  chr2:233302001-233302031
  Hypo

SEQ ID NO: 118849 - DNA, 102 bp, Homo sapiens; identical to SEQ ID NO: 86020
  chr2:233322912-233323014
  Hypo

SEQ ID NO: 118850 - DNA, 2742 bp, Homo sapiens
  chr2:233350208-233352950
  Hyper
tctgtccggggcattcgtaggtcccccactgacagttgggacccctagctttggggccagctccagacctcgcggagacgtcaacccagcccgccggcgcgcctctccctcctggccctcactgcctgccagagggctgggaaattgcggctcccgcggctcctctaaacaccgcaattaccccagggaaattacttgcgccctcctcccgcgctctgcctctgtgcgctcccctcccctcccctctcctgctcgtctcttccctcctctcctctcacgcacccgcctcccgcgcgcagggacccctgggcaaggccactgcgccccggatccgcggccgctggcagggcgctcagggggcgcactcacgcggatgacgtagcgcgaggagttcctgtcgtccaggctgaccgtgagcgagaagagcgcggcggcgctgtacacgccctgcgccttgtacagcagccggttgaggtcccatcgcgccgcgacccccggacgctcctccgcgccgcccaggtcccagcccccgcagtcctcgatgacctctagcatgggtcgcgggcccagtcgctcgatctcgcgcatgtcgaggcacgagcggaagaaggcgcgcaccttgcgctgggccgcgccgccaggcccacccccgggccgcgccagcaggcgccgtaggcgctcctcgttttgctcgccgatggccgcgatggtgccataggtgagcttgtcgtcggggatggcgtggcgccgcagccaaccgccgcaggcgaacgagtagaagtcctggcatgggtcgatgctggcgtccaggttggcggccaggaagcgagcggcgcgcgcgaaggccttgcgctcagggcagccctcgggacaggcgccgccgccggccgcgaccgggcccaggtacttgagggccagcatagccgccagaatggcgcagaggccggcggcgaacaccagccccgacagcaggcacacctcgcgccggttccagcgcggcagcccggaccgggccccggtggcgctgcgcgcagcgcccaacgggaagcccgggggcagggaggccccgcgcgcgccccccgcgccgcagcggctcacgtacttgacctcttggaactcatcgtagtgcgccgtcagcgaatacgggggctccatggcgccgaggccgccgcggtgcagacctgggccacctgggctacgggatgcgcgtggccgccggcctcctcgtgggcctccgcatggccctggggccgcagctgcgggaagggcggaagcaggctcaggaggcgccgcagccggatggggctcagggtcaccgcgaggagggacacaggcctgggtgcagaggccccagccgcgggcctcattcactgcggaaaccagggactatgagggttcggcggggccaccacccccgggtgcacagtggagtcttcccccctgtcccctccctgcacacacttgagggccgcagggttgggagggctcttattggaagcaagaggcgccaggcaaggggcctggcacgtagtgggccttcattgaaaggtcgtccctcttccccttcgcctttctcttccacgacctgccccagccaaggccgggtggagtgggggaagaagcggaggctggagtgaggaggtgcggtcaggggcgcgtctatgcgacactttcagctctccgcgctggacccagacagacgctccgcaaagcggccaaagaaccaaactttgtcctcgcggaagtccgcgggatcgaccacgccaaccccgctccctggctccttctgctcggtggcccgacggcccactcgccccttccctaggggcgcgcgccaacgccccagggtggcggacacacaacccacccactggacggccctgatggagaacccgagacgggttccctccccccactcccaccatctctgtccccgccccgagccactcctggcttcaacaggttctccccagaacccaaacttgggcgaagtttcacccccggcggggagcgagctggctggcgacccccgagccccggcgccgtgcggcgcagtccgcggagcccgagagccgagcccgggagccgcagccgcagccgcagccggagccgcagccgagaggacgcagacaaagccgggaggctccgcgcagtggcggcggcggcgacggaagtggccgcggtggtggcctcagcggcagggactcgggcgccacttacccggcaggtgcgcgcccgagccggcggtgaccgagcgggtcgggcccgagcgggggcctgagccgcagcgcagccgagcgggcgtccggtgtctcccagcgcccgccgcctcctctgccgccgcgccgagcccgccgcgccgcccgcctgccggcccgagggagggggcgcgccggcggctccaccctcctccgcccgccccgcgcgcccctccttcctcctgcatctctcgggccacctggcagtggggcggcagcgcggacgtgggtcggcggccgcggagacaggctcccgggggtcgtgcgcgggctgcggtcggggactccgggtccagccgcgttccgagacgagtgagggcagcgagtactcccgtgaagggtcccctccgatccagtgtccccactcccagccgcccaccagccggctggaaaggggctggagctggagatgaggagccgaggactcctccgaagggctgggggcggtgtcagtagtgcctgtgtctgccggcacagtccctgg

SEQ ID NO: 118851 - DNA, 562 bp, Homo sapiens
  chr2:233367784-233368346
  Hyper
caaacacgcactctgcggaaggccggggcgggcctggccgctgcgggactcctggcccggcgcccttgacgtcagcggctgggccgtgacgtcacctcaccgcccccgccgcgctcccgcccccgcccgcgggcactcagtctccgctaatggcaggcgacggggaatggcacatctgtcttgccgggaattagttcattgaatcaggcggcccgagctgcggcagcgaccttagccctggccccagggaggggtctgggcgggcggcgtgggggaggttcaggctggagggctgagtgcggggacgggaggaggggactcacctggactcgcgagggggactgagcgctctccaaatataggtcaatgtcccgctcagcctccctcccccagcaccgtgaggaccgaggcctggggcctggcgcccgcctggtggacctcgggggcaggctggggaccgggcccctgcgggacgcggcgcggcaggacgctccccgcgcctttctttctgcacctgcccctcggggtgggtccccctctttaccctcgcttccccccgcgg

SEQ ID NO: 118852 - DNA, 776 bp, Homo sapiens; identical to SEQ ID NO: 86029
  chr2:233388398-233389174
  Hyper

SEQ ID NO: 118853 - DNA, 94 bp, Homo sapiens; identical to SEQ ID NO: 86030
  chr2:233405327-233405421
  Hypo

SEQ ID NO: 118854 - DNA, 162 bp, Homo sapiens; identical to SEQ ID NO: 86031
  chr2:233474440-233474602
  Hypo

SEQ ID NO: 118855 - DNA, 62 bp, Homo sapiens; identical to SEQ ID NO: 86032
  chr2:233497779-233497841
  Hyper

SEQ ID NO: 118856 - DNA, 1091 bp, Homo sapiens
  chr2:233498221-233499312
  Hyper
gcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttcccggagttcagccgccgcctcatcaaggacctggagagcatgttcaaactgtgagctcccgctgcgcgcccttcgcccccgggaccagggagggagcgggagggctttctggtccgaagtcccgggccctgtttgtgtggggaggggtcccggggtgcaggtagcatttggcccaacgcagccagatcttgcgtgctcgggtctatctcggcgcggtgggggacggggccgaagaggggggacaccaggagcaggagctctccgggacggagcccaaaagttctcggcggctgccgggcccgagttccaggtcccccaaccccgaccactggtcccgccccctccgcccgccagtccggagatttgctccgaaagcaacttctaggaaagggagccgtcgccgcgcctcacctgccagctttcactgtatccccccaagggaaaaattagcccctgttggccttttatcttttaaaacaaaaggggaaagttaatccttggctgcagcgcggggtctgatgaatgagcggaggccgagaacggggagtttggtaaagtcgttgtaagagattcaggactttcctggagcaggcgcggcccgggagcctcctgggggcgcggggagggggggcggttgtgggaaccg

SEQ ID NO: 118857 - DNA, 30 bp, Homo sapiens; identical to SEQ ID NO: 86036
  chr2:233735535-233735565
  Hypo

SEQ ID NO: 118858 - DNA, 810 bp, Homo sapiens; identical to SEQ ID NO: 86037
  chr2:233740776-233741586
  Hyper

SEQ ID NO: 118859 - DNA, 50 bp, Homo sapiens; identical to SEQ ID NO: 39772
  chr2:233750505-233750555
  Hypo

SEQ ID NO: 118860 - DNA, 67 bp, Homo sapiens
  chr2:233793411-233793478
  Hyper
ccgggcgagtctggtcgcaggacgagccacgctcagctacgcacgaccctggcgggtctgggatggg

SEQ ID NO: 118861 - DNA, 105 bp, Homo sapiens; identical to SEQ ID NO: 86039
  chr2:233846572-233846677
  Hypo

SEQ ID NO: 118862 - DNA, 30 bp, Homo sapiens; identical to SEQ ID NO: 14487
  chr2:233960620-233960650
  Hypo

SEQ ID NO: 118863 - DNA, 30 bp, Homo sapiens; identical to SEQ ID NO: 86041
  chr2:233969832-233969862
  Hypo

SEQ ID NO: 118864 - DNA, 36 bp, Homo sapiens; identical to SEQ ID NO: 86042
  chr2:233970346-233970382
  Hypo

SEQ ID NO: 118865 - DNA, 227 bp, Homo sapiens; identical to SEQ ID NO: 86043
  chr2:233986775-233987002
  Hypo

SEQ ID NO: 118866 - DNA, 180 bp, Homo sapiens; identical to SEQ ID NO: 86044
  chr2:233990977-233991157
  Hypo

SEQ ID NO: 118867 - DNA, 189 bp, Homo sapiens; identical to SEQ ID NO: 86045
  chr2:233997086-233997275
  Hypo

SEQ ID NO: 118868 - DNA, 30 bp, Homo sapiens; identical to SEQ ID NO: 86046
  chr2:234059490-234059520
  Hypo

SEQ ID NO: 118869 - DNA, 60 bp, Homo sapiens; identical to SEQ ID NO: 86047
  chr2:234077773-234077833
  Hypo

SEQ ID NO: 118870 - DNA, 87 bp, Homo sapiens; identical to SEQ ID NO: 86048
  chr2:234079049-234079136
  Hypo

SEQ ID NO: 118871 - DNA, 210 bp, Homo sapiens; identical to SEQ ID NO: 86049
  chr2:234079595-234079805
  Hypo

SEQ ID NO: 118872 - DNA, 30 bp, Homo sapiens; identical to SEQ ID NO: 86050
  chr2:234090326-234090356
  Hypo

SEQ ID NO: 118873 - DNA, 176 bp, Homo sapiens; identical to SEQ ID NO: 39778
  chr2:234109964-234110140
  Hypo

SEQ ID NO: 118874 - DNA, 30 bp, Homo sapiens; identical to SEQ ID NO: 86052
  chr2:234199097-234199127
  Hypo

SEQ ID NO: 118875 - DNA, 30 bp, Homo sapiens; identical to SEQ ID NO: 39779
  chr2:234330364-234330394
  Hypo

SEQ ID NO: 118876 - DNA, 244 bp, Homo sapiens; identical to SEQ ID NO: 86054
  chr2:234331271-234331515
  Hypo

SEQ ID NO: 118877 - DNA, 510 bp, Homo sapiens; identical to SEQ ID NO: 86055
  chr2:234369602-234370112
  Hypo

SEQ ID NO: 118878 - DNA, 30 bp, Homo sapiens; identical to SEQ ID NO: 86056
  chr2:234373355-234373385
  Hypo

SEQ ID NO: 118879 - DNA, 324 bp, Homo sapiens
  chr2:234475179-234475503
  Hyper
ccgaaaccactgccccgactccaggagagcgccgcgtcctcaggcaggcctgggcagcctctcgcctcgccctcctcagactgggccaccaacactgtccctacgcttcccacgtccctcccaggatccccgggcgccagccgcacttactgcctaaagcccagacccccgccctggccaaaacgcgaagcgaacgaacccgccccaactgggcgccgccatgttggcgagggcgggtctccagaaagtgatttatggatcgtggactatgcttcccaggatgccccgctggagcgccggcccctcgcacggggccttatggga

SEQ ID NO: 118880 - DNA, 78 bp, Homo sapiens; identical to SEQ ID NO: 86060
  chr2:234737331-234737409
  Hypo

SEQ ID NO: 118881 - DNA, 35 bp, Homo sapiens; identical to SEQ ID NO: 86061
  chr2:234776737-234776772
  Hypo

SEQ ID NO: 118882 - DNA, 30 bp, Homo sapiens; identical to SEQ ID NO: 39782
  chr2:235382081-235382111
  Hypo

SEQ ID NO: 118883 - DNA, 695 bp, Homo sapiens
  chr2:235404276-235404971
  Hyper
tcgcttttgtctttccgacaactgagccttccacctggggctgggagggcggacagcaggaccggctcttccactccccaccgcggccccccgacctggtcagtagctctggcgttcagacaaaaggtcccctgagctgggggtggggggcaggtcgagagtaggccggtaaatcagacttcgcagctccttaagtcaccagtcctgcatttgggtgcagagattccgttttaaaaattcgaagcatcgctttggttcgctctttgttcgcgggcgcgggttctcgctcatccatccatccatccatccaaccatccatccatccattcattctttcttgacgcactcgctcgctccccggtcgctccgggcgcattaccgcttcttcttctgcttgagggacttcctgcgtttcaggatcatctcatagagcttgtccatgccctcggtgaggccctcgccgatgatggcgcacgccggctggacgtgataggtggtggccgggataagctcgtgcagcgccagctgcttctcaatctctgccaccggcagcgacttgggcaggtcctgcttgttggcgatgaccagcagcggcgtgccctggttctcggcgaacttggtcaccttgtgcagctccgtcttggcctcctccagccggtccacgtccaccgagtccaccacgtagatgatgccgt

SEQ ID NO: 118884 - DNA, 181 bp, Homo sapiens; identical to SEQ ID NO: 86068
  chr2:235859973-235860154
  Hyper

SEQ ID NO: 118885 - DNA, 59 bp, Homo sapiens; identical to SEQ ID NO: 86069
  chr2:235860892-235860951
  Hyper

SEQ ID NO: 118886 - DNA, 90 bp, Homo sapiens; identical to SEQ ID NO: 86072
  chr2:236256461-236256551
  Hypo

SEQ ID NO: 118887 - DNA, 436 bp, Homo sapiens; identical to SEQ ID NO: 86073
  chr2:236401968-236402404
  Hyper

SEQ ID NO: 118888 - DNA, 100 bp, Homo sapiens; identical to SEQ ID NO: 86074
  chr2:236402701-236402801
  Hyper

SEQ ID NO: 118889 - DNA, 175 bp, Homo sapiens; identical to SEQ ID NO: 86075
  chr2:236403151-236403326
  Hyper

SEQ ID NO: 118890 - DNA, 87 bp, Homo sapiens; identical to SEQ ID NO: 86076
  chr2:236403854-236403941
  Hyper

SEQ ID NO: 118891 - DNA, 181 bp, Homo sapiens; identical to SEQ ID NO: 86078
  chr2:236417611-236417792
  Hypo

SEQ ID NO: 118892 - DNA, 193 bp, Homo sapiens; identical to SEQ ID NO: 86079
  chr2:236452425-236452618
  Hypo

SEQ ID NO: 118893 - DNA, 125 bp, Homo sapiens; identical to SEQ ID NO: 86080
  chr2:236577930-236578055
  Hyper

SEQ ID NO: 118894 - DNA, 221 bp, Homo sapiens; identical to SEQ ID NO: 86081
  chr2:236579027-236579248
  Hyper

SEQ ID NO: 118895 - DNA, 126 bp, Homo sapiens
  chr2:236579583-236579709
  Hyper
ggcgggccctcgccacggagcggagcctcgcggccacgcggctacttcagcctgcggcgggccccggccgaagcgcactcgtccagcgccgagagcatcgacggctccccgcgcagaggtgggcag

SEQ ID NO: 118896 - DNA, 42 bp, Homo sapiens; identical to SEQ ID NO: 86082
  chr2:236877226-236877268
  Hypo

SEQ ID NO: 118897 - DNA, 297 bp, Homo sapiens
  chr2:237068390-237068687
  Hyper
ttgggggtgggtgcccggagtgacgtccgcccccccaccccgggcccggccctgcctcaggcttttgcctcgggcccaggccgctctcgagccgtgggcgcgccctcggggctcggcccccggtttcggtctcaggcccccgggagtatcaggagaacaaggtcgcccgagatgggccgccgcgccccccgacggcctccctgcctccctgagtgtccgagccgccaggctggtagcgcagccgggcctcctgcctctctccctcgaggcccacggggtgcacggcttcctgcagga

SEQ ID NO: 118898 - DNA, 16 bp, Homo sapiens
  chr2:237068925-237068941
  Hyper
gcggtggaggctaggg

SEQ ID NO: 118899 - DNA, 1367 bp, Homo sapiens
  chr2:237072335-237073702
  Hyper
ctcaggtgtgtgggtcgggggacggcgtccctgcgggcctcgaatgctgcagcagcgtcgtgtggccagtgggtacctgccccgagcagcaggcgctcaccggcaacctgcactcagcgcttcctggcgggcgggatcccggccttgcggcccccgcgccaggccagggcgcgacccgggcgccatcccctccctgccaggcttcatggcgctgggcggggcgcggccaggagcctctgcggctctcggcgccccgcagagccggccgacgccctcggaggactggcccttctattttattgggctcgaaaaccaagtctgggccattttccgccaccggaactgttgggaacgcggcgggaaagggtgactcggtcgctcccagccttcaccctgcgcctgaagtttgggtggaggtcttggtccccaggcccctccgccgtggggaggtgacggcctgtaagtagtaaaaattaagtcaatattagtactaacccatggcgggccgcgcttccccttcttcggctgagaacctcgccgagggccgagcgccgctgcatcgcagcggctcaccggcctcccctccttcccccactcgaaaggctgaggctggcgaagccccggcttctctcgcgcttcgggctgctggcttggtggcaccacgctcacactcgctggcccgctgaacgcccctgggcctgtccgccgcagtatctggcggcgcgcttcggggtccggcagcgagcggacagggctctgagcgcagggccggggttgggacaggagtgggcttggggaccaggcacgccccaccgagatggggaggcgcgcagctccccgtcccttgcagaccgactcccagctcccctgcgtagcctctcccgttttccccctttgtggtgcggactaccggggcgtccttggggtggggcggtgcccgggtcccgccccctcgaccccgcccggagggggaggtgccggggccgggggcgctccagccagcctccgcctccgactgagggctgccgggaagccggctgggctcgctgggtttttgctcctgtcgccagataacgcccggagcctgatttatggaccctccactctgccggcaggcgagcaccgcttcttttcgggccggagatatttgtaaaggaaagacgtttcctccctggctgtagtcgatttggagcatcaggagtttgtgcaaagccaccaatacccgcactcgcttgcctcctccgggcacccacctcctcctctgccgaagtttgccggcctactaggtatcgattaggctgtgcaaaagggggagatagatttctaaggtgagaattaggttttcttaaattcgtaatcctatcggc

SEQ ID NO: 118900 - DNA, 55 bp, Homo sapiens; identical to SEQ ID NO: 27979
  chr2:237075130-237075185
  Hyper

SEQ ID NO: 118901 - DNA, 370 bp, Homo sapiens; identical to SEQ ID NO: 86091
  chr2:237075817-237076187
  Hyper

SEQ ID NO: 118902 - DNA, 189 bp, Homo sapiens
  chr2:237076558-237076747
  Hyper
ctactccccagcgggcgctgcatcatcatcagcgacggcgggaacgctgcgctcatagacgcgctcggtagaggccagcgagaggcgaaaagtccccgcgccgcgccgccgccgggaagcccgccggacgccgggagcaccgccgggagcgccgggcaggggccgagcgggacccggagagcagacgcc

SEQ ID NO: 118903 - DNA, 608 bp, Homo sapiens
  chr2:237076991-237077599
  Hyper
cggcgtacttatctccggcgggcgcagccagcacctttaaatcgcgctcctctttctcattcacattttgcctgccgcctggcccggctcgcctcacgtggggctgggcgcctctggccattggctgagcggggcgggggtggggcgaaagcggggccccgccctttccacccaagctggcctcgagcgggctgcgggcgccaccgtcggagcgcgcgggccggggagccggagcctgcatgcctagcccgtgccgcgcaaacttgagacgggcggatggcacctccaaggctcggaccttggggccctgcagccttgtcgaggccacctcgaagggtagcctccggggcccgcacccccacggctgggccgggggcgctttatttcttttactgtatttgccatggaaccaacctgcctgcggctcactccagcgctgggtgctccggctgcgcctggggtccgggcgagggtcctggagttgggggcagggtcctgcccctccggagccacccccggggcgaaggctgggagctggcagcgcctgcccgccgccagaaacccgccgggttgctcgctgtaggtccgcgcaccgggtggggcgggga

SEQ ID NO: 118904 - DNA, 60 bp, Homo sapiens; identical to SEQ ID NO: 86097
  chr2:237077904-237077964
  Hyper

SEQ ID NO: 118905 - DNA, 467 bp, Homo sapiens
  chr2:237078192-237078659
  Hyper
cgagcggggcttcctcgagtctccaaggcccgggcttcaacttcccgggtctagacgtcagccctgaaccgccaacagcaccgggttggggagaaggaaagaagggcattgttagttcggtcattaaaaatcagctcacgccgaggagctagtggttggggagttggcccgtgttggacgtgtgttatgtatcacttacaagcacatttaattgggagataaagataaatcgatctttatgaatttatcgacccgattctttgaagctcttttttcgcgttcttcctctttctctcgctctagccccaaggccccccgggggacgtcttaatcccagatcagctcctctgccaggagtcccgccggagacccactgcccacccagcagacctggaggaaagaggggagggtgtgtccttggcgccccgggacgctgggaaaactcgctggtccgccgccagccctct

SEQ ID NO: 118906 - DNA, 42 bp, Homo sapiens; identical to SEQ ID NO: 86099
  chr2:237079083-237079125
  Hyper

SEQ ID NO: 118907 - DNA, 258 bp, Homo sapiens; identical to SEQ ID NO: 86100
  chr2:237080173-237080431
  Hyper

SEQ ID NO: 118908 - DNA, 1538 bp, Homo sapiens
  chr2:237081182-237082720
  Hyper
cagaaacaaaacaaccgcaaaatagaaatgtgaaggggaggggcttttcttcttcttcatttcctcctgggagttgaaaaatgttatccgcaggcctgaaggctgggaaacgtgacccttcacacctgcgccgccctctccactccagcgacgaggaacaggaggagccacagccgctcggcccgcgaggcgagccctcgtggcatctgggaatgggagggtgggggtggaatgctacacagccccggagcccctggggcggcgggcgctgtcgcgccgacggcgcacccggcgagcgttgcgtgcgcttggagcccgggactaccccaactccacgcggaactcggctcccccggccgggatccagatgtccgagggcgcttgcgggtgtcctagttctttttcagagcagccgtaacgattgaggctggggagttcaagaccactgggggtaactgatcgcccatcgcccttcgtcctggaagcccagcgcccgcgctcaccgcgcgtctctccgggagcacctagccaggcaaagggggattctccgtggggactgaggcgtacgcccgccccggggctcccggcttgggaagagggagcaccaggcgaaggccaggctgggggctcgggtccaagggctgcagctgtgcgggcggaggccgggggtgcgggcgggagtggtgtccccttgtgtcctgcccgggtctggctccggccggggttctggaggccgcgtccgtcggcgaaccccagcccttggagtgttggggagggagacgccggccgccaggcgcttctcacctgggtttatctcctcccatctgctccctcggattcccgaggccccacctttcggggacttcaaacgcgccctgccacccggtgcccggctttcatctcccgcacagcaggcattgtttgcgggacttcacagagatgctaatccccgggccgcgtgaaccgcggcctgggaaccgggcagagggcacggaggggtgagggggtgcgctttggcctgggctggggaccttcgggatggcctctcgggcagccctcctgaggagcccgggtctgctaccgtgcgggcgccgcatcccgcctgcctcgtcctggaaggctgcgggcacgtcgcaatgggcctgggctggacgcagccagcgtccaacacacggagaaggaagaagcagaggccagagacgatggccggcgcttagctgtgagccccatgagcttccaatgctcgccaggagaccgtgtgtctaggagaggcaggccatggaccctatgagtcttccctggaggctggaaccccccgggactcctggacaccccaaaccaagtccccagccgctgcctccacgacggccccgacccccttcagggaagtagtattttaaagaggatgcggtctgcccggagggcacgcatttaaccctttagaaaccgcgctggagggagcagaagggtgttgaatcaacagccatgcacaccaggggcacccctccaactttagcttcttccgggaccaaatgagc

SEQ ID NO: 118909 - DNA, 780 bp, Homo sapiens
  chr2:237086290-237087070
  Hyper
ggcctctggaacatctaaaaacagaccagaggccacccaatggaacaggatgcagtgtgacatttcacaacatacgacgcctctcctgggaagggagagctcgcgagcgcctctactgggtgggcgcagcgccatccccattgcacgaaccgagacggaggtgcggaggccgtgtctggccctggagagtcctccctctgtcgtctgctctcagcaccaagtctggcatcgccagggcgccaggcacggccttcccagggagaagccttttctgtcatttttgattattttactttaaatatgtgtgcaaaaccttagctacattctcgtgggccagggataggcaacgcgtgcacctagacctcttgcttgcccccacactccgtctccccagggccaccccctcaacccccccatgccatcagagttttgaacaccgctggagatggcgggggggaggggggcgaatttggaggcgggacccgaactgccggccaaggaccaagggctggcctcgcccttcgctcccactgggcaccgttctcgccgcgggaccttgccttgagcgcgccccctgcgggccgcggtggggattggccccttggaaagagggaaataggctgcgcgcgccggggcgggagaggcgctgcctccagtcctcccgggtgggggtctcccctccgagatccccgagggaacccgtcccgtgcactaccggatttccggtctctgaccagctggggcttcatttctacgcgtgcttttactgctctcctcctc

SEQ ID NO: 118910 - DNA, 196 bp, Homo sapiens; identical to SEQ ID NO: 86106
  chr2:237087422-237087618
  Hyper

SEQ ID NO: 118911 - DNA, 228 bp, Homo sapiens; identical to SEQ ID NO: 86107
  chr2:237088011-237088239
  Hyper

SEQ ID NO: 118912 - DNA, 861 bp, Homo sapiens
  chr2:237145136-237145997
  Hyper
tgtacgccttaaacacgtgccgcttgctgaatgtcaatcacacctcggtaaagctgcttttaaagagcattgctagaaccttgtttccttcctctttctcaagactggcgggggtccacgtggccccctgatcccccctctgaactcaaatgacctttcttaggtgggtcccctgcctgagtccctgaatgcccagcagtcccgcctgcctgcgttgctgcccctgctgggcaggacatccaggcaactttgacagtcggtggagaagcagcaagggcgatgcggtttctgagagagccgcgcgggttcccagcactaaacgtgggcgactttccttaatcttcccccagagacagaaggccatgcaatgacaactccaagggcaggggctggagcattttgactaacagaaaagtcaggatgacacaatgcaagccgagaaaccccacacgagtcctgtgcaaagacaggtggccccgctgcctttccgagacccggagcacacgctgggagggcgctctctggggacgggggctgcgggacccccagaccccgcgcccgggcgcgaactagctgagcggccgctgggcctccctagaggccggcacagctccgcttccgagcgggcctggaagccccgcccgaggagctaaccatttatgtcacactgtgacaattattctgcataaaattatcattaaaaaccctaatttttcagcctccaaccccgccagtggccttttagcatccccggcgccggcggctgggctgtgatcaccgcgctcattacctcggcgtggcgcctcccgcgcgcgctcgcaatcaagcgctaattaaacccgcgggggccggggccggggc

SEQ ID NO: 118913 - DNA, 560 bp, Homo sapiens; identical to SEQ ID NO: 86111
  chr2:237146057-237146617
  Hyper

SEQ ID NO: 118914 - DNA, 390 bp, Homo sapiens
  chr2:237416039-237416429
  Hyper
gagaaaccaggactgcgagaatcttctgcttcgggcaggaaaaggtgaggccgggtttgcttcgcaggcacggagcgcgcaggcgcagagaggtgtttcactccttcccgtcgcgacccagagactcgcgaacctcacttcggccactcaggtgggcgcgacgcggccctagcaacggaaacgccgcgcctgcgcattgccttccgcctgccccctccccccccccgccccccgcattccgcgcctgcgccaccgcgggaggcctgggtgggcgcagctgtgggagccggtcggagtccgagcgctccgtcgcggggcccggccgcttggcgagcctgctccgggccccagcacttagcctgtggtcctccaggccgtcttcccgctttc

SEQ ID NO: 118915 - DNA, 30 bp, Homo sapiens; identical to SEQ ID NO: 86113
  chr2:237486176-237486206
  Hypo

SEQ ID NO: 118916 - DNA, 92 bp, Homo sapiens; identical to SEQ ID NO: 86114
  chr2:237544340-237544432
  Hypo

SEQ ID NO: 118917 - DNA, 81 bp, Homo sapiens; identical to SEQ ID NO: 86115
  chr2:237904291-237904372
  Hypo

SEQ ID NO: 118918 - DNA, 314 bp, Homo sapiens; identical to SEQ ID NO: 86116
  chr2:238280498-238280812
  Hypo

SEQ ID NO: 118919 - DNA, 377 bp, Homo sapiens; identical to SEQ ID NO: 86117
  chr2:238395078-238395455
  Hyper

SEQ ID NO: 118920 - DNA, 157 bp, Homo sapiens; identical to SEQ ID NO: 86118
  chr2:238395729-238395886
  Hyper

SEQ ID NO: 118921 - DNA, 129 bp, Homo sapiens; identical to SEQ ID NO: 86119
  chr2:238475087-238475216
  Hypo

SEQ ID NO: 118922 - DNA, 30 bp, Homo sapiens; identical to SEQ ID NO: 86120
  chr2:238490173-238490203
  Hyper

SEQ ID NO: 118923 - DNA, 993 bp, Homo sapiens
  chr2:238535860-238536853
  Hyper
tcaaccggtgcccaccgccctggcgcgcgtcgctccgcgattaccggcccgccaaacagtccccgcaaagtccaccctccggggctcccggtccctcaggtcccgcgtgcccggccctgggcatccgcagcgtccccgtggtatcggacccccatcgtccctgacacctggcgtctccgccccccgcccccgtcccccgccccgccgtccctggcccctgcagtccctggcccgcgctgcggacctccggctctggcttcccccgggtccccgcggcccccgtccccccgcgtccccgcgtccccggcccagcgcccgctgacgccatgacgccgcggcggagggaggggccggggccggggccgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggtgagcgctccgggagggcagccggggggcgccgggcgggcgcgggggccggacggctgtcagggtctctccggcgtccgtctgtcccgctgtgcgtctgtgccactgcgcgtccggctccaggcgggtgggccgggcaggcgcgcgccggggcgctgatccccaggcgctgcgccccggccccgatctccgaggcctgcggaccccgcacccgttctccagccccgggcccagcccgcgacgctgcgcgccctcccccaccccggccaccgtcggccgctgcgccctcgggagaggagccgggcgccgccagcgcgcgaggtggcccgggctggccgggtgggggcgagcgccccgctttgttgtgcggcatgggaggaggcgggggcttaggcccgacctggaggcagtggacggtcgccggaggccacatggccctgctgaaatggccgagtcgctcaggtgaccat

SEQ ID NO: 118924 - DNA, 30 bp, Homo sapiens; identical to SEQ ID NO: 86123
  chr2:238768112-238768142
  Hyper

SEQ ID NO: 118925 - DNA, 30 bp, Homo sapiens; identical to SEQ ID NO: 86124
  chr2:238768375-238768405
  Hyper

SEQ ID NO: 118926 - DNA, 18 bp, Homo sapiens
  chr2:238833221-238833239
  Hypo
actcggtctcaaaaaaca

SEQ ID NO: 118927 - DNA, 741 bp, Homo sapiens
  chr2:238864558-238865299
  Hyper
cccctggaccccaggcgaggccaccagcgcccaccatccaaagggcgacagggaggcgtccccccaaccccggcggcgatgcctcctgagtcctaaccacacgccgtggacccccgcaccctcagtagccccgcgccgagtgtaaccgcgccccgtgtcctgggatcccgcggcccgggtaaccaggtcccatgtaaccgcagcctggtgaagccgtgcgccctgggcgcggctacttggccctcacggcagggcggagatgcgaggccccagggttcggccccgcagcgccgctgagtccaaggaccgagctgggagtgggggcggagccaagaaggggcgcccctgcgcccacaagccgcagcgcccaggaatcccctgggcgcctccgcgtcccccgcgggctgtcccggcaggcaggcagcccaccccagggctcccctcgtggaaggacacccctgctgaccctggccctggttctggcggtgtctccactcagccctcggagggacgcccacctcccgcggagctgggggactgtggcttcctcctgcgcggggaggtcggtgggcgccgtggacccgtcccgcccctgtctgaggagccgagtcggccacagaggggcagcagactagggagggctgatgggccgtgcacttagctccctccgggctgctggccggggcccttgaacggacagatgccaactggcagatgagggggctgcgtccacccccaccc

SEQ ID NO: 118928 - DNA, 46 bp, Homo sapiens; identical to SEQ ID NO: 86129
  chr2:239039796-239039842
  Hypo

SEQ ID NO: 118929 - DNA, 368 bp, Homo sapiens; identical to SEQ ID NO: 86130
  chr2:239050963-239051331
  Hypo

SEQ ID NO: 118930 - DNA, 84 bp, Homo sapiens; identical to SEQ ID NO: 86131
  chr2:239051823-239051907
  Hypo

SEQ ID NO: 118931 - DNA, 30 bp, Homo sapiens; identical to SEQ ID NO: 86132
  chr2:239071498-239071528
  Hypo

SEQ ID NO: 118932 - DNA, 740 bp, Homo sapiens
  chr2:239072151-239072891
  Hyper
tggggcacttctgcccgagcttcccaaatcttgagggaaacgggagccgctgcagggtcaggacgcaaagactccgaggcccttcaggccgaggggacgtcgccctcgccccacccctgcgcccggcaggcccctggtctcgctagcacctgtcgttcagggctggacccacgcggcgggcgggtgaggggtccctggcgcgcggccaccgctcgctctgtgccaggtgcggtgcggcagcgggagcgcgcggagcccgaaccctgtacgtgtggccccgccgggccggtcgctgcgagcctcgccccggtctcggccaccgccggggaggacgacgacgacgtggtgggggacgtgctggcactgctggccgcgcccctggccccggggccgcgggcgccgcgcgtggaggccgctttcctctgccgcctgcgccgggacgcgttggtggagcggcgcgcgctgcacgagcttggcgtctactacctggtgagtgccggcgcgcgggagggcgggtgagtccggccgggcgggagccggggtgaccatccgtgcccctcgcagcccgacgccgagggtgccttccgccgcggcccgggcctgaacttgaccagcggccagtacagggcgcccgtggctggcttctacgctctcgccgccacgctgcacgtgggtgaggcccggggcgtgggaggatcgcccgctctgtcgcccaccccgccgcccgcccgcttgaccac

SEQ ID NO: 118933 - DNA, 30 bp, Homo sapiens; identical to SEQ ID NO: 39787
  chr2:239083135-239083165
  Hypo

SEQ ID NO: 118934 - DNA, 43 bp, Homo sapiens; identical to SEQ ID NO: 86136
  chr2:239132262-239132305
  Hypo

SEQ ID NO: 118935 - DNA, 30 bp, Homo sapiens; identical to SEQ ID NO: 86137
  chr2:239133018-239133048
  Hypo

SEQ ID NO: 118936 - DNA, 30 bp, Homo sapiens; identical to SEQ ID NO: 86138
  chr2:239133524-239133554
  Hypo

SEQ ID NO: 118937 - DNA, 113 bp, Homo sapiens; identical to SEQ ID NO: 86139
  chr2:239133985-239134098
  Hypo

SEQ ID NO: 118938 - DNA, 431 bp, Homo sapiens
  chr2:239139974-239140405
  Hyper
ctcaatcgttgatttcggctgcacttcctatccctgggggagctttcaacgctccgccgtccaggccgccgggccccgcagcccgcgccccgctctctagggctgggcccccaggggctggacgacctctctcgccttcgctttctcaagcgtaaatcgggcggcgggggctgcagagccttcatctcttcctccgtcccgggatgtcggagagacggcagcccagcctccgccaccgcaaagctgcttaacgggcagcgcgagtccctcgggcaccgttggaggccgttgctcaccgttgggcaagtgctttaagaagcacgaggatgtcgagtgtcaaatgcggcaaagggctcagagctcgccgccaaggggcgtggcctccgggccgcggcggcctctgggagttgtagtcccgcctcaacttgtgg

SEQ ID NO: 118939 - DNA, 165 bp, Homo sapiens; identical to SEQ ID NO: 86141
  chr2:239147044-239147209
  Hypo

SEQ ID NO: 118940 - DNA, 215 bp, Homo sapiens; identical to SEQ ID NO: 86142
  chr2:239147417-239147632
  Hypo

SEQ ID NO: 118941 - DNA, 78 bp, Homo sapiens; identical to SEQ ID NO: 86143
  chr2:239152958-239153036
  Hypo

SEQ ID NO: 118942 - DNA, 30 bp, Homo sapiens; identical to SEQ ID NO: 39790
  chr2:239183260-239183290
  Hypo

SEQ ID NO: 118943 - DNA, 41 bp, Homo sapiens; identical to SEQ ID NO: 86145
  chr2:239186621-239186662
  Hypo

SEQ ID NO: 118944 - DNA, 86 bp, Homo sapiens; identical to SEQ ID NO: 86146
  chr2:239265701-239265787
  Hypo

SEQ ID NO: 118945 - DNA, 30 bp, Homo sapiens; identical to SEQ ID NO: 86147
  chr2:239317559-239317589
  Hypo

SEQ ID NO: 118946 - DNA, 184 bp, Homo sapiens; identical to SEQ ID NO: 39792
  chr2:239322426-239322610
  Hypo

SEQ ID NO: 118947 - DNA, 67 bp, Homo sapiens; identical to SEQ ID NO: 86149
  chr2:239482485-239482552
  Hypo

SEQ ID NO: 118948 - DNA, 30 bp, Homo sapiens; identical to SEQ ID NO: 86150
  chr2:239482782-239482812
  Hypo

SEQ ID NO: 118949 - DNA, 181 bp, Homo sapiens; identical to SEQ ID NO: 86151
  chr2:239684667-239684848
  Hypo

SEQ ID NO: 118950 - DNA, 30 bp, Homo sapiens; identical to SEQ ID NO: 86152
  chr2:239705259-239705289
  Hypo

SEQ ID NO: 118951 - DNA, 295 bp, Homo sapiens
  chr2:239755112-239755407
  Hyper
gcggaggaaggagggcggtcaggccgggtggggctgggtgcggtggctctgcagaacctttaggcaccgaactgaagccgcgggtccggtgcgcggacactgcgcagggcgctgctaccgactcacatgcatgcgagggcccgctcctaggcgttctgccttcctggacggattgttggtaaaacgtcccctagaacggccggagccagggccctcggacaggggcgcgaagggcccgctctttgccgtcctcgggtttcccaacgcggtggtcgtggcccgcgggccccacctc

SEQ ID NO: 118952 - DNA, 247 bp, Homo sapiens
  chr2:239755687-239755934
  Hyper
cggggtccgtggtgtcgctcaccgaggccgggccccacactccagccaccctgagcctcctgctcggagctgcccgcgggctgccagcgcagcggaggctgggcccggggcagcctcgtgcagctcccggagcgccctccgtcctctgctgacccgcgaagcgaaggcggagcgcagaggctggggccgtacaaggcgggccggcaggcgccccaacccgcgcccagcaacccgggtagggccaggc

SEQ ID NO: 118953 - DNA, 81 bp, Homo sapiens
  chr2:239756425-239756506
  Hyper
gccgggcctagggctcggggcggcctgagagtgccctgcgttcggggtgggggcgcgggcggcgggcgaggacccggcccc

SEQ ID NO: 118954 - DNA, 1159 bp, Homo sapiens
  chr2:239757296-239758455
  Hyper
gtggcgcatggagggcgcgtggtccatgtccgcctcccactagcgccgcgccacccacctccggaccggcgcgccagggtaggtgctgcgcgcgcgacgggcgccctccgctgcggggggcgggcggcaggggcgcaggggcattggggcctgctcgtgtctcctcggcgaggccccgcgggccgcgggggcttggatgccgtgcgcttttcctcttagcaaggaaggcgggcgggcgggacgctcacagtcccagggacacccctgagtgcagacttccacgcgagggtgtcagttgggaaccggcggaccggtgactcccccggcgggttctgaagatacttagacagatggtcgcagttttcattctcggtggtgtgtgggtgtccgtggttggcggtggaaggagcgagcatcagaaaaacctcctggggccggctggggactgggatatgaggaccagctgccctttgcgtccgccgcagcgcaggccgcccgcgaagctgcccgagccgggtgttgccgggcgaatggcttcgctttcttcctgggcaagggtagagcgcgtccgtcgggcggacactcagatctacccagctgctcgcgcctggggtccccggccgtcggcgccctggcctgcccagtgggcgtagaggtgcgggcctgcggctccagggtttgcctggggaggacgggaggaaactgccctgcgcttcggggccagagcagccacagggccgggtgtgcccgagaagggccctgggccgagagcgcagagcctggagcgctgaggcaggcgggtccgacgcagccgcgcggagccccagggcgcccgcaggcaggtggagctgacctaggaactgggagccctgagtcccaaccttgaccctggagtacccgggaggggccccgcccatccagccccgcagggatgggcgaggggtccaggctgggaaacgggtctgggggacagggaggctgtgcgcgccgggccctgcgcgaggagaaggctcgggggacacagctgccaggagcactccaagttctggtttcctctggaagagcgattagggcgtcctgcaccgggtccttttcaccagacaccttccaagtccctttagacaagctcgagccacggaggcgccgtccttaggctctg

SEQ ID NO: 118955 - DNA, 30 bp, Homo sapiens; identical to SEQ ID NO: 86159
  chr2:239780321-239780351
  Hypo

SEQ ID NO: 118956 - DNA, 271 bp, Homo sapiens; identical to SEQ ID NO: 86160
  chr2:239888518-239888789
  Hypo

SEQ ID NO: 118957 - DNA, 274 bp, Homo sapiens; identical to SEQ ID NO: 86161
  chr2:239957240-239957514
  Hypo

SEQ ID NO: 118958 - DNA, 127 bp, Homo sapiens; identical to SEQ ID NO: 39794
  chr2:239997460-239997587
  Hypo

SEQ ID NO: 118959 - DNA, 30 bp, Homo sapiens; identical to SEQ ID NO: 86163
  chr2:240003796-240003826
  Hypo

SEQ ID NO: 118960 - DNA, 30 bp, Homo sapiens; identical to SEQ ID NO: 86164
  chr2:240067129-240067159
  Hypo

SEQ ID NO: 118961 - DNA, 55 bp, Homo sapiens; identical to SEQ ID NO: 86165
  chr2:240080007-240080062
  Hypo

SEQ ID NO: 118962 - DNA, 197 bp, Homo sapiens; identical to SEQ ID NO: 86166
  chr2:240080368-240080565
  Hypo

SEQ ID NO: 118963 - DNA, 487 bp, Homo sapiens; identical to SEQ ID NO: 86167
  chr2:240103578-240104065
  Hypo

SEQ ID NO: 118964 - DNA, 23 bp, Homo sapiens
  chr2:240165134-240165157
  Hypo
accgctcccggctggataaatta

SEQ ID NO: 118965 - DNA, 349 bp, Homo sapiens; identical to SEQ ID NO: 86169
  chr2:240168786-240169135
  Hypo

SEQ ID NO: 118966 - DNA, 30 bp, Homo sapiens; identical to SEQ ID NO: 86170
  chr2:240169782-240169812
  Hypo

SEQ ID NO: 118967 - DNA, 116 bp, Homo sapiens; identical to SEQ ID NO: 86171
  chr2:240213695-240213811
  Hypo

SEQ ID NO: 118968 - DNA, 66 bp, Homo sapiens; identical to SEQ ID NO: 86172
  chr2:240216405-240216471
  Hypo

SEQ ID NO: 118969 - DNA, 30 bp, Homo sapiens; identical to SEQ ID NO: 86173
  chr2:240226977-240227007
  Hypo

SEQ ID NO: 118970 - DNA, 146 bp, Homo sapiens; identical to SEQ ID NO: 86175
  chr2:240270365-240270511
  Hypo

SEQ ID NO: 118971 - DNA, 30 bp, Homo sapiens; identical to SEQ ID NO: 86176
  chr2:240319982-240320012
  Hypo

SEQ ID NO: 118972 - DNA, 40 bp, Homo sapiens; identical to SEQ ID NO: 86177
  chr2:240399164-240399204
  Hypo

SEQ ID NO: 118973 - DNA, 30 bp, Homo sapiens; identical to SEQ ID NO: 86178
  chr2:240485257-240485287
  Hypo

SEQ ID NO: 118974 - DNA, 155 bp, Homo sapiens; identical to SEQ ID NO: 86179
  chr2:240505959-240506114
  Hypo

SEQ ID NO: 118975 - DNA, 58 bp, Homo sapiens; identical to SEQ ID NO: 39800
  chr2:240566166-240566224
  Hypo

SEQ ID NO: 118976 - DNA, 55 bp, Homo sapiens; identical to SEQ ID NO: 39801
  chr2:240582300-240582355
  Hypo

SEQ ID NO: 118977 - DNA, 167 bp, Homo sapiens; identical to SEQ ID NO: 86182
  chr2:240612421-240612588
  Hypo

SEQ ID NO: 118978 - DNA, 348 bp, Homo sapiens; identical to SEQ ID NO: 86183
  chr2:240619528-240619876
  Hypo

SEQ ID NO: 118979 - DNA, 30 bp, Homo sapiens; identical to SEQ ID NO: 86184
  chr2:240650547-240650577
  Hypo

SEQ ID NO: 118980 - DNA, 754 bp, Homo sapiens; identical to SEQ ID NO: 86185
  chr2:240658183-240658937
  Hypo

SEQ ID NO: 118981 - DNA, 157 bp, Homo sapiens; identical to SEQ ID NO: 86186
  chr2:240690401-240690558
  Hypo

SEQ ID NO: 118982 - DNA, 27 bp, Homo sapiens
  chr2:240756273-240756300
  Hypo
gggggtggtggctcacgcccagcactt

SEQ ID NO: 118983 - DNA, 398 bp, Homo sapiens; identical to SEQ ID NO: 86188
  chr2:240809303-240809701
  Hypo

SEQ ID NO: 118984 - DNA, 167 bp, Homo sapiens; identical to SEQ ID NO: 86189
  chr2:240874074-240874241
  Hyper

SEQ ID NO: 118985 - DNA, 30 bp, Homo sapiens; identical to SEQ ID NO: 86190
  chr2:240965962-240965992
  Hypo

SEQ ID NO: 118986 - DNA, 112 bp, Homo sapiens; identical to SEQ ID NO: 86191
  chr2:241074559-241074671
  Hypo

SEQ ID NO: 118987 - DNA, 181 bp, Homo sapiens; identical to SEQ ID NO: 86192
  chr2:241095604-241095785
  Hypo

SEQ ID NO: 118988 - DNA, 170 bp, Homo sapiens; identical to SEQ ID NO: 86193
  chr2:241107135-241107305
  Hypo

SEQ ID NO: 118989 - DNA, 30 bp, Homo sapiens; identical to SEQ ID NO: 86194
  chr2:241157270-241157300
  Hypo

SEQ ID NO: 118990 - DNA, 38 bp, Homo sapiens; identical to SEQ ID NO: 86195
  chr2:241236738-241236776
  Hypo

SEQ ID NO: 118991 - DNA, 70 bp, Homo sapiens; identical to SEQ ID NO: 86196
  chr2:241262151-241262221
  Hypo

SEQ ID NO: 118992 - DNA, 34 bp, Homo sapiens; identical to SEQ ID NO: 86197
  chr2:241263378-241263412
  Hypo

SEQ ID NO: 118993 - DNA, 30 bp, Homo sapiens; identical to SEQ ID NO: 86198
  chr2:241264182-241264212
  Hypo

SEQ ID NO: 118994 - DNA, 148 bp, Homo sapiens; identical to SEQ ID NO: 86199
  chr2:241350165-241350313
  Hypo

SEQ ID NO: 118995 - DNA, 58 bp, Homo sapiens; identical to SEQ ID NO: 86200
  chr2:241375833-241375891
  Hyper

SEQ ID NO: 118996 - DNA, 36 bp, Homo sapiens; identical to SEQ ID NO: 86201
  chr2:241392394-241392430
  Hyper

SEQ ID NO: 118997 - DNA, 334 bp, Homo sapiens
  chr2:241393135-241393469
  Hyper
gtgtccagacccctgcgcacccgctccggctgcgcggtttgccgtcttcgtccctggccgcggcggctggcgactggcatcggggcgcccgggacccccagggcggcgacgctgccgccggtgccgccgagcctttgttccgccgccggggccggtttcacgcctgtcgccctcgcaagcagccgcgggtgacaggagccttagccggcctggggcgcggaccctcccacccggggcagaggtgtccctacgacgcccctcggtttcgggtcgcagtgcgcggcggaggttctgcggcggcggaggggctccttggcgacgctgtcatttgggt

SEQ ID NO: 118998 - DNA, 83 bp, Homo sapiens; identical to SEQ ID NO: 86204
  chr2:241398532-241398615
  Hypo

SEQ ID NO: 118999 - DNA, 30 bp, Homo sapiens; identical to SEQ ID NO: 86205
  chr2:241515213-241515243
  Hypo

SEQ ID NO: 119000 - DNA, 118 bp, Homo sapiens; identical to SEQ ID NO: 86206
  chr2:241542135-241542253
  Hypo

SEQ ID NO: 119001 - DNA, 149 bp, Homo sapiens; identical to SEQ ID NO: 86207
  chr2:241543418-241543567
  Hypo

SEQ ID NO: 119002 - DNA, 51 bp, Homo sapiens; identical to SEQ ID NO: 86208
  chr2:241544980-241545031
  Hypo

SEQ ID NO: 119003 - DNA, 33 bp, Homo sapiens; identical to SEQ ID NO: 86209
  chr2:241581574-241581607
  Hypo

SEQ ID NO: 119004 - DNA, 30 bp, Homo sapiens; identical to SEQ ID NO: 86210
  chr2:241581963-241581993
  Hypo

SEQ ID NO: 119005 - DNA, 30 bp, Homo sapiens; identical to SEQ ID NO: 86211
  chr2:241642432-241642462
  Hypo

SEQ ID NO: 119006 - DNA, 179 bp, Homo sapiens; identical to SEQ ID NO: 86212
  chr2:241647044-241647223
  Hypo

SEQ ID NO: 119007 - DNA, 39 bp, Homo sapiens; identical to SEQ ID NO: 86213
  chr2:241656179-241656218
  Hypo

SEQ ID NO: 119008 - DNA, 30 bp, Homo sapiens; identical to SEQ ID NO: 86214
  chr2:241657313-241657343
  Hypo

SEQ ID NO: 119009 - DNA, 73 bp, Homo sapiens; identical to SEQ ID NO: 86215
  chr2:241662384-241662457
  Hypo

SEQ ID NO: 119010 - DNA, 30 bp, Homo sapiens; identical to SEQ ID NO: 86216
  chr2:241681007-241681037
  Hypo

SEQ ID NO: 119011 - DNA, 30 bp, Homo sapiens; identical to SEQ ID NO: 86217
  chr2:241717092-241717122
  Hypo

SEQ ID NO: 119012 - DNA, 53 bp, Homo sapiens; identical to SEQ ID NO: 86218
  chr2:241721534-241721587
  Hypo

SEQ ID NO: 119013 - DNA, 67 bp, Homo sapiens; identical to SEQ ID NO: 86219
  chr2:241722175-241722242
  Hypo

SEQ ID NO: 119014 - DNA, 111 bp, Homo sapiens; identical to SEQ ID NO: 86220
  chr2:241729006-241729117
  Hypo

SEQ ID NO: 119015 - DNA, 2530 bp, Homo sapiens
  chr2:241758266-241760796
  Hyper
ccgcaagatccaatccgcttgccctggcaggcctttaattccagcaatgcaggcaccccttggaaagggctgacgcttggggaaggggtcctccagtctctgggggaaagtccctattcccggggacgtgggcgcgcatcgggtccgcgccgggcgacgtcgcgctcgcgcccagcaggccccatgacttggcattccctccttcccctccccctcccgcccctgcggccggcagggcccccccaaccccacctaccggcgcccagcgccccgctcctgcggaccctccctcccggcggggatgctgccccggcccttcccagcgagagggcagcgcggctggtttgggggaagtcagcgtgaggagcggcttaaagcgggagtgcgaaggtcttcgcggccactgttccttcgtgtcatccgagcccgggcgccgggggcgcgccgccagcctagaccctgcggccccgcagcccctccctcgccgccgggccacacctgttacaggggcgctggctgctgagacgcaggcagtgctcgccggcggcccctcccaggtgctgggtctttctggaagggagctggggtctctggcgtgggagggggtgatgggcaggccggccgtgcaacgaagcgggtggccaggccccaacgccgcagcccccgccccgcccgcctgttttgctcccggctccagcatccgccctcccccaccccgggaaccggagcagctgcccgcgcccggccgccctgcgcgctctcccctcgggccgaggcgctgcagccgcgcaccctcccaggtgcggcgtcagcgtcctcagccccgctcaccatccctcccctcccccgccgtctgggcgcagcccctcccgcagccccgccggtggctcctctccagggaagcggaatagccggggaagggcgggggtatcccgatcccgccggccgggcgagccctcccgagggcgacccccgcccgcctaagccgagggtcccgctgcagccgagatcgcggcaaagggaccttttccagcggcacctgaagggcggacacccctgaatttcccccattgttctctgcggagatggaggaaggtctggaagtgaaggggcctcgcagtgcctgcgctttgggcggcaacaagggcgccgggccggagctccccgccctgggcgcagtgggtgcaggtgcgggctgcgggcgcgggctgccgggcgcaggtgcggggcgaggggcgcgggcgcgggaggccgggcgggcggcggccttacctctccggcgtcactggcggcggccccgcatgggcactggcatgggcgcgggctctcgagcccggagctgctgccgctcgccggctgctctgcgctgtgacggcgccgccgcgtgacgggctgcgcgcccccggcccggaccgccccgcgcccctcccgaggcgctggttggctgcgcgcggcgtccgagctccagtcgccagctggtttgtcgcgcggggagagggacgggcgacgcggccgccgcggggatggggctggggacggagggggccggggccgggctgtgacgtcaccgctgacaccgcggcgggccccgcggagggtgggggaccgacacccggctcggacgcagcgtcccctcccccggcgtgcccctgagacctcgcgggggagggacccggcggcgccccgtcccgaagccccgcgtgcacctgaacttgcccgcggacccctcgccgggccgtcccccaccctggcccctttcgagtgaaatcgtaaaacgtccacctgcccccgctctgagccagcgacagacgcatcgtggggggcgggcggggctggggagggagggctccttgcgccagggatgctggctccgggtgtaacaggtgcgcggtgaaatcgcatcttgtgtcggggccggggcgccgggggaagagcagcagtgacccaggccctccccgccggatgatgcaacccgcccgcggacccgccgcctcgcctctaccgcggctcgtggggaccccccgccctcctctcgccccacctctccaggcccccattgtcctcaccccagcctgtccagtttaacttccttggacccccaagtcacacgccgctcgggggccaccccggcaaaccccagcctgcgtcacccgcccccagccgccttcctagttccaggggctgactggtatctctgtgcgcgccaccgtcctccctccaccgtcccagggctgggcaacttcgacaaagcctctgggcagctcgcccatgggaacctccccgcactgcggtgcgggggtgcacggatttcgggccaccctgaaccccggggctgggtcccctccagcccagcccctgccatcgagcccctgccatgggcatcctggcgtcgcctggctaagcctccctggcgcccagcaggggcctgcgctgccctagcggcctcgccgttaaccatttcatccacactcctgggagagccggcttcacctcagtcccgacagctgcgtgcgagcgccttgcaggtggc

SEQ ID NO: 119016 - DNA, 280 bp, Homo sapiens; identical to SEQ ID NO: 86224
  chr2:241771102-241771382
  Hyper

SEQ ID NO: 119017 - DNA, 188 bp, Homo sapiens; identical to SEQ ID NO: 86225
  chr2:241771583-241771771
  Hyper

SEQ ID NO: 119018 - DNA, 160 bp, Homo sapiens; identical to SEQ ID NO: 86226
  chr2:241771976-241772136
  Hyper

SEQ ID NO: 119019 - DNA, 41 bp, Homo sapiens; identical to SEQ ID NO: 86227
  chr2:241859518-241859559
  Hypo

SEQ ID NO: 119020 - DNA, 270 bp, Homo sapiens; identical to SEQ ID NO: 86228
  chr2:241861858-241862128
  Hypo

SEQ ID NO: 119021 - DNA, 145 bp, Homo sapiens; identical to SEQ ID NO: 86229
  chr2:241862358-241862503
  Hypo

SEQ ID NO: 119022 - DNA, 671 bp, Homo sapiens; identical to SEQ ID NO: 39818
  chr2:241864757-241865428
  Hypo

SEQ ID NO: 119023 - DNA, 30 bp, Homo sapiens; identical to SEQ ID NO: 86231
  chr2:241868098-241868128
  Hypo

SEQ ID NO: 119024 - DNA, 30 bp, Homo sapiens; identical to SEQ ID NO: 86232
  chr2:241873900-241873930
  Hypo

SEQ ID NO: 119025 - DNA, 89 bp, Homo sapiens; identical to SEQ ID NO: 86233
  chr2:241874844-241874933
  Hypo

SEQ ID NO: 119026 - DNA, 146 bp, Homo sapiens; identical to SEQ ID NO: 86234
  chr2:241896932-241897078
  Hypo

SEQ ID NO: 119027 - DNA, 224 bp, Homo sapiens; identical to SEQ ID NO: 86235
  chr2:241937658-241937882
  Hyper

SEQ ID NO: 119028 - DNA, 86 bp, Homo sapiens; identical to SEQ ID NO: 86236
  chr2:241938205-241938291
  Hyper

SEQ ID NO: 119029 - DNA, 30 bp, Homo sapiens; identical to SEQ ID NO: 86237
  chr2:241971172-241971202
  Hypo

SEQ ID NO: 119030 - DNA, 30 bp, Homo sapiens; identical to SEQ ID NO: 86238
  chr2:241989234-241989264
  Hypo

SEQ ID NO: 119031 - DNA, 307 bp, Homo sapiens; identical to SEQ ID NO: 86239
  chr2:242004869-242005176
  Hypo

SEQ ID NO: 119032 - DNA, 105 bp, Homo sapiens; identical to SEQ ID NO: 86240
  chr2:242006589-242006694
  Hypo

SEQ ID NO: 119033 - DNA, 314 bp, Homo sapiens; identical to SEQ ID NO: 86241
  chr2:242009344-242009658
  Hypo

SEQ ID NO: 119034 - DNA, 30 bp, Homo sapiens; identical to SEQ ID NO: 39822
  chr2:242011200-242011230
  Hypo

SEQ ID NO: 119035 - DNA, 122 bp, Homo sapiens; identical to SEQ ID NO: 86243
  chr2:242011442-242011564
  Hypo

SEQ ID NO: 119036 - DNA, 70 bp, Homo sapiens; identical to SEQ ID NO: 39823
  chr2:242021761-242021831
  Hypo

SEQ ID NO: 119037 - DNA, 30 bp, Homo sapiens; identical to SEQ ID NO: 86245
  chr2:242022435-242022465
  Hypo

SEQ ID NO: 119038 - DNA, 59 bp, Homo sapiens; identical to SEQ ID NO: 86246
  chr2:242128768-242128827
  Hypo

SEQ ID NO: 119039 - DNA, 30 bp, Homo sapiens; identical to SEQ ID NO: 86247
  chr2:242129507-242129537
  Hypo

SEQ ID NO: 119040 - DNA, 30 bp, Homo sapiens; identical to SEQ ID NO: 39825
  chr2:242131916-242131946
  Hypo

SEQ ID NO: 119041 - DNA, 164 bp, Homo sapiens; identical to SEQ ID NO: 86249
  chr2:242138184-242138348
  Hypo

SEQ ID NO: 119042 - DNA, 30 bp, Homo sapiens; identical to SEQ ID NO: 86250
  chr2:242143600-242143630
  Hypo

SEQ ID NO: 119043 - DNA, 190 bp, Homo sapiens; identical to SEQ ID NO: 86251
  chr2:242148690-242148880
  Hypo

SEQ ID NO: 119044 - DNA, 143 bp, Homo sapiens; identical to SEQ ID NO: 86252
  chr2:242153667-242153810
  Hypo

SEQ ID NO: 119045 - DNA, 122 bp, Homo sapiens; identical to SEQ ID NO: 86253
  chr2:242156554-242156676
  Hypo

SEQ ID NO: 119046 - DNA, 159 bp, Homo sapiens; identical to SEQ ID NO: 86254
  chr2:242294167-242294326
  Hypo

SEQ ID NO: 119047 - DNA, 147 bp, Homo sapiens; identical to SEQ ID NO: 86257
  chr2:242436356-242436503
  Hypo

SEQ ID NO: 119048 - DNA, 30 bp, Homo sapiens; identical to SEQ ID NO: 86258
  chr2:242439539-242439569
  Hypo

SEQ ID NO: 119049 - DNA, 47 bp, Homo sapiens; identical to SEQ ID NO: 86259
  chr2:242448500-242448547
  Hyper

SEQ ID NO: 119050 - DNA, 89 bp, Homo sapiens; identical to SEQ ID NO: 86260
  chr2:242467414-242467503
  Hypo

SEQ ID NO: 119051 - DNA, 46 bp, Homo sapiens; identical to SEQ ID NO: 86261
  chr2:242472490-242472536
  Hypo

SEQ ID NO: 119052 - DNA, 513 bp, Homo sapiens
  chr2:242498287-242498800
  Hyper
ggcgccggggcggggcgcgcgtcctcgcgggtctgaatggaagggtcgaggtcgtcgtcggcggcgagcagatcctgaagccagaactccaccccggcgcccgcgccatgcggcgggagaggtgagcgcggcgggcgtggcgtccgtgccggggtgcccggggtgccacgggaacggcgaggccggggacacgcgcgcaggacgccagcggcggaggtgggcggccccgggccggggcggggagggccgggtcctggcagtcgccgtgggggacgcgctgggctgtgccctccgcccccgccgcccacgcactcgtcttcgagggcgggcccggcggccccggagcaaaccgccgtctccccgcggccccaccggtccctggcagcctcggggaatgtctgtagctgaattcgggctctgaaagaaggtggcgctgggtttttaaagatttggggcacaaaaaacgagagcggacccggcgccggctacggcccttcccgagggccacgccca

SEQ ID NO: 119053 - DNA, 91 bp, Homo sapiens; identical to SEQ ID NO: 86263
  chr2:242499035-242499126
  Hyper

SEQ ID NO: 119054 - DNA, 30 bp, Homo sapiens; identical to SEQ ID NO: 86264
  chr2:242501690-242501720
  Hypo

SEQ ID NO: 119055 - DNA, 134 bp, Homo sapiens; identical to SEQ ID NO: 86265
  chr2:242523955-242524089
  Hypo

SEQ ID NO: 119056 - DNA, 37 bp, Homo sapiens; identical to SEQ ID NO: 86266
  chr2:242524369-242524406
  Hypo

SEQ ID NO: 119057 - DNA, 51 bp, Homo sapiens; identical to SEQ ID NO: 86267
  chr2:242549626-242549677
  Hyper

SEQ ID NO: 119058 - DNA, 120 bp, Homo sapiens; identical to SEQ ID NO: 86268
  chr2:242550007-242550127
  Hyper

SEQ ID NO: 119059 - DNA, 75 bp, Homo sapiens; identical to SEQ ID NO: 86269
  chr2:242554549-242554624
  Hypo

SEQ ID NO: 119060 - DNA, 124 bp, Homo sapiens; identical to SEQ ID NO: 86270
  chr2:242598673-242598797
  Hypo

SEQ ID NO: 119061 - DNA, 99 bp, Homo sapiens; identical to SEQ ID NO: 86271
  chr2:242602250-242602349
  Hypo

SEQ ID NO: 119062 - DNA, 30 bp, Homo sapiens; identical to SEQ ID NO: 86272
  chr2:242617894-242617924
  Hypo

SEQ ID NO: 119063 - DNA, 39 bp, Homo sapiens; identical to SEQ ID NO: 86273
  chr2:242625092-242625131
  Hypo

SEQ ID NO: 119064 - DNA, 120 bp, Homo sapiens; identical to SEQ ID NO: 86274
  chr2:242636865-242636985
  Hypo

SEQ ID NO: 119065 - DNA, 87 bp, Homo sapiens; identical to SEQ ID NO: 86275
  chr2:242637045-242637132
  Hypo

SEQ ID NO: 119066 - DNA, 71 bp, Homo sapiens; identical to SEQ ID NO: 39832
  chr2:242672951-242673022
  Hypo

SEQ ID NO: 119067 - DNA, 30 bp, Homo sapiens; identical to SEQ ID NO: 86277
  chr2:242714055-242714085
  Hypo

SEQ ID NO: 119068 - DNA, 30 bp, Homo sapiens; identical to SEQ ID NO: 86278
  chr2:242716305-242716335
  Hypo

SEQ ID NO: 119069 - DNA, 89 bp, Homo sapiens; identical to SEQ ID NO: 86280
  chr2:242735157-242735246
  Hypo

SEQ ID NO: 119070 - DNA, 782 bp, Homo sapiens; identical to SEQ ID NO: 86281
  chr2:242755844-242756626
  Hypo

SEQ ID NO: 119071 - DNA, 180 bp, Homo sapiens; identical to SEQ ID NO: 86282
  chr2:242757477-242757657
  Hypo

SEQ ID NO: 119072 - DNA, 53 bp, Homo sapiens; identical to SEQ ID NO: 86283
  chr2:242762778-242762831
  Hypo

SEQ ID NO: 119073 - DNA, 60 bp, Homo sapiens; identical to SEQ ID NO: 86284
  chr2:242763132-242763192
  Hypo

SEQ ID NO: 119074 - DNA, 99 bp, Homo sapiens; identical to SEQ ID NO: 86285
  chr2:242766114-242766213
  Hypo

SEQ ID NO: 119075 - DNA, 132 bp, Homo sapiens; identical to SEQ ID NO: 86286
  chr2:242784279-242784411
  Hypo

SEQ ID NO: 119076 - DNA, 39 bp, Homo sapiens; identical to SEQ ID NO: 39837
  chr2:242791597-242791636
  Hypo

SEQ ID NO: 119077 - DNA, 244 bp, Homo sapiens; identical to SEQ ID NO: 86288
  chr2:242794852-242795096
  Hypo

SEQ ID NO: 119078 - DNA, 30 bp, Homo sapiens; identical to SEQ ID NO: 39839
  chr2:242814897-242814927
  Hypo

SEQ ID NO: 119079 - DNA, 111 bp, Homo sapiens; identical to SEQ ID NO: 86290
  chr2:242815269-242815380
  Hypo

SEQ ID NO: 119080 - DNA, 30 bp, Homo sapiens; identical to SEQ ID NO: 86291
  chr2:242827465-242827495
  Hypo

SEQ ID NO: 119081 - DNA, 30 bp, Homo sapiens; identical to SEQ ID NO: 86292
  chr2:242829172-242829202
  Hypo

SEQ ID NO: 119082 - DNA, 30 bp, Homo sapiens; identical to SEQ ID NO: 86293
  chr2:242829930-242829960
  Hypo

SEQ ID NO: 119083 - DNA, 388 bp, Homo sapiens; identical to SEQ ID NO: 86294
  chr2:242832880-242833268
  Hypo

SEQ ID NO: 119084 - DNA, 363 bp, Homo sapiens; identical to SEQ ID NO: 86295
  chr2:242833478-242833841
  Hypo

SEQ ID NO: 119085 - DNA, 247 bp, Homo sapiens; identical to SEQ ID NO: 86296
  chr2:242836393-242836640
  Hypo

SEQ ID NO: 119086 - DNA, 30 bp, Homo sapiens; identical to SEQ ID NO: 86297
  chr2:242849495-242849525
  Hypo

SEQ ID NO: 119087 - DNA, 60 bp, Homo sapiens; identical to SEQ ID NO: 86298
  chr2:242890284-242890344
  Hypo

SEQ ID NO: 119088 - DNA, 84 bp, Homo sapiens; identical to SEQ ID NO: 86299
  chr2:242891217-242891301
  Hypo

SEQ ID NO: 119089 - DNA, 172 bp, Homo sapiens; identical to SEQ ID NO: 86300
  chr2:242891535-242891707
  Hypo

SEQ ID NO: 119090 - DNA, 30 bp, Homo sapiens; identical to SEQ ID NO: 39845
  chr2:242892372-242892402
  Hypo

SEQ ID NO: 119091 - DNA, 38 bp, Homo sapiens; identical to SEQ ID NO: 86302
  chr2:242913228-242913266
  Hypo

SEQ ID NO: 119092 - DNA, 180 bp, Homo sapiens; identical to SEQ ID NO: 86303
  chr2:242925496-242925676
  Hypo

SEQ ID NO: 119093 - DNA, 159 bp, Homo sapiens; identical to SEQ ID NO: 86304
  chr2:242929019-242929178
  Hypo

SEQ ID NO: 119094 - DNA, 39 bp, Homo sapiens; identical to SEQ ID NO: 86305
  chr2:242930454-242930493
  Hypo

SEQ ID NO: 119095 - DNA, 30 bp, Homo sapiens; identical to SEQ ID NO: 86306
  chr2:242933429-242933459
  Hypo

SEQ ID NO: 119096 - DNA, 30 bp, Homo sapiens; identical to SEQ ID NO: 86307
  chr2:242948345-242948375
  Hypo

SEQ ID NO: 119097 - DNA, 131 bp, Homo sapiens; identical to SEQ ID NO: 86308
  chr2:242985060-242985191
  Hypo

SEQ ID NO: 119098 - DNA, 99 bp, Homo sapiens; identical to SEQ ID NO: 87264
  chr20:244370-244469
  Hypo

SEQ ID NO: 119099 - DNA, 36 bp, Homo sapiens; identical to SEQ ID NO: 87330
  chr20:276977-277013
  Hypo

SEQ ID NO: 119100 - DNA, 321 bp, Homo sapiens
  chr20:291052-291373
  Hyper
cccccaaatccaggccgccctgccccctccggaaaggggagttgggggcgagcgccgaaatctgagtggctctttcaagcctccgttgccatagaaaccggccgcacaggccgatgctgtccattacaccatcctctagcctcgcagccaatggactccgagctccatcgccagaggccccgccccccagctctggggagtccaccaatcagcaggtcccgtgacttagagccctgccctcggcccagggacaccaccaatgcgcttcgaccctgccctccttctcttcggtgtaacaagaagactcgatatttttttttt

SEQ ID NO: 119101 - DNA, 40 bp, Homo sapiens; identical to SEQ ID NO: 87364
  chr20:304445-304485
  Hypo

SEQ ID NO: 119102 - DNA, 182 bp, Homo sapiens; identical to SEQ ID NO: 87433
  chr20:327689-327871
  Hyper

SEQ ID NO: 119103 - DNA, 250 bp, Homo sapiens; identical to SEQ ID NO: 87544
  chr20:399939-400189
  Hypo

SEQ ID NO: 119104 - DNA, 1155 bp, Homo sapiens; identical to SEQ ID NO: 87550
  chr20:401016-402171
  Hypo

SEQ ID NO: 119105 - DNA, 821 bp, Homo sapiens
  chr20:590311-591132
  Hyper
cctaccccgacctggcggccgcagcgagggacgcagcacactcacccccttgcgctggttgctgaggcagaaggtgcagatggagcgcggctggcggccgccgtcggcggcggcggggacggcgcccttggcactgcccgcggcacggaagcacggctgcccgtcgtcggccgagtcgcccagcagcagcacgttggccaggtgcgcgatgtagctggacgccaggcgcacggtctcgatcttggacagcttgcggtccaccggctcggtggggatgagcgtgcgcagcgccgtgaaggccgtgttcacgctctgagtgcggtcccgctcccgcgcgttggccgcctgccgctgtcgcaccaccaccacggggcccgcgccgccgccgccgcccgcccgccgcccgcccccggggcccgggccgcgccgcgccgcctccgggccctcgcagcagccgaacgactggtccgacgcgtcgctctcgctgcggttctcctcgtcctcgctcagcagccgcacgtccgggtacagcacgtgcgcgccgacgggccgcagcagcgcgaacgccatgggcgccggccgcgtccctccgtgcgccgcgtcccagcgtcggccgcgccccgccgtgcgctcccgcgcgctcccacggccccgccggcccccgccttataggcgagggaggggccaatggcaaggccgccccggccgggggcggagggctccgcccggccaatggggaggcgtccgcccggccaatggggaggcgtccgccgcgccctggccaatggcgacgctcccaccgcctccgtcccccaggttga

SEQ ID NO: 119106 - DNA, 193 bp, Homo sapiens
  chr20:592405-592598
  Hyper
cctggatccccccaccgccagcatttgaccgtgaccccagccaggctgggctttggggaggagggaaacagccagcatgggccccctccccgcagggctggtcccacacacagccccagaccaggctgctgcttcctgagccgatgaattattaccgggagatttccttccctgtctgcgcctcctcacaggg

SEQ ID NO: 119107 - DNA, 30 bp, Homo sapiens; identical to SEQ ID NO: 88333
  chr20:620674-620704
  Hypo

SEQ ID NO: 119108 - DNA, 30 bp, Homo sapiens; identical to SEQ ID NO: 88396
  chr20:624100-624130
  Hypo

SEQ ID NO: 119109 - DNA, 1253 bp, Homo sapiens
  chr20:644114-645367
  Hyper
ggacgctggggaagacggtgtggaagtgagtcgtgggtttgggggttggggagaaaagttccgggccgggccgggggtccccacgagagggtcatgggcagggaaacgcagccggggctgggcgagggcgctgcgggcgcaggtagggggcccggggcgcgtggagagcgagttccgggcgcgagggcgaggcggaaggctcagctggccgggccggcgggggtcggcgggggtggctcggccgccttggcgcaggccgcctcgcagtgcttgtggaggtaggacttgagcgcgaagctcttgtcgcactggcggcagcggtagtgcttgaaggccgagtgcgtctgcatgtgcgcgcgcaggttggagcggtcggcgaaggccttgccgcagtgcgcgcagccgaacggcttttcgccggtgtgcgagcgcatgtgaccctgcagcagccagggccgcgagaaggccttgccgcagacgccgcacttgtggcgcaggttgtgcgtgagcaggtgcatggcgagcgcgggcatggacacgtaggccttgccgcacgtcgggcatttgcgcgccagctggctgtccaggctgcggtgcgtctgcttgtggcggctcaggttcgacgacgtggcgtaggtcttgccgcactcggcgcacgcgtgccggtgcccgccgcccgcctgcgcccccgcgcgccccgcgcgccccccggcgccccccgcgtctcccgagccccccgcgtccccgccgcccccgccccgccgccgccgcgagcgcccgtccgagatgaagaaggcgtccatggagtagctgtcggtcactgccgcctcccctcggaagtagcgcgccgacaggctcgactgcgggctttcggggtcgctgtactcctccggcgccgccggcgggtacgcgggctcggccggggccagctccaggcccggcttctggtccgcatcgtagctgctcgggggcaggcggtgcggggcgtaccctggagggggcgagaagtggaggggcggtgagaggaggcgccgaagagggtttcccgctttgagcgcgtcaccctttgcgccttccagcttggcgcccctgtggcagctccgacagtggtggtctccgacctgcacctcagctcttcctgtcaggcagcctgggttcaattccttcctccatcgacggcagtgcaaatagccgccaccccaacccacggagcatggggccagcacggttgtacagagcgtaccttcactatc

SEQ ID NO: 119110 - DNA, 63 bp, Homo sapiens; identical to SEQ ID NO: 88455
  chr20:656222-656285
  Hyper

SEQ ID NO: 119111 - DNA, 155 bp, Homo sapiens; identical to SEQ ID NO: 88456
  chr20:656542-656697
  Hyper

SEQ ID NO: 119112 - DNA, 188 bp, Homo sapiens; identical to SEQ ID NO: 88457
  chr20:656937-657125
  Hyper

SEQ ID NO: 119113 - DNA, 27 bp, Homo sapiens
  chr20:673796-673823
  Hypo
cagaaaactaggactcggacacaccag

SEQ ID NO: 119114 - DNA, 86 bp, Homo sapiens; identical to SEQ ID NO: 88459
  chr20:673883-673969
  Hypo

SEQ ID NO: 119115 - DNA, 30 bp, Homo sapiens; identical to SEQ ID NO: 88462
  chr20:688324-688354
  Hypo

SEQ ID NO: 119116 - DNA, 224 bp, Homo sapiens; identical to SEQ ID NO: 88463
  chr20:690677-690901
  Hyper

SEQ ID NO: 119117 - DNA, 251 bp, Homo sapiens; identical to SEQ ID NO: 88464
  chr20:708600-708851
  Hyper

SEQ ID NO: 119118 - DNA, 213 bp, Homo sapiens; identical to SEQ ID NO: 88465
  chr20:741858-742071
  Hypo

SEQ ID NO: 119119 - DNA, 30 bp, Homo sapiens; identical to SEQ ID NO: 88467
  chr20:796141-796171
  Hypo

SEQ ID NO: 119120 - DNA, 45 bp, Homo sapiens; identical to SEQ ID NO: 46068
  chr20:799104-799149
  Hypo

SEQ ID NO: 119121 - DNA, 44 bp, Homo sapiens; identical to SEQ ID NO: 46069
  chr20:799689-799733
  Hypo

SEQ ID NO: 119122 - DNA, 30 bp, Homo sapiens; identical to SEQ ID NO: 88471
  chr20:848500-848530
  Hypo

SEQ ID NO: 119123 - DNA, 108 bp, Homo sapiens; identical to SEQ ID NO: 88472
  chr20:865993-866101
  Hyper

SEQ ID NO: 119124 - DNA, 547 bp, Homo sapiens
  chr20:982661-983208
  Hyper
cggtcctccggcccccggtctgccccgcagcgcctgcccggccgccctgcccagccaccccttgtaccttgcttcttccttcggttcagggcgagcatgtccacggcgtgggcgacgagcaggagcaggcagagtggcgcccgcatctgggcagccggatccgggctggcgctccccaggcggcccgacggcccaagggccccacgtcccggcggcggcacggcgggcgcgggggctgctgtgggcgcgccgggcgcatccgccaggcgcgggtcggtccggccgccaggtctagtgagggcgttggcggagccggggcactgccctggcggggaggagccggcgcggcgggggcggcgcgttaaccagctcggggcccgggagcgcgcgcggggagggggcgggggtcacccgggtcggggccctcgagttcgatctgtcccgcagccggcggtcttgcgtctttcccgcccccagcactgcccccgagcacgtgcacgtgcccaccgccagccacaggtacgcacgcgcgcgcaggtacagatgc

SEQ ID NO: 119125 - DNA, 30 bp, Homo sapiens; identical to SEQ ID NO: 87098
  chr20:1165419-1165449
  Hyper

SEQ ID NO: 119126 - DNA, 30 bp, Homo sapiens; identical to SEQ ID NO: 87100
  chr20:1167086-1167116
  Hypo

SEQ ID NO: 119127 - DNA, 68 bp, Homo sapiens; identical to SEQ ID NO: 87102
  chr20:1206095-1206163
  Hyper

SEQ ID NO: 119128 - DNA, 507 bp, Homo sapiens; identical to SEQ ID NO: 87103
  chr20:1206684-1207191
  Hyper

SEQ ID NO: 119129 - DNA, 156 bp, Homo sapiens; identical to SEQ ID NO: 87108
  chr20:1323452-1323608
  Hypo

SEQ ID NO: 119130 - DNA, 30 bp, Homo sapiens; identical to SEQ ID NO: 87111
  chr20:1644048-1644078
  Hypo

SEQ ID NO: 119131 - DNA, 91 bp, Homo sapiens; identical to SEQ ID NO: 87114
  chr20:1692213-1692304
  Hypo

SEQ ID NO: 119132 - DNA, 1139 bp, Homo sapiens
  chr20:1783321-1784460
  Hyper
tccaggcagtaggttcgccagccattgcttgtgcgtcttcgcggagagagaggggggagatgccccggcgctccttacccggctggataagaccctttggggaacttgctgcttcgcaagtcttacttgtgaggacccggagggtttgcctttgaccccgcctgtgaccttaagaaaacccctttctaccctgcgcctgtcccacagctggaagtgataattttaagaatgaattaagcactcggtgtgtgacactgcggcactaagcactttctggactgtgttaggccccattttacagacggggaagctgaggcctccagaggcggagtaacctgctcatggttacaaagctggtcagcggcgggcaggatttgaatccagggttcccggttcctaatcctctgcttttaccacttaatttatcctgcctccaagggctgctgggaaaaaggcggatttcaaaggagaagcagctaaggaaaagctctggaaagggccaacggagcggatattcccggagcccctctgcgagccacgcgcccctctgggaagcccgcttccccctgcagacaggcgctgtgacacgcttgcgccccggtcgaacaggcgaagaggccgaggcccagagcggcgcagggcgagcctggaggctgcgccccagacctggaccagccacggacgccgctcccgccgctccctccgctccgctgcgctccgcacgctggcgccggctccccgaggccccgggcgccccggccgcacgcctgggtaaaaggtcccgaggagtccgcagaagcgcgcccacgcccgagacggccgtttccgccggcctgggaaaggggcggagaagggggtcgcccgggccgcagcgtgccggtccccgccggccgagccgtgtttggggccagtccccgcaccccgcttcttccccacctggggagcggggcgccgcggtaggggcactggagcgcacgatgcaccccgccaacgagtcctttctgcagacggggttcctgttttcatgcaaatgcctttgttagcgcaccgggaaccagggggacggaactgcagctgacgcgggctgcgcgccgcttttccgccttcgcttgattcggcctcaacgacttaaacgcgcc

SEQ ID NO: 119133 - DNA, 165 bp, Homo sapiens; identical to SEQ ID NO: 87141
  chr20:1856228-1856393
  Hypo

SEQ ID NO: 119134 - DNA, 32 bp, Homo sapiens; identical to SEQ ID NO: 87155
  chr20:2002327-2002359
  Hypo

SEQ ID NO: 119135 - DNA, 120 bp, Homo sapiens; identical to SEQ ID NO: 87168
  chr20:2058784-2058904
  Hypo

SEQ ID NO: 119136 - DNA, 147 bp, Homo sapiens; identical to SEQ ID NO: 5237
  chr20:2113428-2113575
  Hypo

SEQ ID NO: 119137 - DNA, 323 bp, Homo sapiens; identical to SEQ ID NO: 87233
  chr20:2187713-2188036
  Hyper

SEQ ID NO: 119138 - DNA, 30 bp, Homo sapiens; identical to SEQ ID NO: 87263
  chr20:2398195-2398225
  Hypo

SEQ ID NO: 119139 - DNA, 41 bp, Homo sapiens; identical to SEQ ID NO: 46074
  chr20:2444391-2444432
  Hypo

SEQ ID NO: 119140 - DNA, 505 bp, Homo sapiens
  chr20:2539304-2539809
  Hyper
gagggcaggagaaagcgcgacgagagggcctccttccaggagcggacagcagccccaaagagggaaaaggagattccgaggagggaggagaagtcgaagcggcagaagaaacccaggtgtgttgtggctccgattctgggcattcgctccgcgcgctcccgctccttcgcggcccttccccttcccccgtgagggactgatgcccccctccccggggagaggcagcccgtgccctcgctctggcttccgtgcctcccagcccttaccactgccccactctgcggtgggttcttcatcccagaaccgggatgaagatcgcgggtccgcgcgggggagtggccgcgggctctccactccagcgcctcgtggcacccggtgaggcggggcgcgggtggagaggtggcggggcgcgggtggagaggtgacagggcagcgggtgggacacgatcccgcgtcccctgaactccagctggtgactcaccccggctctcgaagaggaggagct

SEQ ID NO: 119141 - DNA, 246 bp, Homo sapiens; identical to SEQ ID NO: 87312
  chr20:2583218-2583464
  Hypo

SEQ ID NO: 119142 - DNA, 23 bp, Homo sapiens
  chr20:2645508-2645531
  Hypo
aacatagggagacctcgactcta

SEQ ID NO: 119143 - DNA, 30 bp, Homo sapiens; identical to SEQ ID NO: 87321
  chr20:2646617-2646647
  Hypo

SEQ ID NO: 119144 - DNA, 158 bp, Homo sapiens; identical to SEQ ID NO: 87322
  chr20:2668770-2668928
  Hyper

SEQ ID NO: 119145 - DNA, 282 bp, Homo sapiens
  chr20:2672952-2673234
  Hyper
gcgaaagctcggaggcgtcaaaatgagcagcaagtccaggcacaaggcgtcgggcgcggagagtacggcgggtgccgggggagggagatgaggccgcgaagacgccggggcttcgtccggcggcgacggggaggccgcggaggttcccgagcgcagcggggcgcgcacctcccgctcgggccgggctccctcgccgcgcggccccggatcctccctgcgcgggtttccgtggcccccgccgggctcttccgttccctcccgcggcctcgaccaggccgcagc

SEQ ID NO: 119146 - DNA, 313 bp, Homo sapiens
  chr20:2674135-2674448
  Hyper
ggagcgcccaagaggcgagcgcgcactgagccacccggactcggcgctgcgctgctggaggcgcctggtgccgtcgggtcgggctgagctagacgcccgcagcctcagcgggaccggatccggggcggcgggggcgctcactcaccgcgcgccctcatgttccctgcgcaggacgctctgccccgcagcgggctgaacctgaaggaggagccgctgctgcccgccggcctgggctcagtgcgctcctggatgcagggcgcgggcatcctggacgccagcaccgcggcgcagaggtaagcgctcggaccggacc

SEQ ID NO: 119147 - DNA, 30 bp, Homo sapiens; identical to SEQ ID NO: 87326
  chr20:2718301-2718331
  Hypo

SEQ ID NO: 119148 - DNA, 209 bp, Homo sapiens; identical to SEQ ID NO: 87327
  chr20:2728381-2728590
  Hypo

SEQ ID NO: 119149 - DNA, 135 bp, Homo sapiens
  chr20:2731229-2731364
  Hyper
tcctctccaccccaccgcagtccccaccatcgcgcagccccccgcaccgatgctcatcgagcccttcgagggacactcggtagtgaccctacttagcctccccggagctccagtctaacgcggaaaggctgagca

SEQ ID NO: 119150 - DNA, 59 bp, Homo sapiens; identical to SEQ ID NO: 37876
  chr20:2731616-2731675
  Hyper

SEQ ID NO: 119151 - DNA, 148 bp, Homo sapiens; identical to SEQ ID NO: 87331
  chr20:2774812-2774960
  Hypo

SEQ ID NO: 119152 - DNA, 212 bp, Homo sapiens; identical to SEQ ID NO: 87332
  chr20:2775721-2775933
  Hypo

SEQ ID NO: 119153 - DNA, 114 bp, Homo sapiens; identical to SEQ ID NO: 87333
  chr20:2777098-2777212
  Hypo

SEQ ID NO: 119154 - DNA, 83 bp, Homo sapiens; identical to SEQ ID NO: 87334
  chr20:2780664-2780747
  Hyper

SEQ ID NO: 119155 - DNA, 1103 bp, Homo sapiens
  chr20:2780867-2781970
  Hyper
tgtgtgagtgcgcgcgcgtgtgtgcgcgtgagtgcgagtgtgcgtgcggggtgagtgtgcatgactgtgagtgtgcgtgggtgtgcgtgtgcccgcgtgttagggagggatcgccccacggggcaggagagccgggcagtcggcttgcgggggagcggaccgtcggtcggggaactcaccgttagctgtctccgccggcggctgtgccgggctgctatgcagggccggggtcgagcctgggaccttggtggtcccgggctgcgcgaggcccagcaccgagttcctgggcgcccccagagccgggccgacggccggcgcgaaggcggccagggcgagcaggagcccccacatggcggggattgagtgccaggggcgcgcgggctacggcgggtggcgggtcggtctcttcctgccgagtgcgccgagccccccgccccttcctgccccccgcccctccgcagcctcctgcccgcccacagcccgctgcccgcctcggacctcggagaggaggagagggccgggaggagcgagcggggctgacctccaaggggccgccccaagtctcaggaccgccgactctgcccttcctctccgccgtctggggccaacccgcctcgttggcgcgctgcgcctttatagtctgcaaagccacactgaagagaccagagatcacctggtggccatcaagtcgaccaacaggaggcaaagccccttatctgagcaattcagaatgacacttccctattgtctaaagccacatctggtaccaagcttccgtcccaagaatttataagtaactagaatttctgtacgtttccggaatgagtgcacgttaagacccattgtgcaaactttgctgacatcaaggcaccaaaatatcgacaaatgtaaccatttaccatgacctaagtgactaatgtggtccaaattaccctgcagttccccgcagggagctcagtcctctcttgctgaagcgcctactgcgctctgctgcctcgtcctttccgtctaataaaactttccttttcagacctacacggttgttgataagttcttttaccacccgggagccaaccacttcccggttccggagctctgacacc

SEQ ID NO: 119156 - DNA, 513 bp, Homo sapiens
  chr20:2785576-2786089
  Hyper
gggcccaagaagaggcggcacggcggcgcttcccaccaccaccatcaccaagcccggccctgcccctcctctcctttcccttccctcccctactccttcgctcactcacccggctgccacgtcccgtcccggggttacataacccggagagagaagcctgagcgatagcctgcgggctggggctgcggtggaggagccaagggttgatgcactgcctgacctgccctccggctcctcgcccccagcccgtattctcctcggggagccggcagccctgggtctgcccagatccggagatgcccttcccgccctccctccaagaccccctttggatcctgcattcctggtcatctctccagaaggaaggaaacgcgtccagcggtgtgcctttggccggcgcttggcctttgcaaagggctctccagggagatgctcccatccccacgaggagcgatgcccagaagtggcccgcaatcctctggcgtaagcggggccctgcgcaaatgttttttg

SEQ ID NO: 119157 - DNA, 40 bp, Homo sapiens
  chr20:2801775-2801815
  Hyper
gcagctgctctgaggcgggggaaggcgtggtggggggtcc

SEQ ID NO: 119158 - DNA, 147 bp, Homo sapiens; identical to SEQ ID NO: 87339
  chr20:2820440-2820587
  Hypo

SEQ ID NO: 119159 - DNA, 135 bp, Homo sapiens; identical to SEQ ID NO: 87340
  chr20:2820726-2820861
  Hyper

SEQ ID NO: 119160 - DNA, 399 bp, Homo sapiens; identical to SEQ ID NO: 87341
  chr20:2852724-2853123
  Hyper

SEQ ID NO: 119161 - DNA, 30 bp, Homo sapiens; identical to SEQ ID NO: 46076
  chr20:3001373-3001403
  Hypo

SEQ ID NO: 119162 - DNA, 22 bp, Homo sapiens
  chr20:3027758-3027780
  Hypo
aagggtggctgggagcggtggt

SEQ ID NO: 119163 - DNA, 597 bp, Homo sapiens
  chr20:3052519-3053116
  Hyper
ctgagcggattttgacgccccgcccttgaccgcggtcgaggcccccacggcgccccagcgcgtctcagccccgctgtcccgcccgaactccgaaccccggaccccagcatccttgcccggcgcaccccggccggcctcgcagggtcctccgagcgagtccccagcgccgccccggctcccgctcaccccgcccgtccccgcagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggccagaaggcgtgcgggagcgggggccgctgcgcggtcttgggcctctgctgcagcccgggtgagcggggcaaggcgctccggggccagggggaggcgggcgggggtgcggccgggattcccctgactccacctcttcctccagacggctgccacgccgaccctgcctgcgacgcggaagccaccttctcccagcgctgaaacttgatggctccgaacaccctcgaagcgcgccactcgcttcccccatagc

SEQ ID NO: 119164 - DNA, 266 bp, Homo sapiens; identical to SEQ ID NO: 37885
  chr20:3063125-3063391
  Hyper

SEQ ID NO: 119165 - DNA, 229 bp, Homo sapiens; identical to SEQ ID NO: 87374
  chr20:3063597-3063826
  Hyper

SEQ ID NO: 119166 - DNA, 777 bp, Homo sapiens
  chr20:3073251-3074028
  Hyper
ccgtgttccaagtgacgtggcctgtcgcacccgccggggacaatgactgcggccctggggtcccacagacgttccctttgctagacttaaggaagagctaggcctgtccgcgctcccagcccccacgcagccagacacccgcgggtgctgagatgaagagtgaagtcaccaggagagacaggaaacagcgcgggcctcggggacccgagggcgcggaagctcgggggccggggtcgagcacagattgggaggcgcagcgctgggcgcacgtccccgtcggcccggcggcccctaatgaggcgcgctgtgcgcagactgctaagagcagcatgagcacggctccggcggcccccagggccccgcgggtcggcgccaccccggagcgcggtgcccggaatcacttagcgccatcagccgggcggctgggagggggaagcggccgatccgggcggctgggagggggaagcggccgatccaggcggcagcggagggggctgcagcggaggcggccccggcttgcacgctcgcccttccgcctgcccggcagggccccgtctgagccccaggccccaggcccagcggcgccgctcgccggtgaaggaaaccagcgcagagaggccgcgctgccaggcgcgtggtggtccgggggtccacgtgtgagcctcgccctaggctgccaattgagagttccacctccgcccagagagaccccacctcacccctccaacctggggcgcgcgggccggcggaggggtcctggggcgagtgggcaggata

SEQ ID NO: 119167 - DNA, 79 bp, Homo sapiens; identical to SEQ ID NO: 87400
  chr20:3154916-3154995
  Hyper

SEQ ID NO: 119168 - DNA, 100 bp, Homo sapiens; identical to SEQ ID NO: 87410
  chr20:3202053-3202153
  Hypo

SEQ ID NO: 119169 - DNA, 91 bp, Homo sapiens; identical to SEQ ID NO: 16562
  chr20:3202418-3202509
  Hypo

SEQ ID NO: 119170 - DNA, 39 bp, Homo sapiens; identical to SEQ ID NO: 87412
  chr20:3203262-3203301
  Hypo

SEQ ID NO: 119171 - DNA, 30 bp, Homo sapiens; identical to SEQ ID NO: 87413
  chr20:3204581-3204611
  Hypo

SEQ ID NO: 119172 - DNA, 105 bp, Homo sapiens; identical to SEQ ID NO: 87414
  chr20:3204870-3204975
  Hypo

SEQ ID NO: 119173 - DNA, 307 bp, Homo sapiens; identical to SEQ ID NO: 87416
  chr20:3218629-3218936
  Hyper

SEQ ID NO: 119174 - DNA, 480 bp, Homo sapiens; identical to SEQ ID NO: 87417
  chr20:3220549-3221029
  Hyper

SEQ ID NO: 119175 - DNA, 73 bp, Homo sapiens; identical to SEQ ID NO: 87419
  chr20:3229253-3229326
  Hyper

SEQ ID NO: 119176 - DNA, 102 bp, Homo sapiens; identical to SEQ ID NO: 87420
  chr20:3229557-3229659
  Hyper

SEQ ID NO: 119177 - DNA, 30 bp, Homo sapiens; identical to SEQ ID NO: 87431
  chr20:3274373-3274403
  Hypo

SEQ ID NO: 119178 - DNA, 180 bp, Homo sapiens; identical to SEQ ID NO: 87450
  chr20:3388001-3388181
  Hyper

SEQ ID NO: 119179 - DNA, 90 bp, Homo sapiens; identical to SEQ ID NO: 87451
  chr20:3388444-3388534
  Hyper

SEQ ID NO: 119180 - DNA, 83 bp, Homo sapiens; identical to SEQ ID NO: 87452
  chr20:3388884-3388967
  Hyper

SEQ ID NO: 119181 - DNA, 784 bp, Homo sapiens
  chr20:3641207-3641991
  Hyper
gcttcgcagtcctcacgccggttcccgctggctccgcagtcgcaccagggcgccacgcgcgcgctcacgttgtccacgtagttaggggtgacggcggtgcctgcggggaccctgagggcgaagtcatcggcccacccgggcggagatatcccctggagaacccccgccctcgcccggatcccggccgcgcgtacccacgaggcccgcgtaggcgcgcaggcagcgggcgccctggtccagcaggcagccgtcgggggcgctgggcgctggggtgcacgagacctgaaaggccaggaggcgaggcctgcgcggcgggagggcggtgagccggagagaggccccgtccccaccctcgccacggccccgccgccgcccgcgcgcacctgcagacccggctgcgctcgcagaagtttaagggctcaaggcaggagggcggcgcggggccgggccccgaaaaggcgcaggagggcacgaaggtctggcgccgacgctcggcgcacgcggggcccgcgcacgggcagaagagcagtgcgtgggtgagcgcgggcggcccgcgggcgaagaagcggcgcagggcccggcggcagcgggcgcggggacagcccccctgcgcagcccggcccaggcactgcgccacatactcggagcgcaaacgctggcaccgcgcgtccgccgtgcaggcttcggccgcgtccacacatcggttccctccgaccgagctcgccgaccctgggaaaggcgcggggaggctgcaggtctcagtgcgccccgcatgcacacttca

SEQ ID NO: 119182 - DNA, 35 bp, Homo sapiens
  chr20:3653294-3653329
  Hyper
gggcccaggtgagggcgcagcgccccagacctgag

SEQ ID NO: 119183 - DNA, 893 bp, Homo sapiens; identical to SEQ ID NO: 87490
  chr20:3662307-3663200
  Hyper

SEQ ID NO: 119184 - DNA, 188 bp, Homo sapiens; identical to SEQ ID NO: 87502
  chr20:3713295-3713483
  Hyper

SEQ ID NO: 119185 - DNA, 74 bp, Homo sapiens; identical to SEQ ID NO: 87506
  chr20:3729991-3730065
  Hypo

SEQ ID NO: 119186 - DNA, 1009 bp, Homo sapiens; identical to SEQ ID NO: 87524
  chr20:3758173-3759182
  Hyper

SEQ ID NO: 119187 - DNA, 37 bp, Homo sapiens; identical to SEQ ID NO: 87525
  chr20:3763466-3763503
  Hypo

SEQ ID NO: 119188 - DNA, 119 bp, Homo sapiens; identical to SEQ ID NO: 87526
  chr20:3764967-3765086
  Hypo

SEQ ID NO: 119189 - DNA, 85 bp, Homo sapiens; identical to SEQ ID NO: 87527
  chr20:3766966-3767051
  Hyper

SEQ ID NO: 119190 - DNA, 30 bp, Homo sapiens; identical to SEQ ID NO: 87529
  chr20:3802377-3802407
  Hypo

SEQ ID NO: 119191 - DNA, 120 bp, Homo sapiens; identical to SEQ ID NO: 87532
  chr20:3820930-3821050
  Hypo

SEQ ID NO: 119192 - DNA, 17 bp, Homo sapiens
  chr20:3826486-3826503
  Hypo
gggcgtagtggctcacg

SEQ ID NO: 119193 - DNA, 41 bp, Homo sapiens; identical to SEQ ID NO: 87549
  chr20:4010137-4010178
  Hypo

SEQ ID NO: 119194 - DNA, 17 bp, Homo sapiens
  chr20:4066865-4066882
  Hypo
ctcgtgtcttcagttcc

SEQ ID NO: 119195 - DNA, 89 bp, Homo sapiens; identical to SEQ ID NO: 87555
  chr20:4085057-4085146
  Hypo

SEQ ID NO: 119196 - DNA, 35 bp, Homo sapiens; identical to SEQ ID NO: 87560
  chr20:4186660-4186695
  Hypo

SEQ ID NO: 119197 - DNA, 273 bp, Homo sapiens; identical to SEQ ID NO: 87563
  chr20:4202505-4202778
  Hyper

SEQ ID NO: 119198 - DNA, 1273 bp, Homo sapiens; identical to SEQ ID NO: 87569
  chr20:4229327-4230600
  Hyper

SEQ ID NO: 119199 - DNA, 30 bp, Homo sapiens; identical to SEQ ID NO: 87667
  chr20:4589710-4589740
  Hypo

SEQ ID NO: 119200 - DNA, 30 bp, Homo sapiens; identical to SEQ ID NO: 87689
  chr20:4650709-4650739
  Hypo

SEQ ID NO: 119201 - DNA, 24 bp, Homo sapiens
  chr20:4657791-4657815
  Hypo
gcgaaactccgtctaaaaaaaaaa

SEQ ID NO: 119202 - DNA, 30 bp, Homo sapiens; identical to SEQ ID NO: 46086
  chr20:4677123-4677153
  Hypo

SEQ ID NO: 119203 - DNA, 76 bp, Homo sapiens; identical to SEQ ID NO: 46087
  chr20:4690696-4690772
  Hypo

SEQ ID NO: 119204 - DNA, 30 bp, Homo sapiens; identical to SEQ ID NO: 87707
  chr20:4720642-4720672
  Hypo

SEQ ID NO: 119205 - DNA, 91 bp, Homo sapiens; identical to SEQ ID NO: 87729
  chr20:4749380-4749471
  Hypo

SEQ ID NO: 119206 - DNA, 969 bp, Homo sapiens; identical to SEQ ID NO: 87737
  chr20:4802998-4803967
  Hyper

SEQ ID NO: 119207 - DNA, 94 bp, Homo sapiens; identical to SEQ ID NO: 87799
  chr20:4981307-4981401
  Hyper

SEQ ID NO: 119208 - DNA, 20 bp, Homo sapiens
  chr20:5025098-5025118
  Hypo
tttgagacagagttgcgctc

SEQ ID NO: 119209 - DNA, 37 bp, Homo sapiens; identical to SEQ ID NO: 87829
  chr20:5203282-5203319
  Hypo

SEQ ID NO: 119210 - DNA, 30 bp, Homo sapiens; identical to SEQ ID NO: 87838
  chr20:5261671-5261701
  Hypo

SEQ ID NO: 119211 - DNA, 1584 bp, Homo sapiens
  chr20:5296172-5297756
  Hyper
cagcacacctggaaacgactccacatgtgggcgccgcgggatgctgggtagcaaggagatgacccagctgaacaatgcatttggtccactcctgcgaggggaggagaacgccgagggacaggaactgcgcgccagcaaaagacaccctaacctggggtgcgcccgccagctgctttcccaaggtgaaaacctccaagaggcgagatgcaaatcccagtggcgtccacacccggaggtgtcttctctccaggtcgcccctccgtctcatgcgacaccccaatccccgcagcctctgctcagcgtgggaccaagaatggggagtcctacccctcctcggctttccagccccctaacccaagacaagagggcgcgcgcccgggctgggacaggtcccagccgcattttcgtagattgcactccccgcccgggagcgacccgttccagcagcccccttcccgccccatcaacgcggccgcactgtcggcgtctagaggcgacatcctggcaaagacaggaatcaagtcagaaattcaggctctagaagcaaaggctgcggtgcctcctggctggaagaaaacggcgggtgggtggaggatgcggtgcgcgggaatttccccacggacgcttgctgtttcctgctcacctttcaggaaggtgcccctctacctgcaccctcccctgcaatttggagctcgtccgcgagctcagctacccgctggctccctctgcccgcgcccgcacaccacagactccgcttaccgtaccctacccggtcctagagggcccagaggggatctcctgaaaccaactcgcctgcttggagccagccccgacgcatatctcgagagtggcgggaggcaaagcagccggaatgcccgagaaaaaagtgggcgtcagaggcccttgtcctagcgactcccccaccgcaccgactgagtcccgggactgcagggatctaagcccttacctgtctcggcgcctcctttctgtgcgctctgctgctccggaagccggatcgagagtcacagtgtggttgggcgcaggcgggccgctcggttttcacctcgaggacccggacttgcacttgcagagccgctgcgtgggggatgtccctcttttttcctcgccccggcgggctcctccggcgtgtcagggtctctgggttccagctggagttggcgctccggccccacagctctttccagcgtctcggacctgtgcgccccgccccgcgctggactccgccccggggtccccgcctgcctcctagtccaggccaagggtggatgcccagctcccccaccccaccgcgtgctctcgggctggtgcgtccagggcgcgggcaccgtagctccggccgcgctgacgcgagtccccggcagcgggggcagcctctcgcacggatttcagcgccttcgcatcccgtctgaatcggaccacacagtagccgggtttctaccgtgcgcttgggaacagtgagcaccgccctctgccgccagtcgtggcaccgcacccgggtcgcgcgcgcaggaggggagagtcctgtcttccggaggtgcccagtgccagcgtccgcgcccacta

SEQ ID NO: 119212 - DNA, 30 bp, Homo sapiens; identical to SEQ ID NO: 87933
  chr20:5658367-5658397
  Hypo

SEQ ID NO: 119213 - DNA, 21 bp, Homo sapiens
  chr20:5732235-5732256
  Hypo
ccaccacgcccggctatcttc

SEQ ID NO: 119214 - DNA, 23 bp, Homo sapiens
  chr20:5761884-5761907
  Hypo
agggcttcctgagagcgagtgca

SEQ ID NO: 119215 - DNA, 48 bp, Homo sapiens; identical to SEQ ID NO: 46089
  chr20:5762556-5762604
  Hypo

SEQ ID NO: 119216 - DNA, 354 bp, Homo sapiens; identical to SEQ ID NO: 88002
  chr20:5891915-5892269
  Hyper

SEQ ID NO: 119217 - DNA, 54 bp, Homo sapiens; identical to SEQ ID NO: 88067
  chr20:6022905-6022959
  Hypo

SEQ ID NO: 119218 - DNA, 800 bp, Homo sapiens
  chr20:6032685-6033485
  Hyper
acccgggtcacccctcgaggaagaacgcagccctgccccccggagcgcacgcgcagcctggctctgcgctcaggccggctgaaaacgcggggcgcccggactcaccccgttcaaggaacgtgccgctgagatccaggacttcgagcgtgaccaggggcgcgccatcctctccagcgaacgccgcctcggcgatgcccccctgggctccgcgacccagcgcggtgcaggagaggttgaggagctgcagcgcggggaagcaggcgaaggcccggggctgcagcgcccgcagcggattcccggcgagcgccagggcgcggaggctgctcagcgcgggcccggtgcacggcggcagagcggccagctggttgtagctgaggtccagggtgtgcagccccgccggcccacccgggccccagcgcagcgcggcgatgcggttgtggcgcagggtcagcacctgcagctgctccaggtggccgagctcggaagtgctcagggcgcgcagcaggttgtggctggcgtcgaggctgcgcagtgtgcgcggtaggcagccgggcaggcgctccaggttgcggttcgccagggtcaaggccgtcgcatccgcggcgggcagcccctcgcagggcgagtcggtggcgttgctgccactgctcccccaggggccctgctgagtgacccggaagagcgggaccttctcctggggagggtctgcccagctggggcgcagcaccgtcagcagcagcagcggtagggtttgccgcatggcgtctggggagagaacagcaggacgcccatcaaatcca

SEQ ID NO: 119219 - DNA, 128 bp, Homo sapiens; identical to SEQ ID NO: 88176
  chr20:6103795-6103923
  Hyper

SEQ ID NO: 119220 - DNA, 47 bp, Homo sapiens; identical to SEQ ID NO: 88460
  chr20:6748423-6748470
  Hyper

SEQ ID NO: 119221 - DNA, 300 bp, Homo sapiens; identical to SEQ ID NO: 88461
  chr20:6748763-6749063
  Hyper

SEQ ID NO: 119222 - DNA, 30 bp, Homo sapiens; identical to SEQ ID NO: 88466
  chr20:7958418-7958448
  Hypo

SEQ ID NO: 119223 - DNA, 1765 bp, Homo sapiens; identical to SEQ ID NO: 88470
  chr20:8112233-8113998
  Hyper

SEQ ID NO: 119224 - DNA, 37 bp, Homo sapiens; identical to SEQ ID NO: 88473
  chr20:9048495-9048532
  Hyper

SEQ ID NO: 119225 - DNA, 75 bp, Homo sapiens; identical to SEQ ID NO: 88474
  chr20:9049163-9049238
  Hyper

SEQ ID NO: 119226 - DNA, 203 bp, Homo sapiens; identical to SEQ ID NO: 88475
  chr20:9049467-9049670
  Hyper

SEQ ID NO: 119227 - DNA, 30 bp, Homo sapiens; identical to SEQ ID NO: 88476
  chr20:9376224-9376254
  Hypo

SEQ ID NO: 119228 - DNA, 851 bp, Homo sapiens
  chr20:9487096-9487947
  Hyper
ctccaaactggttggcgtggcacggggttggcccttggcttcgcagtgcccggaggttcggagcgagcactggaccagagcccaagttcccaagttcccattccacggggagatgcggactttaggtggacccggaatggaaggagggtttttgctgcccgcatgcccccagggctctttccgggaaatagaagggcgagtcctttgcttccgcagcgtccggtgggaaaagatgccacgtggcgcggtgcgggcggactcagaggccccaggcgcccccgggaactgccacttactcagggcccgcggtccctggcgaaaacgggcgtggcgccagtgctcagaccgtgaagtggaaaaacggatcataacctcgcgttaaggggaaattcaggtttttttctctgagaaatgtatccttccctaaccaaaatccagcacctagggccacccatccctcggtccctgagcccaccctctccctgcaggcacagctatcccaggttccggcccatcaagttgggaaatgagacgatccatcagtgccaggctcccgggagctgcagctggctccaagtgcgtggccggaggcgtcccccatctgcacgagtccccagagtcacccgggaataactgcgccgccgccgcctccgccgcctgggctcccgacctccgcgcgacccgcgttagctcgcgttgcctgctgtggctttgctgctctgggctacaaggccgggccggcttgggttgagactcccgaggctgcaggcgaggcggtgggtacaaacttccgtagatcctgctgtttctctgaagaagaagaaaaacattggccccggagaattagataa

SEQ ID NO: 119229 - DNA, 218 bp, Homo sapiens
  chr20:9488294-9488512
  Hyper
cgggatcttacatcccgcctgcggcgtcgggcagcgcacctggcgggctggaccgggacagggggcggtgcgcaccggggctcccaagcagccttagcggtggagaccttccgaggggaggcgagcctgcggtttgtctcccgttaaggtggaagactggatttttcctccagttccgatctagggtgaagtcccttctcccgcgccctcatgcccag

SEQ ID NO: 119230 - DNA, 446 bp, Homo sapiens; identical to SEQ ID NO: 88481
  chr20:9488726-9489172
  Hyper

SEQ ID NO: 119231 - DNA, 261 bp, Homo sapiens; identical to SEQ ID NO: 88482
  chr20:9489455-9489716
  Hyper

SEQ ID NO: 119232 - DNA, 507 bp, Homo sapiens
  chr20:9495183-9495690
  Hyper
atctcattggccctccgcacaagccaagccacagccactcctgccacacaatcggattgctttcagcactcgcagccgtggaccgccgtgcggtcctttcctccgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccgtgagtagcgatttggcgactgggagagaggacgggcactctttgcagagaacagagccggcaaagtaaagtcaattagcttgagataaaaaatatggcccttaatgttttgcggtgttttttcttt

SEQ ID NO: 119233 - DNA, 956 bp, Homo sapiens
  chr20:9496026-9496982
  Hyper
gtctccccaccctagcgcccgagacgcgtgggctgagccctgaactgatggaattgttttgtttgttccgcagatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatgtaaggaatctttcccccccctcagcttgctcctagggctccagggcgaagggcacccttcctcaaggctcttcgaagacctgggttgcccgccttctttcccacaccccggcaggctgctcccgaatgctgcatggggattccagcttgtaatgccttctgttcccctgcctgctttgaaagtaaacccccttctctccgcttccctatcggggctgcacgtagagcatctaaccgcatgttcccggaacctgggatgcgcgcgcgcaaaggagcgcccaagcgtgcaacccagagtttggacgcgccgccctttacagcccccgccccggggccgggcgagctgagggggcgcggggcgtctgtgttcccagctgatcacagaacaggccgatatcgcattgacccggggagctgaggtgaagggccgctgtggccacagccagtcggagctgcaagtgttctgggtggatcgcgcatatgcactcaaaatgctctttgtaaaggtaactccgagcccagcgggcagaggggccgcaggctccgcgtgggtgtgggaagtggcggcccctaggtttaagaacccagacgctgcggggacgattgaagcgcacctccccggctcaacaggaaagccacaacatgtccaagggacctgaggcgacttggaggctgagcaaagtgcagtttgtctacgactcctcggagaa

SEQ ID NO: 119234 - DNA, 30 bp, Homo sapiens; identical to SEQ ID NO: 88487
  chr20:9497348-9497378
  Hyper

SEQ ID NO: 119235 - DNA, 685 bp, Homo sapiens
  chr20:9819189-9819874
  Hyper
tgggttgagggtgggcggtcccctatccctaccctccaggcagcaggtccctagcctttgcatctcctaggagatgcaggatcgcgctgtcacagtggtcctcttcgcatcctctcccggcaaagagagatgctccggttaccagcggcgcgcatccccgcaggcgcctctcctctcgccgatacccacccaggcagtcccgacaggcgcgcctgcctacctggtggccggctgtcagcgaagcggcggtgcctcagccccttctcagctgctacagcgctcccagcgccatgttcccggtctccccgggcgcacgctggggaactactactggctgggtaggggcaaggggggcgggggccagcgggagggggtgagaggcagagccacagctttctactctccacccaaacctcccccagctactgagcatgcccagctgcccggcttcgcccctcggaggactgtccatgagcgtacgcagctgctccgggttttcgtggcagccggcgggaggcaggctgtagcggcggccgggggtggaggtgagggggagggtcggggggcgtgtctacactcagggtgcaggagccaggagccgggagctggagcaggcgaccaatccaatcacgtttactcccagtcgtccccggcgggggcagctcctgcacgccctctcccccaa

SEQ ID NO: 119236 - DNA, 34 bp, Homo sapiens; identical to SEQ ID NO: 88493
  chr20:9981583-9981617
  Hypo

SEQ ID NO: 119237 - DNA, 828 bp, Homo sapiens
  chr20:10198127-10198955
  Hyper
taacattgcgaggcacgacttctaatcgcatccttcccggaaaagtacaaacagttcctcagacgaggtcccccacctcccacgcgctccccagccctccctccctgcggagagccccgcgacagcctccccaacacctgtgaatcatccgggaggctgccaccgccgagcgatccgcgcaccacccccttcccgggcccgggcacggccagggaggacagttagggttgttgctttataattatcacttttaatctctaatacgaccagcacaagtagcctttgtctccccgccctgatttgagcatccgagggccccccgaggcagcctgcacgggtaccccggggtttgcgcactgagtgaacccccagattcggccgtgtcccagccgtccttgctctgaatcccccacctcctcccggccgtttggacggttccctcggggcgtctgtgcctccgtggggtacccctaagacacccagcatgaaaccccagcaccgactgcaaattccaccgaaagcagagtcatccgtttttgccctcggcaaacaactcaacttcaagcctcgagtccttgcaaacccacgctggctgggctaactccgcttcccttctccttcccccgactcctgcaacagctcagagagcctggctctgacgtagttcaaaataacgtgcgccagcctcgctgcccggctgaccacagcaacgagagccacaagccctcgacgctgcttcgataacatgaagcaatcactcataaaaatagcaacccacgtagcctggccatatatggagctggcgagggtggacggggatgcccctac

SEQ ID NO: 119238 - DNA, 453 bp, Homo sapiens; identical to SEQ ID NO: 87091
  chr20:10199315-10199768
  Hyper

SEQ ID NO: 119239 - DNA, 123 bp, Homo sapiens
  chr20:10200073-10200196
  Hyper
gaaagggggagttcccgccccgggcaagctgagctgctgcagcgacagcagcctccatgccccgcggacttgatttatgccgcctgctccacgtcaactgcaggctggcgggaggcgggcggg

SEQ ID NO: 119240 - DNA, 202 bp, Homo sapiens; identical to SEQ ID NO: 87094
  chr20:10640930-10641132
  Hypo

SEQ ID NO: 119241 - DNA, 30 bp, Homo sapiens; identical to SEQ ID NO: 87095
  chr20:10686912-10686942
  Hypo

SEQ ID NO: 119242 - DNA, 30 bp, Homo sapiens; identical to SEQ ID NO: 87096
  chr20:10774557-10774587
  Hypo

SEQ ID NO: 119243 - DNA, 166 bp, Homo sapiens; identical to SEQ ID NO: 87097
  chr20:11589587-11589753
  Hypo

SEQ ID NO: 119244 - DNA, 72 bp, Homo sapiens; identical to SEQ ID NO: 87099
  chr20:11667745-11667817
  Hyper

SEQ ID NO: 119245 - DNA, 30 bp, Homo sapiens; identical to SEQ ID NO: 87101
  chr20:11872354-11872384
  Hyper

SEQ ID NO: 119246 - DNA, 227 bp, Homo sapiens; identical to SEQ ID NO: 87104
  chr20:13200556-13200783
  Hyper

SEQ ID NO: 119247 - DNA, 437 bp, Homo sapiens; identical to SEQ ID NO: 87105
  chr20:13201128-13201565
  Hyper

SEQ ID NO: 119248 - DNA, 563 bp, Homo sapiens; identical to SEQ ID NO: 87106
  chr20:13201961-13202524
  Hyper

SEQ ID NO: 119249 - DNA, 45 bp, Homo sapiens; identical to SEQ ID NO: 87107
  chr20:13202742-13202787
  Hyper

SEQ ID NO: 119250 - DNA, 207 bp, Homo sapiens; identical to SEQ ID NO: 46091
  chr20:13243380-13243587
  Hypo

SEQ ID NO: 119251 - DNA, 30 bp, Homo sapiens; identical to SEQ ID NO: 87110
  chr20:13641995-13642025
  Hypo

SEQ ID NO: 119252 - DNA, 142 bp, Homo sapiens; identical to SEQ ID NO: 46092
  chr20:16554594-16554736
  Hypo

SEQ ID NO: 119253 - DNA, 142 bp, Homo sapiens; identical to SEQ ID NO: 46093
  chr20:16555036-16555178
  Hypo

SEQ ID NO: 119254 - DNA, 180 bp, Homo sapiens; identical to SEQ ID NO: 87115
  chr20:16954966-16955146
  Hypo

SEQ ID NO: 119255 - DNA, 38 bp, Homo sapiens; identical to SEQ ID NO: 87116
  chr20:17141814-17141852
  Hypo

SEQ ID NO: 119256 - DNA, 500 bp, Homo sapiens; identical to SEQ ID NO: 87117
  chr20:17206513-17207013
  Hyper

SEQ ID NO: 119257 - DNA, 863 bp, Homo sapiens; identical to SEQ ID NO: 87118
  chr20:17207260-17208123
  Hyper

SEQ ID NO: 119258 - DNA, 414 bp, Homo sapiens
  chr20:17208389-17208803
  Hyper
caggatgccatgctccggggatgctgtccgaggtaccaagttctcgaggctgcctggggatggagggatgaagccctgaacagctaagcctggcgttggctacttggccagggaagtctcccccacccccatcccccggagaaagaatagtttcctacagacgaggctggacgtttggacactgcaattcacctcggtgtttctcccaccccgcgccgggaggacttccctcccagggacttcggtccctgctcctctccgggaacaacggcttcctgactctagatttggaaagaaactggtctctaaaatcggggcggaacttctgcgccctcacccccgcccacgaccgcccacccctggagcgcacttctggttggctccctagttctcaactcccggctacaggagctg

SEQ ID NO: 119259 - DNA, 340 bp, Homo sapiens; identical to SEQ ID NO: 87121
  chr20:17209295-17209635
  Hyper

SEQ ID NO: 119260 - DNA, 194 bp, Homo sapiens; identical to SEQ ID NO: 87122
  chr20:17482549-17482743
  Hypo

SEQ ID NO: 119261 - DNA, 32 bp, Homo sapiens; identical to SEQ ID NO: 87123
  chr20:17511525-17511557
  Hyper

SEQ ID NO: 119262 - DNA, 30 bp, Homo sapiens; identical to SEQ ID NO: 87124
  chr20:17598565-17598595
  Hypo

SEQ ID NO: 119263 - DNA, 30 bp, Homo sapiens; identical to SEQ ID NO: 87125
  chr20:17674659-17674689
  Hypo

SEQ ID NO: 119264 - DNA, 30 bp, Homo sapiens; identical to SEQ ID NO: 46095
  chr20:17702368-17702398
  Hypo

SEQ ID NO: 119265 - DNA, 39 bp, Homo sapiens; identical to SEQ ID NO: 37945
  chr20:17919829-17919868
  Hyper

SEQ ID NO: 119266 - DNA, 18 bp, Homo sapiens
  chr20:17971912-17971930
  Hypo
gggcgcagtggctcacgc

SEQ ID NO: 119267 - DNA, 77 bp, Homo sapiens; identical to SEQ ID NO: 87130
  chr20:17972170-17972247
  Hypo

SEQ ID NO: 119268 - DNA, 93 bp, Homo sapiens; identical to SEQ ID NO: 87131
  chr20:18037359-18037452
  Hyper

SEQ ID NO: 119269 - DNA, 109 bp, Homo sapiens; identical to SEQ ID NO: 87132
  chr20:18038494-18038603
  Hyper

SEQ ID NO: 119270 - DNA, 289 bp, Homo sapiens; identical to SEQ ID NO: 37946
  chr20:18039647-18039936
  Hyper

SEQ ID NO: 119271 - DNA, 175 bp, Homo sapiens; identical to SEQ ID NO: 87134
  chr20:18051230-18051405
  Hypo

SEQ ID NO: 119272 - DNA, 76 bp, Homo sapiens; identical to SEQ ID NO: 87135
  chr20:18073083-18073159
  Hypo

SEQ ID NO: 119273 - DNA, 30 bp, Homo sapiens; identical to SEQ ID NO: 87136
  chr20:18174471-18174501
  Hypo

SEQ ID NO: 119274 - DNA, 30 bp, Homo sapiens; identical to SEQ ID NO: 87137
  chr20:18178355-18178385
  Hypo

SEQ ID NO: 119275 - DNA, 217 bp, Homo sapiens; identical to SEQ ID NO: 87138
  chr20:18233341-18233558
  Hypo

SEQ ID NO: 119276 - DNA, 30 bp, Homo sapiens; identical to SEQ ID NO: 87139
  chr20:18270495-18270525
  Hypo

SEQ ID NO: 119277 - DNA, 208 bp, Homo sapiens; identical to SEQ ID NO: 46097
  chr20:18489646-18489854
  Hypo

SEQ ID NO: 119278 - DNA, 197 bp, Homo sapiens; identical to SEQ ID NO: 46098
  chr20:19080645-19080842
  Hypo

SEQ ID NO: 119279 - DNA, 59 bp, Homo sapiens; identical to SEQ ID NO: 87143
  chr20:19186737-19186796
  Hyper

SEQ ID NO: 119280 - DNA, 957 bp, Homo sapiens; identical to SEQ ID NO: 87144
  chr20:19192659-19193616
  Hyper

SEQ ID NO: 119281 - DNA, 32 bp, Homo sapiens; identical to SEQ ID NO: 87145
  chr20:19193883-19193915
  Hyper

SEQ ID NO: 119282 - DNA, 30 bp, Homo sapiens; identical to SEQ ID NO: 87146
  chr20:19402623-19402653
  Hypo

SEQ ID NO: 119283 - DNA, 51 bp, Homo sapiens; identical to SEQ ID NO: 87147
  chr20:19579962-19580013
  Hypo

SEQ ID NO: 119284 - DNA, 40 bp, Homo sapiens; identical to SEQ ID NO: 46099
  chr20:19674013-19674053
  Hypo

SEQ ID NO: 119285 - DNA, 182 bp, Homo sapiens; identical to SEQ ID NO: 87149
  chr20:19738199-19738381
  Hyper

SEQ ID NO: 119286 - DNA, 151 bp, Homo sapiens; identical to SEQ ID NO: 87150
  chr20:19739010-19739161
  Hyper

SEQ ID NO: 119287 - DNA, 370 bp, Homo sapiens
  chr20:19739416-19739786
  Hyper
ccctgcgcctgagcgcgcgggtcagacccggtgtcgcacagctttgatccccagcgcggaccccactggtgagtccagccagtgtgcagggcagatgctccgaccggagatttcctcccccgggtggaaaagcaggagggttgttgtgtccgggcagggggcacttgggctgtcgcggtgattgatggctgcgcagcgggcggaggaggagccccggattcctgccgggaagggacggggccactttcccactttgaggcctccccgcccccttctgggcttggcctccacccttggcctgggctcccaccagctcggcgtccacccaccggcggtggcgcgcccctcgaccgcgcggggacagcaggat

SEQ ID NO: 119288 - DNA, 47 bp, Homo sapiens; identical to SEQ ID NO: 87153
  chr20:19928306-19928353
  Hypo

SEQ ID NO: 119289 - DNA, 30 bp, Homo sapiens; identical to SEQ ID NO: 46101
  chr20:19961658-19961688
  Hypo

SEQ ID NO: 119290 - DNA, 30 bp, Homo sapiens; identical to SEQ ID NO: 87156
  chr20:20321098-20321128
  Hypo

SEQ ID NO: 119291 - DNA, 99 bp, Homo sapiens; identical to SEQ ID NO: 87157
  chr20:20321680-20321779
  Hypo

SEQ ID NO: 119292 - DNA, 30 bp, Homo sapiens; identical to SEQ ID NO: 87158
  chr20:20343755-20343785
  Hyper

SEQ ID NO: 119293 - DNA, 1914 bp, Homo sapiens
  chr20:20344329-20346243
  Hyper
accccatagcaagaacgctcgccagggtagaaagtatgcccttgtggaccccaggagtctggctgcctcttcgtcctcctgcggcaggcgaggcggggtgcaggtgtgagtggggtgggaggaaggggaaaggatcggggtcgccgcagcctttctggtcagtttcgctgggttttgtcagttccgtttgagaccgaggcgcacggactagcggccgccagcacctcacaggtggaggacacctcttgcgccccaaggtcaatgtcatcccgatgggtcccgtgccgtcctgactctccctgacctaattctttggttatgactttctcaccttctgggcttcgcctctgccagctttcgccgacgtcgcccttcccgccgcccgcccgggccttcctacccgctctcctccctccctggcccgacggtcccactgaggcaaaaacaaacagccctgagggcacttcaaggagcgtgcagtggccccgacggtactctcggggggataaaagaggtggccagccacgccgtcggcccccggccgaataatgggcgcgcagcagattgccagggggcacttgaaactcgaggggagggaaatacttgagcgcggtccctccccgcgaggacgcacgacgcagcctcgcggatcgtcccttgttcgctctctttcatgcactctccttttgtgtggaattatctaaacgggagatccctggcagctttatgctaatgcgccgaacaaaggcaacggcccgcgggcgggaggcccggaaggtgcctggggccgggccgggcggggtggcggccaggcgggctgcgcgtgtctctcgcgtgcccctgggactgacacaacaacccctcattcctgcaaatacaaagcctctcaccggctcgggtcgggcgcacccggcgcagggaggcgctggtccctccgggcggcgggcactgcagcggtaacgcacggttcctgccggttgtggctcgggggactgagggccgggagtgggggcttctgtgaagccagaagagaagtctgcagcagagtggtgatgaggggcgctgacacctcacccccaacgccgacgtctccaaacgcgataccctctgcggggtgagaatgcgggcccgcccggctcctcccgtgaggccagggcctcctgttctcctagacaccccaaggagccaactcctccgcagaagttccccgcttctgctcttatttccaagcttcgcgctttctacaaactccctgttgccttgactttgatttccagccgtggtgagggtcagagtgaaccccggcgcgctccccgacggcatccccgcacaccaggataggagaaattggagggcctggggcctcgggctccgcagtcgtcggaggaagaacccaccgcggggtccgcaagggaaagtgaagaggcccgggatttttccaaagcgctggccaggaccccgaaggaaggggaggagtcacctgaagccggggaaggccccttgggtgctctgccttggatccttatgttcactgactttcgcgaagcccccctggaggggggcaaatccgcgctgtttcccccaacttaacttcacgcggcccattctccgaatcgcgtgcgccaaggccggcgtcgggggcgcactgtgatggcgctttgctcttcccaggcgaagacaaatatctcgacccgatgtccccatgcatgcgggtgcacaggttctgagaaaatcacgcagaaggcggctgcgatccacggcccgggctgggctacacctgcttggaggtcgctggtgtgtgcgtgcgcgcgtgcgcagcctaactccttccagccccgggtggtgaaattagtttccaatactagtacctttcaagtttccatttattttgactgtacccgtctgaaagcagat

SEQ ID NO: 119294 - DNA, 3504 bp, Homo sapiens
  chr20:20347246-20350750
  Hyper
ccttttgtgtttcctcggggctgggctggacagaggatggaggcaggcggcccagtctgggtccaaacggaacggcagcggaggtgggggtgggggtgggggcggggggaatcttcgctgttgtctcttcctggtggcacaggggaggcggcttgtcctctcggaggcctcagcctgcctcagagtacagattgccccccctccccccgtccagcacgcgtctcttttgcgtccagattggccgcgaccggagctcaatagcaggaggttaatttccttcacaaaggtgaagggggcacggctccgtgggggctgcgcccagacaggcagcccctttatttcgcagcgccttgattggagcccttgatttagcatctgatgtcaaccggcaaacaaaatgcccgctcggaatgaaaatgcatgaggccgcgcggggaggagaaagccaacttcactggggcgcacgaggccgaccgcgcgtttcgggcttcggccaactcgacccggattaaccgagccttggaccacgcggaagctccgggcggcctgggtcgggccccgccaaagatgccattcccaagcctccaagaacccaaaagttcagaaattcacgttcctctgggaacccagcccagcccgcccgcgctccaatcccgcgctttcgggagactgagaaggccgtgccaattccttctcaaactcgaaagaaaccttctctagccccgtgggcgcgcggaggctgcgagcacaaacatcgccctcggccactgccagaaggccgggccccctgtccacacttggaaccccggggaacccttttgcttggcctcttgggtccagcggcccatccgtccaaggtccgggcggaggccgtccggaccctgctgctctctcggattcttgtttatttcccaaacaccacgcggagccactgcgcctccgcaacgatctcccccgcaccgccccggcgcgcccccgcccccacccaatcagcgcgcacaacttccccctcggctccggctcgcggattgaaccctcctgacatatttggggccattcttctcctttgttgctattttgctagcgacccgcgggtaatccccgcgcgggaggggggcgtgcattgtcgcgctgatggacgggcccatttggcggctccgcgccccccggaggagagacacaaagcccaggcacgtgcgcctccccatagagaagcagcagaccgtgaagggaggcggggccgggcgtgtgcctggaccgggcggggcggcggcgccgggcggggcgaccaggggcgcgcgcgggggccccgcgccctcaggtacatctgccgcacctaccgggcgacccccgagtcccggcccccttttggccgccccatcgccctcccaccctgccaggctgaggagctgcggacgcgctgattggctccaggggaagcgggaggcgagaacaatggccccctccccccgttaaaagggagcggctgccgggcccggggacagggacgcgcgtgcagggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaagaagcccaaggccatccgcaagctgcacttcgaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcactccccgaacccgagtccgcgctgggggagcctcgcccccgcccccaccgggtgaaagtgtcgtctccgcttctctcggtgtggcgtgacggtaaccccatactctccttttgactccttttggaacccccacttttacgttgtgtccctccgcctcccccatggcgcaacaggagtcagtctctttctgtacaagggagaaaagctgtacgcgtttgtctcgtggttggaagcct

SEQ ID NO: 119295 - DNA, 202 bp, Homo sapiens; identical to SEQ ID NO: 87164
  chr20:20367287-20367489
  Hypo

SEQ ID NO: 119296 - DNA, 142 bp, Homo sapiens; identical to SEQ ID NO: 87165
  chr20:20376831-20376973
  Hypo

SEQ ID NO: 119297 - DNA, 191 bp, Homo sapiens; identical to SEQ ID NO: 87166
  chr20:20377191-20377382
  Hypo

SEQ ID NO: 119298 - DNA, 80 bp, Homo sapiens; identical to SEQ ID NO: 87167
  chr20:20421118-20421198
  Hypo

SEQ ID NO: 119299 - DNA, 32 bp, Homo sapiens; identical to SEQ ID NO: 46105
  chr20:20914015-20914047
  Hypo

SEQ ID NO: 119300 - DNA, 30 bp, Homo sapiens; identical to SEQ ID NO: 87170
  chr20:20952267-20952297
  Hypo

SEQ ID NO: 119301 - DNA, 3908 bp, Homo sapiens
  chr20:21080562-21084470
  Hyper
cccctctctggcagccgcggagacaaaggtctccaggaataattggagatgtgcatggaatattaaattaatttactgctcttaattcttatgcaaattctgacctccgatggcgcctatcaattaccccgcccgcagtgaaagcgaaagcgacagtttcttctcttcgcttttttttcttttttaagaactcgaaaaaggaaatatttgcaataagcaggcggtagtagcacttcgtagctggaattatttaattgaatcttcaagtttttagggatgcccgtagaggataaaaccccagtgctcagcggagagggtgggaggggtacagggggcggaggaatctgttggtttgactgtacacctgcgggcggcggcaaaatacagccacgagccgggaccagtaatgtcaaataaaacattggcttgtagacggacgcgggccttgggaatcgcgcgagcccagcgttagcccggggtttcaccgaagccggcgattcgaagggagtggcgtttccgcaaactgcatcgctaggggcccggcgtggaagcgcctctgcgcaactttcctccaccgctgcctacaagggaggctctggcttccgtttacttattttttaggagttttaacctttggttcctgcttttacaaccgctaaccccaaaaacattttttttttctttttgttctttgtaaaaccaaaccactatgctgtgcgttcatgttcaactctgttgaaatcccgggtgggccgaaataagatttaattgtctcctgcgtggagaagtgacacccactttttcccctgaattgagcaaacaccagggctttgtctgagcttgtggcttaaacgccgggcggtttctgcacccagttggtgggttgtaagacaggaggtttccaagtctttcatcatgtttctaacaaggaaaaccaaatcgggcccataatgtcatcagccccggcccgacctcgccgggacctcggcagcccgatgatgtcgctagcggccccggcgcagccacgacgcgccgcctttcagctcctcgcagtccccacaaaagccagacaacaatatcaattaatcatgcagcgggcaaacaaggagatttatcccgcgacaaacagccccaccgagagccgctgaatgggcgtgattagcatgtgaaaaggcgagcaaaactccgcggttcaacagctaaagagcaatttgatggggctgggatggggaaattacttgattagcgtccatcggaggagaacacggttacagcccctcggccgggaatccgacaggggaacaaaacgcgctggtaaacgcggcgacgtacagggagcgcgagcgagggagggagcgccggcgagggagggagcgcgggggccgacatcgagaggcaatcggggtgggggcagaaataggggctgacccgctagcccccgccaaaccgcgaccaccctcacctagggctcccgggcggactcaagacttcacccagcgctggaggtcgaccttaatttagagcgctgccccggctctggcccggaaagagagtgacagaggcgcgtgcgggggaaaggcccacccacgctgtccctggagtcccctccagtgtccccagggacgcagtccgcggccgccagctccaggggctcgggccccaggttggagtagccacgctagcggctaggccgttccaccgggtagctccgcccttccttttgctcaggcagctaactttggagccgggcaagacgtgttttcccgctccttcgaatttaaccgcccagtgcctgcctcctggaaaagctgtcacgattgggcttgggcttgggcttggccttggtcaagaaaggtttcctcggctgcgccaccgtggggatggaggtgggagttggaacacagccccctagctgagtgcaggggccagaggctggcgggggcacgcgggggtggttgggggcggagtgcggcgaggggtgagggcgcgaccgccttggggcaggggcggcgatggagtagctccgggctctccacggactcgattggacagccccaggccggctttggatccttggaggcggatacgcaaggccagacctggtggcgtggccagttgggcatcgcggtatcttccccaggcctggagggcagtgctgaaggcccgcggccgaggttttgctttaagtatacttgggcctcgcaactcagctgtttgcgaacagagacctggcgaatcgccgaggagcggcgcggctccgcgtccccacttcaaggccaagtggagagtgaggacacgctgaggccccctgctacctatcatgccatcttaagcgggcaccgactccttacccagaaaagatcctggagctaaagcctgcgcctacaccagagaggggaatttaagtttcccactctcgacgtgtctggaaccttccctctagccgcatacccacaaccccctgctccctggctcctcccagtgtcaaggaaggagaaagactcccaccctgtccccaaagtctcagactaactcgctccaggtcacaggacccactaagagggcctttccagctcatgcccggaacaggggtgcagcggcgaccctctgggatctggagagagagaatttaacacggccttcctgaagtacattcacgcaaatgtgagaaagacttcaacgcacagaatcgccaaagcccttgccgtcttaaataaatcctgccccttggcacagaagaacggagaaccaaggagttaattcctattttataagaaaaaaaaaaaaaaaaaggagggggagagaggaagggagtggatggcccccactgagcggaacaattgtcactcagttgaacagtgtcaattaacaaaccgcagctctggcagacttcaaaaggcttgattctttttgaaatgtctgtggtgatgggtgtgcagcgaaccccagctcgccggtggccgctcaccccgctcgcctctctctccctctggactcggtgctgaagccccagtgcagctcgctcctccttctgtcagcagctggacccggaagccctgactcccggcttggcgcctgtgctgagagcggagaaggacgtcgcgaccggcaggcctggagggcgcattggtgtgcagagtgtagcggctggtctggccctgggaaccccagacccgcgaagctggagggcgcactccccggcctcagagccccaaaccggaggcgctgtccaaacgcgccaacgctgcaagcaatgtggcagggcacaccgaaatgcgtgtctcgcacacctgcccatctttccctgctcaacacgaaagcgccttgtggctctaagcgcttccttggggtggctggggctgtgcattttaattccaaagtcaagaggttgaaccatctcaaagttggcgggtggagggggcggtggcagggaactagatggctggatgcctttgcctgcggggtggcagggctgtccctaccaatagccacggctcggggctggctttgtagttatttttccaagttctgcccggtgcccatcatattgccctgaaaagcaaaagaggccgatgcaatttattccaatgggcggtttttaagaagctggcaatttgaaccggctgggtgttatttagtgcaatatgaaatcaaatgatcctatttctcaaataacagtgtctgtgaggagaagtgaatcctctgaaagggtaattgtctgctgatggtgtttcccattatacccgatcttggcctaaatggtgttcggcagcggggcggagagcgaggggtgaaatcaatgtgcgccaactcgcgctctggagacaggaaaaggtagcaccgctggcgtcctggcacgtcgagcgaacaatgccaccccacgcgtcactgatcgactcatcttgcag

SEQ ID NO: 119302 - DNA, 1014 bp, Homo sapiens
  chr20:21085668-21086682
  Hyper
tctaggaggaaggttcggccactgcacctggagcccgaagcaccggacaccaggcgcgccgttctggcgctctgcagggcctctctgggtgaaggaaagcgggcagcctgggttcagcccaccgggtcccctttcgaatgccatttcccagctgaaaatccagccagcacagcctggacgccgagccctctggagccctggtcaggacgctttaattttcaccctcccgctctgggtctgaacaacccccccgtcccccgccccccaccccaaggtgttgtttcctagggtcttctggggacatccctacctgtcgagggcctgccctcctcgggctaaaagttcagcccttcgacagagccatggaataagaggcgactctccctgtgtcccgcaagtggtttctcgaggtacccctctgaggctgcagcccccggagcagacctggctctgcatagcagcaaaagcaaccgcctacctgggccggggcaggactgtgccgcggcggcagggacagtgtgagcgccgccggccccctcacccggcgagggccctgcgctcacacttcttccaggggaaggagtggccacgcctgagcccccctaaacgacctcttcaggagaaaagagtgccggccaggagtccctccagtaacctcagtttagatcgggttttcgcgcctcccctaggaatccggctggaaaccccggagactctgcgcctagagttttgcgggcgtctctctgcctccccgcagcttccggctctcgcaggcttcatccactccctcttcccccggacctgcctgaaccccgccgagcactaggcaaggccgggctctgcgggctggggaaaagaaggggcttggggtggcccaacccgaccgccacctcggcccggcctgcggggaaaccccacaaagtcaaggcgcggggcggggtcggggggatgggatccagagagagactcagaggggcgccccttccccccaggggtctccgaatcctagggact

SEQ ID NO: 119303 - DNA, 282 bp, Homo sapiens; identical to SEQ ID NO: 37964
  chr20:21086906-21087188
  Hyper

SEQ ID NO: 119304 - DNA, 649 bp, Homo sapiens
  chr20:21372082-21372731
  Hyper
cgggccgggtgaggccggggtccctgcactcctttgctgggcgcgcctggaccgaactgaagggcccgggcgccgcgacctcgcagccgggggcgggatggtggcggcgcccgggccccgcgtgctactcagagctcaggtcctaggtgcttggctcaactttctcccagcggggtcgggaagcgccaggccctcggtgcacgtggggcacgcgcccggcgcctgggtctcccctgcggctcgctagtcgcccggcccagcccgcagaccccgcggctggccctcccgggagccccgcgagccggccgcacgcacaggatgggcgcggaaagccccttcctctaccctcgggcgcaccctccttcctcgtccgcggcgccgcagcttctcaacctgccgctgcatctcaactccctgcaagcagcagagctgtagaataccagaaatggtcttccttccgaggctgccgttttaagttccaagtgtgaaagtaaccgaattttgctatgcttagaaatctaaaatctggacattccctgaagagtcaacttagagtccccagtttctcgatctggctccgtcccactgactgacgcctcctgcccaccccgaaaggatcctggagctgcgatctcgccagactctattc

SEQ ID NO: 119305 - DNA, 2450 bp, Homo sapiens
  chr20:21376207-21378657
  Hyper
ttttatagttacaaacgccaacaaagtttccaactttgagagctgtagttaagaatgccgtgtgaacttctccaccttttcgcgtcatttaagaacttctaggaggagaaaatcaccacctcaaagcctcgtggcataatgttacactactcggtttccgggctgtcgctgtcccccgcccccagcaagaggttcacagcctgctcctctctgagaccggttcgttttgaatcgcagtttacacgcgcgagtcggttttcgcatgcctcccccatccgttctagcagtttcttgcagacccttcgggtgcaccaggacctagccccggggcgccctcgctgtcaccacgtcctgccatagagcaggttggcgcccaggacgccgccgctgtactccccggcggccgcgtccagggccgccaggccgccccccgggccgtgcagcgcgggtgggctgggcgacagctcctccagctcaggtgctggcgtcggggccggcggctgcggaccggcctggccgggggtgggcgtgctggcgccgttctggcacggcttgccgtccttgaccagcacaggcaccgccacgcggcgcggggacggcggcggaggcggcggcgggcccaggccgccctcctgctgcagctgctgcgccgccttgtccttggcctgccgtttcatcttgtaccggtggttctggaaccagatcttgacctgcgtgggcgtcaggtggatcatgctggccaggtgctcgcgctcgggcgccgacaggtacttctgctgcttgaagcgccgctccagctcgtagacctgcgcctgcgagaagagcacgcggcgcttccttcgcggagcggctgccgccgccgccgcgtgcagcgggcccagcgacttggcggcgtccgcgatgccggtcagcgaccccatgccggccacattcacgcccgccgacggccccatgaacctggagactggggaagagtcccaagggggaaggcgagtgagctccaggcccgccgggagccggtccagccgccgctctcttcacgccgcggccgcgacgccgccgggccctcgctgaatcccaagaccccctgaccgccgcggcctccggccccagcacgccccgcgcgccctcggcgggtcccagagcaccacgccctcaacgggtcccaggacgccgcgcgcgttcccggtcaggtcccaggaccccccgcgcgcccagggtccccagaaaccccgcgcgtcccgggccgcgtcccaggacgccccgcgcgcccgctcggccccaggacctcctaagccgcgcgcaccccgtcccgcgcccccgcgcccctcggctgtggcgggaaacgcctgagccgcccgcagccccgcgctcctggcccctctcacttgacgagtagcgtgggtccgggttggcgccgtaccagccggtggccgcgccgccccgcatgccgtccgtgtaggcgggcagctcgcccatgttgcccaggccgccgttgcagtagctgcccatggcgccgtgcgggaactgcgagacgccgggcggcatgtggtaggtggcggccgccgccgccgcagctgctgccgccgccgccgcggccgccgcgttgtgacccgccatggcgtgagaaggctgcatgcccgccacggtcgccgcctgcgaggagggcccaggtggcggcgcgcggtaggcggccgcggcccccaggggcgcccccaggccgggtggcgcgccgtccatggcgccgctgaacttcttgtaggtctcctcgatggggctcaggatgtcggacacggagaagggcgtcgtgtgctttgggctcaacgacatggctcggcgggcagccaggtaggggggcctggggcgcgcgccggcaggacgcggcggccgctcgtcgccgccacctcggccgcggcagctgagcctgtgacgaggagtcggcggctcggcgagccccccgggctgcgggatctggggtttattttagtccggcgccaggtttacgacagactcggggggcggagcaacatcccaaacgagcaaacaatggtcattgacatctttttctctcgcccccccaacccccgccccataatggaggcaaaaaaaggtaaaaggggcagttgggtgtttcttggaaagatcactccccgttgcttttcccatctttgcttttcccatcctttgcttttcccatccttcgctcctccatccgcggccgttaccccagccctcgagcaccagaaatagaaactcggaggctggcgtcgaggctagacatggactccgcgcctggccccttccagatcccagttttctaaagtgacttcgcaccaaagtccggtataattgcggaatggggaacgtgctgctaagtttggggggagggtgttgcgggggcttgcttcgtcctctccagttatcagcccctcattcgctccatcacctaa

SEQ ID NO: 119306 - DNA, 1359 bp, Homo sapiens
  chr20:21485917-21487276
  Hyper
gtgtagaggacacctcgcggagacatctcgagtcccgcaggtgtctgagctgcgctgcgcgccccagccgggaagccttttcttatccaaccgcgccgccccgcggaaagcctgggtactgcagacgccctcaccggcccaccgacagctggttttgaagcgggggcttagaaaagtaaaggggacagtgtttggagccacgatgcctttgatgtgaggcggttccacccaacaatcaacgaatcaagctggaactgcaggccctacttttgttggggggaggaccttaaggaatgtcacccccttgtcccctaccctctgccccacgcccagcctctcagaaggcaccaggcgtgagtagagtgcgaggcgtccacaccctcgtgtcccttccattcccggacacctttgcaccctagccgaggcctcagcacggagtgagggttgcctggggtgccctgctgtgtgtggggcgttcttgcctcccgggccctgaccccacggtctgggtcggcgaggcgtctctccctggcgtctggactgtgcgcctgccccgcttccaggcgacgaacggcaggagccgggggtccggcgggacccggatccagggcgggcggaaggcgagggtctctccttcccggaacccccgccccggaaacctgcaaccaaaccgggtccctcctccgcatcgctcccgcgctcccgggccgcctccccacgcgggcacccactctccgggccctcgcagcaccgccctctccgcgtccacccgcgcggccgacgccgccaggggccctgagatcgcggagacagcgcgccctggcgcctggtggggccctcccagtggccagagcgctcctggaccagtcggctgtggtctgtgcccaaacacgatggaaaccggggctgggacgggcggtggtacgcacgtggaggagaagaggcatggcgggaaaaccacagccgaacacaggtcgactcgcacctcccaggcacccgccgccgtctgactcgcggctctccccaaggttccgactcgccgccacctcttggcaccactcaccgggctccgacccgggccgcgagtccgctgatgcgcagctgcctccggcggctcccgggctctgcccggacccgcgcgcagagacgctcgggaacgctgggctcgggcgcctcctggcggcggcagcacgcggcacacgctcggttctccggcccgagggggcgcgtggagcgtacgcgggatccgcgcgcgggcctgggctgctggcccacatttccccgcttgctcggatggcggcgctgaggcctattcgcctctttattaataacgatgcctcgggagggaaaaaatagagc

SEQ ID NO: 119307 - DNA, 338 bp, Homo sapiens; identical to SEQ ID NO: 87190
  chr20:21487336-21487674
  Hyper

SEQ ID NO: 119308 - DNA, 639 bp, Homo sapiens
  chr20:21488158-21488797
  Hyper
gacccaaattatttccgactgcctcgcgccaatttggaccgcttagaggaggcaaaaaatgggcaaattccttggaagccctgctgtgtctccctggtactgaattttgtaagcacgcgatacaggagacattgaaaattaaagaggaagtatctccctcctccaacatggggagagacgctgttggaagaagtttctgaagtggtttcccatcgcaccaagaggccagtgggatggatccccgcgcataattcaaaggaacgcgcgcgtctttagctcttcggggttggtaaccaagtggtccggccgggcgcaagtcgccttggaaccggctgcagcccaagtctagctgggcccgggactgagcggcacccttggcctctcagaacctttctcgcggtgagtggaagggcggctccgcgcgcgggcgcttcggggccggtcggttgcgaaatcagggggtggattttcatctacccaggagccgctaagcccgtaggggaccgagcatcacccaggccctgggtaccctgagttgcctcctgagccccaggacggtccgatggtgcagagctcccaggcagaagttagtttcctgatacacacacagcagtgagcaaagtgcgcacaagtgagcca

SEQ ID NO: 119309 - DNA, 778 bp, Homo sapiens
  chr20:21488998-21489776
  Hyper
caactttcagtgtcacggggcctaggcggggcaagcgccctccgaagccatcaaagacaggggtggctttttctcccctcctccagcctcctccccaatagatatagcacgaatttttaatgcgtcttcctttcacagacaacaatacagggtttgaaagccggacacaatttaggttttgtgcgggtccctcctcgcgctccctcggcccagctggccatatggaatccagcatggagcccgtggatgacaaagggacccagtgacaggcccaacaaaaccccaaggagacttctgcctgactccgggattcactgccggcgataagcgcgctgaatggtgcggggtggggcggggggtggggggcgggccccttctccttcttcccctctctctgtccccgcgatcctttctctgtccctttttaatatgcacgcctctaacatctccggctcccagctttcccattgtgcggttttgtaccgcccgctgtagattgggcgaagatagactgctgaagcggaccccgcgccgggtgcgctcccagggcgctggggttagggccacacagggctccgcaggcgcttttattgactccatggggacccgaggacagagagaggcgggcgccgggtccacctcccgggctcccggccggccacaggagcgcacacccagattgcaggcccgcggtcctggccacagctccaaatttgtcctcaatgagcaagtggtggaagcctgccagggtgaggaccttccacgcttcccccttcct

SEQ ID NO: 119310 - DNA, 1585 bp, Homo sapiens
  chr20:21490175-21491760
  Hyper
tcaattatccaggggcggtgtggaacgcgggaataaagtgtcatcgcgtccctgggctgctgcgcagagtgctatcgacgcacagatttggtcgcacggataatcatgtttgctttagatattgaattaaacctgatcatcaactacagggagcgagaaagtcagctgggaccgctccttttgcccggcctcctcactgccacccaaccccccagccttgatggtgcagcttcggagagaacagagatacaatttccaaatgcgccgacgttcagtccctcagcgtctgcagcacccgctgggctctgagctagagtcccaagtatttttagaaacccgcgagatagaggagaaaggctcatcctccagttggccaggcttcctaagacgctcccccgcgtggccaagtgtgcgccagcatctgccaaggagatcttcctccagcaacaagggtgggacggaatccgttccccgccggaaagatggatgcgcccttcccgggcgtgcccggggctgtgtgcccacttcccatccggggagctcaccccacccccaaacctctacttcctagcaatccacccagttccacgctcaagggctgacctggggggaccgcacaccctggttcggaccgccgaacgctggagggaaggaggcccgggatccagtccccggagagaggcctggaagcccggaaaggatgggagcgtaagggaagggagaggcatggtttgctgggattgccaaagattctcgctccctggcttcctggggccaaagatcctagggagggctgcagtatcccctccctcccccgagcccagaaccccgcgtacttcccccaagccccctaagccaaagcctcgcgcgccctgaccgttcccacccccagccttagcggtctcctaggtcagcaccagcccgcagattttgaaaaggagtggggagtggggagaaggcagccagtcttaacctcagacccccacccacccactttcttagcgtgaggtaagtcaaatgtaacaaagtgaaagtcatcgagtgtagtggcttcaacagcttctcaggctgaaggagccactcatagatttgggccagcgaggggggtttgctctcctcgcctttgcggctcccgaagtcacttttcctcccgtagccggacgctgccgcccggggttcagacagcgcgcgagaccaggggagatgcgggggagggtgggcggccctgggcttccggccgaccgctcgcaggccggaggccgagcgttctcctccccgccccaatcctaggcgcggggtgcagcctgtggtcggaggggcctgcaccgggagccccgcccgccccagggccccggtacccccggcctccccgcccgagaggaaccgcctgtgggagccccgcgggcggccgggcccggctcccaggcccaggcctccggcccggcgcagtaggacaaacgggagggcagggattttttctttttttcttttttaaacacaggatttttattaaaattcttatttaaaaaatcgaaagctttctgcgcccggcgctgttggggaaccgcgccgaatagctgagctc

SEQ ID NO: 119311 - DNA, 2962 bp, Homo sapiens
  chr20:21492293-21495255
  Hyper
aacattctgtaaacacggcgtagagttcagccctctcccaaggttcagaaggagaggcatgggcagagctgggtgggtggaatctgccactccaaggagacgcaggcaacctcccggcgcctccctagtggagccgagagtcaactcgactccataataataattataataataataataaccaccataaggaccgaggcctcctcgccgccaccgccgccggggtggggcctgggcctggggccgcgagtctcgttggggcggcgctcaccaagtccactgctgggcctggaccagggggtgtgctgtcgggtactggggggtgctggccgagctgtactgggcgttgtactgcatgtgctgcagcgactgcgcgctgtaggcagaaaagggaatgcccgcctggaaggtggcggctgccaggtcctgggctttgagcgcgtgacatggtttgccgtccctgaccaagacgggcacggccacccggcgcggcgagggcaggggcgtcacctccatacctttctcggcccgggcgcgcttcatcttgtagcggtggttctggaaccagatcttgacctgcgtgggcgtgaggcggatgaggctggccaggtgttcgcgctcgggcgccgacaggtaccgctgctgccgaaagcgccgctccagctcgtaggtctgcgccttggagaaaagcactcgccgctttcgcttcttgccggcgtcccccccgccgcccggggtctccttgtcattgtccggtgactcgtcggccgagggctccggggacttggagcttgagtcctgagggggcgccccggcagccagaccgtgcactggggggagggggagagagaagcgcgtcaggcgtctggaggccgcgcgcagcctgcaccagactcggagcaccctggatcctccgtgcgaccctggacctccgcgcctggcagcccagccccgctgcctttgccatgacccctgccttcctctacgcctgacgaagacgtcgggacctcccagggtaaagagggaaatccgtaggagtgggggctaggggctcgcctttcaaggggctcacatagtgtgggtgagaatttggggggggaagtggcactgaagatcatcgcgggttaagggctccggcgcccttaagcggtttcctctccggcgagacgtgggcagatttttaaaagaaataccccacaatcccagcattgatcggctcggccatttaaggcaggtttttgggggctttcgtttctgctttcgggccttctagacaccccctgcactgcacaaagcgtcctctatgatcgcgcagggggcagggtgagctatttatacccgggccacccgaagcctccccaccctccacccgtacccggacgaggctcgctggctacctccagggcgccaggccagtccctcccagcggccggagtccgggggctgcggctggagccatcggtccgggttgacatcatataccagcccctgggaggtatagcccttctccctctttctccttaacttctcgcattgaaaaaaattttggagaccaagttctttcccggaactaaggaggcttgaagaggagggcagaggacatcctatacaggtgttaaaaatctttctacggatccgagtgagggggtccgggcttacatggccccttcccctttcactcccagcgtccaacccgggctgcggctgcaggaatggaggggaccacggcctcggcagccaagttttgctacttacgggagtactgaaggccctcggtgctggccagccagcgcgtgtacgggttgtcgctgctgtcgtagaaggggttcttcaggggcaggctctgcaccgcgtccagggcgccctgccccagcggcccggccctcttggctggctcgggcccctcgttctcttcctccggaccttcggccacagagccctcctcatcgttggtgtccggcaggtctaagatgtccttgaccgaaaaccccgtctttgtgttggtcagcgacatggttcgagaccccaaaatttatgtcgcaaagttgtagcttcacttggtcaattcgtggcgctcccctgccccggcgggcgggggaggggggagttggggggagggactgggggaggggaggggggaattggctttaattattgggataattattatttttaaaaagagaaagaaactggggatggggaggaaaaaaatgaagcccaacccagtgcctctctctgtcttctttgaaagcacgcggaaatggacgcaggaagccgggcggcctgcgcgccgagcgccgcgggccccggccttagtttctaactccaggaggggtgccaaggcggcgtcagctcgggctccggcggccgctcggcgcgcggtggcggctggtggcgaggaaaaaatgggccattgcccgagcgatcagtccatataaggctgggctccactcacgaacctggggaggcggggagagggggagaaagagagggagggagggaaagaaagagggagggagggggagcgagagagggagcgggagaagggtggaaaaaagggggaagagacattaaaaacgcaaaggttggccacgtgtgggcgggtcttgggagtcaagtggatgaagacagtatttgcagatgtgaaattgtgggttttggggagctccgcgctcccagccaacggccctctagagcaagatgagaggtgtaacgtgtcaattaattgcaaagacggggcgagcctttttttttttaaacccagtatttacatacaaagggccaccgcgtcgctcgcgagtccacacacttgaaagggccgttttaacaaattgcatcttaaaaaaggtgggggtggggaggaggaggggagaaaacaaaacagaaaccaggaggagggaaaaaatcctctttaacattcaccggttcctacctccccgcccccgcgcgcccacccccggca

SEQ ID NO: 119312 - DNA, 3353 bp, Homo sapiens
  chr20:21495662-21499015
  Hyper
tcactttctgctttgcgggcggtcccggggagggcggggtaagagtgaggagctccaacttcgtctggggtcggaccctggccctgctgcctctgggctctgcgggcctctttccccgggtggaggaaagggcagacggccctgctctttcctgccctctattatccctccctctccggccccctccctctccagcctctggctagaggtggagcagcgggaaggcggcggggcgggattgcgggggtgggggtgggggttgtgtctccagcctgggtgaagacccagaaagctgcgggggaggggggtcgctgggtggcccgacgatgcctcgttttctccccagttttcttctcccacgcgagttctttagtgtggtctctttttggacgccttgggtgcgttcggagtacgcgctccacgtttccaggttaagtcaggttagtgtgaagtttccagccactctcggctctgggaactgaactttcccgggacttgcacttcctcctcggcgctggggttggaaaagaccacgccgcatttgccaccccttcttctagttaaaacttttttggggggggggtgcaggggtgtagattggctacctgatgctcgttcgccccagaggagtgtcaggaaggagctttgtctgggggcggggaggggcacagaaggccacccctgcggggtccaggtctagtcttcccacaacctgggctcctccgcgcgggccaagctgagcgcgcgggcaccgggtcctcctcgcgcgcagctgcagcggacgccgccgcgccccagctgcccccgggttgccagcgctgggtgagggcacctctccccgagccgctcggcggctttctgcagccctagctgcctcgcccccagtatgtgacgtgggtgacaatggcccaggttagagcaagcccctcgtcggcgcgtcctgggtggtcggacccgggcaaacacaaatacaaaccgattgctaagctgcggacaatgagcgaaatgtagacaaatgtcccgctcccgttggaagcctttgtcccggctcggtttttgcatttatttcagtggcgaaataatacatgattgacgctctctttcaatgtgtcctaactgtttggaataaatctaaggttgttcctagttgtcatggcattcaacccttttcaatggactatctcttcattcatttctgaatccgtccacaatattaaggaaaccccttcatgtcgacgctccccgattcctctttctcctcctactttttcttttctcctttctccccctccttccccccttttttcccctggaagaattagaaacttgtttgaatcgtcttcctcgaacccattacttttcgtgctttttttttttttttgctcgctttccgtctctgtctttctcagcgccccccctcctccgccctttcacgtgggagctcgtcgctctgccccgtcggaggagggaagttggttctccaggagtcggggaagcgtcgagtttggatccaggggcgggagtgggcctgccactgctattgttactcagctgctaaataaataactggagagaaaaaaagttcctcaacccaagcgttgcagcaaagaccctccttttgttcctcctcttattcctcagtcctaagggggtggaggctgtcttggggtccagggcagccactaggttggggacccagaataggatctggttgggccaggcaaattcttgggtcaggtggcaaaggggtctttggcagcaagtgtcgtttctcgcatatccccagagccctcttaggtgggggagtgcccgcagaggcctcccaaagcgtgttcatttcttcagctgggaaccacctcgctgaagttccatgtagttcccaacttctctcccccttccccagcatagtgaccctttcttctcaggatctaaatcagcaccgctgctattgatcaagtcccctcccctcacccgtgggagcctgcaaggtccgcagagcgcctgagagaggattgctttcctaggggaatcctggctcctggaattaatcacggggagggagtgctgccataggcgcctagagaaggaggccctcagcccagttctcaaaggtcgggtttgcctttgcgcctgccccttagcctcaatgaccagccgaatccttctgggtctcagcttgcggtgtcctcttgtcggagcacctgaggcgcccacttcccctgccctcgcaggacgcctcctggactccggcccctcctacactttcaccccagcgagtcttccagtttttatttcccctggcctgggggcagctgggcagggagggagagaattggagagagcttcggccttgcctcctccgcgatcggtgcttccgggtccacagcactcagcctctcccgggacctcgagactcatttccccatcacttctcgtccgtgtggttcccgcgtccatttccagagcgttaacatttgcaattgaaaaggcgctgggagaccgctgggaggtccgtaattgaaggggagaaactgggcttgttagtggaagatcataaaatgcaagtcccccaggagcggcctgtggacgccgggaggcctgcgcaggcccagctggcggccagggcaagtccggtgcccagagcacagtccagtgtctcctcaatttcttgggcccggcttgcgcccaaagagcctaggggccaggcgccaaacgcaccttttctgtcccaattaaacaggtgattgcatcctgaggactccccaagaggcctccccgagagtaccacagctaggccttctagagcccaggagctttggttctctgcgatcccgcacacccgcaggctgagaggccctgccccgctcccttccccctccggagggttcttcagtaagggcccaccactcccaccctgtcagcgtctgcctgcaccagtttcagctcctggtctcccccactcggcattctttagtaaattctttccaggtaccgtcttgcacccaagcgagttcaatgtcctccgttccgtcaagtttgggtttgagctttgggctcagctgccgtggtctggagacctcgtaggcactctgcaagatgcctcgttctgctgcatgcttggggaggaagttgagctgggtgctggaagttctgaacccagcatgccccgggccggaggagatttgcttggtgtctccttagcgtcccgaacaccgcgcgcccctgctggggtaacctgaacagctggacccctcaactcgatctttattatcagcattggggctccagattccgtacacatctctagctctattcattcttcctaggttgagaacggacgcattgggagtcct

SEQ ID NO: 119313 - DNA, 374 bp, Homo sapiens; identical to SEQ ID NO: 87207
  chr20:21499224-21499598
  Hyper

SEQ ID NO: 119314 - DNA, 247 bp, Homo sapiens; identical to SEQ ID NO: 37992
  chr20:21500104-21500351
  Hyper

SEQ ID NO: 119315 - DNA, 1864 bp, Homo sapiens
  chr20:21501381-21503245
  Hyper
ctccttggctttattcgttcgcgctgctctaatgactaaatatgttacaatgagattacgcatcgtcagtgttgccttcaggaacgttctttcagccaagcccgaccttccccggatgagggcgatttcaatacgggagatctgggtttctccaggaaacacgcgctgaaagcactctcttatctgaatttacttcttaacacgtgacaaaatcattaccacaagactttggaaaacaagcggctctcctaacgggttgcattcagcacttaaagctgggtcgggcaggctgatgtgaaaagtagttgtcggtggcgcggagaaggcacgctcttagctggagctaagggctggttccgggaaggacagggaatgcacccttgggccctcgggcacagagagggggttcctagggctctgtctctctctctccaatgtgagccccagaggttcacaaccttcccctagacgcaacgtcccctttccacccccaagagccactaaagtcgagaaggcgccagaggagctccaaagggcctcctggtagtgtgtgcgtgtgtgttgtgggaggaggttggggcggagggggcgcccctcggagacaaggaccccaccgaggttcatttctgatcctctggcgatctctactgacacaaacgagaactgtccggcgccgggcgcggcccaggcgacactcgcctcccaaactccagtcttcagtcgcctctccagagacctcagtccactgcgcgggccctcagccccggctcctcctgtctgcgactcccaccacttgccctcgtgctcatcaccaccgtcccctcacgtcccagttccgtctgaggagaagcccctgtctccactgggcgccatctccaaattaccttcgggacttctgcctctgtttcaatccccgatcccgagctccctgcgacgcacagggggcgacttacccggtggaggtgggtgcagcggccgccccttcctcaccgcggccccgccagccgaggcgcaaccggccccgggcaatcgggagggagctagccaggcgctccgcgcgcccgctccgccttctactcccggagctgcggcgacagccccgccgcatttcaaggcgcgtctttatctagtactccacctacccggacccccctcgctctgcgcccttcccccaccgcgcgccctaccaggcggggctcaggggaccgcaggcggggaccgccgcgggtgccgcgcccctccctcctcctccgcctcccagccccgcaccttcccagcccctgggacagtcccgctttccctgaccgcaccggaaagtgcgcagcggcgggatcacctggcctcggcggctggtaaaacttttcctgactgcaggcgcgacagaggggccctgcccgtcctcgagtgctcgccactcctgccgtgatccgcaaagtcggggagaacttcggaggcccgcacttgcccacctgctgcgtccggactacgcggcttggggatcgagccgagtcaggacccgggagagcgaggggctcataaccggggtccgccgtgaacccgagctccggcgccgctcggcggcgacgacggtgccccgagacccctctctgctggcaggccgcggtgaccgtgcccggagcgcgttcccgcgccgggcggctgtggcaggaggaccagacagtcagcgcctggcagcgagggcgacgccgggcttcctccatcgccaccgccgggctccgctgcggctcccgggctccgccgggtgccccgcgccatccccatcccgcgttcaccggaaacgcgtgcgagctggaggctcacctggagcgcgactgcgccgctggagcctcggctgggcgagcgc

SEQ ID NO: 119316 - DNA, 430 bp, Homo sapiens
  chr20:21503574-21504004
  Hyper
acatggtaggctttgcggggagggggcttccaccccgcctcggccccctgcccccaaacgcgcgggtagattccctccctcctgcgcccctctgagcaggagatctgggaccccaggtttctcctgaccctcgcccctcctccgtccccagcagtgccttggactccgcagctcctggcgagcccggactgctggttaacaaggtcgccatctataaattgctcggtcgctaagacgccataaaaccaaagggccagatgtggcacgttatttatgtgtgaaaccgcgtttacactagatacgcggatccaaggccgatagcacgacttcgcgggaggtcacagacctctcgccccggctccaggctcctcccccagcacgatctcctctccaggttgaggggtgtcggtcttgccgggaaagggattca

SEQ ID NO: 119317 - DNA, 30 bp, Homo sapiens; identical to SEQ ID NO: 87214
  chr20:21504416-21504446
  Hyper

SEQ ID NO: 119318 - DNA, 17 bp, Homo sapiens
  chr20:21651132-21651149
  Hypo
aaaccagctgcaggccg

SEQ ID NO: 119319 - DNA, 264 bp, Homo sapiens
  chr20:21682255-21682519
  Hyper
gacgctctgaccttgcgctccgaggcggcgctcacaggcgccaattcagaatctagtcttcctctccccttcctcgctccctccttccaccgccgcagtcattccccgcggagtttcgttgtgttgttacacaagccagcttttggtttgttagttgttcgcattcccccagggtttgcagctccccgatctggctcagctcttcttcccatagtttctttgcagctagcagctcctcatttctcttttcgtcaattttcttct

SEQ ID NO: 119320 - DNA, 46 bp, Homo sapiens; identical to SEQ ID NO: 87218
  chr20:21682946-21682992
  Hyper

SEQ ID NO: 119321 - DNA, 1122 bp, Homo sapiens
  chr20:21683311-21684433
  Hyper
ctcctttttgactcccgctttcggcaaagagtttacctctctttcttttcctgccttgggaaaactgggcgagggcccgaagcctctggggtaccctcagatccatcctctgccctgctaggagtccagccccaggcggaggagttttgccccaggtttctgagtgcgccctcagctaacaggctcccgcgaccctggaagcggaactttgttgcactccgcttccagaggacgctgaaatacggtgccaaacccagccaagcaaaaacgcagaatccgcgagctctttacctctgtgcgctcagcgctgactagtagctgtccccgggccatggagagggctaagctgcctccttgggaggtgggagagacgtttcttttccttctgcaatctcatcttagggccatctctcaccaagcctagcctgcagctcgggaacccgcgatacccggccgggggacgacagggggcgacaaactgtaaggttttccctatgcccgaccgtgcagaaggctgcagcgagggctgtgtgctcccgatcgcgcacagctggctgcgggaaaggggccaggattgagacgaaggctcgcggactctgctaccggggagaaccaccccctctcatcgtgcgcaatccccagactcacccctctacagtagcccccagccacgggcggccttcacggggacgggggcggagttttgtcctggactgcgactccttgccacttttccaagctcggcagcagaggtggggtggacgttcccctgaaagggtagttgggcgaaccagctctcacggtgtcacgaccggctttatttcctcgtctttagagtgtgcctgttgactcctcacctactggggggaagaagcggctttagctgcttttccggatcacgagtatccactggactgaggcagggatgtggcgttcctttatctcagagactccaaggtctggaaatcaacctttcttggtatctcgcgcccgacgaagctagcagattccgcaatggagagcactgggcagggtgcgtccccactccccgcacccccggagccccgagcatactgtgcgtgcttagtcctctcttcgctgccttcgcggaactcctggctt

SEQ ID NO: 119322 - DNA, 30 bp, Homo sapiens; identical to SEQ ID NO: 38003
  chr20:21685666-21685696
  Hyper

SEQ ID NO: 119323 - DNA, 558 bp, Homo sapiens
  chr20:21686184-21686742
  Hyper
ggtagagtttcagggcggggaggggggcgctggggcgcagtgacgggaaccaatgagctgccaactcgcgcgtctccggcgtgactgccgagattgacgtggaggacacgtcaaattgattcccgcacgctgcagcctcccggtcagacgaatttctcccaatcggatgaagttcaccctgggcctggggtcgcgggcgtggagagtgtcctgggagggggcagcagcggcggcggcaggccctggagcgggcggcagcgcgctccgctgccgcgcacagcgcgtctccagcccgcggctgggccgccgcggctctcggctctcgggcgccctccctctatgcctctcacgcggcggcggcggcgcccaagctctcccggactgcgccgggcccagccccggccaccccggccaccccggcgccaggcagctggccggcccgctcgctatgggtaaggggcgggcgacaggcagggctcgggagggctgatgaggtgggtcgggtccgcctgcctcccttccctctcgtccgctttccctgggcgacccagtcctggg

SEQ ID NO: 119324 - DNA, 848 bp, Homo sapiens
  chr20:21686963-21687811
  Hyper
tcacctttggaagtgcgcctgggtgcagtccctcgctccgcgtggggacccttggctaacccgccgggtgttttctccccctccggctcactcttgtctggcgcatccgcagagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctgcgtgagcaagatcctggcgcgctacaacgagaccggctccattctgcccggggccatcggggggagcaagccccgcgtcaccactcccaacgtggtcaagcacatccgggactacaagcaaggagaccctggcatctttgcctgggagatccgcgaccggctgctggccgacggcgtctgtgacaagtacaatgtgccttcggtgagctccatcagccgcatcctgcgcaacaagatcggcagcctggcgcagcccggaccgtacgaggcaagtaagcagccgccgtcgcagcctacgctgccctacaaccacatctaccagtacccctaccccagtcccgtgtcgcccacgggcgccaagatgggcagccaccccggggtcccgggcacggcgggccacgtcagcatcccgcgctcatggccctcggcacactcggtcagcaacatcctgggcatccggacgtttatggagcaaacaggtcagttgtggcggcctccgtagccttctattaaggggcagaacctggggcgggcaggcttgcaggagaggactcacactcgctctcctcccgggaccggttctgg

SEQ ID NO: 119325 - DNA, 30 bp, Homo sapiens; identical to SEQ ID NO: 87227
  chr20:21689196-21689226
  Hyper

SEQ ID NO: 119326 - DNA, 149 bp, Homo sapiens; identical to SEQ ID NO: 38008
  chr20:21689912-21690061
  Hyper

SEQ ID NO: 119327 - DNA, 45 bp, Homo sapiens; identical to SEQ ID NO: 87229
  chr20:21693467-21693512
  Hyper

SEQ ID NO: 119328 - DNA, 141 bp, Homo sapiens; identical to SEQ ID NO: 38010
  chr20:21694434-21694575
  Hyper

SEQ ID NO: 119329 - DNA, 337 bp, Homo sapiens
  chr20:21694952-21695289
  Hyper
ggggtctctggagagcgcgagtctctgcttcactcttccagagccttcaagggttgagcgctcacgacctcgctctgcaggcgtcctgagtcccagtgcctctcgcactgcgcggcgctaggtagtgatccgacgcctctgtgcttcctcccgcagtggctgacaggaagcctcccagctccggcagcaaggccccggacgccctcagtagcttacacggactgcccatcccggcctcgacctcctaggggcagctctccccggacccgagcccggagggaacggcaggcggacccgggcgcacaggtctgcgcggcggccccggcaatcggcacgg

SEQ ID NO: 119330 - DNA, 261 bp, Homo sapiens; identical to SEQ ID NO: 87232
  chr20:21748255-21748516
  Hyper

SEQ ID NO: 119331 - DNA, 233 bp, Homo sapiens; identical to SEQ ID NO: 87234
  chr20:22356457-22356690
  Hypo

SEQ ID NO: 119332 - DNA, 887 bp, Homo sapiens; identical to SEQ ID NO: 87235
  chr20:22557396-22558283
  Hyper

SEQ ID NO: 119333 - DNA, 155 bp, Homo sapiens; identical to SEQ ID NO: 87236
  chr20:22558541-22558696
  Hyper

SEQ ID NO: 119334 - DNA, 187 bp, Homo sapiens; identical to SEQ ID NO: 87237
  chr20:22559055-22559242
  Hyper

SEQ ID NO: 119335 - DNA, 150 bp, Homo sapiens
  chr20:22559622-22559772
  Hyper
tagagttggggaaagcgcgcagtggcgatttgtgagctcgttatctcggaacccgggctaggggagggatttaagcgggaggggggcgtgaaagacacaagaagcacagaaaagcctccgaaagcgcctgctccccgacatcctttttat

SEQ ID NO: 119336 - DNA, 169 bp, Homo sapiens; identical to SEQ ID NO: 38018
  chr20:22559973-22560142
  Hyper

SEQ ID NO: 119337 - DNA, 171 bp, Homo sapiens; identical to SEQ ID NO: 87241
  chr20:22560380-22560551
  Hyper

SEQ ID NO: 119338 - DNA, 339 bp, Homo sapiens
  chr20:22562562-22562901
  Hyper
caggcccgttttgttcgtgaccgggcccatggccaagctgccaggcatgggggaaccgtagccggggtagtgcatcacctgttcgtaggccttgaggtccattttgtggggttggtggtggtggtggctgtggtggtgctgctgctccgaggacatgaggttgttgatggagaacgggtggttgaaggcgtagtggtgttccggcttcaggtgggcctcaggcggcaggcccgggtggtggggcgggcccagcaggtgggccgcggcctgctgctgctgcccgggagagggcgccggctctggggggctcagcgccgcagccggcgtccccttcagctc

SEQ ID NO: 119339 - DNA, 30 bp, Homo sapiens; identical to SEQ ID NO: 87243
  chr20:22563764-22563794
  Hyper

SEQ ID NO: 119340 - DNA, 34 bp, Homo sapiens; identical to SEQ ID NO: 87244
  chr20:22564154-22564188
  Hyper

SEQ ID NO: 119341 - DNA, 30 bp, Homo sapiens; identical to SEQ ID NO: 87245
  chr20:22565429-22565459
  Hyper

SEQ ID NO: 119342 - DNA, 254 bp, Homo sapiens; identical to SEQ ID NO: 87246
  chr20:22565952-22566206
  Hyper

SEQ ID NO: 119343 - DNA, 414 bp, Homo sapiens
  chr20:22567354-22567768
  Hyper
cgcaggagaagggggcgctacacttccaaggagcggactttggaagcccccacctccaccacagcactattggtggccggggtcagggacaccagagagcgctcggcgggggcttccacagtgacagggcgccccctgtcggccgccaggcccgcgggaccgacccgagtcctcatttacccccgcgatcccaaccccgcagctccggcaccggagcaccttctcccccgctctcccagtctctccgaaaacgccttcggggggactcggcctttttggagccccaacccctaggttctgcgcgaacccaaaacggcctcctgcaccctggcgaggttctgggagctccggtagggtagggctggatgacgcctcctagagtctcggagcagccgctcccgcaccctcccggca

SEQ ID NO: 119344 - DNA, 73 bp, Homo sapiens; identical to SEQ ID NO: 87249
  chr20:22634183-22634256
  Hypo

SEQ ID NO: 119345 - DNA, 23 bp, Homo sapiens
  chr20:22656661-22656684
  Hypo
gcgcccggcgggtctggccatgc

SEQ ID NO: 119346 - DNA, 30 bp, Homo sapiens; identical to SEQ ID NO: 87251
  chr20:23015837-23015867
  Hyper

SEQ ID NO: 119347 - DNA, 1483 bp, Homo sapiens
  chr20:23029003-23030486
  Hyper
gctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcatgttacccaggcgcgccgcgtgcaggcgccggggaaagcgcgggcactgcgacagggccgtgccggagcagaggggcacaggacgccgatggcgacagcctctcctgtccgtcccagcccagacacttcttgccgctgcgcgcagcccctgcgaggcagcctctgacatgcggatcggccagggctcgagtttataagtgcccggccctccctccctggacgttcgggaaaaggaaggaagtgcctggtgggaagggctgatgccgcatactcggattgctgggttctctggccgcccttgcgcccgccctcgcgcatgggatcacctcgccgggatgagtaaacc

SEQ ID NO: 119348 - DNA, 888 bp, Homo sapiens; identical to SEQ ID NO: 87255
  chr20:23030745-23031633
  Hyper

SEQ ID NO: 119349 - DNA, 30 bp, Homo sapiens; identical to SEQ ID NO: 87256
  chr20:23031922-23031952
  Hyper

SEQ ID NO: 119350 - DNA, 45 bp, Homo sapiens; identical to SEQ ID NO: 87257
  chr20:23092381-23092426
  Hypo

SEQ ID NO: 119351 - DNA, 17 bp, Homo sapiens
  chr20:23114731-23114748
  Hypo
gggcgcggtggctcacg

SEQ ID NO: 119352 - DNA, 107 bp, Homo sapiens; identical to SEQ ID NO: 87259
  chr20:23117794-23117901
  Hypo

SEQ ID NO: 119353 - DNA, 85 bp, Homo sapiens; identical to SEQ ID NO: 87260
  chr20:23138452-23138537
  Hypo

SEQ ID NO: 119354 - DNA, 397 bp, Homo sapiens; identical to SEQ ID NO: 87261
  chr20:23618248-23618645
  Hyper

SEQ ID NO: 119355 - DNA, 83 bp, Homo sapiens; identical to SEQ ID NO: 87262
  chr20:23969237-23969320
  Hypo

SEQ ID NO: 119356 - DNA, 2584 bp, Homo sapiens
  chr20:24449601-24452185
  Hyper
ctggagtctgaactccgcgcccgcttgctcctccagggcttagctggtcaggacttgaacattcgccggatccataaattgggtcatttttaacctcaaaaccgaaccgcagcctggggaggcctttaggaccgaggggagccatcccttcctctagtcgggcagcaaattcctgtcctcctagtcccccgcagctatcccccgcccccagcctctgtggccctcacattgtcagacactggccgcgggccaccatctggacgcgatcccccgctagggcctccctggtctgggccaaagttggtggccaccttcgcgcgggctgcgccctccttctcttccctgccctcctcccccggggcccgcgcccgctgcctccagcacgcgcgtcggcaggctcggcaagcgaagaggagcggctcgccccagggcgcccctcgcccagcctgccggccaggcgagcgcgacgagagtctccccgcaccccttcctctcccgggggccgagagggttgggctccgccccggcgccgcagctcccgactccccgccgctcgggctgccgccgctgccccgcgcccggcgctcggggcagccgggggcgcaggcggagagcgcagggcggggagaggcgtggggagcagagcggcgctgaggggagggcagaggaggagagagcctggcagcggaggagcagaggcgggcgccgcaccgccccgcacgctcgctcgctcgggagagtcgcgggcggccgcttgggcgcacttgccgggtcaccttgtcccggaggtaagtccagacctcccggccgcgggggcgggcggaggggcccgcagtgggcggggtcgcggcaggggccgcgagctggcggcgggagctggaggctgccctgcgctggcgggtgtcctagtcctggctccgcctcggagcgcgcagacccggcggcggcgtggcgcccgcggtaagtccgggtggtcgccgcgacgagacttgggagacacggggtcgcagggcgggagggggagctgagccggcagagaaaatgcccaggaaggggtcgatgctggcctgggctgcaccttggtgccttgccaccccgggagacgcgaaggggctgctgtgcgaattcgatgggagctggtgagaccgagaactgagagcgtagcggagccaggctgcccagcagggccatgagggcgcgcggcgggccaaggctctgcgggttcgggctgcccctcggagtgacccgaaggagaccagccagggctggtgagccgggcggccacggagctggggacctaggtctgtttgggagtaggaagggaaacagactaattctccgagcggagcggcaggcaaggtgcaagcgcgcttgggatggggaatcccgacgggcgaccgtggcggaagcagagactcctggagcctctttcctctagccaggacaagacctgccttcaaaagctgtctggcccctggcagccgcgacagcctgcagccctgggagccacagccctggcgccgagatgggagcgagcacatacgcttttttggttccaatttgaatctcgctttttcctagtcgtgatttctgcctcttcatgtgcactctctgggcagtgaggaggaaggaatggctcactggatgagttgggcacttttcttagggaaggggctttgtccctatgcgctttttgcaagaccctactagagtggctctggcagccgagctttgaggaggcggccagaggggccgcttggcgtttctgaaagacgagaggaaggggtcttctggtagtcctgttttcctttgggggtttcgttgcacgcagaggcttgggcgcttggcacccagacttcaggtgcgcacagtcctcctgcgacgtcagatgcgctggcgccgcggcgctcctggctcggaccgatgcctgcgccttccctggccacgtcctggtgtttagtgcagcagacaccggccgaaggcttggctgattgggggtgtcgaggggaggggggctgggcgttacacagtggctccgttttctggttggaatcagttggtgaggcgtgcgcgcgcgagtccgtgtatctgtccgtctccctcctacagcccagcgtgtttggtctgagtccaaagaaggaggtggtgtgtgtgctgcgtagacctgcgcctgtggggtgagcagcctcatagcccccagagccggccaacttctccgtgctaggctgcgacctcaagggctgccgcgtcggggatcggaagtggtcttcaaagaggggtctaggtcgcgaaatcctggcagcagccgaagtgaaaaggagctgctaggaggcgggcggggggcagtctgatgtccgttctggcgcggacaggaagaaactgaagtcgaatttttagttgaattgcgtgctctgtgtttggcggtggtgtggcccgttcttttggaggtccacaccacaggtatgaggcctgtgggccctgaggaagcgcgatccccttaattcctccctcccctctctctccaccgcccgcccctttgcaaggagcaagcctgacagtagctgatcggcgccctctctcaccc

SEQ ID NO: 119357 - DNA, 94 bp, Homo sapiens; identical to SEQ ID NO: 46108
  chr20:24467593-24467687
  Hypo

SEQ ID NO: 119358 - DNA, 152 bp, Homo sapiens; identical to SEQ ID NO: 87271
  chr20:24485768-24485920
  Hypo

SEQ ID NO: 119359 - DNA, 251 bp, Homo sapiens; identical to SEQ ID NO: 87272
  chr20:24523851-24524102
  Hypo

SEQ ID NO: 119360 - DNA, 30 bp, Homo sapiens; identical to SEQ ID NO: 87273
  chr20:24557052-24557082
  Hypo

SEQ ID NO: 119361 - DNA, 188 bp, Homo sapiens; identical to SEQ ID NO: 87274
  chr20:24570981-24571169
  Hypo

SEQ ID NO: 119362 - DNA, 92 bp, Homo sapiens; identical to SEQ ID NO: 87275
  chr20:24571457-24571549
  Hypo

SEQ ID NO: 119363 - DNA, 34 bp, Homo sapiens; identical to SEQ ID NO: 87276
  chr20:24577284-24577318
  Hypo

SEQ ID NO: 119364 - DNA, 30 bp, Homo sapiens; identical to SEQ ID NO: 87277
  chr20:24591039-24591069
  Hypo

SEQ ID NO: 119365 - DNA, 35 bp, Homo sapiens; identical to SEQ ID NO: 87278
  chr20:24646770-24646805
  Hypo

SEQ ID NO: 119366 - DNA, 30 bp, Homo sapiens; identical to SEQ ID NO: 87279
  chr20:24710156-24710186
  Hypo

SEQ ID NO: 119367 - DNA, 30 bp, Homo sapiens; identical to SEQ ID NO: 87280
  chr20:24710762-24710792
  Hypo

SEQ ID NO: 119368 - DNA, 37 bp, Homo sapiens; identical to SEQ ID NO: 87281
  chr20:24859497-24859534
  Hypo

SEQ ID NO: 119369 - DNA, 30 bp, Homo sapiens; identical to SEQ ID NO: 87282
  chr20:24872315-24872345
  Hypo

SEQ ID NO: 119370 - DNA, 30 bp, Homo sapiens; identical to SEQ ID NO: 87283
  chr20:24872697-24872727
  Hypo

SEQ ID NO: 119371 - DNA, 89 bp, Homo sapiens; identical to SEQ ID NO: 87284
  chr20:24872934-24873023
  Hypo

SEQ ID NO: 119372 - DNA, 30 bp, Homo sapiens; identical to SEQ ID NO: 87285
  chr20:24873703-24873733
  Hypo

SEQ ID NO: 119373 - DNA, 30 bp, Homo sapiens; identical to SEQ ID NO: 87286
  chr20:24947246-24947276
  Hypo

SEQ ID NO: 119374 - DNA, 30 bp, Homo sapiens; identical to SEQ ID NO: 87287
  chr20:25003625-25003655
  Hypo

SEQ ID NO: 119375 - DNA, 246 bp, Homo sapiens; identical to SEQ ID NO: 46113
  chr20:25028280-25028526
  Hypo

SEQ ID NO: 119376 - DNA, 474 bp, Homo sapiens; identical to SEQ ID NO: 87289
  chr20:25058288-25058762
  Hyper

SEQ ID NO: 119377 - DNA, 1542 bp, Homo sapiens
  chr20:25061746-25063288
  Hyper
aggggactgggaggacgctgcgccggcagaggagcgcggtacccgggactcccttttcagcaccccaaggggcggacagttccagggctcgaggccccgtactcttccaggacccgtcaatcattcgatcatttccgcccgcgtttccacctggtaccttgttcggtgctgctggtgaccaccacaggcccgggccttcccgacccacgcagctgccagaggcggagactggcgcctggcgctggggggaaaaatggccctctggagatggttgttgaagaccccagggtctcatcaaaaggttccacccggaaccaggtggtggcggtctcacatcgctgagggaacaggaccccggatgagaggcagggatttaggatgcagcaaggggcaggcggcgcagctccgcgaatgcccctcccgcgacggggcctcgctctgggctccccgcctagatctgggccgctggggccaggggtgcggtggggcgatggtctgtgacccctgcgcggctcagagcctaggggacaggggcaggagcggaaagcgcgggcctgattaccggacgtggagacgctgtcgctgcgcttctggcggccgagcgcaggcggcggacggctgggagccagcggggcagcgggctcggggcccctgggcggcaggaacggcacgtccgctaggagcaggcagggtgctcgagcggccgccggcggctgcgtgccgaagccacagaggaggccgagtcccagcggtagggccccacgcgccaggctggagccgtcaagccccgggcccgggcacggcgcgactgccggaccctcgcagccagatccctgtcctgggccagcgggcgccggcagctcggcctccaagcccagcaggtccgtgatggcgaagccccgggggcgcgagcccctaggggaaccgccaggcaccagcgccctgctgctagtgcgcccgtcggaaagcgagtcccggccggtcatggttccttagcaagcaaggcgcgagcctctctggatcccgtttgcggagggcccagcttagaggaagctttataggattgggctgccggtcgggcgcgggaggcctgaagggctccaatcagctgggcgcgggcgcgtcgccgttccggaccccgcgagatggggacgccaccagttcccctcccctcggttaccgcccacccagctgcagtcccctcagtcacctccttctcctcctctcttctgtccagcccaccccaccccaccccacccccattctaggagggaggggaggaaagaaggtaagggacagtgactccgctgtctgcctgtccctcgaaaagtcgcaagttctacatcctggcgtggccttctccttccttccagactctctgggtggaggccccactcccagctgccctgaagcttctttgatgcgacccaactgcctattaagacctaggaccccattcccaaccacaccccgatggctaccccatatatgtccccagccagccctccacctccgccgccggtgccacgaaggccttcctgt

SEQ ID NO: 119378 - DNA, 1828 bp, Homo sapiens
  chr20:25063698-25065526
  Hyper
agcacaccttttcatcggggcttacaatttattgtccaatttcacgattattcaaagaaagcctgattctttgaataatcagtgaaactctgatattcgctaaagttggccccaagcacgtgggtaagtaactactggttcgcgctttgaacccaaccagccctcatcgctcggagccctgcgtcccccgcttcccaatcccagaaccccggaagcagatctcctcagtcccactccctgagggtcctacagtccgaggtcccgcagcgagggaggagcaaacgcctgagctccgcgggaacccggcgcggctgcctgcgcgcacgcagggaccggagcccgagcctgggccctgcaaagtgggtctcccactcgctgcgcgttcgagtggggcctccgctaaacatgcagattaaacaaggggcttccgataaggataattacaggaggctgcgcattgactttccgttactaaaggaagacccaaatctcccccttgcaagctgttcccgggattaccaaaacaatcactttcttttgagatcattgtcttttgaaccactccagctcggggcagaacgctttagacgctggcgttgttttccgctccgcgaggaattttcccccagatttatctctgggtttagggaaggcgttgggcattcgggactgcgtagtcgtttgtaaatccgaatttggggtagcagttaagtgagatacctacgcttccacacagtttgtagcccgagaccagtcaggcaggcagggtagtcgattctaaggtggcccgaccggggtcgcccgcgaatggaaagcctaaggggcgagggcggacgcgggcgccgtgcctgcagccccgggtgccgaccaagtggcctcacctgggacaggtcttggggtctccctcccctaggtctccctggaaggtaggcgatcacgggagtgacagaccccgagtagatagccagtgatccaaagacaccaaaaggccaggcggtaggagcccagcctcagacactctctatagtgaccgcggcgcctcgggaaggatcgtcttaaactcattttgcaggtgagagcaactgggacttattaacccagtcacatcggacacagagacgtggcgagggcgacacagagcaggagactcaatcaaggagcccgtattggagctctaaggggactcagagatgcagaaggaacgaacttctaaggggtcttgcaattcctggactggggcgttcctaatgcatcccgggaccccaatgccagggaggggcctgcaggaccccagcggtgggcgagttgtgtcctgggtcaccttgtgtttcgcagcgtggcggtggcaggagcccagcgcgggaggacattttcatagcctcctacagtgagaaacgccccccacccgacgctgcgctcatctgtgtccccgctgttgccggggctctggtatccacttgcgcgccctatgtggtggggatccacccagagcccagcgtcaagttatacgggcgcttcactcagcgtcagccaagaccagggaagcgcttcttgccgtttaggagacgtctgcaagagataaaaagctagcccacgatccacccacaatcctcgtgtccccggggtgccctcgcagttgccaaacctacgggccgcgtttaggggaagcctccgcgtcctggcggccaaaagaatgggctccttccagcttccccctaccggataccacctgcaaatctattgccagaggcgcagctcccgcgaacgttcccgccccgggcggcccccaggagtcgttttgggtccctaaatccgttgagggttccga

SEQ ID NO: 119379 - DNA, 72 bp, Homo sapiens; identical to SEQ ID NO: 87298
  chr20:25065766-25065838
  Hyper

SEQ ID NO: 119380 - DNA, 30 bp, Homo sapiens
  chr20:25129130-25129160
  Hyper
ccccccaccccggggcgcccaccaccccgg

SEQ ID NO: 119381 - DNA, 59 bp, Homo sapiens
  chr20:25129434-25129493
  Hyper
ctggctctttgctgtcgtcactcggttctccgcccatccccgtgcgcacgtgttcgctg

SEQ ID NO: 119382 - DNA, 161 bp, Homo sapiens; identical to SEQ ID NO: 87300
  chr20:25230352-25230513
  Hypo

SEQ ID NO: 119383 - DNA, 220 bp, Homo sapiens; identical to SEQ ID NO: 87301
  chr20:25230753-25230973
  Hypo

SEQ ID NO: 119384 - DNA, 97 bp, Homo sapiens; identical to SEQ ID NO: 46116
  chr20:25251463-25251560
  Hypo

SEQ ID NO: 119385 - DNA, 30 bp, Homo sapiens; identical to SEQ ID NO: 87303
  chr20:25260377-25260407
  Hypo

SEQ ID NO: 119386 - DNA, 30 bp, Homo sapiens; identical to SEQ ID NO: 87304
  chr20:25281398-25281428
  Hypo

SEQ ID NO: 119387 - DNA, 30 bp, Homo sapiens; identical to SEQ ID NO: 87305
  chr20:25320569-25320599
  Hypo

SEQ ID NO: 119388 - DNA, 23 bp, Homo sapiens
  chr20:25344133-25344156
  Hypo
tgagtcaccgcacctggctgaca

SEQ ID NO: 119389 - DNA, 765 bp, Homo sapiens
  chr20:25565479-25566244
  Hyper
tggtgtgtgtgactgcgcgcacaggcgggaggaaaggggcgaatctgcaaaacgagtacaacagataaaattcgcaacagacttctacaccctttcaatcaaccgtcccaagcgccacgaacgcgggtcccgctccgtggggggccgcagccacactggcaggagggaatcctgggcctcgaccagacgccggcggcgtcaggagaaacggcccgcgctgggcaggcggcgggcaccgcgtagctcattaccacggggggccccggccaaggccgcccgcctcaggccgagccttggggctgtgctggacccgggccctcgttcgcacggcgcccgcgccgccgccgtcgggaaaccgggttttcaagcgttcggcccagcgggcgctgtattttagggcgtgacccccgccccgccctcgagggcgaccggaagagcaggcaccacagcagatgcgccgagtctgcgccccgcaccgcgaggagcacccgaggccgcgctcccggagccgggtctggtgactaaggcgcgggtcgcgacgcaggggcggccccggactctcgaccccaccagccgcctgaatgtcccgccggacgcccgggccggctcacctgggaggcgcctccgccgtccgcccgcgcggggccaggagcgcggcaccacccccgtaccgccggccgctctttgtgtctggaggccgcgacgcaacactcctcccggcctcgaggcaccgccccctcggtgtcccggcgcagtgggcgaaca

SEQ ID NO: 119390 - DNA, 30 bp, Homo sapiens; identical to SEQ ID NO: 46117
  chr20:25603036-25603066
  Hypo

SEQ ID NO: 119391 - DNA, 99 bp, Homo sapiens; identical to SEQ ID NO: 87313
  chr20:25968565-25968664
  Hypo

SEQ ID NO: 119392 - DNA, 30 bp, Homo sapiens; identical to SEQ ID NO: 87314
  chr20:25972523-25972553
  Hypo

SEQ ID NO: 119393 - DNA, 30 bp, Homo sapiens; identical to SEQ ID NO: 87315
  chr20:26116723-26116753
  Hypo

SEQ ID NO: 119394 - DNA, 720 bp, Homo sapiens
  chr20:26188812-26189532
  Hyper
aacctcaggcatggccgggccaccaggaaaacacggccgcgggatcccaccgccacagacacgagggcggtcccgcggcgccccgcctgggacgccggaaggccctcggcacccaccaagacctgcctcacgagcccctggtcccgccaccggggccccgaagcgaccacagccacaaactcaacgccagggccacatcgctcgtgattctcgtccatcctccgacccggtcccgctccgggagaccggcgcgcccccaccgtgggacgctttcccagggccaggcggcccgaccacgtgccacgcaaacgccgtcgtccgcaccggtcgcgactcggcaagggagcgggcggagagctgactcgcggcggaggggggtcactcgccggacggaacgctgcgcgcagccatcgctcgctgtcagccgcgtcccaacccgctaggacgctgggccctgccggcgggatcctccccttactcggaaaggggaggcgccggccacagtaggcgacgagccgcgctcggccaccaccgcggtggccggcggaaccctcgctctccccccgtcaccccgtcgagggggaagctgaggagggttcctctgcaagcgagtcgctactgcagcgctaccataacggagagagagacagaggcggcaggccgggggatcccgtaccccaaggcacacctcttggatcgctagagaaggctttctcaccg

SEQ ID NO: 119395 - DNA, 180 bp, Homo sapiens
  chr20:26189592-26189772
  Hyper
ggcgctcagggaggcctggggaagggagggggcctgtggtaccaggaaaaacctgcgtgcggcaaccttgagcgttcgcggtcagggcggggaccggcaggtgcgagcgtgagcgcaactccacaagcccccgcctcccacccccccccccaccccgtccacccgcctcttttcttcaga

SEQ ID NO: 119396 - DNA, 518 bp, Homo sapiens
  chr20:26189832-26190350
  Hyper
ggcggccggccggcgcacgcgtcaccagcccaagcccaccgcgatcgctcacagggcccgtgcgcacccgccagaggggagcaccggacgtgcgctcgccggaccaggcgggcgcccttccccgcgtgggaggggcgcgtctcgtctcactcaaccgcctcgaaccccacaccgacgagctccctcaggacccacgcgcggacaccgaggcgccgaccggaggagggggcgctgggggtgggaacgacacaccaccgctcggcctcgggaacctgagggacaacccggagcgctccaggagcaccgcaaaggcccagggggagccaacgctcgcgcaaactccccgggagggcagcacgacgggccggcgggacagcacccccaccgctgcggaggggggccgcccgcaagtcgacaaccacaggaggcgagagcgaggggtgcctgccgcgtcagaggaccccccgacccaccccgcgaggcagaaggcgggggcgggacagcgaggtcaggccggg

SEQ ID NO: 119397 - DNA, 30 bp, Homo sapiens; identical to SEQ ID NO: 87344
  chr20:29873905-29873935
  Hypo

SEQ ID NO: 119398 - DNA, 30 bp, Homo sapiens; identical to SEQ ID NO: 87345
  chr20:29958799-29958829
  Hypo

SEQ ID NO: 119399 - DNA, 30 bp, Homo sapiens; identical to SEQ ID NO: 46118
  chr20:30022593-30022623
  Hypo

SEQ ID NO: 119400 - DNA, 591 bp, Homo sapiens
  chr20:30063043-30063634
  Hyper
ctcccccggccgaggcggcgaggggaggggaactggcctgaggggctgctcactgaggcgggtggtacagcctggagcatccagccgctggagctgcgagggaccctggacccctcccacgccgaggtaaagccctgcgctacgcgccgccaacttgctcaagttggagcagagttcgccaggcgattgaagggggattcggcagcgttggcaggaataggggggcttcgaaaccgcgtccctagggtgagggtcttcagacctgggacccggagggctggatagccctggacaaagacccctccaaccccaggatgggggattcacacccgggatgccggctgagaaagctcggacccagactccaggaatggcacagcgttcccgggccctgtggtctgccctccccgtcccctgccaggaccctgtcctgtcacctaacctggggcctgaccggcggcagctcccgtccccaaaagcagttggaggccgtagcgccagccgctcctgaatttttcacacagggggcgggtcagacacgcggttcccatggcactagggcactcgggttacagtcgggttacccccata

SEQ ID NO: 119401 - DNA, 30 bp, Homo sapiens; identical to SEQ ID NO: 16575
  chr20:30101713-30101743
  Hypo

SEQ ID NO: 119402 - DNA, 28 bp, Homo sapiens
  chr20:30134312-30134340
  Hypo
ggaggctgaggcaggcggatgacttgag

SEQ ID NO: 119403 - DNA, 30 bp, Homo sapiens; identical to SEQ ID NO: 87352
  chr20:30151940-30151970
  Hypo

SEQ ID NO: 119404 - DNA, 47 bp, Homo sapiens; identical to SEQ ID NO: 46121
  chr20:30153940-30153987
  Hypo

SEQ ID NO: 119405 - DNA, 93 bp, Homo sapiens; identical to SEQ ID NO: 87354
  chr20:30175456-30175549
  Hyper

SEQ ID NO: 119406 - DNA, 42 bp, Homo sapiens; identical to SEQ ID NO: 87355
  chr20:30175841-30175883
  Hyper

SEQ ID NO: 119407 - DNA, 20 bp, Homo sapiens
  chr20:30181151-30181171
  Hypo
cacatcgttgcttttgcatc

SEQ ID NO: 119408 - DNA, 44 bp, Homo sapiens; identical to SEQ ID NO: 87357
  chr20:30191611-30191655
  Hypo

SEQ ID NO: 119409 - DNA, 136 bp, Homo sapiens
  chr20:30193856-30193992
  Hyper
cggcatgcgttcctgcggacgatcgcatcttgtgtcgctgaagcgcctcccccagggaccggcggaccccagccatccagggggcaagaggaattacgtgctctgtgggtctcccccaacgcgcctcgccggatct

SEQ ID NO: 119410 - DNA, 30 bp, Homo sapiens; identical to SEQ ID NO: 87360
  chr20:30199446-30199476
  Hypo

SEQ ID NO: 119411 - DNA, 37 bp, Homo sapiens; identical to SEQ ID NO: 87361
  chr20:30244648-30244685
  Hypo

SEQ ID NO: 119412 - DNA, 30 bp, Homo sapiens; identical to SEQ ID NO: 87363
  chr20:30407129-30407159
  Hypo

SEQ ID NO: 119413 - DNA, 215 bp, Homo sapiens; identical to SEQ ID NO: 87365
  chr20:30464460-30464675
  Hypo

SEQ ID NO: 119414 - DNA, 39 bp, Homo sapiens; identical to SEQ ID NO: 87366
  chr20:30468269-30468308
  Hypo

SEQ ID NO: 119415 - DNA, 517 bp, Homo sapiens; identical to SEQ ID NO: 87369
  chr20:30555886-30556403
  Hyper

SEQ ID NO: 119416 - DNA, 275 bp, Homo sapiens; identical to SEQ ID NO: 87370
  chr20:30582750-30583025
  Hyper

SEQ ID NO: 119417 - DNA, 57 bp, Homo sapiens; identical to SEQ ID NO: 87371
  chr20:30584443-30584500
  Hypo

SEQ ID NO: 119418 - DNA, 51 bp, Homo sapiens; identical to SEQ ID NO: 46125
  chr20:30585053-30585104
  Hypo

SEQ ID NO: 119419 - DNA, 389 bp, Homo sapiens; identical to SEQ ID NO: 87375
  chr20:30639105-30639494
  Hyper

SEQ ID NO: 119420 - DNA, 1074 bp, Homo sapiens
  chr20:30639695-30640769
  Hyper
ttagacgggcgggttcgaatccctaggagtgggatttgggatcctttggagactggggtaggacgctgggcggtgggatggggaggtgttagggaaagtggagcggaagggatgggggttcgcatccttggtggacgcgttagaagcctcctatggatggtgctaatattttttttctcttcgtggagggtttgggatccttcttgcaggagacggaggttatgaccctcggggagccggttaggatcctggggtggcgtctgaatcttcggggaggtgttaggacacttggggcggagttagcctcgctcagggcgcggctaaggcgcccagatggcctgcgggcgccaccacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggtgagtgccgcgcacaggggaccgggaatacccggcccgcgaggggtcccaggaggcggagggagcccaggagcctggggagggctggctacgggtgcggctgggggcagcgaggggagacggaacgtcgggggagccgcgggtagcccgggggatgaggggtcgacagcgagtggagggtgccctagggaggggcggcactgttgcggactgctggattcccggggaaggggacgctcgggcccgtgcagtgactttatccaccacttctctgggccgtccaggttccccttcttgggggggggcggggattttttttttaatttaaaaaagaaaaagaaggaagggatggggcttcacagaacccgggaaggggaaggcccttacggttcccggtgggggccgggtcacgccgggttggcagccagcttggggaagggggtagttgggcggaggcgtgacgtgcgagccacacccagg

SEQ ID NO: 119421 - DNA, 42 bp, Homo sapiens; identical to SEQ ID NO: 87379
  chr20:30671697-30671739
  Hypo

SEQ ID NO: 119422 - DNA, 30 bp, Homo sapiens; identical to SEQ ID NO: 87380
  chr20:30689127-30689157
  Hypo

SEQ ID NO: 119423 - DNA, 30 bp, Homo sapiens; identical to SEQ ID NO: 87381
  chr20:30727301-30727331
  Hypo

SEQ ID NO: 119424 - DNA, 30 bp, Homo sapiens; identical to SEQ ID NO: 46127
  chr20:30770464-30770494
  Hypo

SEQ ID NO: 119425 - DNA, 412 bp, Homo sapiens; identical to SEQ ID NO: 87385
  chr20:30777833-30778245
  Hyper

SEQ ID NO: 119426 - DNA, 89 bp, Homo sapiens; identical to SEQ ID NO: 87386
  chr20:30814945-30815034
  Hypo

SEQ ID NO: 119427 - DNA, 138 bp, Homo sapiens; identical to SEQ ID NO: 87387
  chr20:30864881-30865019
  Hypo

SEQ ID NO: 119428 - DNA, 48 bp, Homo sapiens; identical to SEQ ID NO: 46129
  chr20:31108565-31108613
  Hypo

SEQ ID NO: 119429 - DNA, 213 bp, Homo sapiens; identical to SEQ ID NO: 46130
  chr20:31115617-31115830
  Hypo

SEQ ID NO: 119430 - DNA, 33 bp, Homo sapiens; identical to SEQ ID NO: 87390
  chr20:31129565-31129598
  Hypo

SEQ ID NO: 119431 - DNA, 30 bp, Homo sapiens; identical to SEQ ID NO: 87391
  chr20:31144605-31144635
  Hypo

SEQ ID NO: 119432 - DNA, 30 bp, Homo sapiens; identical to SEQ ID NO: 46131
  chr20:31147343-31147373
  Hypo

SEQ ID NO: 119433 - DNA, 420 bp, Homo sapiens; identical to SEQ ID NO: 87393
  chr20:31151587-31152007
  Hypo

SEQ ID NO: 119434 - DNA, 149 bp, Homo sapiens; identical to SEQ ID NO: 87394
  chr20:31180087-31180236
  Hypo

SEQ ID NO: 119435 - DNA, 49 bp, Homo sapiens; identical to SEQ ID NO: 87395
  chr20:31210079-31210128
  Hypo

SEQ ID NO: 119436 - DNA, 174 bp, Homo sapiens; identical to SEQ ID NO: 87396
  chr20:31226649-31226823
  Hypo

SEQ ID NO: 119437 - DNA, 181 bp, Homo sapiens; identical to SEQ ID NO: 87397
  chr20:31232544-31232725
  Hypo

SEQ ID NO: 119438 - DNA, 71 bp, Homo sapiens; identical to SEQ ID NO: 87398
  chr20:31376743-31376814
  Hypo

SEQ ID NO: 119439 - DNA, 41 bp, Homo sapiens; identical to SEQ ID NO: 87399
  chr20:31485187-31485228
  Hypo

SEQ ID NO: 119440 - DNA, 30 bp, Homo sapiens; identical to SEQ ID NO: 46134
  chr20:31553994-31554024
  Hypo

SEQ ID NO: 119441 - DNA, 30 bp, Homo sapiens; identical to SEQ ID NO: 87402
  chr20:31607353-31607383
  Hypo

SEQ ID NO: 119442 - DNA, 123 bp, Homo sapiens; identical to SEQ ID NO: 87403
  chr20:31671342-31671465
  Hypo

SEQ ID NO: 119443 - DNA, 30 bp, Homo sapiens; identical to SEQ ID NO: 87404
  chr20:31690556-31690586
  Hypo

SEQ ID NO: 119444 - DNA, 30 bp, Homo sapiens; identical to SEQ ID NO: 87405
  chr20:31690858-31690888
  Hypo

SEQ ID NO: 119445 - DNA, 188 bp, Homo sapiens; identical to SEQ ID NO: 87406
  chr20:31744494-31744682
  Hypo

SEQ ID NO: 119446 - DNA, 157 bp, Homo sapiens; identical to SEQ ID NO: 87407
  chr20:31797604-31797761
  Hyper

SEQ ID NO: 119447 - DNA, 36 bp, Homo sapiens; identical to SEQ ID NO: 87408
  chr20:31920935-31920971
  Hypo

SEQ ID NO: 119448 - DNA, 30 bp, Homo sapiens; identical to SEQ ID NO: 46135
  chr20:31940171-31940201
  Hypo

SEQ ID NO: 119449 - DNA, 30 bp, Homo sapiens; identical to SEQ ID NO: 87415
  chr20:32155248-32155278
  Hypo

SEQ ID NO: 119450 - DNA, 258 bp, Homo sapiens; identical to SEQ ID NO: 87418
  chr20:32242529-32242787
  Hypo

SEQ ID NO: 119451 - DNA, 30 bp, Homo sapiens; identical to SEQ ID NO: 87421
  chr20:32298233-32298263
  Hypo

SEQ ID NO: 119452 - DNA, 69 bp, Homo sapiens; identical to SEQ ID NO: 46137
  chr20:32301884-32301953
  Hypo

SEQ ID NO: 119453 - DNA, 76 bp, Homo sapiens; identical to SEQ ID NO: 87423
  chr20:32378890-32378966
  Hypo

SEQ ID NO: 119454 - DNA, 30 bp, Homo sapiens; identical to SEQ ID NO: 87424
  chr20:32379308-32379338
  Hypo

SEQ ID NO: 119455 - DNA, 30 bp, Homo sapiens; identical to SEQ ID NO: 46138
  chr20:32414088-32414118
  Hypo

SEQ ID NO: 119456 - DNA, 201 bp, Homo sapiens; identical to SEQ ID NO: 87426
  chr20:32450357-32450558
  Hypo

SEQ ID NO: 119457 - DNA, 38 bp, Homo sapiens; identical to SEQ ID NO: 46140
  chr20:32459722-32459760
  Hypo

SEQ ID NO: 119458 - DNA, 30 bp, Homo sapiens; identical to SEQ ID NO: 16581
  chr20:32524318-32524348
  Hypo

SEQ ID NO: 119459 - DNA, 150 bp, Homo sapiens; identical to SEQ ID NO: 87429
  chr20:32677281-32677431
  Hypo

SEQ ID NO: 119460 - DNA, 30 bp, Homo sapiens; identical to SEQ ID NO: 87430
  chr20:32677661-32677691
  Hypo

SEQ ID NO: 119461 - DNA, 26 bp, Homo sapiens
  chr20:32768436-32768462
  Hypo
aaatattttctgggccgtgcgcggtg

SEQ ID NO: 119462 - DNA, 279 bp, Homo sapiens
  chr20:32803867-32804146
  Hyper
ggccctcgtccttgtcgccgtagtcctctgccacgaccgcagcgccaacgccagagacggagttggccgggactgcacgcctctcgtcgctccgcgtcccctggcaccttctcttgagtggcaggcaagcaagcaagcaagcgggcggggtcagcgccccaagaagggaaagagcgcgagggccagctaacgccgccgccgccgtcgccgctgagtcagcgcgaagcgccctctccgagtaggtgccgcgcgggcgggcgctggcgccagcagtctcat

SEQ ID NO: 119463 - DNA, 69 bp, Homo sapiens; identical to SEQ ID NO: 87436
  chr20:32899446-32899515
  Hyper

SEQ ID NO: 119464 - DNA, 224 bp, Homo sapiens; identical to SEQ ID NO: 87437
  chr20:32950057-32950281
  Hypo

SEQ ID NO: 119465 - DNA, 30 bp, Homo sapiens; identical to SEQ ID NO: 87438
  chr20:33131612-33131642
  Hypo

SEQ ID NO: 119466 - DNA, 251 bp, Homo sapiens; identical to SEQ ID NO: 87439
  chr20:33134788-33135039
  Hypo

SEQ ID NO: 119467 - DNA, 30 bp, Homo sapiens; identical to SEQ ID NO: 46144
  chr20:33137930-33137960
  Hypo

SEQ ID NO: 119468 - DNA, 426 bp, Homo sapiens; identical to SEQ ID NO: 87441
  chr20:33146323-33146749
  Hyper

SEQ ID NO: 119469 - DNA, 29 bp, Homo sapiens
  chr20:33290324-33290353
  Hypo
ttatcactagagtgccgggcacggtggct

SEQ ID NO: 119470 - DNA, 78 bp, Homo sapiens; identical to SEQ ID NO: 87443
  chr20:33547578-33547656
  Hypo

SEQ ID NO: 119471 - DNA, 32 bp, Homo sapiens; identical to SEQ ID NO: 87444
  chr20:33572900-33572932
  Hypo

SEQ ID NO: 119472 - DNA, 128 bp, Homo sapiens; identical to SEQ ID NO: 87445
  chr20:33574767-33574895
  Hypo

SEQ ID NO: 119473 - DNA, 65 bp, Homo sapiens; identical to SEQ ID NO: 87446
  chr20:33834734-33834799
  Hypo

SEQ ID NO: 119474 - DNA, 41 bp, Homo sapiens; identical to SEQ ID NO: 46149
  chr20:33855099-33855140
  Hypo

SEQ ID NO: 119475 - DNA, 30 bp, Homo sapiens; identical to SEQ ID NO: 16584
  chr20:33866905-33866935
  Hypo

SEQ ID NO: 119476 - DNA, 320 bp, Homo sapiens; identical to SEQ ID NO: 87449
  chr20:33879960-33880280
  Hypo

SEQ ID NO: 119477 - DNA, 41 bp, Homo sapiens; identical to SEQ ID NO: 87453
  chr20:34041981-34042022
  Hypo

SEQ ID NO: 119478 - DNA, 84 bp, Homo sapiens; identical to SEQ ID NO: 87454
  chr20:34044003-34044087
  Hypo

SEQ ID NO: 119479 - DNA, 30 bp, Homo sapiens; identical to SEQ ID NO: 87455
  chr20:34119886-34119916
  Hypo

SEQ ID NO: 119480 - DNA, 59 bp, Homo sapiens; identical to SEQ ID NO: 87456
  chr20:34147171-34147230
  Hypo

SEQ ID NO: 119481 - DNA, 374 bp, Homo sapiens; identical to SEQ ID NO: 87457
  chr20:34147978-34148352
  Hypo

SEQ ID NO: 119482 - DNA, 33 bp, Homo sapiens; identical to SEQ ID NO: 87458
  chr20:34183450-34183483
  Hypo

SEQ ID NO: 119483 - DNA, 1507 bp, Homo sapiens
  chr20:34188565-34190072
  Hyper
caagtgctgcggaaccgcctttggggtctgatcccttctggctttctttttcttctttcgggtgagccgggacaacgtggacccctgctgggcctggggaggctcaggttcagctctcccttccaacacctgcatggacacagccagcagaaggcggccgcggaaccaaatgccttggccaacgccttcgttgagaccttgaagactatcccggagccccgcgccggggggcgagccatagaggggcacccaggccgggccgaaggtagggttaaaccccgctgtggggaacaagagaagcgtgttggaggggagcgtggggagggcgagtgctggtaaatctctgcacctcaccctgatctcctccaagtattcgggggtgagggcaggggaggggggctaagccgctctgaaacggaagaagttggccagcagctgcggacgcgccgctgtggaacacgacctggggcgcctccaaaacagctcagcgccccaaggagctggaaatcgcgggagcccggcctcgggggacgcagcctgagccctgggggcggggtcgggattggggcggagctacgggcgatcggccaggcctgggggtcggggaaaggagtggaccggcagtgtcagcgtgtgcacagctgtagaagggtgggactgggctggttactggacaggcggttgtggtcagaattttgccaacggagccaaaccgatggtggggttcacagtctgggggcggcttgaagcagtttgttttgcgggcggaccagccctcctaggcggagcggggtcgcgaggatggggcttgcggttgggaatgggccctatggagccctatggaccgaggcgagtgaggccagatttgccgcggccagaagcgctcacccgcgcggcccggatgggagatccgcctcaggtccggcacgtgcgtagcgagtgccgcgtcgaccaggggcgcgtcgtcccgcagctgcaggcggaggctgcgcgtcagcggcgggaagagctccacgaagctcagctgctcgttccattcgggcgccgccgcctcggcgctcaccgacgtctcgccctgaaggtggcgttaaagacaggagaagggagatcagcgcggagtcggggccggagccgcggcgccgtgggccccggagggacttacctcctgccccaggaaagacacccgcacatagggctccaccaggacgcgctggtcgtgcagggcgcggaccaggctgcccagcagccccaggcgcagcgcgggaagcccctcggcgcggtacaggcgcacgcggagccgcgcccatggcctctcggcgggcaccccgcgcggcaggagcaggttcctaggggagggggcaccgagcggggggggagaaactgggatctcggcccctccccttatccgcgccccacggccacccccggatccatgtcctcctccccacctcaccccggctcacttctcgatgtccgaacagtgccctggggccgggggtagcattgg

SEQ ID NO: 119484 - DNA, 30 bp, Homo sapiens; identical to SEQ ID NO: 87463
  chr20:34288804-34288834
  Hypo

SEQ ID NO: 119485 - DNA, 116 bp, Homo sapiens; identical to SEQ ID NO: 87464
  chr20:34312502-34312618
  Hypo

SEQ ID NO: 119486 - DNA, 30 bp, Homo sapiens; identical to SEQ ID NO: 87465
  chr20:34632854-34632884
  Hypo

SEQ ID NO: 119487 - DNA, 30 bp, Homo sapiens; identical to SEQ ID NO: 87466
  chr20:34639308-34639338
  Hypo

SEQ ID NO: 119488 - DNA, 215 bp, Homo sapiens; identical to SEQ ID NO: 87467
  chr20:34710563-34710778
  Hypo

SEQ ID NO: 119489 - DNA, 162 bp, Homo sapiens
  chr20:35089026-35089188
  Hypo
gacctaccacaggtgcggcctggagagatgaggcccacaaggcagcgacaggacctggattcagtgaggagaggggactcgcggggtagaagccaggaactgggaaggcgaggaggcgtgaaggcaccacctactgccaacccggctcgagctggtcacttt

SEQ ID NO: 119490 - DNA, 84 bp, Homo sapiens; identical to SEQ ID NO: 87469
  chr20:35201464-35201548
  Hyper

SEQ ID NO: 119491 - DNA, 30 bp, Homo sapiens; identical to SEQ ID NO: 87470
  chr20:35441848-35441878
  Hypo

SEQ ID NO: 119492 - DNA, 30 bp, Homo sapiens; identical to SEQ ID NO: 87471
  chr20:35444175-35444205
  Hypo

SEQ ID NO: 119493 - DNA, 30 bp, Homo sapiens; identical to SEQ ID NO: 87472
  chr20:35464204-35464234
  Hyper

SEQ ID NO: 119494 - DNA, 359 bp, Homo sapiens
  chr20:35491156-35491515
  Hyper
aagcgaggcgctgagcggcaagcggctgctgcccaccgacgacgcggccaccgacggctcgtccggggaggcgggcggccgcgggggctgctgcgcggagggcgcgggctgggccggctgccccgtacggacccccgccgggcccccggccgcggactcggcgtcgctgctcagcgccagctccaggcccagcaggcgcgcctcctccgacgcgcagtccgacacctccgagctgctatccgtgaggctggggggcggcggtggcggtcgcggccccgcacccgagcgcggacggcccttggcacggaccccggtgcggaccccggccacccgcacacccgcaccgcgcgccccgggag

SEQ ID NO: 119495 - DNA, 111 bp, Homo sapiens; identical to SEQ ID NO: 87474
  chr20:35506436-35506547
  Hypo

SEQ ID NO: 119496 - DNA, 146 bp, Homo sapiens; identical to SEQ ID NO: 87475
  chr20:35874090-35874236
  Hypo

SEQ ID NO: 119497 - DNA, 282 bp, Homo sapiens; identical to SEQ ID NO: 87476
  chr20:35924130-35924412
  Hypo

SEQ ID NO: 119498 - DNA, 403 bp, Homo sapiens
  chr20:36012895-36013298
  Hyper
gcaggcccttcctctcgccaggggtagcgcccctgggtgacttgggtgtccggggggtgggggggcggccgtacacactgtgaagcgtccgcgccgccgccgctggctttggggtggagcaagcgcaaaagacacggggtgtggttaatgggttctaattggacgcttaagcccaagaagaagaagggcggcgcgggaccgggcctgttgctgccttggcgcccagtcctttttcgttgcctgggtccgcccagagatgagtcgggacgcgcggcccacgtgcggcggaggggcagctgggtcgctcggggaacggggcaccggatggccccggttgggcccgcgccaggatgcgcccctgcgccctctgctggcgctctgcggtcaccgcagccccggagag

SEQ ID NO: 119499 - DNA, 58 bp, Homo sapiens; identical to SEQ ID NO: 87478
  chr20:36043953-36044011
  Hypo

SEQ ID NO: 119500 - DNA, 33 bp, Homo sapiens; identical to SEQ ID NO: 46158
  chr20:36049828-36049861
  Hypo

SEQ ID NO: 119501 - DNA, 39 bp, Homo sapiens; identical to SEQ ID NO: 16588
  chr20:36151122-36151161
  Hypo

SEQ ID NO: 119502 - DNA, 151 bp, Homo sapiens; identical to SEQ ID NO: 87481
  chr20:36192064-36192215
  Hypo

SEQ ID NO: 119503 - DNA, 30 bp, Homo sapiens; identical to SEQ ID NO: 87482
  chr20:36296722-36296752
  Hypo

SEQ ID NO: 119504 - DNA, 222 bp, Homo sapiens; identical to SEQ ID NO: 87486
  chr20:36526757-36526979
  Hypo

SEQ ID NO: 119505 - DNA, 58 bp, Homo sapiens; identical to SEQ ID NO: 87487
  chr20:36530144-36530202
  Hyper

SEQ ID NO: 119506 - DNA, 440 bp, Homo sapiens; identical to SEQ ID NO: 38073
  chr20:36531551-36531991
  Hyper

SEQ ID NO: 119507 - DNA, 105 bp, Homo sapiens; identical to SEQ ID NO: 87489
  chr20:36571234-36571339
  Hypo

SEQ ID NO: 119508 - DNA, 26 bp, Homo sapiens
  chr20:36666715-36666741
  Hypo
tttttttttttgagacggagtctctt

SEQ ID NO: 119509 - DNA, 41 bp, Homo sapiens; identical to SEQ ID NO: 87492
  chr20:36760800-36760841
  Hypo

SEQ ID NO: 119510 - DNA, 30 bp, Homo sapiens; identical to SEQ ID NO: 87493
  chr20:36764156-36764186
  Hypo

SEQ ID NO: 119511 - DNA, 41 bp, Homo sapiens; identical to SEQ ID NO: 87494
  chr20:36767876-36767917
  Hypo

SEQ ID NO: 119512 - DNA, 88 bp, Homo sapiens; identical to SEQ ID NO: 87495
  chr20:36775243-36775331
  Hypo

SEQ ID NO: 119513 - DNA, 57 bp, Homo sapiens; identical to SEQ ID NO: 87496
  chr20:36780994-36781051
  Hyper

SEQ ID NO: 119514 - DNA, 33 bp, Homo sapiens; identical to SEQ ID NO: 87497
  chr20:36781339-36781372
  Hyper

SEQ ID NO: 119515 - DNA, 379 bp, Homo sapiens; identical to SEQ ID NO: 87498
  chr20:36888856-36889235
  Hyper

SEQ ID NO: 119516 - DNA, 69 bp, Homo sapiens; identical to SEQ ID NO: 87499
  chr20:36978578-36978647
  Hypo

SEQ ID NO: 119517 - DNA, 24 bp, Homo sapiens
  chr20:36990660-36990684
  Hypo
gaggtcagggctgggcgcggtggc

SEQ ID NO: 119518 - DNA, 21 bp, Homo sapiens
  chr20:37088489-37088510
  Hypo
aataaatgggctgggcgtggt

SEQ ID NO: 119519 - DNA, 177 bp, Homo sapiens; identical to SEQ ID NO: 87503
  chr20:37208085-37208262
  Hypo

SEQ ID NO: 119520 - DNA, 38 bp, Homo sapiens; identical to SEQ ID NO: 87504
  chr20:37233304-37233342
  Hypo

SEQ ID NO: 119521 - DNA, 30 bp, Homo sapiens; identical to SEQ ID NO: 38075
  chr20:37274701-37274731
  Hyper

SEQ ID NO: 119522 - DNA, 999 bp, Homo sapiens; identical to SEQ ID NO: 87507
  chr20:37302402-37303401
  Hyper

SEQ ID NO: 119523 - DNA, 6820 bp, Homo sapiens
  chr20:37351422-37358242
  Hyper
gagagaagcctcctccgggagactgggaggggcttgggatgggaggaggtggcaggaggcgggagggtgtagagagggaagcctgtcttgtcctggcagctccaactctctggccaaagccctcgggccgccctacttgtgcgctgacgtgagctaatctagaaatactgcagagaaagagtggctggggttcccagggagaaagggcctcgagagaggggagatggggagctgcttccttttttgtttccttcggtttttccgtccgcccccgcccccacttccagtcacagccgctacttctccattcaggctgggactgccaggtggagccctgcggtttactgctcaggaggagcccggccaggacatcagctggggacttacgcagggacccattcagagcagcggaccctcacggagactactacaaagggactaacacaggcacgaacgcaggcaaccccattcgggaacacatacgtaatccaacacactagctctggcacacacactggaatgcgcgcaaaaccacacagacacagaacacacgcggttaccaaacctcattctcagaggccacactgatccaacctcaagcagagtctgatacagcatcggtctttgtctctgggtctctcccttactcgcgctcacacacccgtaccccaatcaacacaaacagcccaagctttcacagcctggaggcggccgtcggagcagggccccagcgcaccgcgagcctctgcttcctccgccttgcagcgccgcgagcccttctttcctccgcgcctggccccgtctgcgcccctctcggcgtgggcattcgcagacccgctaggaggctgacgagaggtgtcctcatagagtcctgccttcttccagacccccaaacgaaaagaaagagaaaagccaacctttcgcctccattctgcacgcatttggagagcggctggtggcgagcgatccgcacaatcgcttccctcgcggcgtccctggacgggcggagagaacccgggtgactgagcctgaggctgagcttccttgggagcgatccatgccagccacttctaccttcaagggggactcgcggccgggtttacgcgcgaaggatgggtgccagggaaactgacttatagacgacccgctccgcgagagactgacaactcagtcctgcgggctttcggggcgcccagaccagtccttagccagaggatctggggctgcacagctcccggaccctggagggggtggtccgggggtgggagactgcgagcatcagcccacgccggccccctcccaccctgcggcggcgaggtgggaagggccaggatgcgagcttagcacctcccctagaaatgcagcacttcgcccccccacctcccctgccctcggcgctccctctttcacgcgctccctcccgcctccttcccaagggcgcccttcttctgcccccagctcacgtctgaatccctcggcgccccctttctcttctcctagccccttcctcacgtcccctgcctccgggtatttcctctctccaatcccccacccccgcaccgcctgattccgaggggcgggagcgcattgggctgcgcacgggtgggggcgccgcgccagcttcgcgtagctgctctgacgccgctgccgccgccgccgccgccgccgccctccgcagcccagctcgcgccccgcggcagctccgcagtgcactagccaccaccgccgccgccgccgctccgccagacctgctgccagcttgcccggtccagccctgagagagcctcgaacgccagctgcgagggtcatgagccagagagccccggggcgccgcgcggagagcaagcggagatagcgactttgcgccccccagccctcgccttcttgcatcgcgttccccgcatcctcgggtccttctgtcctttccgctgtccccaccgccgccatggccaccttgctccgcagcaagctgtccaacgtggccacgtccgtgtccaacaagtcccaggccaagatgagcggcatgttcgccaggatgggttttcaggcggccacggatgaggaggcggtgggcttcgcgcattgcgacgacctcgactttgagcaccgccagggcctgcagatggacatcctgaaagccgagggagagccctgcggggacgagggcgctgaagcgcccgtcgagggagacatccattatcagcgaggcagcggagctcctctgccgccctccggctccaaggaccaggtgggaggtggtggcgaattcgggggccacgacaagcccaaaatcacggcgtgggaggcaggctggaacgtgaccaacgccatccaggtaagcgcgggattcccagttctgcctgtcctcccccctcccagctcagcgtgccgggctctgcccccgacagtcgcccggtgatctcggcctggagaccccctcctgtacccaggaatctccctttctccatccctcccagccctgcgcggggacctacgcccccaggcggtgttttccgccctaacccacgctccctcccaacggcaccagctgcaagaccgctaggctgaagttcggtctgagacacctgtccggagacactgcaaaagtgaaggaaatggggggagggagcaggaagcgatgagaaagaaagaaaatcaggattggagggcacggtttggtcttggactctggaacggattcacagctgcatttttgggaggaaagaagaaggggaaatcgctgaggtcggagtctcctccccccgcacacacgcatagacacgcacacgtatataggcaggcacaccacatgcccacagccccccttcccacgaacaaaggcgcaggcacaggcgcacacgacatgtatctatatatagaccacagtactatccccaaatgcacctgcgtacacccctacagctccacaaacaaaagcatatacctgcacataccaaacacacgaatattcgtttgaacatatgcacacacacatgcacagatgcatgcagacaggaaccagcctgctcccttgggtgcggccctgttggagacatacaggtatacacacacgaaagcacacacatgctcccacacaaacacatttagtccgcaataatccagcattacctgtgcacagactcgcccctctcgcccgaaatcccggctgcaccgcaaagaggcggccagctcctccccgtgtgaccctggcgaagccctctccagaggctaagaatggcccctgctctctaggccctctccccttattcctaaccccccactccccaccaggcggcgcaggactcctacatagggagcaggtttggagtcttggcaacgacctccgagctagcaggggctggcaggccgcagctttctgggccgaaggagacttcagctctaggcaaccccggtcccttacagcttggccccgcggcgtccctggagcgcactatcactggggccacggaaggcaggttttctgggagcagaggcctcccaggggttgttccatgtatcggggtaagcaggactccaccgggccccgaacaccagatggcccgacccaaggcgctttccgctccggggcccggcgagacggccttgctggatcacggacccggggctgctcccgccttcgctgtgccccgcgacttcccggggcgtctttcaaggctccgtttgataggccccaagggaggccagggcaggaggctggaggctcgtaggcctccgggaccctggatttcgttagctcttagtccccgtgtggattctaaaccctacagccctgtccgcctgaccctgaagcttctggttctagactcttgctcggttcggctttctggcctccctggcgccttcccgccaagctcctcctcctgcttgcctccccagcctccacttagtccccttccttaggtctcgccctcgcctcactctaactccagccttgtcctaagactctcaatttccagccctgcttcctcctccccgcgcgctgctccccaagcgtcttcacattgtctctgttcttgcctcccaggggctttgccccaccttcagcccctctccctctctaccctatttccttttcgcctcacaactgcagcctttaacgtttcctcctctggtctgagcctgagacgcccgagttttcctctttagctcccgtgccccattccagccccaccacaaatcccgtgcccactctttccactggcccaggcccagctcactacctttcttagagcccctttccgactacgctcccttctgtcccttctcatctcctcccccaactcctcattctgttcctgtccccagaaaccatcccgaagtatctcccttccctcctgtggcttctccctattctcagccctctcccaccctagccctctcgctatcaccagccattagcgcacctttccttctcagatccgtccatacatccctccctctccatctctggctcgacacccgggctcactattagttcccctacatccaccccgcagcctgctcttaacctctcctccccggcggctcagacccaattctcagtgtccttagcgcccccttcgggccacagcgttaagccacgccccccgggcccctcatccgttgccaagttcgctgagcgtccgcgtctggttgcctctccgccccacagggcatgttcgtgctgggcctaccctacgccatcctgcacggcggctacctggggttgtttctcatcatcttcgccgccgttgtgtgctgctacaccggcaagatcctcatcgcgtgcctgtacgaggagaatgaagacggcgaggtggtgcgcgtgcgggactcgtacgtggccatagccaacgcctgctgcgccccgcgcttcccaacgctgggcggccgagtggtgaacgtagcgcagatcatcgagctggtgatgacgtgcatcctgtacgtggtggtgagtggcaacctcatgtacaacagcttcccggggctgcccgtgtcgcagaagtcctggtccattatcgccacggccgtgctgctgccttgcgccttccttaagaacctcaaggccgtgtccaagttcagtctgctgtgcactctggcccacttcgtcatcaatatcctggtcatagcctactgtctatcgcgggcgcgcgactgggcctgggagaaggtcaagttctacatcgacgtcaagaagttccccatctccattggcatcatcgtgttcagctacacgtctcagatcttcctgccttcgctggagggcaatatgcagcagcccagcgagttccactgcatgatgaactggacgcacatcgcagcctgcgtgctcaagggcctcttcgcgctcgtcgcctacctcacctgggccgacgagaccaaggaggtcatcacggataacctgcccggctccatccgcgccgtggtcaacatctttctggtggccaaggcgctgttgtcctatcctctgccattctttgccgctgtcgaggtgctggagaagtcgctcttccaggaaggcagccgcgcctttttcccggcctgctacagcggcgacgggcgcctgaagtcctgggggctgacgctgcgctgcgcgctcgtcgtcttcacgctgctcatggccatttatgtgccgcacttcgcgctgctcatgggcctcaccggcagcctcacgggcgccggcctctgtttcttgctgcccagcctctttcacctgcgcctgctctggcgcaagctgctgtggcaccaagtcttcttcgacgtcgccatcttcgtcatcggcggcatctgcagcgtgtccggcttcgtgcactccctcgagggcctcatcgaagcctaccgaaccaacgcggaggactagggcgcaagggcgagcccccgccgcgcttctgcgctctctcccttctcccctcaccccgcccccaccagcccagtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctctgtccttccaagtggggccccgacactttggttccagtcatcgagggggttgggaagggagggagagggggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcggggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggcttgcgcggcccggtgtcgggtttgtgtgttcgtaccagccgggatcccctggcgctgggaggcgtgggaactggctcccgccggctgaaaccggagatggtgagcagctgtggttaaagggtccggggagggctctagggagtacaaagattagttggcggcgaggaggctcctcaggtgtgaggaggaagctgaagacggagagtgctgtagcggccccctcagctg

SEQ ID NO: 119524 - DNA, 104 bp, Homo sapiens; identical to SEQ ID NO: 38084
  chr20:37359606-37359710
  Hyper

SEQ ID NO: 119525 - DNA, 36 bp, Homo sapiens; identical to SEQ ID NO: 87515
  chr20:37367644-37367680
  Hypo

SEQ ID NO: 119526 - DNA, 1820 bp, Homo sapiens
  chr20:37434112-37435932
  Hyper
tggaggagggggcagcgttaggaaaactattccgaagcctggccacgtcccaaccggtttcaacttcctgcagctcagaagaggggtccccacccgagagcgccgggaccctgtcccgcgctgcctcccaagccggatggggttgagcgcgcccaccccagtcccaggagctcaggccccgccttgggggaggagccgagaggcggcgcggaggctcgcggccgagcagagccagctctgtcgccgctggagcagctgcggctcggggacccacagacacagccggggtcgggagccgcccggggcagggctcgggagagcgggtgagttccccggcggcgccaccaccctccttgcgctctgcggcttcgcagggcgggggatgaggatggggcggggaggtggtcccagcctgctatcacctagctgggggccggggcgctttggccaagggacgatagcttgagataaatgggagtgtggggactctggaaagacgggtaccgagagcgctaggtccgggagtcgggctggaatgggggcgttctccccggcctcgcaattccttgacgaggccaggggagggggcgcattggcaggttgttggctgcggccgtcgtagaccgatcttggggcggggaggtggggtcctcggtctgttctggactcatggggccgccgtctgccgggggtgcaatgccgggcggcgggagccacagcggacaccaaacaacccccccccgcgcactctcccggccgggcatggtggtgccgccccctcgcgtggcggggcttggtcctggcgggcagcggcagggcgcagagagcgctcctgcccgggcgggaaagatccccaaggcaggcgcctccacctgcagacccgccccgcctcaggatccggctgacagcaccagccagcccggggagaccccgcgagtggtagttccccgggaggggcgcgcccggcctctcccagggccccgtgcgccggcggctgggtcccccgcgccaggagcgctcccctctgggcgactccggctcatcgattccggcccagaggagcgcccccgggcgccgaggatgggcggagacgtgcagccgcccctgagaggtcgcccagaggggtctccccaaggtcacccggagtgcccaggctgagctgcccagaccgccccgggtggagagccgggaggcaggcgctcgctgccctcctccttcccccatgtagactcccttcctccgctcccccaccccggcccggcctccagcttcactggagatgctgatgatgcagctcccagcccttggaggataattgagcctgggagagctttgaatctggccctcctgagaccccagggctgcgccgctgccgcgcgccaggcctgggtcccggtgctcccgggcacctcaggagcggagggagagggatgtggcttcatcagcgcttctaggaaccgaaaaccgagctgcctgcgcgcccatgtgattgcatttcacataaagggcccctgttttcactgtcagaagagccccccagctctccgcggctctggacaccaggtgccgcctctgaatcaccctctgtggaggacccggggcccggaggtacaggcgccctttcccgcagggctctccctggaaagggcctgccgatggcggcctcagtccgcaggggtacttccctgtgtaccctgccatttcctgcggctggtgaagcaccggagaaaaaccgtccatctaggaggcctcctccaaggctggtaataaagcttcttagcccagccagcgactagctgtctactcgtgggcaaggtact

SEQ ID NO: 119527 - DNA, 30 bp, Homo sapiens; identical to SEQ ID NO: 87522
  chr20:37536400-37536430
  Hypo

SEQ ID NO: 119528 - DNA, 30 bp, Homo sapiens; identical to SEQ ID NO: 87523
  chr20:37549668-37549698
  Hypo

SEQ ID NO: 119529 - DNA, 30 bp, Homo sapiens; identical to SEQ ID NO: 87528
  chr20:37799258-37799288
  Hypo

SEQ ID NO: 119530 - DNA, 31 bp, Homo sapiens; identical to SEQ ID NO: 87530
  chr20:38134545-38134576
  Hypo

SEQ ID NO: 119531 - DNA, 26 bp, Homo sapiens
  chr20:38186909-38186935
  Hypo
cctcggcctcccgaagtgcacattga

SEQ ID NO: 119532 - DNA, 30 bp, Homo sapiens; identical to SEQ ID NO: 87533
  chr20:38244640-38244670
  Hypo

SEQ ID NO: 119533 - DNA, 168 bp, Homo sapiens; identical to SEQ ID NO: 87535
  chr20:38808911-38809079
  Hypo

SEQ ID NO: 119534 - DNA, 2133 bp, Homo sapiens
  chr20:39315901-39318034
  Hyper
atttttctatataatcgagcaggcaataaaactgatgagatttgggcgccgagcgtcctaactgaggcctgtgtctcagggctgagagccagtgttctccgaactctgacagacaggtccgtctgtccttccttctttcgctcagcctcgcctctcgcctgccgggacgccagagtccctctcctttcctcgttgctctcttcctggcgcggactactctccgggcagcaaagcagctgtcccggcttaacgcgcaaagttcagaaagccaggagtctccagatggccttggtgacttctcgggactatgcctcgccgcccttcagcctggagagaagttactccgggacctcccaccctctcgtctctctctccggctctgctcgagtctaggaggcggcgctggcgtgcgctactctcgccttagccaaggtcccctgcccgcccgcgcacccgcccgtcgcccgcggcccgcgcgcccttcctccctctcgctcaagtcaaacaggtcaaggctggggccgcggcagggacagggtccggggtagtctgggactagggacgtgggacagggagtccgggccggggcaagggcgggggccaggaccggccacgactcacagaaagaactcgggagaggaggggctgtcgctggtggagcccgcctccctgaagccggagttggcgagtttctcgcacttgaccttgtaggcgtctctctcgcgggccagccgggacacctcctgcttaagctgctccacctgctgaatgagctgcgtcttctcattctccaggtggtgcttctgctggacgcgtttatacctgcaagactgggcgtagccccggttcttcagggtccgccgcttctgcttcaggcggatcacctcgtccttggtgaagccccgcaggtggcggttcagctcgcgcacggacatggacacgagctggtcgtcggagaagcggtcctccacgctgccgttgccgcccgccgccgtcgccgaggccgtcgcgtgcggcccgggcccggggtggctagtgggcagctgttgcgccgggctagcggcgctggacggcggcggcgacgcttggtgatgatggtgatggtgcgggtgagcgtgcgggcccagctcgtcgtgggccacgccggcgcccgggtacgcgtggtgcgggtgagggtggtggtgatggtggtggtggtgagcgccgcgaaagctgtcgaagctttgcagcggctgtggcactgggtgcgagccgatgagcgcttccaccgcgtcctcgggcgtcaggttgagcgcctcggggttcatctgctggtagttgctcgccatccagtacagatcctcgaggtgtgtcttctgttcggtcgggctgaagctgggcgacgagggcacggagctacacggagtgctgagcggtgtggaggacaccgagccggctggctgcaggcgtgtgcagggcctgcccggacgctccgcgcgccccagtggctccttcttcacgtcgaacttgagcaggtcgaagtcgttgacatactccatggccagcgggctggtgggcagctctggccccatgctcagctccgcggccatcgctgaagcgaggcgcagccgccgctgccgcccgggaaactttgcggccggccggagcgcgccgagccaagcgcgggggggaagagcggagaagagctggggaggcggggagcgagggcgcagcgggccggggccgccggccaagcctttgtctggggacgcggcggcgcgccggagagtcccgaggctgcctgcaccgccccagagctctgggctgtgcccgcgcagggaccgggccgggtagagtcgggcggggtggagaggcaagcggagcgcgcggtggggctgaggggaggcgtggggcgagtgcccgttgctcgctctctagctctcttgctcttacgctctctcgctcgcagccgctcgcagctcggcggtgcagctgtgctggatccggcggcgccgcagccttttatcgcctcctgatgtcactggggtgcgggggcccgggcggcccggtgcgcgggccaatagctgcacggcctccgcggcccagcggcgcagggcggggcgcgcctgacagctcccccgccccccgcgtcag

SEQ ID NO: 119535 - DNA, 789 bp, Homo sapiens
  chr20:39318877-39319666
  Hyper
gcttggacggcgcctcgtacccagccaggtctcccctacctggcccaacccaagccagcccagaacgcatactatgtgtgcaccagagcccaggacaggttcccctcgagcgatgtacaggtcctcgggtcccgtcttcgtactcagccgcgagcctcgagccgcgagctccgctctggtcgccccgttgaaattccgtgccccagcgttcgggggtgcccgtcggctgctccctgggccggaaggtcctgggcggaggaaggccggtagccaaaagtggaagcgccacagtgaagcggcccagggccaccgggtgagaaacctccccggagggcagacggggagaccgaagcacaccgcactaggcatccagactgggcttgggagccgcgcaccctccctacccagatccaggatggctagaattaacgggttctttctgagacctcggctcaggcgccgaaaccggatagatcgcgaattcgctggacccggagacccgacccgcctcccgcgtcaccttcttctttctagctttgggcgcgcgcagcgaaaggcaggagaggcgcgcactgggtgagtgagtcccggccgctgtctgcgctggaccagcccgactgacctcgcgcgtaggggtcgcgtgagccacaccggtgcagacgcgcctagattatttttaaatgttagaaggtaaaatatttgcctccaattaatctgaaaactctctattctcttgcgccctcggagaggctggggtacggcgtggtattgggccgcctatttttaata

SEQ ID NO: 119536 - DNA, 30 bp, Homo sapiens; identical to SEQ ID NO: 87541
  chr20:39435965-39435995
  Hypo

SEQ ID NO: 119537 - DNA, 40 bp, Homo sapiens; identical to SEQ ID NO: 46164
  chr20:39687444-39687484
  Hypo

SEQ ID NO: 119538 - DNA, 30 bp, Homo sapiens; identical to SEQ ID NO: 87543
  chr20:39739532-39739562
  Hypo

SEQ ID NO: 119539 - DNA, 1330 bp, Homo sapiens
  chr20:39994530-39995860
  Hyper
ctgcctggcataagccgaccgctgtggacggctgtgccacagcacaggcccggagccaggagcccgctctggctctgcagcccggccacgctggggctcccatggggttgctggggccaggctgactgcgagagggcagcggccgcccggatgcgcagctctatctcctacctggccgggccaggggagagaagggaggcccggggcgggggagccccgcgtgctcagcgcgcggaccgcctttcctcctctccctccacctggtccgctcgcccggagtctgcacacagcgcagctggaaaatgttacttcgctggaaaggtttccgctggcactgccaggatcccaagccgccgcgccaggccccctcggttcctttttcctcgccagccccgcaacctcccggagcgtagggcgctcgcctgggcaggggctcggccccgggcgccgccccctctgtgcagcggcctcggggtgcccggggcctcgacgccccccgcgggtgcgggcaggtgggagcggcgacgcgcgcgggcccatccctccctcttcccgcccgccgcccgcccgcgcttacttgtgcggccccgggcgcagccgcgggcgccatcccgtcgtgtagagactgtagcgggaggcaccgggcggcgcaggccgcgccaggagcggggtgcccctggcctgcgcccccgagagcagcgccgcgacggcgcacagccagacgagcaggcggcggcggcccatagcggcccccgcgcctctgcccggccccgcgcggtgccccccgccgggtgtccgcctgcagcgccgcgccgcccccgccgctggtcggcccgggtcccgccccgagggtcccggggtccccttcggcccccgagctcgctggcccggccgcctggcgcttcgcggcggctgcgtcccgcggagtggccggcgctgctagcggctggggccgcggaggggaggcgggaggcgggctctttgcggattagcataaacttggggccgcgccgctcgccgccgccagcccctcgccccagctccgagcggacggccgaggagccgcctgcgaacaggaggttccaaagggagcagccccaggtggcaggggcgcaggccgccgcgccctgggaggccccccgagcacaccagccactctgtcgcctgcgggcacggggcgagacgcagagaagcggacccctgaggccagcctgggcgtggactttccaggagtcgtccaccctcaggatacgcttgtcttcagagtccgtgtgaacccgggaactgctctccagggctctggagccgagatggccgtgactgggggcac

SEQ ID NO: 119540 - DNA, 30 bp, Homo sapiens; identical to SEQ ID NO: 87548
  chr20:40020573-40020603
  Hypo

SEQ ID NO: 119541 - DNA, 66 bp, Homo sapiens; identical to SEQ ID NO: 87551
  chr20:40321459-40321525
  Hyper

SEQ ID NO: 119542 - DNA, 106 bp, Homo sapiens; identical to SEQ ID NO: 87552
  chr20:40457626-40457732
  Hypo

SEQ ID NO: 119543 - DNA, 30 bp, Homo sapiens; identical to SEQ ID NO: 46165
  chr20:40715181-40715211
  Hypo

SEQ ID NO: 119544 - DNA, 30 bp, Homo sapiens; identical to SEQ ID NO: 87556
  chr20:41607723-41607753
  Hypo

SEQ ID NO: 119545 - DNA, 1977 bp, Homo sapiens
  chr20:41817217-41819194
  Hyper
accagcctgttcctgcgtcccacgggctgatctcagcctgtccccgcaatcccagccacctcaggccggcgtggttacaccaaaagcaatcggtgctaagaaactttaaggtgattttgaacttggaagtacacctgcagcactcccttctcttccctccgccgctactcttgggggggggggggctcgggggtggaagctgcctgcggtggggcttggtgatgtgtaagaccctggactgtggtgccctccagcacccgccaacgtgcctttaggagcacggcaggcaccacccccccgcccccgctccccctactctggggaactacctctgctcaccgccttcccgtggccaaacccaaatatgagttccccgaacttttcaggagcggacgcgctcacgggtcaaatccactcccctccaagggccttaacacgggcgcccagctacctcggagaaaagccagcgggtagggcggaggtattgctctcggtcatcaacgcaaacatcccctcgggtgcctacagcggcctgcttaggggagcagcgtgttcagagcaaatggagagcttcctgtatctccgaggaaaaaagaaaagccgccgccccggcagcctcggcctgctggggacctgtcctccccactaaaagcgcgcgctgcccgaggagctgcccgggagagaacgctccaccccgggcgtcggtgccgctcctcgtctcgccgccccaaacactcaagtggcagattccgacaagtgggaggcagcaagtggaaatattcgcaacaaccgcggaaagttactccagcccggggggccggcaggaaactgaagcggggaacttcgccaaacgcgggctgccgagggacgcgaggggccgggctcgctggccggggcgcgcggggacactgcttcccgcgcctgcaagctgagacccgggttccggccatggggacccgcgcccccgcgagcccacacaactttctcctccgagggccccgcggctgggggcccgcgcgcatccaggagggagcggggagcccaggggagccgggcgggcgcactcacctgcggcgctctgagcccgggcgccgggcagtggcggcagctgcagcctcaggagcaggctgagggcgagcgcggcgaggctcgccatccgggcggcggcgggcagctcagccccttcccgcgggggccggggccgggactggggcgggcgcggggtggccccgcatcgccggcgcggccgctggctgtgcgcgcggctggctccgctcgggctcccggagccggcgctcctgcgttccaagccgaggcgcggcgcgaactgaggcgggaggctgggcgggggcgggacgcggggggcggggggcggtgtcccccgagtcctaacgccgccgccgttgccgccgccgccgccgccgccgcccgcccgggcgctccgcctcggccgtgcacacaccctcacgcgcacgcccgcgcctggcacacgcccgcggctggcacacgcgggctcccccgcgcaccctctccggggccgaccagctcgggccgctggcacagtcacgcgcgtccacacatcacccccgcacccacacgccgggcagggtcctcgcctcttcgccccgcgccgcgccgcgcagccaagcatcgtctgccctgtgggggcgcaggtacgggggcggtgcggggaggaggaagctgcagcagccgtttgaactcggggtggggaacaggtgaatgggggttcggtggcgagaagagggagggagggagcagccctcgcaactcaagataaggggccaggtgaattgcgaaagcgggtgggggcgtctgcccaaagctggggcaggcggctgctggccagggtctcgggcacaccctgagatgagaatttcatctaagagcgcgcgcgcgcacacacacacaacccactcacactcttctgggcgcatcgctgaccgcgccacaatcgtc

SEQ ID NO: 119546 - DNA, 90 bp, Homo sapiens; identical to SEQ ID NO: 87561
  chr20:41935531-41935621
  Hypo

SEQ ID NO: 119547 - DNA, 124 bp, Homo sapiens; identical to SEQ ID NO: 87562
  chr20:42019051-42019175
  Hyper

SEQ ID NO: 119548 - DNA, 134 bp, Homo sapiens; identical to SEQ ID NO: 87564
  chr20:42088631-42088765
  Hypo

SEQ ID NO: 119549 - DNA, 691 bp, Homo sapiens; identical to SEQ ID NO: 87565
  chr20:42136052-42136743
  Hyper

SEQ ID NO: 119550 - DNA, 172 bp, Homo sapiens; identical to SEQ ID NO: 87566
  chr20:42199155-42199327
  Hypo

SEQ ID NO: 119551 - DNA, 102 bp, Homo sapiens; identical to SEQ ID NO: 1637
  chr20:42218592-42218694
  Hypo

SEQ ID NO: 119552 - DNA, 16 bp, Homo sapiens
  chr20:42292357-42292373
  Hypo
tctttttttgctgggc

SEQ ID NO: 119553 - DNA, 30 bp, Homo sapiens; identical to SEQ ID NO: 87570
  chr20:42346104-42346134
  Hypo

SEQ ID NO: 119554 - DNA, 31 bp, Homo sapiens; identical to SEQ ID NO: 87571
  chr20:42402544-42402575
  Hypo

SEQ ID NO: 119555 - DNA, 1954 bp, Homo sapiens
  chr20:42543082-42545036
  Hyper
ccttcctcttccccccgcacccacgccgcggggcggggactagcgccgcctcaaatatttagggcaagggagtgtcccacttctggggaggggtgccgttcgggcttctctcctcaccgtgggtggcgaaaggcgggacggaaaagcgccgtctggacaggcgcgcccccctcagggatgcagggccgggcgggggacccggcggcggcccagcccggaggaaggacctccacgccccggcccgggcccccgggcccccggccctaggcagcgcccgaggccggaacaatagcgcgcgcgggcggggcgggggcgggggcggggcgctcctctgggcaccgcccccggcccgccccccgcgctcgcagtcccgctcgcacactggctcccacccgccgcccgcccaggcactgcccgcgggagccgccgccgccgccgccgcgcccgccatggacgtccgcctgtacccctcggcgcccgcggtgggcgcgcggcccggggccgagccggccggcctggcgcacctggactattaccacggcggcaaggtaggcgggggcgggcgggggtccccggcgggcggggccggagtcacctggcagctcgggactcaggcgctcccggggtcacacggggccgcgcacatcagccccgccgacgggcacgggcggctcacatcgatcccctcgcggccacgctcacgccctgagttgttgggatcgcgggcagaagtcatcccgacagccacccgtgcgacgacacagtggcccctcactcgcgtccccctgacagcctcgcagtcattcacaagccgtcacagtgacccacagccacacgcaggcggccaggcactgcttacacggtcccgccgtcccacgcaagtcaccctgacagtcacttatacacaacgacacgcaaccactcacccgcaaacagcctcaccgccacagacgagtcacccacagacgctccgatgccccacacaccgtgacatgcccccacccgctgtcacacccaggcacaacgggggacagtcacacaaagaagtcgcccgacagtcacactctcgcagccacaacgcctcacccaggcgcacgctgtcacacacagccacccccctggacggtgagcctcagacacagatcgtcctgacggccacacagtcacacgcggtcacacccagggacggccacacctcggtcatccacactcgcgcgtcgaggtttaacttctcagcgccgcagcacactaattgggcagtttactaattggccgtcactgcctggcggggcctcggattccgagtaggctgcggccaatcgaggcctgtgtcctcccgggagcggtgagccggcgtccctccaggctggggctgtagtgccggacaccctccctcctccatgtttccaggatctatccccccaccccagccaggtcccagctgcgctgcgccgggcgcattcccagtgatggaggcttgcgtgcctggaaccccgaacccgaggcgtcaggtcccactgccgggtctggcccagcctggatgggttgggtgcctctaagcagtccgcgtccccttcggtcgccggagagggaactttcaaacttagttaggaagccagactgtccgcgcgtccgccagtcggtgcgtcggtcccgggccggctggagccaagcgcgggttttcgtcactcggagcccggattgaacagcgcgcgtgggtttcccgcagccctggcgcagacgcgtgggctccgtggcgatgcggggtgagtgcgcgtccagtggctggatcggcgccccccagggtctctccccaacctcgcaggcttttcgtcaggcccctggtagtggggatgaggcaggagagaggcgtcccggcgcggatcccggggcctcccgggctgggcctccctgagtgcgccctcaggccccaggggagcggcttctggcaaag

SEQ ID NO: 119556 - DNA, 170 bp, Homo sapiens; identical to SEQ ID NO: 13811
  chr20:42587835-42588005
  Hyper

SEQ ID NO: 119557 - DNA, 226 bp, Homo sapiens; identical to SEQ ID NO: 87575
  chr20:42721431-42721657
  Hypo

SEQ ID NO: 119558 - DNA, 92 bp, Homo sapiens; identical to SEQ ID NO: 87576
  chr20:42777351-42777443
  Hypo

SEQ ID NO: 119559 - DNA, 31 bp, Homo sapiens; identical to SEQ ID NO: 87577
  chr20:42777683-42777714
  Hypo

SEQ ID NO: 119560 - DNA, 17 bp, Homo sapiens
  chr20:42823271-42823288
  Hypo
attttatttttgagacg

SEQ ID NO: 119561 - DNA, 194 bp, Homo sapiens; identical to SEQ ID NO: 87579
  chr20:42840769-42840963
  Hypo

SEQ ID NO: 119562 - DNA, 30 bp, Homo sapiens; identical to SEQ ID NO: 46169
  chr20:42853157-42853187
  Hypo

SEQ ID NO: 119563 - DNA, 544 bp, Homo sapiens
  chr20:42875761-42876305
  Hyper
tggcggcttttctggcgcgggccagggggaggaggagaaaggagctcccgggatcccctcgccccctcccccaactgcccggtgagtaatgacattcacggagcggggagggagggaggagaggggcaggctcggcgaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtagagccgggccgggagccgcctgcgccggtggccaggaagcttggggaggggagccccagggcttgagggatctgagggcggcgaaagactggaggggggaacctggggtttgggggtcccggaggtcgggggacgcaagggttccttc

SEQ ID NO: 119564 - DNA, 122 bp, Homo sapiens; identical to SEQ ID NO: 87582
  chr20:42876545-42876667
  Hyper

SEQ ID NO: 119565 - DNA, 30 bp, Homo sapiens; identical to SEQ ID NO: 87583
  chr20:42931309-42931339
  Hypo

SEQ ID NO: 119566 - DNA, 46 bp, Homo sapiens; identical to SEQ ID NO: 87584
  chr20:42955385-42955431
  Hyper

SEQ ID NO: 119567 - DNA, 30 bp, Homo sapiens; identical to SEQ ID NO: 87585
  chr20:42979880-42979910
  Hypo

SEQ ID NO: 119568 - DNA, 89 bp, Homo sapiens; identical to SEQ ID NO: 87586
  chr20:43017310-43017399
  Hyper

SEQ ID NO: 119569 - DNA, 30 bp, Homo sapiens; identical to SEQ ID NO: 87587
  chr20:43048609-43048639
  Hypo

SEQ ID NO: 119570 - DNA, 38 bp, Homo sapiens; identical to SEQ ID NO: 87588
  chr20:43052738-43052776
  Hypo

SEQ ID NO: 119571 - DNA, 169 bp, Homo sapiens; identical to SEQ ID NO: 87589
  chr20:43065628-43065797
  Hypo

SEQ ID NO: 119572 - DNA, 113 bp, Homo sapiens; identical to SEQ ID NO: 46171
  chr20:43276908-43277021
  Hypo

SEQ ID NO: 119573 - DNA, 213 bp, Homo sapiens; identical to SEQ ID NO: 87591
  chr20:43295109-43295322
  Hypo

SEQ ID NO: 119574 - DNA, 174 bp, Homo sapiens; identical to SEQ ID NO: 87592
  chr20:43379820-43379994
  Hypo

SEQ ID NO: 119575 - DNA, 32 bp, Homo sapiens; identical to SEQ ID NO: 87593
  chr20:43382837-43382869
  Hypo

SEQ ID NO: 119576 - DNA, 122 bp, Homo sapiens; identical to SEQ ID NO: 87594
  chr20:43385505-43385627
  Hypo

SEQ ID NO: 119577 - DNA, 57 bp, Homo sapiens; identical to SEQ ID NO: 87595
  chr20:43416117-43416174
  Hypo

SEQ ID NO: 119578 - DNA, 1549 bp, Homo sapiens
  chr20:43438010-43439559
  Hyper
cagctccccacccctcgctctggctgaggttgtgcgcaggcctgggaggaggaggttcaagccgctggctggtggccggcttcagcccaccaagaaaggcgactccagggacaagagcacctgaggtcaggggcacacaccagcgggcggacaagtgtagagttggcgccgccctacacctctctccgggaagagaggggaggaaaggccgtcacctggccggttcccctccgtctgccccaggcgtataagaagcaggagtctggagccccagcccatgagggaaggagaggagagataaatgggggcgctcaaggcctggggcgccgggcaggggtcttgggcagggatcctctggatgtggccaagacaaagatggagaggtaaggtctgcgcgccacctccaatggcggggggcgcgtcggagccccaggggtgggacggccaaagcccagggcttgaagagtgggcacattcaggagactcagggagggtggcaggtcggctccagggacgaggcaaggggcctccaataggcgcgggtgaggagggagatgggtcctggcgacccaaagggcccacctgcgggaaaggtgaatgcagacaatctcggggtccctgggggagaaggccagaaggtagcgcatcctggagaccctggggtcccgtgggtgcggaaggagaccctgggggcgccttcccaggggattgggggtggggaggagggcgcacgggtcggggagggggctaccggacctggatcccgggacaccccgggggtctggggggcgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggccgccccattcttgacgcggagtacggcgcgcggcgtggtggcggcggcccggggccgggccgaggctccgctgcggggctggcgggcgcggcggggccggcgggcgggccaggagctggcggcgcgcggagcccgaggcgcgctgtgctgctggcggcggcggcggcggcggcggtggcggcggcggtggcggcgcagcgcgctctggtccgcggcgccccccgccggcagcgcgaggcgggcttggagcggcgccgcagccaatccgtgccgccgggggagggggcgccgctgcggggcgtgggagcccggagggcgcgggctgcggcctcttctagcagcccccgggcccggcaggtgcgcgcggggaggcaggcgccgggcgaggttgtctgggccctggtccgagggctgttcccgaccccgcctcggcccccaccctcagccggccgacttgcggagaggccggcgtccagtccctcacccagacaggcctctcccagagacactggcgcgctcggaggggatgcgctcaaagggtcccgcccaggcgggtcggcactcggcctcccacacag

SEQ ID NO: 119579 - DNA, 364 bp, Homo sapiens
  chr20:43726504-43726868
  Hyper
tggcagaagaagttgcgcgtactgggcgccagcaggaggcgcgacgacacctcgaagctgaaccaggcgatgcagaagtactcgaggcgtcgcagcaccgggtcgtcgcgcacgccttccgggctgcggcccgcggccaccgcagccacggcggccgccgcctcgcgggcctggtactcgggcaggctgtggatgcacatggcggcgatggaggcgagcaccacgctgatggagacgcagctgaagagcttgctcggcagcgagtagcccgggttctccatggtcagccagaggcggcggcgcaggcggccacagcgcgccgcgccatagcgcgccagttctcgctgcacgtcggagatctcgt

SEQ ID NO: 119580 - DNA, 207 bp, Homo sapiens
  chr20:43727096-43727303
  Hyper
ggtcgaagtagaattcgcgcgccgcctcgtcgtagtcgtcgcacaggcgccgcgcctgctcctccgacgccgcggcctgcaggcggcccagccgcgtgcccgggaagcgcgccagggcgcgcgcgctcagctgccgccgcacgccacccacgttcacgcgcagcgcctcgtcgcttcgccgccagcggatcccggtgtcggggcccg

SEQ ID NO: 119581 - DNA, 179 bp, Homo sapiens
  chr20:43729562-43729741
  Hyper
tgtggtggcacctcccgggcgcctcgcgtgtctgtcccaaagccaccgaggctgggagccgctggctatactcggtctcgcctctgccccgccggccccgccgagcctcctgctgcaggcggccccgctgccctctccttccttcttccttgcctagtcccccgcggctgaaggccgca

SEQ ID NO: 119582 - DNA, 372 bp, Homo sapiens; identical to SEQ ID NO: 87602
  chr20:43922168-43922540
  Hyper

SEQ ID NO: 119583 - DNA, 171 bp, Homo sapiens; identical to SEQ ID NO: 87603
  chr20:43926590-43926761
  Hypo

SEQ ID NO: 119584 - DNA, 21 bp, Homo sapiens
  chr20:43952338-43952359
  Hypo
caggatcgtctcaatctcctg

SEQ ID NO: 119585 - DNA, 36 bp, Homo sapiens; identical to SEQ ID NO: 87605
  chr20:44006173-44006209
  Hypo

SEQ ID NO: 119586 - DNA, 34 bp, Homo sapiens
  chr20:44099479-44099513
  Hyper
gtttccttctcgaaccggccgaagcctgccctgc

SEQ ID NO: 119587 - DNA, 32 bp, Homo sapiens; identical to SEQ ID NO: 87606
  chr20:44420207-44420239
  Hypo

SEQ ID NO: 119588 - DNA, 21 bp, Homo sapiens
  chr20:44421911-44421932
  Hypo
acactttgggccgggcgcggt

SEQ ID NO: 119589 - DNA, 404 bp, Homo sapiens
  chr20:44452650-44453054
  Hyper
cgttgttcttgtcgccgtctttcatcagagattcgatctcctcgtccgtcacgtgctccccggaggccctgaaaatctcagccagctcctccgggtcgatgtagccgtctgcattccttcaggtccgagggacagggcagggctcagggccggggcgagctgccctggccaccacactcgacgccccgcttccgcactcccaacacggggaagcttccagcgctgccggccgggttctgactgctaagcccctccctcggctcccgggcccccagcgcacctgtcgaagatgcggaagcactcggccagctcctcctcgctcttccctttcgcgtcctctttcatctggcgcaccatcatgaccaagaactcctcgaagtcgatggtgccgctgcctgcgggca

SEQ ID NO: 119590 - DNA, 135 bp, Homo sapiens; identical to SEQ ID NO: 87609
  chr20:44462871-44463006
  Hyper

SEQ ID NO: 119591 - DNA, 40 bp, Homo sapiens; identical to SEQ ID NO: 46174
  chr20:44477901-44477941
  Hypo

SEQ ID NO: 119592 - DNA, 23 bp, Homo sapiens
  chr20:44509241-44509264
  Hypo
acccgcggtggctcacgcctgta

SEQ ID NO: 119593 - DNA, 336 bp, Homo sapiens; identical to SEQ ID NO: 87612
  chr20:44518882-44519218
  Hyper

SEQ ID NO: 119594 - DNA, 48 bp, Homo sapiens; identical to SEQ ID NO: 87613
  chr20:44540105-44540153
  Hyper

SEQ ID NO: 119595 - DNA, 383 bp, Homo sapiens; identical to SEQ ID NO: 87614
  chr20:44540444-44540827
  Hyper

SEQ ID NO: 119596 - DNA, 30 bp, Homo sapiens; identical to SEQ ID NO: 46175
  chr20:44562147-44562177
  Hypo

SEQ ID NO: 119597 - DNA, 46 bp, Homo sapiens; identical to SEQ ID NO: 87616
  chr20:44569195-44569241
  Hypo

SEQ ID NO: 119598 - DNA, 23 bp, Homo sapiens
  chr20:44601506-44601529
  Hypo
taatagagctgaggccgggcgct

SEQ ID NO: 119599 - DNA, 240 bp, Homo sapiens; identical to SEQ ID NO: 87618
  chr20:44601829-44602069
  Hypo

SEQ ID NO: 119600 - DNA, 716 bp, Homo sapiens
  chr20:44639138-44639854
  Hyper
aagacttgccgcgggcggtgattgacgacgcctttgcccgcgccttcgcactgtggagcgcggtgacgccgctcaccttcactcgcgtgtacagccgggacgcagacatcgtcatccagtttggtgtcgcgggtgagaacgtgaggagggaaaatccaagagacctgggcggggtcagggaagggaggaccacggagagcgtggaggcagcagtggccccggcttcctcttgcctgcccgcgctgccctggcttatacggcccctcctgccagacagtgcacagggccagggcgccaggctgggagagcttcgcgcaggcgggatttcagcccgcacttatttcggagcccttgccttgggcagcgcacaatctgcgcagcagtactcggctaaccctcttcctctcgacctgtttcttcagagcacggagacgggtatcccttcgacgggaaggacgggctcctggcacacgcctttcctcctggccccggcattcagggagacgcccatttcgacgatgacgagttgtggtccctgggcaagggcgtcggtgagattctgagtcctcctggcccctgattcccttcattctctcccactcatcacccgccgccctaactccggtcccccctcctcctgcagtggttccaactcggtttggaaacgcagatggcgcggcctgccacttccccttcatcttcgagggccgctccta

SEQ ID NO: 119601 - DNA, 83 bp, Homo sapiens
  chr20:44640284-44640367
  Hyper
actccgcctgcaccacggacggtcgctccgacggctaccgctggtgcgccaccaccgccaactacgaccgggacaagctcttc

SEQ ID NO: 119602 - DNA, 276 bp, Homo sapiens; identical to SEQ ID NO: 87623
  chr20:44640624-44640900
  Hyper

SEQ ID NO: 119603 - DNA, 143 bp, Homo sapiens
  chr20:44642389-44642532
  Hyper
tcggtctttgaggagcggctctccaagaagcttttcttcttctctggttagttacctactttccctcccccgcccggtcaatccccatcagtcaaggaggctcaagagaccatcgataacccacgaaacgtcttgtgcgtttt

SEQ ID NO: 119604 - DNA, 340 bp, Homo sapiens; identical to SEQ ID NO: 87625
  chr20:44650172-44650512
  Hyper

SEQ ID NO: 119605 - DNA, 718 bp, Homo sapiens
  chr20:44657718-44658436
  Hyper
ctccccccaaaaccccgccagtggctcacgcctcctgcatacgggatgaggtgagcagcgccgctgctgagagggggcgcgcgcgggtgtgagcgtgtgtccgtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtaagctgtggtccgggggcggcgggggagggggcagcgaggagaggaggcagctctggggttagaggcggagcgggggccacctccttcagagaggaggctgggactgacccgggcggtgggcgccagttgcagcctggagctcagctccattggaatgctccgggcgctgtccaaggtgctggaatgcgccgcgcccgggggcagagctgcgggccgggggattatcgctgcccacggcttcgggctgacttgggttagctaaaccgaggaggcggtgggaaggggatagaagacctagaatgggctgatgtggagctcgacggcgggaggagggctcctttccccgacaggggaccccggcgtcctggcgcagagcaggcacccgtggagccgggggg

SEQ ID NO: 119606 - DNA, 171 bp, Homo sapiens; identical to SEQ ID NO: 38131
  chr20:44659126-44659297
  Hyper

SEQ ID NO: 119607 - DNA, 30 bp, Homo sapiens; identical to SEQ ID NO: 87630
  chr20:44659623-44659653
  Hyper

SEQ ID NO: 119608 - DNA, 30 bp, Homo sapiens; identical to SEQ ID NO: 38132
  chr20:44660307-44660337
  Hyper

SEQ ID NO: 119609 - DNA, 356 bp, Homo sapiens; identical to SEQ ID NO: 87632
  chr20:44660605-44660961
  Hyper

SEQ ID NO: 119610 - DNA, 30 bp, Homo sapiens; identical to SEQ ID NO: 87633
  chr20:44681660-44681690
  Hypo

SEQ ID NO: 119611 - DNA, 946 bp, Homo sapiens
  chr20:44685860-44686806
  Hyper
atcgtgaagaaatcccgggacgccaagcttgttttgctcaacatgcctgggcctccccgcaaccgcaatggtgatgaaaactgtatcctggaattaaaattgggggaaagagggaggtggacgtcagggaatctgggtcctgtccctgggatggaagagctgagctgttcctgcctccggatcagcacctcggacagggacacgggcgcgagaggtcccctggcagccgagcgcgaccccaatttcgtcgggagggaaggagaccgggtctttctccttgaccggctctcagacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttat

SEQ ID NO: 119612 - DNA, 200 bp, Homo sapiens
  chr20:44687107-44687307
  Hyper
ctgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctc

SEQ ID NO: 119613 - DNA, 42 bp, Homo sapiens; identical to SEQ ID NO: 87638
  chr20:44720305-44720347
  Hypo

SEQ ID NO: 119614 - DNA, 18 bp, Homo sapiens
  chr20:44723384-44723402
  Hypo
gcccggcccatgaagacc

SEQ ID NO: 119615 - DNA, 40 bp, Homo sapiens; identical to SEQ ID NO: 87640
  chr20:44747259-44747299
  Hyper

SEQ ID NO: 119616 - DNA, 47 bp, Homo sapiens; identical to SEQ ID NO: 46179
  chr20:44756555-44756602
  Hypo

SEQ ID NO: 119617 - DNA, 829 bp, Homo sapiens
  chr20:44802981-44803810
  Hyper
aggaatggaagagtccgctcctagcaagtcccccctccgtccagccgccaagggagggttgggggagggcaggaaagggggtccgcgggggaaacgcgttgtcctggggccccggcgtgtgctgggcgggtgagcagccgcgccccgacggcagggcgaggggctaggaggcctgggcctcgtcgtccccgcggtggccggcgtagagcgcggccaggggccggaagcgcggaccccagctgctgagataggcgaagtcctgctcggagcccgacgagccgctgtgcagggagctgagcgaggcggccggcgagtccgcgccctcgaaggcgtaggtctggaaggcgtcgtagggcggcaccgacaggtccccgtccgccagtgccaccttgcggctgatgaagtccctgaacactgagaagtctggctcggggctcggcggcccctgcggcagcgagtggcgctcggagggcaggtgggcctgcggggggctgcccgcgcccccgcccgagcccccgcccgctcccccgcccgcgctgccgcccccgtcgccgcccttgagctcgccgaagtcgtagaggctccgcagcgccgacatgtcgtaggcttcggtgtcctgctcgccgccgccttcgtcgttgtatttgatgacgttgtcccgcatgtcttcatcctcgtccgagctcaggtggctcttgtggtggcgcctgagggtgaggatcagcagcaccagcactgcgagggggacagagggggcaactgagggccaagcccctcccagggcattagaaggaccctctaccccatctcctcccgcctcccacccagc

SEQ ID NO: 119618 - DNA, 85 bp, Homo sapiens; identical to SEQ ID NO: 87644
  chr20:44845479-44845564
  Hypo

SEQ ID NO: 119619 - DNA, 224 bp, Homo sapiens
  chr20:44875187-44875411
  Hyper
tttgagggtgggtgtcgtgagaaggttcggggagaggtgggccagggttgccaatgggggcagggccgcggaaggagctgtttgtgtggggccttggcgacaaccgcggggcccagcggttcctgtgggtgctgacaggagcctggcggtgagtgatggaggaggcggttgtaaaataggttaccgtcgggcgcccggggttcactctgcggatggtgctgttg

SEQ ID NO: 119620 - DNA, 570 bp, Homo sapiens
  chr20:44879731-44880301
  Hyper
ggttccacacccagccgcgtttgacgcggccggctcccagcgcgccgtcctgccgagctccgggcgccgacggcgagggtgtgcccgctgcccacaggcgccccagcagcgtcggcggcggcggcagcagcagcagcagcagtagcgcgggggacagcgcgactcccgcccggagccccctaccttcgggcctcggcctcatccttggcctgcgcggggctggggcccaggagcatggacgagaggcaccagggcgccgctgcttggtcgcacaacgatgcggcgccgtgtcacatggtggcctcagcgcggccgccgggatgtcgcccccgacggggcacccggacgggcccgcggccctgaacgccgcccagccgcgggggtacccggctggagggggagggggcgcggccgcatccggggcatggacagcccccggggtgcccgcccgcgcccccgtcgccgcgtcgcgtgcggatcaccaggcagcacctggacagctccagagtcggggaagcgccatggttcctgcgcagaaaggatgcgggttggggccggcagatcctgcca

SEQ ID NO: 119621 - DNA, 145 bp, Homo sapiens; identical to SEQ ID NO: 87648
  chr20:44893551-44893696
  Hypo

SEQ ID NO: 119622 - DNA, 1286 bp, Homo sapiens
  chr20:44936006-44937292
  Hyper
ccacccagggctgcccggcaccccgcgcgcccacgcagtccactcttcacagtaaacgccgcggcccccgagggttagccctaagtggcgctctctttggacgttaggctgtcgggggccccgtccttcttccccagcggggacggtgtctccggagtcgggtcctaaggaagagagcagcgctggctctcgctcaccgccagcccgcccgacggccatagggcagggggggtcgcgccggtggggccggcaggggtccctgtgggccgcctccccggctcagaggggaccagaaccgtgcgtgtcgccgcggctggagtcagcctccgggtgtccccggacgcggcacgacctcgcacacacacaccgcgcgcacacgctcgcgccgtgcggtattttcccggccccggaccccgcctctgggaggggccggggagccgagccccgctagcagggttgggggaccgggaacgcctgggtcccagccctcgcgtcagggctgtgcgccaccttcccagccccttttggcgcgccggctcggcccctggcgctgccacccctcggcccgcgggggtcccggaggctcccgggcgcgcggcggacgaggttgtggggacgggtgggagctgcgggcttcgggccgagaggcggctcggctccgcgccggggaaagtttggacgtgggaaactccctccccgccctcccggccgagaggagggggcgcgcagggccgggcgcaggcaccccggctcctcctgcggctggaggctcgccccccgcgccgcctgcccggccgctcccgccggccagggggctccctccctgccgggcagcctcccctcggcggcgatccggccgctcctcccgcggcaccccgcgctcttacctcggggagcggcccggggctccccctagtcctgccgcctcgggacgctgcgtggggcgggagccccggcgcgggcagcgggcgagtccggagccccgcggccgcccgcaggagccggagggagagcgggagcgagagggggagccgcggcggcgtgtgcgcgcgtgtgtgtgagcgagagagcgagagagcgagagagcgagggagtgagcgagcgagcgggagcgagggagtgtgcgtgtctgactggggggaagtgtgcaagggacggatcccttccttcctcccgcagcctctggtggagactcggagaatgcagggcccgccgggcaggagccgcgcagcgccaagccgcaggcggccgccggcccggacccccgcagccggggaaccccagcc

SEQ ID NO: 119623 - DNA, 101 bp, Homo sapiens; identical to SEQ ID NO: 87652
  chr20:44937542-44937643
  Hyper

SEQ ID NO: 119624 - DNA, 281 bp, Homo sapiens; identical to SEQ ID NO: 87653
  chr20:44941380-44941661
  Hyper

SEQ ID NO: 119625 - DNA, 47 bp, Homo sapiens; identical to SEQ ID NO: 87654
  chr20:44993202-44993249
  Hyper

SEQ ID NO: 119626 - DNA, 30 bp, Homo sapiens; identical to SEQ ID NO: 87655
  chr20:45096840-45096870
  Hypo

SEQ ID NO: 119627 - DNA, 394 bp, Homo sapiens
  chr20:45141834-45142228
  Hyper
ctagctacttggatgcgtaaacctttcaccttcaccaagcgccttcttcgggcaaatcagggccctagagagagctcgcccgtggcctgcaggtcaggagcccaatcctgccctggctgcctcgcctcccgaccacaggaaaccctccctccaaagacagggagagcgcgcgtccaccctccgcagacccgaggcccgctccgcccggccccaccgttccctccgacgcccgagtgctcagagctcgccgccagcccttcctataggttgtgggtgcacccgcttcgcctccagttcgcaccaggtccaagtctcggcgggaccagggattcacgggctgcaggaccctcacccggaagagcctggcgaaccggaagggcgtccaggtaaaaaa

SEQ ID NO: 119628 - DNA, 573 bp, Homo sapiens
  chr20:45279814-45280387
  Hyper
gcaagggagggaaggcgagggggtctggtggagcctgtctacactgggacctcagcggtctcccaacttggaggcttgggagaagaggatcccgcctgtggttgaccgggggcgcacaggcggaggaggcgttaccttgggcgggagggcgaagaccaccggcagcagcgcgagcggcgtgaacagcagcaccagcagccgccgcgcgctccacaccttcttggccgctgctgccagcgccgccatcagcgcgatcgcctggcggtacgggccggcccgggactgccccgcctggccccggcgccggcttaaagcctgggggagggtcggggaggggactgcgctggggaacccgccctctccctgctcctcctggaggaaaagggtggtgcctgcgcccctgggaccgggtgaaagaggcccgggaacgttggagaaagttaggcactagaattagcaaacgggaccccagccgcagggcagtgtggccttgcctcttggcttcccagcaatgtggcctggggcagctggcttatcctctcctcgcctctgtttactcgcctgtgagatggc

SEQ ID NO: 119629 - DNA, 37 bp, Homo sapiens; identical to SEQ ID NO: 87660
  chr20:45316162-45316199
  Hypo

SEQ ID NO: 119630 - DNA, 416 bp, Homo sapiens; identical to SEQ ID NO: 46181
  chr20:45337605-45338021
  Hypo

SEQ ID NO: 119631 - DNA, 587 bp, Homo sapiens; identical to SEQ ID NO: 87662
  chr20:45338197-45338784
  Hyper

SEQ ID NO: 119632 - DNA, 1458 bp, Homo sapiens; identical to SEQ ID NO: 87663
  chr20:45523171-45524629
  Hyper

SEQ ID NO: 119633 - DNA, 29 bp, Homo sapiens
  chr20:45833539-45833568
  Hypo
ctgattatcgccactcgactgtatagttt

SEQ ID NO: 119634 - DNA, 30 bp, Homo sapiens; identical to SEQ ID NO: 46182
  chr20:45834171-45834201
  Hypo

SEQ ID NO: 119635 - DNA, 30 bp, Homo sapiens; identical to SEQ ID NO: 87666
  chr20:45871153-45871183
  Hypo

SEQ ID NO: 119636 - DNA, 37 bp, Homo sapiens; identical to SEQ ID NO: 87668
  chr20:45941815-45941852
  Hypo

SEQ ID NO: 119637 - DNA, 87 bp, Homo sapiens; identical to SEQ ID NO: 87669
  chr20:45949101-45949188
  Hypo

SEQ ID NO: 119638 - DNA, 29 bp, Homo sapiens
  chr20:45951417-45951446
  Hypo
gctgggattacaggcgtgagccaccacac

SEQ ID NO: 119639 - DNA, 47 bp, Homo sapiens; identical to SEQ ID NO: 87671
  chr20:45951653-45951700
  Hypo

SEQ ID NO: 119640 - DNA, 146 bp, Homo sapiens; identical to SEQ ID NO: 46185
  chr20:46013515-46013661
  Hypo

SEQ ID NO: 119641 - DNA, 25 bp, Homo sapiens
  chr20:46034351-46034376
  Hypo
agtgagactccgtctcaaaacaaaa

SEQ ID NO: 119642 - DNA, 30 bp, Homo sapiens; identical to SEQ ID NO: 46186
  chr20:46175625-46175655
  Hypo

SEQ ID NO: 119643 - DNA, 30 bp, Homo sapiens; identical to SEQ ID NO: 46187
  chr20:46315525-46315555
  Hypo

SEQ ID NO: 119644 - DNA, 30 bp, Homo sapiens; identical to SEQ ID NO: 87676
  chr20:46354550-46354580
  Hypo

SEQ ID NO: 119645 - DNA, 30 bp, Homo sapiens; identical to SEQ ID NO: 87677
  chr20:46365350-46365380
  Hypo

SEQ ID NO: 119646 - DNA, 36 bp, Homo sapiens; identical to SEQ ID NO: 46188
  chr20:46365599-46365635
  Hypo

SEQ ID NO: 119647 - DNA, 188 bp, Homo sapiens; identical to SEQ ID NO: 87679
  chr20:46386594-46386782
  Hypo

SEQ ID NO: 119648 - DNA, 25 bp, Homo sapiens
  chr20:46390872-46390897
  Hypo
ttatcagcagcgtgaaaacagacta

SEQ ID NO: 119649 - DNA, 293 bp, Homo sapiens; identical to SEQ ID NO: 87681
  chr20:46413326-46413619
  Hyper

SEQ ID NO: 119650 - DNA, 128 bp, Homo sapiens; identical to SEQ ID NO: 87682
  chr20:46414099-46414227
  Hyper

SEQ ID NO: 119651 - DNA, 279 bp, Homo sapiens; identical to SEQ ID NO: 38157
  chr20:46414635-46414914
  Hyper

SEQ ID NO: 119652 - DNA, 383 bp, Homo sapiens; identical to SEQ ID NO: 87684
  chr20:46415137-46415520
  Hyper

SEQ ID NO: 119653 - DNA, 30 bp, Homo sapiens; identical to SEQ ID NO: 87685
  chr20:46430501-46430531
  Hypo

SEQ ID NO: 119654 - DNA, 30 bp, Homo sapiens; identical to SEQ ID NO: 87686
  chr20:46438115-46438145
  Hypo

SEQ ID NO: 119655 - DNA, 30 bp, Homo sapiens; identical to SEQ ID NO: 87687
  chr20:46438350-46438380
  Hypo

SEQ ID NO: 119656 - DNA, 30 bp, Homo sapiens; identical to SEQ ID NO: 87688
  chr20:46454708-46454738
  Hypo

SEQ ID NO: 119657 - DNA, 30 bp, Homo sapiens; identical to SEQ ID NO: 87691
  chr20:46580194-46580224
  Hypo

SEQ ID NO: 119658 - DNA, 30 bp, Homo sapiens; identical to SEQ ID NO: 46189
  chr20:46582135-46582165
  Hypo

SEQ ID NO: 119659 - DNA, 70 bp, Homo sapiens; identical to SEQ ID NO: 87693
  chr20:46687876-46687946
  Hypo

SEQ ID NO: 119660 - DNA, 196 bp, Homo sapiens; identical to SEQ ID NO: 87694
  chr20:46729505-46729701
  Hypo

SEQ ID NO: 119661 - DNA, 198 bp, Homo sapiens; identical to SEQ ID NO: 87695
  chr20:46731680-46731878
  Hypo

SEQ ID NO: 119662 - DNA, 30 bp, Homo sapiens; identical to SEQ ID NO: 87697
  chr20:46798520-46798550
  Hypo

SEQ ID NO: 119663 - DNA, 220 bp, Homo sapiens; identical to SEQ ID NO: 87698
  chr20:46823363-46823583
  Hypo

SEQ ID NO: 119664 - DNA, 182 bp, Homo sapiens; identical to SEQ ID NO: 87699
  chr20:46838294-46838476
  Hypo

SEQ ID NO: 119665 - DNA, 30 bp, Homo sapiens; identical to SEQ ID NO: 87701
  chr20:46955145-46955175
  Hypo

SEQ ID NO: 119666 - DNA, 61 bp, Homo sapiens; identical to SEQ ID NO: 87702
  chr20:46972040-46972101
  Hypo

SEQ ID NO: 119667 - DNA, 30 bp, Homo sapiens; identical to SEQ ID NO: 87703
  chr20:47001190-47001220
  Hypo

SEQ ID NO: 119668 - DNA, 36 bp, Homo sapiens; identical to SEQ ID NO: 87704
  chr20:47128746-47128782
  Hypo

SEQ ID NO: 119669 - DNA, 30 bp, Homo sapiens; identical to SEQ ID NO: 87705
  chr20:47168941-47168971
  Hypo

SEQ ID NO: 119670 - DNA, 36 bp, Homo sapiens; identical to SEQ ID NO: 87706
  chr20:47201897-47201933
  Hypo

SEQ ID NO: 119671 - DNA, 30 bp, Homo sapiens; identical to SEQ ID NO: 87708
  chr20:47241898-47241928
  Hypo

SEQ ID NO: 119672 - DNA, 112 bp, Homo sapiens; identical to SEQ ID NO: 87709
  chr20:47247201-47247313
  Hypo

SEQ ID NO: 119673 - DNA, 258 bp, Homo sapiens; identical to SEQ ID NO: 87710
  chr20:47252924-47253182
  Hypo

SEQ ID NO: 119674 - DNA, 30 bp, Homo sapiens; identical to SEQ ID NO: 87711
  chr20:47258562-47258592
  Hypo

SEQ ID NO: 119675 - DNA, 20 bp, Homo sapiens
  chr20:47259758-47259778
  Hypo
agcaatttgggaggccgggg

SEQ ID NO: 119676 - DNA, 36 bp, Homo sapiens; identical to SEQ ID NO: 46194
  chr20:47260725-47260761
  Hypo

SEQ ID NO: 119677 - DNA, 30 bp, Homo sapiens; identical to SEQ ID NO: 87714
  chr20:47264965-47264995
  Hypo

SEQ ID NO: 119678 - DNA, 30 bp, Homo sapiens; identical to SEQ ID NO: 87715
  chr20:47273573-47273603
  Hypo

SEQ ID NO: 119679 - DNA, 182 bp, Homo sapiens; identical to SEQ ID NO: 46195
  chr20:47274120-47274302
  Hypo

SEQ ID NO: 119680 - DNA, 30 bp, Homo sapiens; identical to SEQ ID NO: 46196
  chr20:47274646-47274676
  Hypo

SEQ ID NO: 119681 - DNA, 342 bp, Homo sapiens; identical to SEQ ID NO: 87718
  chr20:47296022-47296364
  Hypo

SEQ ID NO: 119682 - DNA, 30 bp, Homo sapiens; identical to SEQ ID NO: 87719
  chr20:47358665-47358695
  Hypo

SEQ ID NO: 119683 - DNA, 30 bp, Homo sapiens; identical to SEQ ID NO: 87720
  chr20:47359750-47359780
  Hypo

SEQ ID NO: 119684 - DNA, 86 bp, Homo sapiens; identical to SEQ ID NO: 87721
  chr20:47381385-47381471
  Hypo

SEQ ID NO: 119685 - DNA, 184 bp, Homo sapiens; identical to SEQ ID NO: 16602
  chr20:47428537-47428721
  Hypo

SEQ ID NO: 119686 - DNA, 1537 bp, Homo sapiens
  chr20:47443678-47445215
  Hyper
ggttctgtcaatccccgcccctcctctgagcttcaggttttatcctactccatcaacgcgcagggacgttgggctctggggctcctacggtatgtcctagatgagtggtgcaccgggcgcgtagttattcctgggaaaaagacgcaggagcgccagctcccggcgccgccggggtccccaagcccctgcatcgcggatgtaactaattttaaaactatttgaaaggcggggacggggaagaaaagacaaaagggcagcgcgcgccgcggggaagtggagtgcgggagagccccggtcggagcaggaccgtgcgccggccagggagggaggcgacgcgacagctctggaggagctcggatcccccccgctttccgcgcgccctgcggggcgcccccgaggcaattctccacccacggggaccacggccacaggttgtggggaccgcagcggggcgagcggctggagggaaagctgtccccaagctcccgagcgacactcaccgactgcaagaagcgcaaggtgcccacgtagtccctctcggtgcccaagatctcgttgaggacgcagaggcggaggcgcagctggcgctcggactcccgggcggccgcgcacgggccggggccggagctgggcgccgcggcgccaggggcccgggggtccgggtgggcgcagtccccggccccgtcgccgccgggctcgctgccgctgggcgcctccattctagcgcggccgcgcggcgccggctccttccgtcgcgccgagcggcaactcaggcgtccaggcgccccatcccggacggggcgcgccggcgggccgggctcagcggcgggccgggctcccggcgcggcgggcgggactgggggccgggcggctgggccgggggcggaggcagcgcgcgggggccgggcgaggggcgggagggggcggccctcggggctcccagacggctggccccccgcccccgcgccagggaccgtctgccaagtgccacgccgcgctcggccgcagaggcgctctgcgcgtgcacggggcccctggggacgcggcgcggcgctcggcgcctccgtcggaagctcgggggtcgggcgggagcctccggaagggccccgcggagccgggagtccgaggccgcgcgcacgccgaaccgagcgtaccaactccgcgcccggacgcgtggcgcccccccaacccgcagtcaccgcgggctacgccactcccacccggcacacgcgacacccgccgcgcgcaggctcctgcttgcaggtccggccgctgctcgggccaagtaaacaccgggctgggaaagctcgctgcggagccgctcgggggcaagccagccccgccacgcgcgcctccgcggccccgggaagtcaggggcgaccgctgcctgggcagtgacggcccctctctgggcagtgacggcccctcccgggaacgccgggccctcgcggtgccctcggtgctaccacgaccttgggaaggaacatgcgtggcgcgcgctcgctctcacttttctctttcccgtttcctttcccat

SEQ ID NO: 119687 - DNA, 30 bp, Homo sapiens; identical to SEQ ID NO: 87730
  chr20:47830069-47830099
  Hypo

SEQ ID NO: 119688 - DNA, 204 bp, Homo sapiens; identical to SEQ ID NO: 87731
  chr20:47837002-47837206
  Hypo

SEQ ID NO: 119689 - DNA, 253 bp, Homo sapiens; identical to SEQ ID NO: 46200
  chr20:47905350-47905603
  Hypo

SEQ ID NO: 119690 - DNA, 1248 bp, Homo sapiens
  chr20:47934824-47936072
  Hyper
cacaagatctgtctccgttggcgtcccggtacctagcttgagcccgaccatgggcatgcgtggcgtggcgcgaatcctgtccctgtcgctcgtcctggccgcggtggccacgggggcctgggagcgggggccgctgggcgtgctcttgccctggcagggctccgccgcgctgggccgctgctgtcctggccgtgacccgatgtttgtcgcccgcgggcccccgcgctgcttctgcgaccaagcgtgcggcgcggcgcggcgcgggactgctgcgcagactatacgcgggtctgcccaggtgcacccggggaaaggcaaggcactagcggaacgctcggagcggaggggagctggggcgggggatgagcggaggaagggagcccagcacctagggggctctgggcttggaggggtcacacgagccgagggcggggcgcggcgcttggggactggaagggtgcgccgcggggcagacgggacgtgcagggggtcgcgcgggcaaggagggacgcagacactcaggacctaaaggggaagcactggctgtggagctgcgagccgagaaagacgcgcaggttatgaacctgggtgcgttcatctcgggggacctgaaggagagggactcgtggagagttgaggggtgtttcggaggaggggcgcaaggactgctcacaggacttgaagggcggcaggaaggtggaggattcggcccaggtgcgggacgcaggcggtggaagggaaatgagcacaagaggcgcaggcaggaaggagagcgcctggtgcgagagaggaaggagcgcacccagtaagcggtgtcgggggggtcgtgaagcttggagggcctcgaggggagggaggcgcttgggttgaggtagggcgccagatttcgcaaatcaaaatacagcacacccagttaaactcgaatttcagataaacaaatctttctagagaaaaatatgtcctaaatatcgcatgggatatacttatactaaaaaattatttgttgtttttctgaaattgaaatctaactcggagtcctgtattttatctgagagccccagctggggacgggcgcggggccaagagagctgcgagggaggaggggttgcaagcttctttcgggcggaggggtcacaaggcgaatggagaaggtgacaaggagcatggagaaaccaagaaaagggctaacgcttggagagcaaggatggaaagacgctcaaagcggaggcggaacggtctgagtgattc

SEQ ID NO: 119691 - DNA, 30 bp, Homo sapiens; identical to SEQ ID NO: 87735
  chr20:47949637-47949667
  Hypo

SEQ ID NO: 119692 - DNA, 34 bp, Homo sapiens; identical to SEQ ID NO: 87736
  chr20:48001223-48001257
  Hyper

SEQ ID NO: 119693 - DNA, 449 bp, Homo sapiens
  chr20:48099124-48099573
  Hyper
gggtgcagggggccccgcgggcgcgcgtcacggccgtcttctcacctccatcccgacggctgcgaggcagaaagcgaaagcggacgcgggtcagcaaacggggagctgggcatgctgtccccccgccccccacctctccaccaggctcccagccggccttgaccttcccccgcgcttaagcggctcagtggggtaggacggatggtcgctgtccctcccgccggtgctgaagtccgccgcaccccatggatggagggaggggccgcccctcggggcggggagagggccccaagagatgcccctggagcccgggaggccccaccctgggcttctgcggcccaggcgcgacccagccgcccggggcgctgtccgccccttagagtgctgaaactctcttcattatgggtctcccgatcgagtcccgaacctggccccgccatggggagaga

SEQ ID NO: 119694 - DNA, 30 bp, Homo sapiens; identical to SEQ ID NO: 87740
  chr20:48099861-48099891
  Hyper

SEQ ID NO: 119695 - DNA, 335 bp, Homo sapiens; identical to SEQ ID NO: 87741
  chr20:48100170-48100505
  Hyper

SEQ ID NO: 119696 - DNA, 440 bp, Homo sapiens
  chr20:48184239-48184679
  Hyper
ccacccacaaaccctcggtcctcacctgaaaccccctcctaggtccctgccgtcgcgctaagggccagactcggacttgtcgcggtgggcgattcgccccgggggacctaccggaccccgcaccttcccaccttgcaccttcttggcagggggagcacggcctggccccctcacccacgtgcggggccccgggactcccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagcagcagcaacagtgcggccaggaggccgaggagcgcggcccaagccatcgcggggctggcggggctggcggggc

SEQ ID NO: 119697 - DNA, 86 bp, Homo sapiens; identical to SEQ ID NO: 87744
  chr20:48252895-48252981
  Hypo

SEQ ID NO: 119698 - DNA, 30 bp, Homo sapiens; identical to SEQ ID NO: 87745
  chr20:48403614-48403644
  Hypo

SEQ ID NO: 119699 - DNA, 30 bp, Homo sapiens; identical to SEQ ID NO: 16604
  chr20:48477511-48477541
  Hypo

SEQ ID NO: 119700 - DNA, 30 bp, Homo sapiens; identical to SEQ ID NO: 87747
  chr20:48517671-48517701
  Hypo

SEQ ID NO: 119701 - DNA, 54 bp, Homo sapiens; identical to SEQ ID NO: 87748
  chr20:48524764-48524818
  Hypo

SEQ ID NO: 119702 - DNA, 88 bp, Homo sapiens; identical to SEQ ID NO: 46203
  chr20:48673896-48673984
  Hypo

SEQ ID NO: 119703 - DNA, 78 bp, Homo sapiens; identical to SEQ ID NO: 87750
  chr20:48695412-48695490
  Hypo

SEQ ID NO: 119704 - DNA, 82 bp, Homo sapiens; identical to SEQ ID NO: 87751
  chr20:48720255-48720337
  Hypo

SEQ ID NO: 119705 - DNA, 21 bp, Homo sapiens
  chr20:48720805-48720826
  Hypo
agactccgtctcaaaaaaaaa

SEQ ID NO: 119706 - DNA, 154 bp, Homo sapiens; identical to SEQ ID NO: 46205
  chr20:48767027-48767181
  Hypo

SEQ ID NO: 119707 - DNA, 30 bp, Homo sapiens; identical to SEQ ID NO: 87754
  chr20:48768053-48768083
  Hypo

SEQ ID NO: 119708 - DNA, 25 bp, Homo sapiens
  chr20:48771341-48771366
  Hypo
ttccatacaggcagccgggcgcggt

SEQ ID NO: 119709 - DNA, 281 bp, Homo sapiens; identical to SEQ ID NO: 87756
  chr20:48788892-48789173
  Hyper

SEQ ID NO: 119710 - DNA, 246 bp, Homo sapiens; identical to SEQ ID NO: 87757
  chr20:48863456-48863702
  Hypo

SEQ ID NO: 119711 - DNA, 30 bp, Homo sapiens; identical to SEQ ID NO: 87758
  chr20:48971286-48971316
  Hypo

SEQ ID NO: 119712 - DNA, 155 bp, Homo sapiens; identical to SEQ ID NO: 87759
  chr20:49047009-49047164
  Hypo

SEQ ID NO: 119713 - DNA, 251 bp, Homo sapiens; identical to SEQ ID NO: 87760
  chr20:49194287-49194538
  Hypo

SEQ ID NO: 119714 - DNA, 146 bp, Homo sapiens; identical to SEQ ID NO: 87761
  chr20:49200439-49200585
  Hypo

SEQ ID NO: 119715 - DNA, 42 bp, Homo sapiens; identical to SEQ ID NO: 87762
  chr20:49203345-49203387
  Hypo

SEQ ID NO: 119716 - DNA, 30 bp, Homo sapiens; identical to SEQ ID NO: 87763
  chr20:49203615-49203645
  Hypo

SEQ ID NO: 119717 - DNA, 270 bp, Homo sapiens; identical to SEQ ID NO: 46211
  chr20:49204179-49204449
  Hypo

SEQ ID NO: 119718 - DNA, 30 bp, Homo sapiens; identical to SEQ ID NO: 87765
  chr20:49210458-49210488
  Hypo

SEQ ID NO: 119719 - DNA, 328 bp, Homo sapiens; identical to SEQ ID NO: 87766
  chr20:49218480-49218808
  Hypo

SEQ ID NO: 119720 - DNA, 32 bp, Homo sapiens; identical to SEQ ID NO: 87767
  chr20:49250792-49250824
  Hypo

SEQ ID NO: 119721 - DNA, 406 bp, Homo sapiens; identical to SEQ ID NO: 87768
  chr20:49261761-49262167
  Hypo

SEQ ID NO: 119722 - DNA, 152 bp, Homo sapiens; identical to SEQ ID NO: 87769
  chr20:49286742-49286894
  Hypo

SEQ ID NO: 119723 - DNA, 20 bp, Homo sapiens
  chr20:49323846-49323866
  Hypo
gggcaaggtggctcacgcct

SEQ ID NO: 119724 - DNA, 19 bp, Homo sapiens
  chr20:49324106-49324125
  Hypo
agagcgagactccaccaaa

SEQ ID NO: 119725 - DNA, 56 bp, Homo sapiens; identical to SEQ ID NO: 46218
  chr20:49345671-49345727
  Hypo

SEQ ID NO: 119726 - DNA, 339 bp, Homo sapiens; identical to SEQ ID NO: 87773
  chr20:49346420-49346759
  Hypo

SEQ ID NO: 119727 - DNA, 26 bp, Homo sapiens
  chr20:49350870-49350896
  Hypo
aactaggtagtgtgccggtccttttt

SEQ ID NO: 119728 - DNA, 95 bp, Homo sapiens; identical to SEQ ID NO: 87775
  chr20:49358027-49358122
  Hypo

SEQ ID NO: 119729 - DNA, 34 bp, Homo sapiens; identical to SEQ ID NO: 87776
  chr20:49358362-49358396
  Hypo

SEQ ID NO: 119730 - DNA, 17 bp, Homo sapiens
  chr20:49364856-49364873
  Hypo
gacgacagagcgagact

SEQ ID NO: 119731 - DNA, 160 bp, Homo sapiens; identical to SEQ ID NO: 87778
  chr20:49377911-49378071
  Hypo

SEQ ID NO: 119732 - DNA, 204 bp, Homo sapiens; identical to SEQ ID NO: 87779
  chr20:49380667-49380871
  Hypo

SEQ ID NO: 119733 - DNA, 90 bp, Homo sapiens; identical to SEQ ID NO: 87780
  chr20:49381176-49381266
  Hypo

SEQ ID NO: 119734 - DNA, 30 bp, Homo sapiens; identical to SEQ ID NO: 87781
  chr20:49411040-49411070
  Hyper

SEQ ID NO: 119735 - DNA, 129 bp, Homo sapiens; identical to SEQ ID NO: 38174
  chr20:49435030-49435159
  Hyper

SEQ ID NO: 119736 - DNA, 30 bp, Homo sapiens; identical to SEQ ID NO: 46224
  chr20:49502935-49502965
  Hypo

SEQ ID NO: 119737 - DNA, 75 bp, Homo sapiens; identical to SEQ ID NO: 87784
  chr20:49548179-49548254
  Hyper

SEQ ID NO: 119738 - DNA, 116 bp, Homo sapiens; identical to SEQ ID NO: 87785
  chr20:49548468-49548584
  Hyper

SEQ ID NO: 119739 - DNA, 32 bp, Homo sapiens; identical to SEQ ID NO: 87786
  chr20:49572072-49572104
  Hypo

SEQ ID NO: 119740 - DNA, 43 bp, Homo sapiens; identical to SEQ ID NO: 87787
  chr20:49572791-49572834
  Hypo

SEQ ID NO: 119741 - DNA, 109 bp, Homo sapiens; identical to SEQ ID NO: 87788
  chr20:49575733-49575842
  Hyper

SEQ ID NO: 119742 - DNA, 42 bp, Homo sapiens; identical to SEQ ID NO: 87789
  chr20:49576086-49576128
  Hyper

SEQ ID NO: 119743 - DNA, 186 bp, Homo sapiens; identical to SEQ ID NO: 87790
  chr20:49598367-49598553
  Hypo

SEQ ID NO: 119744 - DNA, 1300 bp, Homo sapiens
  chr20:49638951-49640251
  Hyper
actcaatcaggcccacggtgggggtgaaggggggctccatactgtgcctaaggatacagtgaatgagcaagtgacacacactcccccaccccaatccctaactctccttcctcccaggatcgggggagaaacctcggcccacagccgggatgcgcccccgccggggtcaccgcggcggcgaacgtcccggacttcgcatcccggtgaccccttgggatgaaccgaagccggacccgcaccttggccgtaacaagcgcgctccacgccgccacgcaccagcggtgactcccgagtcctctgtcgccctggcctccccgcaggcgggtttcgaggcccccgcagggagttcagggccacggccacgtgcagccgcccccgagcccgagtttgcaggctcggggtccggttcgcgctttggtggcgcccggcgaggctgcagcgcgcaaagttcccacctcaagttcccgtcgcggcgtccccgcctcggagttggcccggccgcggcttccgttccccccggctgcccacgggtccggggcgaggacgcgagaggggcctggaagtcgcccggggagcccgctctgcctcccggagccgccgccaaacttcggtcccggggcccggctcagctcccgccctcggagccacggccgccccgtctctgcctcccggtccccgccgggctccgagtgcgccgggagcgcggcgcagcagccgccgagggagggagcgaggcaggaggcgggacggagggaggggactgagcgcggggcggggagaaggggcgggcagccgaaagcgcagcgcctggcctcgcctcgcttcgggacagtggcagcggcgccaccgtcacggggcgtccaggcgcccaatcgggaccccgcaccttggatccgggggccctggcgcgcctgctggattgcgctcctcgcggccagttcctgagcccgcgtccgggactgctcgcgctacgccctccctcccgttgccttcttccccgtctgctctcccaggagcgaccaccctgcggccccttcgcctgcacgcgacagccttcaaggtccccgcgctccgctgccctggagcttcacgcaccaggcggcgcggcagcctcctagggtcgcgcgccctgtcagctttccccgcggtgcaagtgctccggtggtcccgggtccgcgcccctagcagcaccgccccagggtctacatgtgctagatattaaaaccccactctccgctgccccggggccgcgctccacgcgcttacacatcctgggaaccacatgcgccatgtctcctgc

SEQ ID NO: 119745 - DNA, 172 bp, Homo sapiens; identical to SEQ ID NO: 87796
  chr20:49708478-49708650
  Hyper

SEQ ID NO: 119746 - DNA, 51 bp, Homo sapiens; identical to SEQ ID NO: 87797
  chr20:49742709-49742760
  Hypo

SEQ ID NO: 119747 - DNA, 30 bp, Homo sapiens; identical to SEQ ID NO: 87798
  chr20:49778368-49778398
  Hypo

SEQ ID NO: 119748 - DNA, 132 bp, Homo sapiens; identical to SEQ ID NO: 87800
  chr20:49836904-49837036
  Hyper

SEQ ID NO: 119749 - DNA, 30 bp, Homo sapiens; identical to SEQ ID NO: 87801
  chr20:49948303-49948333
  Hypo

SEQ ID NO: 119750 - DNA, 30 bp, Homo sapiens; identical to SEQ ID NO: 87802
  chr20:49999712-49999742
  Hypo

SEQ ID NO: 119751 - DNA, 97 bp, Homo sapiens; identical to SEQ ID NO: 87803
  chr20:50052184-50052281
  Hypo

SEQ ID NO: 119752 - DNA, 31 bp, Homo sapiens; identical to SEQ ID NO: 87804
  chr20:50116003-50116034
  Hypo

SEQ ID NO: 119753 - DNA, 376 bp, Homo sapiens; identical to SEQ ID NO: 87805
  chr20:50157663-50158039
  Hyper

SEQ ID NO: 119754 - DNA, 65 bp, Homo sapiens; identical to SEQ ID NO: 38186
  chr20:50158354-50158419
  Hyper

SEQ ID NO: 119755 - DNA, 182 bp, Homo sapiens; identical to SEQ ID NO: 87807
  chr20:50178954-50179136
  Hyper

SEQ ID NO: 119756 - DNA, 30 bp, Homo sapiens; identical to SEQ ID NO: 87808
  chr20:50184172-50184202
  Hypo

SEQ ID NO: 119757 - DNA, 30 bp, Homo sapiens; identical to SEQ ID NO: 87810
  chr20:50378432-50378462
  Hypo

SEQ ID NO: 119758 - DNA, 25 bp, Homo sapiens
  chr20:50383398-50383423
  Hypo
taataataaacgcaaaacagagaag

SEQ ID NO: 119759 - DNA, 155 bp, Homo sapiens; identical to SEQ ID NO: 87812
  chr20:50384245-50384400
  Hyper

SEQ ID NO: 119760 - DNA, 279 bp, Homo sapiens; identical to SEQ ID NO: 87813
  chr20:50384649-50384928
  Hyper

SEQ ID NO: 119761 - DNA, 59 bp, Homo sapiens; identical to SEQ ID NO: 87814
  chr20:50385171-50385230
  Hyper

SEQ ID NO: 119762 - DNA, 767 bp, Homo sapiens; identical to SEQ ID NO: 87815
  chr20:50417309-50418076
  Hyper

SEQ ID NO: 119763 - DNA, 156 bp, Homo sapiens; identical to SEQ ID NO: 87816
  chr20:50419232-50419388
  Hypo

SEQ ID NO: 119764 - DNA, 19 bp, Homo sapiens
  chr20:50470085-50470104
  Hypo
tttgagacagggtctcgct

SEQ ID NO: 119765 - DNA, 30 bp, Homo sapiens; identical to SEQ ID NO: 87818
  chr20:50583692-50583722
  Hypo

SEQ ID NO: 119766 - DNA, 27 bp, Homo sapiens
  chr20:50602104-50602131
  Hypo
tttgagatggagtctcgctctgtcgcc

SEQ ID NO: 119767 - DNA, 1661 bp, Homo sapiens
  chr20:50720360-50722021
  Hyper
tatggtagctccactcgagcaagctttattttaacatataagctattcgtttagtggaggcttcattaaactactcccctccaccaccacctcgggaagttgtggtcaaaacccaccagaccgactgtggtggaagttgatgcggaagctggagagcccgcggctctggaggggtgagccgccccggagaggggacccatcctcctttccgcgcccggaaagagcgggggagaagaggaagtccagttacaactcctttcctcagccccttaaaggaaaggtatcagctaaccacggggagctggcagcctaagagaaagtaggaacctacaatctcttaatctaagcacaagataagcaaaaagggaagcgccttagaaatgcagattccccaaccccacccctgagattccagtggaggcgggggatggggggatccctaacttgcaggaagaatttggcgagcgagaaaaggtcccctcccgcaggctcttctgaagcggaggatcccgggacgagaaatgctgcccggggggcttaaggtagccgacgatctccttgctacatcctgtgtccacgtggcagccgaggagggggtgtgggggccgcctgttaagtgcgacagcatcactgctctatccccaccacggctcccacttcgctcagataaaatgcagagctcttaccaaggctcacggccgtcccccgccccccaccgtctgcccccatcacctctcgggcctccggtgacctctcgggctacagcagcgctgacgccctgggtccctgcgcttctgttccctcggcctggaatgctcttcccccgggtacctgcacagctcgctccctcccatccttcgggtcttcgctcgaacgtccgctcctcggtgaggccttccctggacaacgcatttgaaacgtaaccccaaggcaagaagccaccttccaggcgcgcagccgaagcccagtgccaaggaggccggagactcgggtgcccgcgcatcccgaaaacagcctctgaggggtcctctgagcatccttccagcgtgtttgggaggcaaactcgttgactagctcttgagaggagtggctagaggaatccaggcggggaaggggacggtggactccaggagagtgtaatttacaaaggcggggggcggggacgcccaggtccgagtcccaggactctgcgccggacgcttcgcccgccctttcaggtcccctgcccggtcctcgtacccgcgcgggtccggagaacctctgagcaccggcccccagcccccgggcggggctccagcggcgctactcacccggctcccccgccacctgcggggccacctccgcacactcccggcgcgcaggccgcggctcctcggagttgaggtgctggggcttggcctgcttgcgccgcgacatggcgcgaggaccgggctccccgcgcgtccctaggagtggcctacttcacacaacgaattcccggagttcggaaattaccccccttcggccggaacgcgcatgtcccggcaattctgctcatcagccgagcagggcgatttatcaagagtcctgacggctgattggcctggagccaagaccccaggagtcccgcggacttgcggtccgctcccgggcagcccgcgccacctgggagctcgttagaa

SEQ ID NO: 119768 - DNA, 120 bp, Homo sapiens; identical to SEQ ID NO: 87823
  chr20:50722081-50722201
  Hyper

SEQ ID NO: 119769 - DNA, 41 bp, Homo sapiens; identical to SEQ ID NO: 87824
  chr20:50722261-50722302
  Hyper

SEQ ID NO: 119770 - DNA, 126 bp, Homo sapiens; identical to SEQ ID NO: 87825
  chr20:50722695-50722821
  Hyper

SEQ ID NO: 119771 - DNA, 30 bp, Homo sapiens; identical to SEQ ID NO: 87826
  chr20:50723185-50723215
  Hypo

SEQ ID NO: 119772 - DNA, 216 bp, Homo sapiens; identical to SEQ ID NO: 87827
  chr20:51589786-51590002
  Hyper

SEQ ID NO: 119773 - DNA, 30 bp, Homo sapiens; identical to SEQ ID NO: 87828
  chr20:51796493-51796523
  Hypo

SEQ ID NO: 119774 - DNA, 30 bp, Homo sapiens; identical to SEQ ID NO: 87830
  chr20:52130263-52130293
  Hypo

SEQ ID NO: 119775 - DNA, 120 bp, Homo sapiens; identical to SEQ ID NO: 87831
  chr20:52275843-52275963
  Hypo

SEQ ID NO: 119776 - DNA, 38 bp, Homo sapiens; identical to SEQ ID NO: 87832
  chr20:52285632-52285670
  Hypo

SEQ ID NO: 119777 - DNA, 42 bp, Homo sapiens; identical to SEQ ID NO: 87833
  chr20:52311463-52311505
  Hypo

SEQ ID NO: 119778 - DNA, 132 bp, Homo sapiens; identical to SEQ ID NO: 87834
  chr20:52341618-52341750
  Hypo

SEQ ID NO: 119779 - DNA, 209 bp, Homo sapiens; identical to SEQ ID NO: 87835
  chr20:52385841-52386050
  Hypo

SEQ ID NO: 119780 - DNA, 30 bp, Homo sapiens; identical to SEQ ID NO: 87836
  chr20:52403888-52403918
  Hypo

SEQ ID NO: 119781 - DNA, 30 bp, Homo sapiens; identical to SEQ ID NO: 46227
  chr20:52484713-52484743
  Hypo

SEQ ID NO: 119782 - DNA, 29 bp, Homo sapiens
  chr20:52693116-52693145
  Hypo
agagagattaattttcgtcaccactattg

SEQ ID NO: 119783 - DNA, 89 bp, Homo sapiens; identical to SEQ ID NO: 87840
  chr20:52693385-52693474
  Hypo

SEQ ID NO: 119784 - DNA, 30 bp, Homo sapiens; identical to SEQ ID NO: 46230
  chr20:52773951-52773981
  Hypo

SEQ ID NO: 119785 - DNA, 809 bp, Homo sapiens
  chr20:52789401-52790210
  Hyper
ctcatcaggtctggccgcatgcccaggtccctcggattggactcacaggatcagcagcccgtagccttctttgcggtagtcgcgataggccttccacggtttgatctccagccgctgcgggtacgcgctctcggtgcggtacagcgcttccagcaggcatggcgagcccaggtgcaccgactcaaaggaacccaacttcatgcggaaaatcttgccatacttcttgtggtactccacctgcagccggccgggcacagcgcggtgtcagcgcgcatcctccgccgtgcccgaagcgctttccctcctcccgcctccttcctcctaggggaccggggaccctccctgcccagacgccgaagcgcaccatgcgcccgaggcgcgcatgtcggggagggtttggagcgccactgggagggcggaagagggaggagagagtcaggggcgcgaaaaggggtttaccagggtgtcgtgctgtttcttgagaccccctttccagagaatctgcagcaggctgcccagcagtggccagctggtggggcccggcagggcggccgcgttctgagtctcgccaccagctgtcagcgggcagactggcacctctcgcggctgaggggacgtgtacgccgtagatgtcaccagtctcgggggctgcctcggactgcgcagctgctgcaggaaggcggcaagcgagcggctcttgctgatgggggagctcatggcagcgggggacaccggagcgcgggaaggcaggaggatggggtggggcgaggttggtacgaggtgctagtgggagtcggggcttaacgatt

SEQ ID NO: 119786 - DNA, 89 bp, Homo sapiens; identical to SEQ ID NO: 87844
  chr20:52790612-52790701
  Hyper

SEQ ID NO: 119787 - DNA, 30 bp, Homo sapiens; identical to SEQ ID NO: 87845
  chr20:52824090-52824120
  Hypo

SEQ ID NO: 119788 - DNA, 209 bp, Homo sapiens; identical to SEQ ID NO: 87846
  chr20:52867313-52867522
  Hypo

SEQ ID NO: 119789 - DNA, 79 bp, Homo sapiens; identical to SEQ ID NO: 46232
  chr20:53051998-53052077
  Hypo

SEQ ID NO: 119790 - DNA, 329 bp, Homo sapiens; identical to SEQ ID NO: 38199
  chr20:53091752-53092081
  Hyper

SEQ ID NO: 119791 - DNA, 1108 bp, Homo sapiens
  chr20:53092141-53093249
  Hyper
tccttctcggccgggaggaggcagggctggatccctcagccgccgccgctcctcctcctggcaggccggccgcggagtcagctgacgccggcgctccagcctcgcctccccgcgccgcgctctgcgctccccgaaagtggctgcaagccggccgcccactgtcagggttggggggacagagaaagtgatgtgcgccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggatggcttccaattttaatgacatagtgaagcaagggtacgtgaggatccggagcagacgcctcggggtgagtatcgatcctctccgtgttgctgttcgccggttcgattgtctctctcttgagccagcatccctggagggtggacggagagtccccggccgcgcgccggagaattgcgcggtggctttctcagccgaaacccgcgtctccggggctgtcactgtaaggccagcgtctaggtatgtaatggatctatctttatctcttggatgacttggctttctgatggtggccgcgtgttgggcttcagtagcccctggagcccatctactcgaaataaatatttctcggtagccatggaagttggagctgagaagcccgggcgggggtgcctgccggatgcccccggttcccctcttttcccactcgccgccaacttaacttttccgggggatggatcggctggttgagaaagaggacacgcatactcggtgtgaacgaggtcacgaaccctctgaccccagggagagatttctgccaagcgtaaggtgtctttggatccccccacctctgtcccaggtgtcgtgtcaaaggcggtgcgggctggcctctggtcggggccaacttgggtagatacttgaatctggattttccgtggttcgaagccggggtggtggatttctgttgctggaatacaccctggaggtccacggaagggttatttacgtggaacctgatacctggcatagcgcaagtgctcccta

SEQ ID NO: 119792 - DNA, 159 bp, Homo sapiens; identical to SEQ ID NO: 87857
  chr20:53122859-53123018
  Hypo

SEQ ID NO: 119793 - DNA, 24 bp, Homo sapiens
  chr20:53209356-53209380
  Hypo
caccacgcccggccagataaattt

SEQ ID NO: 119794 - DNA, 30 bp, Homo sapiens; identical to SEQ ID NO: 87859
  chr20:53411711-53411741
  Hypo

SEQ ID NO: 119795 - DNA, 40 bp, Homo sapiens; identical to SEQ ID NO: 87860
  chr20:53530458-53530498
  Hypo

SEQ ID NO: 119796 - DNA, 23 bp, Homo sapiens
  chr20:53535735-53535758
  Hypo
aaaaccaggaggggccgggcgcg

SEQ ID NO: 119797 - DNA, 30 bp, Homo sapiens; identical to SEQ ID NO: 87862
  chr20:53565997-53566027
  Hypo

SEQ ID NO: 119798 - DNA, 90 bp, Homo sapiens; identical to SEQ ID NO: 87863
  chr20:53604671-53604761
  Hypo

SEQ ID NO: 119799 - DNA, 103 bp, Homo sapiens; identical to SEQ ID NO: 87864
  chr20:53801909-53802012
  Hypo

SEQ ID NO: 119800 - DNA, 138 bp, Homo sapiens; identical to SEQ ID NO: 87865
  chr20:53866697-53866835
  Hypo

SEQ ID NO: 119801 - DNA, 33 bp, Homo sapiens; identical to SEQ ID NO: 87866
  chr20:53965510-53965543
  Hypo

SEQ ID NO: 119802 - DNA, 26 bp, Homo sapiens
  chr20:54522665-54522691
  Hypo
agaggagaactcgttgagttttatct

SEQ ID NO: 119803 - DNA, 716 bp, Homo sapiens; identical to SEQ ID NO: 87868
  chr20:54578078-54578794
  Hyper

SEQ ID NO: 119804 - DNA, 67 bp, Homo sapiens
  chr20:54578998-54579065
  Hyper
gcaccgccgagaaggcgaccttggagttggccgcccggaccgatatccccagcggggaggaagagga

SEQ ID NO: 119805 - DNA, 818 bp, Homo sapiens
  chr20:54579873-54580691
  Hyper
gctagccaggtccctcgcaccgaaagcgcggattcgcaggatcaggtccagggcgccgggcgcagcgttcagggcggctggtccggcggggtcctctcctgcctggccgcccgcccccagtccctgcgcacaactttctcgtccctcgtgcagcccggagagcgcgaagcgggcacacgcgctctatttataggagcgcagcgtccggctgggttggcttatcgcgcaacccgcgggctccgagaaaagggggagaaggcgtctggtgaccccatctgagcagctctctcctgacgtttaacgcaccccaaagcaagcggggcgcacagcactggtgattggcaaggttcgaggcccctcagcccctgaaagcccgtggcgtaaaggatgcgtgcccagagaggagcccacggccctgcgctggccccagctccgcgcccactctctcctgctcgatctgagtccgcagaggaggcggctggtcccctcacccctcccagcgcggaactctgccgccgagtgccctccaagcggagcgcggcgctgccaggccgggtcgcgaaaaaggataagccgccgcggacccgcgctgcgcgctgccccgaacctggggaccggcgggcgtcccgaccgcgcctggccgggagcccgccccacacagccctggggcctggcgagctcagggaagccttggggcggaccagagcccgtgggggcggctgggaggaggtgcctgattccttccttccgctccgggaagatgagcctcagaagccgcaggggcgcgccttccccccacaccgcgaatcctccccagg

SEQ ID NO: 119806 - DNA, 18 bp, Homo sapiens
  chr20:54585945-54585963
  Hypo
tttgaggtgcagtctcgc

SEQ ID NO: 119807 - DNA, 170 bp, Homo sapiens; identical to SEQ ID NO: 87873
  chr20:54618242-54618412
  Hypo

SEQ ID NO: 119808 - DNA, 30 bp, Homo sapiens; identical to SEQ ID NO: 87874
  chr20:54880314-54880344
  Hypo

SEQ ID NO: 119809 - DNA, 461 bp, Homo sapiens
  chr20:54918909-54919370
  Hyper
tgtttagctctgcagcgcccaagcctgatgaatttacgacaagcttccaaaaaaggcaattgcggcttgcggagggtctagaggctcagttgcccgaggctgtcttgaggagctgcctttgggactccgcgaaacctcgaagtcttgggctgcgcctccccttgcgcggtcggagccttggcagagcctgcggcgccacctcgtgggcgaggccgcctggtgcaaggtcatccggtgccgggacccgctcctcgccccgccaggacccccgctcacctccaagctggacgcccgcggagccctgatcccctaacgcccgcttccgaggccgagctctgcagccccctgcaaccatcagatccagattgccttcctgcacgagcgcgcaactctcagcctcggagcgtgctggaaatgctgatgggaaccgtttgaatgaccgggcacgggtctgcaagaaa

SEQ ID NO: 119810 - DNA, 17 bp, Homo sapiens
  chr20:55112759-55112776
  Hypo
tgcgtggctggagagaa

SEQ ID NO: 119811 - DNA, 3931 bp, Homo sapiens
  chr20:55199898-55203829
  Hyper
actgaagaagtcctacgtaccgcttgtcatatacatatgtaaagataatttaaaaccctagggtatacccttttcaaatgcagagtttatagtttccaaggggaggagggcaggggaggagtaaccaggacctttcctgccagtcttccaatcgcgatagctcgttttggctgtgaatttccccccttcccctccccctcccgttaattaaataaacgctggaagcgtgtgtttaccgcacacgactcggccctcggggaactctttttctacgtctctcctactcttaaactcctcaactcacagagggttggagagctggcaccatgagcttccagttcctacgggtgagaaaagaggtgtctgtgtggagggcaggtgcgaccccgggggctagcagagaggagaggctgcgggaggactcgctgcgaagggcgaggggtggcgctgggtgggacgggcgcctggggccgtgcagggtggctcctgggtgctgcccgggctgcctgtcgcccagtactggcgcaggaagacgggtccgcgcagcgtctggcaacagtggcctgctccacgcctggaggcgaccaagttctgagttaaaggcgccgggcttagccgggaagtgtatggcgacccagaacacggagcggagaaggcctcaggggacacgaggctaccgccttagtcctcgggcctgcgctccgagcggttagggtgcgtacggatgggctccgggatgttagtggagaggtgacaggagtctaccatcccacggccaagcgtgtgaggcctccggcgggcgggggtcccccccggggcagggcagggggagagtcaggcatgtctctaacgggctccctagtagaaccgctaggaaagtggccttcaaccctaggcacctttgtggctttcaggtagttgggcgactaaaaattcacttttgcctgctgtgaaatgggacaggtggttgtcaggttagagactgtgcccacgaagtctcgtttggcgggccgggactgacgtggacccgggccctcctcggaagcttgggaacctgtgagcccctcagctcctcgcctcactttgcctgtttgaaaaaaggagttgtttgagaggaagagttaaggctcaaaaggttctaaacgaagagcatgcggcctgacgcggagcgcaaagaagcgagcagtgaactgaatctggtgggactgagaccagaggcgtctgtatgcggcggccgcttcgcgccctattaaagcaatctgttatttacgataatcatttttgtaattattttggagtggctgtgacttgatgtctgtggtgccccagggcatgcccttactggacatagatacttcagggtgccctttgacgccagtgtcggtccagtgggtgccagtgccgcgaagggagggtggcgggcgtgaatgccccctcctcctgggtttgccgcaggccccggcctttccaccttgcttgatcctggcgggtctgccacttactgaggtccctaccggcgctcacgttgtcccgagaggcgggacaaacgtccggcgcgtggcgcggagtctgcgaaagcgctcgggggcctccatcttctgctcgggagtcccctccctggggcgggaagaggagtcgcagatctgcccgaatcttgctctacccgcctggccgccttcttccgtctggggtgggggcaggggtggcggatgactcaggcctggggccgggagccctgtttccaaaggcaccacctcgcgcctctttggaagtggcgcgctgttggggcgctcccgctgttgcagaggcctggtttgcggtttcataggggcgtgggtccagggcttccagggagtaagtgagtttaggctccctagggggcggtagaggggaacccccgacaaccttccatcctcttctccaggcggctgcgaggcctccggggttccagaggggtccccttctgccggtgccggctgtcttgagcgcggccacgcagtccgcgtcttcacgtgggcaaggggcggggacgttggagggaggctgtcttggatgctggagccttcggttcccggctctgctgagcagaaaagttgaagtcaaggaagggttgaggcttcctcacaagggcgcgcgcgtgcctgggtgccggcccagaagccgagaatgtgcgtattggggaagggtctcccgtgccgagaagacagaggatttgttctagctgccttccgtacagagggcgcggaggttgcgctccagttcgaacgcttacccattggaaagagggcagcgccggggtccagggaagctccttgggaatgaatggcctttgccaagcggttccggatcctctgggtcctttgggcccacggcacggtgctgcgcgagccctcagtgcccatcggctcccttcgcctcctgcgtagacgctcccaggcggggaggcatatcggttcctccgggcagctttggctagtgttgctgtgggaaaggagagccagggcctgggatgggggatgagcaccttcttgcccattccgggccccagcgtgcaggaggtaaacttgccagcacagacaagacagcttgttcaagctgcacctcaggccgggtcagagaataaaaccgagggctagaaggcccagaatgtcggacagcccagcggcacccgtcagggagtcccaggcgcccgaaagaggcgccgcacctctggcgagtctaggacccatcttcctggacctgtgctctggagtgcctgcgggcctgggtctaatttctgcttctggcaggtgtccccctcccccgccgctaataccaggagcgctgcttctgcggtaacttattttacccccagaagcctgttttgggaccgaagtgtcagggtcctgtgtgtctttttatgcactgttctccttagtgcaaagccctgcagatatgcttggccgaaaagtctcagtggtttcaacttccagattttgttcccgcgtccggtcggaaaatcacctgggatttggctgctgtctaaggccgggggaaagtttcccttggaggacgcctattattattattttcttttaggcccacctgggtctaaataaatgctaaagttcaaacgaacccgagaaggaacagcgaggcagtggatgccgccattccgtggatgggagagtcatgtctactgcaggtgcggacaccgtactgataggcattgattattgcaaaatcgtattcagtatcaaatagaaatagtcttgtcctctaatccccacagaatgtttaaatccagcccagggagccagttggggcgtcccaacaaatacgccctcgagaattagcgatgttccccttacaatgaaagtcaattgctgcataataactgggccaaagaatttcgttagtttaaattttaaaaattagtattgcactttgctttcaagtttgggtggcaagtaccgaaggggagagggaagcagcgtttgtgtggaaggaagtttcgttttctgtctaaacatgtgggacctgggtgtctacctctccagtcgagagctctctgcaggctctctcccaacttcctgcacctcctcaccctcaccttacccgtggcgctcgggttttattcctgcccggcgcttctttcccagggcgagtagaggcttctgagtgaccggcccgccagaggcagctgcagagccggcgttccgcagggcagggcagggccgggccgctgggctggtccagtgcgcgcgggttccccctggcctcagccagccgcgggagatgccacttcgggcgacagcggcgagacgccgctgtccgcaactcctgggcgggtaggaccgtctgctgcctctgcggcccttggggcagactccccaggagtcccttcctctctcctcccgcccgggggccgggaccgcgctgtgcccacgga

SEQ ID NO: 119812 - DNA, 984 bp, Homo sapiens; identical to SEQ ID NO: 87885
  chr20:55204104-55205088
  Hyper

SEQ ID NO: 119813 - DNA, 1152 bp, Homo sapiens
  chr20:55205304-55206456
  Hyper
cgggagcgcggagctcgggctacggactcgcgggagttcactgcgcctccgggccctggagggctgcccctgcccgcaggcccgggcgcttccgccaggaggcgacagcgccatgttcctccaggttcccggcgccccgagacccctgggcagatggggacgcatcctttagaaactgagtcgggccgcccaggggcgagggaacgtgcgcgggcaaggctgcccaatttccagggttcttcatgccccctctgcgccccgacgtgcgagaacactgcccttggcagtgcagggcgcccccacttattactcccctcggctgggcccggccagcagggagggccgccctgtgcgcgcgctccctcttcacttcccagggcggcgcagggtggcgggccctgctttccgagcgccgcccgctcggaggtctttgtcccgagggcgtggaagggagggtcccgggggcgggggaggtgcgcatttcccgcgccgcgcactctatccgcgcctgccgcgctgccacctccagcagtccctgcgtcatgggcgggctccacgagatagctctgcaccgggcgtccggctccttcgccccgggctctggctccttcgccccgggctccggccacggacttttctggcccaagacccagggttcggacttggcgcctccaagcgcctcgggcttgggagcagcgcctagaccttcgccgccgggctttgagaactcgttcccccaggtctttcaccagactctcctccctccccgcactctttgcttacaacgaaatcctcggggcgcattgcccccgggtaccttccgaccctgggcaagccccgccgggcggggtgcggttggtcccccggggccctctgcgtagcccggcgatgccggccagttcgcagtagcggggtttcgcactaacggggtctcctgtttttttttttccctccaggatcgccacgacgggagcagcaatgggaatccgcgggtcccccacctctcctccgccgggcagcacctctacagccccgcgccacccctctcccacactggagtcgccgaatatcagccgccaccctactttccccctccctaccagcagctggcctactcccagtcggccgacccctactcgcatctgggggaag

SEQ ID NO: 119814 - DNA, 77 bp, Homo sapiens; identical to SEQ ID NO: 87888
  chr20:55378966-55379043
  Hypo

SEQ ID NO: 119815 - DNA, 136 bp, Homo sapiens; identical to SEQ ID NO: 87889
  chr20:55379403-55379539
  Hypo

SEQ ID NO: 119816 - DNA, 135 bp, Homo sapiens; identical to SEQ ID NO: 87890
  chr20:55405254-55405389
  Hyper

SEQ ID NO: 119817 - DNA, 30 bp, Homo sapiens; identical to SEQ ID NO: 87891
  chr20:55405620-55405650
  Hyper

SEQ ID NO: 119818 - DNA, 1695 bp, Homo sapiens
  chr20:55499420-55501115
  Hyper
ttaaggagagtatcacgtttatactttaaaaagcccaactgctctgtttaaagtggatctttcataaacttgcagtcaggagcaacaatgacgtccttcagggagtcaaacactttggaaagaaacgcgaactgaaaatgctattggaggacgcaagaaaaccgaaaacgctcggtcgagtttttctgtcaagccacgtttgaaattaaggaattcgtgtaaattgccatctttcgcatccgaagcaagaaacgtacacagtttccctgctatacggagttgttgtgacataagaaaacagaatctttttaaacctcgagtttaattaattcttttttaaaaaagaatttagcagcagcatgttaaaagggaaaggggggggaacccgattagttccaaataagcgtctcttaatcacccttatgaaggcgtaatttgcaaaacactcctaggaagtaacatctttttcatttcaggggaaaaaaaaagtgcattgataaaaaataagtagaacattttaattaaaactcataaagttgtggacatctggttgggattgttcgccgcggcggtgattagcggatccgtgcacctagataatgaagcctggtcgcggttattggcagaagggcccgggcgcgctgtgagaacgctgcaggctcactttgtagtgcggggcctacgcctattagattccaatcagtttcgcctaaaaaggggaggagggcggagtgggaggggggcccagagttaaacacaggaaacaagcgttgagtgtgtgccaataaaaatggtcacaaatcagggctgctgatgtcataaccctgggggtcgggggtcagggggagtgaatgcgcctgaaagggaccgcctgtctgcggccggagcggcggcgggcgcggggggcgacggcgcgcacaatgggcccggagcgcctcattagagacgcgtttgatgcgctcccgtgccccacgggggccctgggcgatgtcaatgggataattacgatgatctaatggccggctcttttgcatgcaggcccgcctgaatggggcgcctggaggctgcattgaggccgggctgtgtaaactgtagggtgcctcgccgactcggagccgcagagactggcggcgggtcaacttggaccactttgcattcacgctttgaataggcggagcgggaggcgtcctttcccgcggccgcctttcagccgagagagtgacagattggaggtcagcggctggcgggacggaagccctcgccgggcagatggacccgctccgggccgcgccggggacccccgccccgcgcacaggcgtgtctacgcggacgggctccgagcgcacccgcgtgtgcgaggcgatgggcagccgcccgtctcccgatgcagccaagagaacggtggttttgcattttttccaaacctcttcttgtcttaatgacaagagtcaaaccgtctcgcgcttggctcccctcccggcacctgtgcgtttccccagaagccgacttggccccggccaagggcacccgcagagcagcccctaccctccaatattttgcaggaggggagaagaggaaaaagagaactggatatttgatatgtcgaaagaatgatcgatgatgaggctgcaccgtaggagcttgccggtctccgaccgctgctggcctgcgaagccggcacgtttacaaggctca

SEQ ID NO: 119819 - DNA, 87 bp, Homo sapiens; identical to SEQ ID NO: 87896
  chr20:55531782-55531869
  Hypo

SEQ ID NO: 119820 - DNA, 196 bp, Homo sapiens; identical to SEQ ID NO: 87897
  chr20:55532189-55532385
  Hyper

SEQ ID NO: 119821 - DNA, 30 bp, Homo sapiens; identical to SEQ ID NO: 87898
  chr20:55533555-55533585
  Hypo

SEQ ID NO: 119822 - DNA, 105 bp, Homo sapiens; identical to SEQ ID NO: 87899
  chr20:55588889-55588994
  Hyper

SEQ ID NO: 119823 - DNA, 430 bp, Homo sapiens; identical to SEQ ID NO: 87900
  chr20:55685373-55685803
  Hypo

SEQ ID NO: 119824 - DNA, 280 bp, Homo sapiens; identical to SEQ ID NO: 87901
  chr20:55693330-55693610
  Hypo

SEQ ID NO: 119825 - DNA, 30 bp, Homo sapiens; identical to SEQ ID NO: 87902
  chr20:55766158-55766188
  Hypo

SEQ ID NO: 119826 - DNA, 29 bp, Homo sapiens
  chr20:55772236-55772265
  Hypo
tgagccaccgcacccggccctaatttttt

SEQ ID NO: 119827 - DNA, 176 bp, Homo sapiens
  chr20:55839603-55839779
  Hyper
gccccaggctcgcgtcgccggggtcgtcgcggctccagtcggaaaccgggacccccagccgcccccgcggcgtcagctctgagatcccgcgcaacccaatcgccaaaacctgtggtttgcgcgccacacgtggtaaatgctgaaaatagattctgccggcccgggacctaccacta

SEQ ID NO: 119828 - DNA, 942 bp, Homo sapiens; identical to SEQ ID NO: 87906
  chr20:55840865-55841807
  Hyper

SEQ ID NO: 119829 - DNA, 393 bp, Homo sapiens
  chr20:55842040-55842433
  Hyper
aaggcttcctggaagcggtgacccttgagccggtcttgcccctcagtccctgtatccttttaagccagccacgctgacccctccgcgcctccctgaagccgttgccagcctgtctctgcgctcgccattccctccgcctggacctctccccactcaccacctcccgcccccatcagacgctgctttctcctcccagagacctccaagacctgccaagctgaggttgtttcctcgcctcgcccctcgcacgtttgttttctttcctgtagtttctcttgctgtctggaattgctgtttgagttactccgtgccttctttattgccttcttacccccgctagacacccagagcactggggcccggatcagcgatcttctccgcacctctggtacc

SEQ ID NO: 119830 - DNA, 30 bp, Homo sapiens; identical to SEQ ID NO: 87908
  chr20:55876620-55876650
  Hypo

SEQ ID NO: 119831 - DNA, 175 bp, Homo sapiens; identical to SEQ ID NO: 87909
  chr20:55925381-55925556
  Hypo

SEQ ID NO: 119832 - DNA, 206 bp, Homo sapiens; identical to SEQ ID NO: 87910
  chr20:55958990-55959196
  Hypo

SEQ ID NO: 119833 - DNA, 205 bp, Homo sapiens; identical to SEQ ID NO: 87911
  chr20:55959376-55959581
  Hypo

SEQ ID NO: 119834 - DNA, 42 bp, Homo sapiens; identical to SEQ ID NO: 87912
  chr20:55965005-55965047
  Hyper

SEQ ID NO: 119835 - DNA, 138 bp, Homo sapiens; identical to SEQ ID NO: 87913
  chr20:55969837-55969975
  Hypo

SEQ ID NO: 119836 - DNA, 30 bp, Homo sapiens; identical to SEQ ID NO: 87914
  chr20:55970272-55970302
  Hypo

SEQ ID NO: 119837 - DNA, 30 bp, Homo sapiens; identical to SEQ ID NO: 87915
  chr20:55983462-55983492
  Hypo

SEQ ID NO: 119838 - DNA, 35 bp, Homo sapiens; identical to SEQ ID NO: 46244
  chr20:55989687-55989722
  Hypo

SEQ ID NO: 119839 - DNA, 30 bp, Homo sapiens; identical to SEQ ID NO: 87917
  chr20:56027674-56027704
  Hypo

SEQ ID NO: 119840 - DNA, 51 bp, Homo sapiens; identical to SEQ ID NO: 87918
  chr20:56031247-56031298
  Hypo

SEQ ID NO: 119841 - DNA, 35 bp, Homo sapiens; identical to SEQ ID NO: 87919
  chr20:56041897-56041932
  Hypo

SEQ ID NO: 119842 - DNA, 23 bp, Homo sapiens
  chr20:56053945-56053968
  Hypo
gttatccaaattagccgggcacg

SEQ ID NO: 119843 - DNA, 30 bp, Homo sapiens; identical to SEQ ID NO: 46247
  chr20:56065208-56065238
  Hypo

SEQ ID NO: 119844 - DNA, 30 bp, Homo sapiens; identical to SEQ ID NO: 87922
  chr20:56066624-56066654
  Hypo

SEQ ID NO: 119845 - DNA, 30 bp, Homo sapiens; identical to SEQ ID NO: 87923
  chr20:56075973-56076003
  Hypo

SEQ ID NO: 119846 - DNA, 30 bp, Homo sapiens; identical to SEQ ID NO: 87924
  chr20:56155603-56155633
  Hypo

SEQ ID NO: 119847 - DNA, 63 bp, Homo sapiens; identical to SEQ ID NO: 87925
  chr20:56240406-56240469
  Hypo

SEQ ID NO: 119848 - DNA, 30 bp, Homo sapiens; identical to SEQ ID NO: 87926
  chr20:56245200-56245230
  Hypo

SEQ ID NO: 119849 - DNA, 46 bp, Homo sapiens; identical to SEQ ID NO: 87927
  chr20:56265981-56266027
  Hypo

SEQ ID NO: 119850 - DNA, 30 bp, Homo sapiens; identical to SEQ ID NO: 87928
  chr20:56267652-56267682
  Hypo

SEQ ID NO: 119851 - DNA, 308 bp, Homo sapiens; identical to SEQ ID NO: 87929
  chr20:56271495-56271803
  Hypo

SEQ ID NO: 119852 - DNA, 38 bp, Homo sapiens; identical to SEQ ID NO: 87930
  chr20:56272948-56272986
  Hypo

SEQ ID NO: 119853 - DNA, 30 bp, Homo sapiens; identical to SEQ ID NO: 87931
  chr20:56296686-56296716
  Hypo

SEQ ID NO: 119854 - DNA, 83 bp, Homo sapiens; identical to SEQ ID NO: 87932
  chr20:56385727-56385810
  Hypo

SEQ ID NO: 119855 - DNA, 36 bp, Homo sapiens
  chr20:56725904-56725940
  Hyper
gtgcagagccatttccgcctccgagtcctgcgttgc

SEQ ID NO: 119856 - DNA, 43 bp, Homo sapiens; identical to SEQ ID NO: 87935
  chr20:56766160-56766203
  Hypo

SEQ ID NO: 119857 - DNA, 68 bp, Homo sapiens; identical to SEQ ID NO: 87936
  chr20:56770989-56771057
  Hypo

SEQ ID NO: 119858 - DNA, 264 bp, Homo sapiens; identical to SEQ ID NO: 87937
  chr20:56771442-56771706
  Hypo

SEQ ID NO: 119859 - DNA, 305 bp, Homo sapiens; identical to SEQ ID NO: 46253
  chr20:56771994-56772299
  Hypo

SEQ ID NO: 119860 - DNA, 30 bp, Homo sapiens; identical to SEQ ID NO: 87939
  chr20:56780195-56780225
  Hypo

SEQ ID NO: 119861 - DNA, 513 bp, Homo sapiens; identical to SEQ ID NO: 87940
  chr20:56780438-56780951
  Hypo

SEQ ID NO: 119862 - DNA, 93 bp, Homo sapiens; identical to SEQ ID NO: 87941
  chr20:56781011-56781104
  Hypo

SEQ ID NO: 119863 - DNA, 819 bp, Homo sapiens; identical to SEQ ID NO: 87942
  chr20:56803306-56804125
  Hyper

SEQ ID NO: 119864 - DNA, 30 bp, Homo sapiens; identical to SEQ ID NO: 87943
  chr20:56821439-56821469
  Hypo

SEQ ID NO: 119865 - DNA, 74 bp, Homo sapiens; identical to SEQ ID NO: 87944
  chr20:56839596-56839670
  Hypo

SEQ ID NO: 119866 - DNA, 30 bp, Homo sapiens; identical to SEQ ID NO: 87945
  chr20:56947808-56947838
  Hypo

SEQ ID NO: 119867 - DNA, 30 bp, Homo sapiens; identical to SEQ ID NO: 87946
  chr20:57009545-57009575
  Hypo

SEQ ID NO: 119868 - DNA, 76 bp, Homo sapiens; identical to SEQ ID NO: 87947
  chr20:57041680-57041756
  Hypo

SEQ ID NO: 119869 - DNA, 33 bp, Homo sapiens; identical to SEQ ID NO: 87948
  chr20:57047499-57047532
  Hypo

SEQ ID NO: 119870 - DNA, 30 bp, Homo sapiens; identical to SEQ ID NO: 87949
  chr20:57056542-57056572
  Hyper

SEQ ID NO: 119871 - DNA, 768 bp, Homo sapiens
  chr20:57089405-57090173
  Hyper
cggtcccactgggcccggcacaaagggcagctctgggtacctacaggccaggccccgactggcgcagagagtgcagcggctctcatattgcgaggtgacgcgactccctcccgcaggccccaggaagctcctggaggcgcgcaggtgccggccaggtgagactggagaaaggcgcgcagggcgcagcatagcagccgcgtgggccgacccagggccgtagtccccaagggcccttaggggacattagacggcgagctccctcccttccgagctcagccagtttgccgggtgggggagggtggcacctacctcccaaaagcaccaggacgcaagcgtaggggagcatggctgcgggcatcccgtcggggctggcaggaccgcccgccgggcgctgccacggtgcgcaaggggaggcgcgggcgcagggctctcggacggctgcgggcgccggcggccaggctggagtcctgcgaagaagttgcgagggtcctgcgcccccctcggcgctcacacgcgctcagccttcccggctgttgatagttgtaagcggagctgcgcactcataggtccaacttgccagaagaggtggagacagcccccggcgaggcgcgcacacccgcgcagcgcgcacagccccctggtgcagctcctgccattcagacccccagccctcccccagatgtccgtcccctggccgtcgccttccccaaagtcttcgcagtgggcaaggaggcctcccccaagctctggtcccggccaaggcagagc

SEQ ID NO: 119872 - DNA, 47 bp, Homo sapiens; identical to SEQ ID NO: 87952
  chr20:57198958-57199005
  Hypo

SEQ ID NO: 119873 - DNA, 863 bp, Homo sapiens
  chr20:57224603-57225466
  Hyper
gctacgctaagcacacgggctccccgaatttccctccccagggcctctctgtctttggatggcctgtcagcaagtccctgcagcctccagcccggcccgcgcggcgacccagtcccctgtcgcccgaatcttccaccgctgcgaagcgtccccgggcgagcgccctgctctccgcgctgcgcggaagccagagccggtcctcacagtgaactcgcccagccctgctcgcggctctctcgattttatgtgggtttcgttggatgcattttgttatttgcctcaatggatgtttcacattaatttttagttgcacaacgaacgcgcgggaacattctccgtgagagaaaaagcacgggtggggggcggttaccggtgcttcccccggtcgcctgggggtcccgcacgcgccccgcgggtgccgctgtctggctggggtccctgggtgagccgcgggcaccggcttcgcgtctccccgggcgcgactccgctttgcaagcgctcagcacacgggaaaccctcggaaaacacacacgtgtgtaaagtttgttccacgcagaaacaaaggacgcgtgggggccgcttctggggcctcggtcctttgttggaaccccgcaccgcagcccggcccgcagcctcgccccgcaaggggaagccggccctgcacaggcccggggcccggaaggcgccgccgcacagctctgcgcccccgacccgctccggccgcgcgctgggccaggcccttggcctcaagcctcccgggcggctccgggccggacccgggtctccgtcgcgggacgccagcctgtttgtgggtgccgtgctcgggcccgggcggcccctgcccgacgcggccccacggagcc

SEQ ID NO: 119874 - DNA, 67 bp, Homo sapiens; identical to SEQ ID NO: 87955
  chr20:57268346-57268413
  Hyper

SEQ ID NO: 119875 - DNA, 131 bp, Homo sapiens; identical to SEQ ID NO: 87956
  chr20:57268845-57268976
  Hypo

SEQ ID NO: 119876 - DNA, 30 bp, Homo sapiens; identical to SEQ ID NO: 87958
  chr20:57385895-57385925
  Hypo

SEQ ID NO: 119877 - DNA, 149 bp, Homo sapiens; identical to SEQ ID NO: 87959
  chr20:57392258-57392407
  Hypo

SEQ ID NO: 119878 - DNA, 30 bp, Homo sapiens; identical to SEQ ID NO: 46260
  chr20:57398016-57398046
  Hypo

SEQ ID NO: 119879 - DNA, 30 bp, Homo sapiens; identical to SEQ ID NO: 87961
  chr20:57465637-57465667
  Hyper

SEQ ID NO: 119880 - DNA, 30 bp, Homo sapiens; identical to SEQ ID NO: 87962
  chr20:57541389-57541419
  Hypo

SEQ ID NO: 119881 - DNA, 30 bp, Homo sapiens; identical to SEQ ID NO: 87963
  chr20:57555048-57555078
  Hypo

SEQ ID NO: 119882 - DNA, 30 bp, Homo sapiens; identical to SEQ ID NO: 87964
  chr20:57616915-57616945
  Hypo

SEQ ID NO: 119883 - DNA, 76 bp, Homo sapiens; identical to SEQ ID NO: 46261
  chr20:57622769-57622845
  Hypo

SEQ ID NO: 119884 - DNA, 76 bp, Homo sapiens; identical to SEQ ID NO: 46262
  chr20:57622905-57622981
  Hypo

SEQ ID NO: 119885 - DNA, 41 bp, Homo sapiens; identical to SEQ ID NO: 87969
  chr20:57674658-57674699
  Hypo

SEQ ID NO: 119886 - DNA, 51 bp, Homo sapiens; identical to SEQ ID NO: 46263
  chr20:57699771-57699822
  Hypo

SEQ ID NO: 119887 - DNA, 40 bp, Homo sapiens; identical to SEQ ID NO: 87971
  chr20:57723438-57723478
  Hypo

SEQ ID NO: 119888 - DNA, 354 bp, Homo sapiens; identical to SEQ ID NO: 87972
  chr20:57767543-57767897
  Hypo

SEQ ID NO: 119889 - DNA, 348 bp, Homo sapiens; identical to SEQ ID NO: 87973
  chr20:57875541-57875889
  Hyper

SEQ ID NO: 119890 - DNA, 208 bp, Homo sapiens; identical to SEQ ID NO: 87974
  chr20:57929975-57930183
  Hypo

SEQ ID NO: 119891 - DNA, 30 bp, Homo sapiens; identical to SEQ ID NO: 87975
  chr20:57935754-57935784
  Hypo

SEQ ID NO: 119892 - DNA, 197 bp, Homo sapiens; identical to SEQ ID NO: 87976
  chr20:57966144-57966341
  Hypo

SEQ ID NO: 119893 - DNA, 55 bp, Homo sapiens; identical to SEQ ID NO: 87977
  chr20:57978786-57978841
  Hyper

SEQ ID NO: 119894 - DNA, 30 bp, Homo sapiens; identical to SEQ ID NO: 87978
  chr20:57994831-57994861
  Hypo

SEQ ID NO: 119895 - DNA, 30 bp, Homo sapiens; identical to SEQ ID NO: 87979
  chr20:58100780-58100810
  Hyper

SEQ ID NO: 119896 - DNA, 288 bp, Homo sapiens
  chr20:58152463-58152751
  Hyper
gccggcctcgcgtggcggcgccgcccccggccctggtcccggtcccgccccgccggcgcctccccgcggccccggctccgctccgcggccctccggcgggatgcgtggccgtggcggggggcgcgcccgctgtcctgcgcccctgcgctcgctgctgggcgccttcggggcccgggacgctgccgccgccgcccgagatcctgcgcaaggtaagcgcgcgctgcggggaggggacgcgggacgtggggcccggggtgcccgccgggcacgaggcgctgggggacgact

SEQ ID NO: 119897 - DNA, 283 bp, Homo sapiens; identical to SEQ ID NO: 87981
  chr20:58179128-58179411
  Hyper

SEQ ID NO: 119898 - DNA, 1010 bp, Homo sapiens
  chr20:58179702-58180712
  Hyper
cccctgccccaagcacgcaataaacactgacaagaaaaagtttttatttcctggttcaacttttttttttttccctggaatatagactgaagaatgggaataaacacgaataaataacaaagcgaggccgcgcacgccgggatgcgcctggctgcagccggcgaggctattgtctccccgccctgaagccagccccggcgtctttctccagctcgtttcctttcccggccttttttttttttttttttttttaattttcttttttaaaaagacgccccctccagccccctcgccggtgaccttggccgcctcggatgctctgattccacgcggctcgctctaacttgcccccgcgccggccgggcccatggccgcgtcggaggacgggagcggctgcctcgtgtcgcggggccgctcgcagagtgaccccagcgtcctcaccgactcctcggccacctcctccgcggacgccggggagaacccaggtaacgggctgggcgggggcggcgggcgggtcggggaggcccgaggcaggtggcgctgagagcaggaccccgcgaggctccgcgccccgcctgcattcggggagccgcggcaggaacccgcgctcggccccgcggttcctatccccagtctcgcagggctggggcgcctcggagccctttgtccataaaagagctgatttcctgggtagagccgggcgctgcagcttcccctcctctccggctggtgagctctgccgtcccctcgaaggaggcttcctttcctcgggtgctgaccggctgggggaagagaggcagacccgtggccgcctccgcccagcgccggttctgggccattccctccctccccactgccgggccccagctccggacgtccccgcttgggcatctgctcctggaaggcagcgctccgcagctgaggccaccgcgctgagggcttccaccaggcgcctgactccagcggggcctggcgcacctgggcgcgctagcccccggacaggtgtgctg

SEQ ID NO: 119899 - DNA, 197 bp, Homo sapiens; identical to SEQ ID NO: 46264
  chr20:58283870-58284067
  Hypo

SEQ ID NO: 119900 - DNA, 188 bp, Homo sapiens; identical to SEQ ID NO: 87987
  chr20:58311568-58311756
  Hypo

SEQ ID NO: 119901 - DNA, 56 bp, Homo sapiens; identical to SEQ ID NO: 87988
  chr20:58331425-58331481
  Hypo

SEQ ID NO: 119902 - DNA, 30 bp, Homo sapiens; identical to SEQ ID NO: 87989
  chr20:58333983-58334013
  Hypo

SEQ ID NO: 119903 - DNA, 101 bp, Homo sapiens; identical to SEQ ID NO: 87990
  chr20:58348371-58348472
  Hypo

SEQ ID NO: 119904 - DNA, 334 bp, Homo sapiens; identical to SEQ ID NO: 87991
  chr20:58507729-58508063
  Hypo

SEQ ID NO: 119905 - DNA, 214 bp, Homo sapiens; identical to SEQ ID NO: 87992
  chr20:58508688-58508902
  Hyper

SEQ ID NO: 119906 - DNA, 303 bp, Homo sapiens; identical to SEQ ID NO: 46268
  chr20:58514097-58514400
  Hypo

SEQ ID NO: 119907 - DNA, 119 bp, Homo sapiens; identical to SEQ ID NO: 87994
  chr20:58514726-58514845
  Hyper

SEQ ID NO: 119908 - DNA, 33 bp, Homo sapiens; identical to SEQ ID NO: 87995
  chr20:58530899-58530932
  Hypo

SEQ ID NO: 119909 - DNA, 30 bp, Homo sapiens; identical to SEQ ID NO: 87996
  chr20:58575987-58576017
  Hypo

SEQ ID NO: 119910 - DNA, 30 bp, Homo sapiens; identical to SEQ ID NO: 87997
  chr20:58584637-58584667
  Hypo

SEQ ID NO: 119911 - DNA, 177 bp, Homo sapiens; identical to SEQ ID NO: 87998
  chr20:58663181-58663358
  Hypo

SEQ ID NO: 119912 - DNA, 30 bp, Homo sapiens; identical to SEQ ID NO: 46269
  chr20:58671797-58671827
  Hypo

SEQ ID NO: 119913 - DNA, 139 bp, Homo sapiens; identical to SEQ ID NO: 88000
  chr20:58682833-58682972
  Hypo

SEQ ID NO: 119914 - DNA, 161 bp, Homo sapiens; identical to SEQ ID NO: 88001
  chr20:58779025-58779186
  Hypo

SEQ ID NO: 119915 - DNA, 30 bp, Homo sapiens; identical to SEQ ID NO: 88003
  chr20:58939020-58939050
  Hypo

SEQ ID NO: 119916 - DNA, 175 bp, Homo sapiens; identical to SEQ ID NO: 88004
  chr20:59005702-59005877
  Hypo

SEQ ID NO: 119917 - DNA, 30 bp, Homo sapiens; identical to SEQ ID NO: 88007
  chr20:59142135-59142165
  Hypo

SEQ ID NO: 119918 - DNA, 30 bp, Homo sapiens; identical to SEQ ID NO: 88008
  chr20:59174643-59174673
  Hypo

SEQ ID NO: 119919 - DNA, 31 bp, Homo sapiens; identical to SEQ ID NO: 46271
  chr20:59185805-59185836
  Hypo

SEQ ID NO: 119920 - DNA, 162 bp, Homo sapiens; identical to SEQ ID NO: 88010
  chr20:59198071-59198233
  Hypo

SEQ ID NO: 119921 - DNA, 193 bp, Homo sapiens; identical to SEQ ID NO: 88011
  chr20:59232938-59233131
  Hypo

SEQ ID NO: 119922 - DNA, 33 bp, Homo sapiens; identical to SEQ ID NO: 88013
  chr20:59443920-59443953
  Hypo

SEQ ID NO: 119923 - DNA, 30 bp, Homo sapiens; identical to SEQ ID NO: 88014
  chr20:59515105-59515135
  Hypo

SEQ ID NO: 119924 - DNA, 30 bp, Homo sapiens; identical to SEQ ID NO: 88015
  chr20:59553124-59553154
  Hypo

SEQ ID NO: 119925 - DNA, 30 bp, Homo sapiens; identical to SEQ ID NO: 88016
  chr20:59565753-59565783
  Hypo

SEQ ID NO: 119926 - DNA, 267 bp, Homo sapiens; identical to SEQ ID NO: 88017
  chr20:59598638-59598905
  Hypo

SEQ ID NO: 119927 - DNA, 19 bp, Homo sapiens
  chr20:59599221-59599240
  Hypo
cactcgcagggagcccccc

SEQ ID NO: 119928 - DNA, 43 bp, Homo sapiens; identical to SEQ ID NO: 88019
  chr20:59640929-59640972
  Hypo

SEQ ID NO: 119929 - DNA, 164 bp, Homo sapiens; identical to SEQ ID NO: 88020
  chr20:59643279-59643443
  Hypo

SEQ ID NO: 119930 - DNA, 185 bp, Homo sapiens; identical to SEQ ID NO: 46274
  chr20:59708146-59708331
  Hypo

SEQ ID NO: 119931 - DNA, 30 bp, Homo sapiens; identical to SEQ ID NO: 88022
  chr20:59715030-59715060
  Hypo

SEQ ID NO: 119932 - DNA, 215 bp, Homo sapiens; identical to SEQ ID NO: 88023
  chr20:59801639-59801854
  Hypo

SEQ ID NO: 119933 - DNA, 131 bp, Homo sapiens; identical to SEQ ID NO: 88024
  chr20:59804316-59804447
  Hyper

SEQ ID NO: 119934 - DNA, 94 bp, Homo sapiens; identical to SEQ ID NO: 46275
  chr20:59821803-59821897
  Hypo

SEQ ID NO: 119935 - DNA, 2397 bp, Homo sapiens
  chr20:59826877-59829274
  Hyper
cacccctgagctgcccgacctgggttcaagcccgggtcaggggagttagcaaggagacacctgaaaaataaaaggacagaatggaagtgcacactcccaccgcgggcccgggcgggaagtcggactaagaccgcggcgggaccgccccatccagaaagggtgccccgggtgtgggggcggaaaccccagcgctgtcttcagtctccacacccgcgcctttttcccctggaaaacgagcgtccttggcctcttcggccgcaaccgggcggctccagacgtccaggagggcagaggctgggctggtgcggcgcggggggcgcgggcgcgggctctgcgcctttaaggcccgcgtcggcagagcgagcgcaggggccgggcggcggggcggggcctcggcggggcggccgcggcttcacctgcagctccgagcgcgcggaacagaggcgcgggcggctgcgaggccggcggacgcaccggcccgagggaacgcgccgccggccggacttggcctggctcccggagccggggcggcgagcgcggcgggcgcagcggggctggaggctccgggcaggcgcgggggagcggcggcggcggcggcgatcggagcggcggcggtggtctcggcggcggcggcggcggcggcggcagggagcgggctcccggtgccgggcaccgggcgggcggcggggaagatgaccgcgggcgccggcgtgctccttctgctgctctcgctctccggcgcgctccgggtaagttgccgcctcccgcccccgccgttcggaagccccgggcagcgggaggtcgtccccggatcccgcggggcgctcacacacccggcggggctctcccgggctcccccgccgcgctccccgctgcatccagcccggcgcccgcgctcggcgaagctgcctgcggtcggcaggagcgggaagccgcctgggcagcggggagcggcggagcagggtgggagtggggctcggtggaggacccggggagctccgcctgcaccggacccgccgagcctccctcgaacgcccaaagcccgtagccgctacccggagctcggcttgcctgcatggggcaggcttccactggcggagccggcgcgccctccatcgcccgggagccgcgcgccgcgggagttgccgagcccagccccggccgtggctgaaggcgtggggcgcccggcggctgcgggccagggatccgcgagtgcggggcgcctgcccgacctctcctgcccaaggcctgggggtccgtctagcggcgccgctcagttctgtgggtgccggcaggacccgcgctgcgggtgggcggcggggtaggactgcggggcactctcacccccgagccctcggcggggctggagcctgcgtgtccggcggggccccgggggctgggagctgggccgggcttgggccgggaagccggacgccgggcgggcgcggcgcgggagggcgccccgggagggcgagcgggtctcccgctgcctctgcagagccccgcgggccggattgccagctttgctctgcgcctggcgaggtgcgcggcccgcgggggcagagagcgcggcggctccgggggcgcccctgggcggaggcggaggggcggcgggagttgcaggaaccccctctcgtggccgatcggcctcgctgccttctcccgggcagcgctgttgtaacctcggaaataaacaagtgccagcggcgggaggcccgctccgaggccgcggggcgctgggggacgcgctgggcacacgcttcgggcgggcggaaactttcctgggcgagttgagcctcccaccgggctgcgggtgcgatttggagcttcgtggccgatgaagaaagccgcggtttagagcttttcgtaaggaatgaccctgcgtcccgctctcctccctcggtgctgggggtagaggggcgccctccgcggtgccggcgtcgggaagcctggagctccgggctgggggcggcctccggagtcgaagcatgggcgggcgacggcagcgcgcggagctggaggaggcggcgggcgggaggcgccactgcccggtgcgggctgcacccgaggcttcctgcgctcgccggggagccaagcaccgctgtgctcctgctccttcagcggggctggcttcccgcttgcacacactgcctctccctccaccacctcctcctgcctgtcacgccccctcccagaagcttggtcggagggccctgtcgtccaccccatccttccctggccctgtgccatgggctctagacttccccactgagcaggaaaggcgagcgagctccggaggacaggaggagaccccctttccggtcagttaggggagccgtctccctgcctgggctggagatgggggctccgagggtgaaaatgcgggctgaagactag

SEQ ID NO: 119936 - DNA, 30 bp, Homo sapiens; identical to SEQ ID NO: 46276
  chr20:59855416-59855446
  Hypo

SEQ ID NO: 119937 - DNA, 182 bp, Homo sapiens; identical to SEQ ID NO: 88031
  chr20:59874095-59874277
  Hypo

SEQ ID NO: 119938 - DNA, 202 bp, Homo sapiens; identical to SEQ ID NO: 88032
  chr20:59880558-59880760
  Hypo

SEQ ID NO: 119939 - DNA, 88 bp, Homo sapiens; identical to SEQ ID NO: 88033
  chr20:59892038-59892126
  Hypo

SEQ ID NO: 119940 - DNA, 180 bp, Homo sapiens; identical to SEQ ID NO: 88034
  chr20:59910173-59910353
  Hypo

SEQ ID NO: 119941 - DNA, 30 bp, Homo sapiens; identical to SEQ ID NO: 88035
  chr20:59960789-59960819
  Hypo

SEQ ID NO: 119942 - DNA, 30 bp, Homo sapiens; identical to SEQ ID NO: 88036
  chr20:59967348-59967378
  Hypo

SEQ ID NO: 119943 - DNA, 50 bp, Homo sapiens; identical to SEQ ID NO: 88037
  chr20:59967982-59968032
  Hypo

SEQ ID NO: 119944 - DNA, 176 bp, Homo sapiens; identical to SEQ ID NO: 88038
  chr20:59971512-59971688
  Hypo

SEQ ID NO: 119945 - DNA, 30 bp, Homo sapiens; identical to SEQ ID NO: 88039
  chr20:59972407-59972437
  Hypo

SEQ ID NO: 119946 - DNA, 70 bp, Homo sapiens; identical to SEQ ID NO: 46279
  chr20:59973035-59973105
  Hypo

SEQ ID NO: 119947 - DNA, 138 bp, Homo sapiens; identical to SEQ ID NO: 88041
  chr20:59981017-59981155
  Hypo

SEQ ID NO: 119948 - DNA, 104 bp, Homo sapiens; identical to SEQ ID NO: 88042
  chr20:60000590-60000694
  Hypo

SEQ ID NO: 119949 - DNA, 145 bp, Homo sapiens; identical to SEQ ID NO: 88043
  chr20:60029813-60029958
  Hypo

SEQ ID NO: 119950 - DNA, 61 bp, Homo sapiens; identical to SEQ ID NO: 88044
  chr20:60055460-60055521
  Hypo

SEQ ID NO: 119951 - DNA, 176 bp, Homo sapiens; identical to SEQ ID NO: 88045
  chr20:60093092-60093268
  Hypo

SEQ ID NO: 119952 - DNA, 46 bp, Homo sapiens; identical to SEQ ID NO: 88046
  chr20:60098210-60098256
  Hypo

SEQ ID NO: 119953 - DNA, 30 bp, Homo sapiens; identical to SEQ ID NO: 88047
  chr20:60108382-60108412
  Hypo

SEQ ID NO: 119954 - DNA, 30 bp, Homo sapiens; identical to SEQ ID NO: 88048
  chr20:60114113-60114143
  Hypo

SEQ ID NO: 119955 - DNA, 78 bp, Homo sapiens; identical to SEQ ID NO: 88049
  chr20:60119581-60119659
  Hypo

SEQ ID NO: 119956 - DNA, 180 bp, Homo sapiens; identical to SEQ ID NO: 88050
  chr20:60120703-60120883
  Hypo

SEQ ID NO: 119957 - DNA, 30 bp, Homo sapiens; identical to SEQ ID NO: 46281
  chr20:60121193-60121223
  Hypo

SEQ ID NO: 119958 - DNA, 30 bp, Homo sapiens; identical to SEQ ID NO: 46282
  chr20:60122026-60122056
  Hypo

SEQ ID NO: 119959 - DNA, 30 bp, Homo sapiens; identical to SEQ ID NO: 88053
  chr20:60146355-60146385
  Hypo

SEQ ID NO: 119960 - DNA, 30 bp, Homo sapiens; identical to SEQ ID NO: 88054
  chr20:60154658-60154688
  Hypo

SEQ ID NO: 119961 - DNA, 30 bp, Homo sapiens; identical to SEQ ID NO: 88055
  chr20:60155641-60155671
  Hypo

SEQ ID NO: 119962 - DNA, 210 bp, Homo sapiens; identical to SEQ ID NO: 88056
  chr20:60162590-60162800
  Hypo

SEQ ID NO: 119963 - DNA, 188 bp, Homo sapiens; identical to SEQ ID NO: 88057
  chr20:60170770-60170958
  Hypo

SEQ ID NO: 119964 - DNA, 30 bp, Homo sapiens; identical to SEQ ID NO: 46284
  chr20:60174306-60174336
  Hypo

SEQ ID NO: 119965 - DNA, 173 bp, Homo sapiens; identical to SEQ ID NO: 88059
  chr20:60175455-60175628
  Hypo

SEQ ID NO: 119966 - DNA, 192 bp, Homo sapiens; identical to SEQ ID NO: 88060
  chr20:60176588-60176780
  Hypo

SEQ ID NO: 119967 - DNA, 30 bp, Homo sapiens; identical to SEQ ID NO: 88061
  chr20:60194960-60194990
  Hypo

SEQ ID NO: 119968 - DNA, 42 bp, Homo sapiens; identical to SEQ ID NO: 88062
  chr20:60202364-60202406
  Hypo

SEQ ID NO: 119969 - DNA, 30 bp, Homo sapiens; identical to SEQ ID NO: 16635
  chr20:60202615-60202645
  Hypo

SEQ ID NO: 119970 - DNA, 160 bp, Homo sapiens; identical to SEQ ID NO: 88064
  chr20:60210054-60210214
  Hypo

SEQ ID NO: 119971 - DNA, 174 bp, Homo sapiens; identical to SEQ ID NO: 88065
  chr20:60225024-60225198
  Hypo

SEQ ID NO: 119972 - DNA, 182 bp, Homo sapiens; identical to SEQ ID NO: 46291
  chr20:60227182-60227364
  Hypo

SEQ ID NO: 119973 - DNA, 378 bp, Homo sapiens; identical to SEQ ID NO: 88068
  chr20:60235329-60235707
  Hypo

SEQ ID NO: 119974 - DNA, 158 bp, Homo sapiens; identical to SEQ ID NO: 46293
  chr20:60237356-60237514
  Hypo

SEQ ID NO: 119975 - DNA, 205 bp, Homo sapiens; identical to SEQ ID NO: 88070
  chr20:60238291-60238496
  Hypo

SEQ ID NO: 119976 - DNA, 199 bp, Homo sapiens; identical to SEQ ID NO: 46295
  chr20:60238848-60239047
  Hypo

SEQ ID NO: 119977 - DNA, 190 bp, Homo sapiens; identical to SEQ ID NO: 88072
  chr20:60243944-60244134
  Hypo

SEQ ID NO: 119978 - DNA, 38 bp, Homo sapiens; identical to SEQ ID NO: 88073
  chr20:60261634-60261672
  Hypo

SEQ ID NO: 119979 - DNA, 192 bp, Homo sapiens; identical to SEQ ID NO: 88074
  chr20:60272958-60273150
  Hypo

SEQ ID NO: 119980 - DNA, 474 bp, Homo sapiens; identical to SEQ ID NO: 88075
  chr20:60281403-60281877
  Hypo

SEQ ID NO: 119981 - DNA, 52 bp, Homo sapiens; identical to SEQ ID NO: 88076
  chr20:60299388-60299440
  Hypo

SEQ ID NO: 119982 - DNA, 183 bp, Homo sapiens; identical to SEQ ID NO: 46299
  chr20:60304145-60304328
  Hypo

SEQ ID NO: 119983 - DNA, 30 bp, Homo sapiens; identical to SEQ ID NO: 88078
  chr20:60306675-60306705
  Hypo

SEQ ID NO: 119984 - DNA, 166 bp, Homo sapiens; identical to SEQ ID NO: 88079
  chr20:60312484-60312650
  Hypo

SEQ ID NO: 119985 - DNA, 77 bp, Homo sapiens; identical to SEQ ID NO: 88081
  chr20:60329584-60329661
  Hypo

SEQ ID NO: 119986 - DNA, 30 bp, Homo sapiens; identical to SEQ ID NO: 88083
  chr20:60334621-60334651
  Hypo

SEQ ID NO: 119987 - DNA, 25 bp, Homo sapiens
  chr20:60352677-60352702
  Hypo
gcatacaaaaacacacgtctacaca

SEQ ID NO: 119988 - DNA, 56 bp, Homo sapiens; identical to SEQ ID NO: 46301
  chr20:60355322-60355378
  Hypo

SEQ ID NO: 119989 - DNA, 130 bp, Homo sapiens; identical to SEQ ID NO: 46302
  chr20:60359749-60359879
  Hypo

SEQ ID NO: 119990 - DNA, 30 bp, Homo sapiens; identical to SEQ ID NO: 88087
  chr20:60373650-60373680
  Hypo

SEQ ID NO: 119991 - DNA, 468 bp, Homo sapiens; identical to SEQ ID NO: 88088
  chr20:60374909-60375377
  Hypo

SEQ ID NO: 119992 - DNA, 30 bp, Homo sapiens; identical to SEQ ID NO: 88089
  chr20:60377972-60378002
  Hypo

SEQ ID NO: 119993 - DNA, 30 bp, Homo sapiens; identical to SEQ ID NO: 88090
  chr20:60382783-60382813
  Hypo

SEQ ID NO: 119994 - DNA, 181 bp, Homo sapiens; identical to SEQ ID NO: 88091
  chr20:60385207-60385388
  Hypo

SEQ ID NO: 119995 - DNA, 30 bp, Homo sapiens; identical to SEQ ID NO: 88092
  chr20:60394427-60394457
  Hypo

SEQ ID NO: 119996 - DNA, 463 bp, Homo sapiens; identical to SEQ ID NO: 88093
  chr20:60415711-60416174
  Hypo

SEQ ID NO: 119997 - DNA, 72 bp, Homo sapiens; identical to SEQ ID NO: 46306
  chr20:60428149-60428221
  Hypo

SEQ ID NO: 119998 - DNA, 30 bp, Homo sapiens; identical to SEQ ID NO: 88095
  chr20:60433992-60434022
  Hypo

SEQ ID NO: 119999 - DNA, 30 bp, Homo sapiens; identical to SEQ ID NO: 88096
  chr20:60434822-60434852
  Hypo

SEQ ID NO: 120000 - DNA, 30 bp, Homo sapiens; identical to SEQ ID NO: 88097
  chr20:60436260-60436290
  Hypo

SEQ ID NO: 120001 - DNA, 249 bp, Homo sapiens; identical to SEQ ID NO: 88098
  chr20:60439571-60439820
  Hypo

SEQ ID NO: 120002 - DNA, 77 bp, Homo sapiens; identical to SEQ ID NO: 88099
  chr20:60447432-60447509
  Hypo

SEQ ID NO: 120003 - DNA, 297 bp, Homo sapiens; identical to SEQ ID NO: 88100
  chr20:60448654-60448951
  Hypo

SEQ ID NO: 120004 - DNA, 134 bp, Homo sapiens; identical to SEQ ID NO: 88101
  chr20:60449362-60449496
  Hypo

SEQ ID NO: 120005 - DNA, 168 bp, Homo sapiens; identical to SEQ ID NO: 88102
  chr20:60452936-60453104
  Hypo

SEQ ID NO: 120006 - DNA, 183 bp, Homo sapiens; identical to SEQ ID NO: 88103
  chr20:60453914-60454097
  Hypo

SEQ ID NO: 120007 - DNA, 201 bp, Homo sapiens; identical to SEQ ID NO: 88104
  chr20:60454704-60454905
  Hypo

SEQ ID NO: 120008 - DNA, 202 bp, Homo sapiens; identical to SEQ ID NO: 88105
  chr20:60457120-60457322
  Hypo

SEQ ID NO: 120009 - DNA, 193 bp, Homo sapiens; identical to SEQ ID NO: 88106
  chr20:60460819-60461012
  Hypo

SEQ ID NO: 120010 - DNA, 71 bp, Homo sapiens; identical to SEQ ID NO: 88107
  chr20:60470186-60470257
  Hypo

SEQ ID NO: 120011 - DNA, 30 bp, Homo sapiens; identical to SEQ ID NO: 88108
  chr20:60473115-60473145
  Hypo

SEQ ID NO: 120012 - DNA, 89 bp, Homo sapiens; identical to SEQ ID NO: 88109
  chr20:60476718-60476807
  Hypo

SEQ ID NO: 120013 - DNA, 273 bp, Homo sapiens; identical to SEQ ID NO: 88110
  chr20:60477306-60477579
  Hypo

SEQ ID NO: 120014 - DNA, 388 bp, Homo sapiens; identical to SEQ ID NO: 88111
  chr20:60485016-60485404
  Hypo

SEQ ID NO: 120015 - DNA, 44 bp, Homo sapiens; identical to SEQ ID NO: 88112
  chr20:60489317-60489361
  Hypo

SEQ ID NO: 120016 - DNA, 38 bp, Homo sapiens; identical to SEQ ID NO: 88113
  chr20:60492770-60492808
  Hypo

SEQ ID NO: 120017 - DNA, 30 bp, Homo sapiens; identical to SEQ ID NO: 88114
  chr20:60493093-60493123
  Hypo

SEQ ID NO: 120018 - DNA, 49 bp, Homo sapiens; identical to SEQ ID NO: 88115
  chr20:60495112-60495161
  Hypo

SEQ ID NO: 120019 - DNA, 35 bp, Homo sapiens; identical to SEQ ID NO: 88116
  chr20:60495405-60495440
  Hypo

SEQ ID NO: 120020 - DNA, 30 bp, Homo sapiens; identical to SEQ ID NO: 88117
  chr20:60497438-60497468
  Hypo

SEQ ID NO: 120021 - DNA, 112 bp, Homo sapiens; identical to SEQ ID NO: 88118
  chr20:60498996-60499108
  Hypo

SEQ ID NO: 120022 - DNA, 111 bp, Homo sapiens; identical to SEQ ID NO: 46318
  chr20:60502200-60502311
  Hypo

SEQ ID NO: 120023 - DNA, 474 bp, Homo sapiens; identical to SEQ ID NO: 88120
  chr20:60502586-60503060
  Hypo

SEQ ID NO: 120024 - DNA, 124 bp, Homo sapiens; identical to SEQ ID NO: 88121
  chr20:60508103-60508227
  Hypo

SEQ ID NO: 120025 - DNA, 82 bp, Homo sapiens; identical to SEQ ID NO: 88122
  chr20:60509238-60509320
  Hypo

SEQ ID NO: 120026 - DNA, 194 bp, Homo sapiens; identical to SEQ ID NO: 88123
  chr20:60515808-60516002
  Hypo

SEQ ID NO: 120027 - DNA, 101 bp, Homo sapiens; identical to SEQ ID NO: 88124
  chr20:60541029-60541130
  Hyper

SEQ ID NO: 120028 - DNA, 36 bp, Homo sapiens; identical to SEQ ID NO: 88125
  chr20:60543265-60543301
  Hypo

SEQ ID NO: 120029 - DNA, 53 bp, Homo sapiens; identical to SEQ ID NO: 88126
  chr20:60545005-60545058
  Hypo

SEQ ID NO: 120030 - DNA, 30 bp, Homo sapiens; identical to SEQ ID NO: 88127
  chr20:60545266-60545296
  Hypo

SEQ ID NO: 120031 - DNA, 272 bp, Homo sapiens; identical to SEQ ID NO: 88128
  chr20:60552065-60552337
  Hypo

SEQ ID NO: 120032 - DNA, 45 bp, Homo sapiens; identical to SEQ ID NO: 88129
  chr20:60559225-60559270
  Hypo

SEQ ID NO: 120033 - DNA, 114 bp, Homo sapiens; identical to SEQ ID NO: 88130
  chr20:60578759-60578873
  Hypo

SEQ ID NO: 120034 - DNA, 48 bp, Homo sapiens; identical to SEQ ID NO: 88131
  chr20:60587262-60587310
  Hypo

SEQ ID NO: 120035 - DNA, 39 bp, Homo sapiens; identical to SEQ ID NO: 88132
  chr20:60616133-60616172
  Hypo

SEQ ID NO: 120036 - DNA, 30 bp, Homo sapiens; identical to SEQ ID NO: 88133
  chr20:60620307-60620337
  Hypo

SEQ ID NO: 120037 - DNA, 45 bp, Homo sapiens; identical to SEQ ID NO: 88134
  chr20:60624858-60624903
  Hypo

SEQ ID NO: 120038 - DNA, 30 bp, Homo sapiens; identical to SEQ ID NO: 88135
  chr20:60635093-60635123
  Hypo

SEQ ID NO: 120039 - DNA, 30 bp, Homo sapiens; identical to SEQ ID NO: 88136
  chr20:60639275-60639305
  Hypo

SEQ ID NO: 120040 - DNA, 130 bp, Homo sapiens; identical to SEQ ID NO: 88137
  chr20:60662678-60662808
  Hypo

SEQ ID NO: 120041 - DNA, 32 bp, Homo sapiens; identical to SEQ ID NO: 88138
  chr20:60731152-60731184
  Hypo

SEQ ID NO: 120042 - DNA, 39 bp, Homo sapiens; identical to SEQ ID NO: 88139
  chr20:60756179-60756218
  Hypo

SEQ ID NO: 120043 - DNA, 22 bp, Homo sapiens
  chr20:60759136-60759158
  Hypo
gggcgcggtggctcacgcctgt

SEQ ID NO: 120044 - DNA, 47 bp, Homo sapiens; identical to SEQ ID NO: 88141
  chr20:60766706-60766753
  Hypo

SEQ ID NO: 120045 - DNA, 835 bp, Homo sapiens; identical to SEQ ID NO: 88142
  chr20:60772977-60773812
  Hypo

SEQ ID NO: 120046 - DNA, 278 bp, Homo sapiens; identical to SEQ ID NO: 88143
  chr20:60781289-60781567
  Hypo

SEQ ID NO: 120047 - DNA, 285 bp, Homo sapiens; identical to SEQ ID NO: 88144
  chr20:60789915-60790200
  Hypo

SEQ ID NO: 120048 - DNA, 345 bp, Homo sapiens; identical to SEQ ID NO: 88145
  chr20:60794701-60795046
  Hyper

SEQ ID NO: 120049 - DNA, 112 bp, Homo sapiens; identical to SEQ ID NO: 88146
  chr20:60795944-60796056
  Hyper

SEQ ID NO: 120050 - DNA, 47 bp, Homo sapiens; identical to SEQ ID NO: 88147
  chr20:60796491-60796538
  Hyper

SEQ ID NO: 120051 - DNA, 34 bp, Homo sapiens; identical to SEQ ID NO: 46327
  chr20:60803825-60803859
  Hypo

SEQ ID NO: 120052 - DNA, 27 bp, Homo sapiens
  chr20:60816241-60816268
  Hypo
tttgagatggagtctcgctctgtcgcc

SEQ ID NO: 120053 - DNA, 30 bp, Homo sapiens; identical to SEQ ID NO: 88150
  chr20:60816656-60816686
  Hypo

SEQ ID NO: 120054 - DNA, 30 bp, Homo sapiens; identical to SEQ ID NO: 88151
  chr20:60856371-60856401
  Hypo

SEQ ID NO: 120055 - DNA, 30 bp, Homo sapiens; identical to SEQ ID NO: 88152
  chr20:60856862-60856892
  Hypo

SEQ ID NO: 120056 - DNA, 30 bp, Homo sapiens; identical to SEQ ID NO: 88153
  chr20:60894037-60894067
  Hypo

SEQ ID NO: 120057 - DNA, 30 bp, Homo sapiens; identical to SEQ ID NO: 88154
  chr20:60903333-60903363
  Hypo

SEQ ID NO: 120058 - DNA, 59 bp, Homo sapiens; identical to SEQ ID NO: 88155
  chr20:60905951-60906010
  Hypo

SEQ ID NO: 120059 - DNA, 40 bp, Homo sapiens; identical to SEQ ID NO: 88156
  chr20:60909496-60909536
  Hypo

SEQ ID NO: 120060 - DNA, 153 bp, Homo sapiens; identical to SEQ ID NO: 88157
  chr20:60921151-60921304
  Hypo

SEQ ID NO: 120061 - DNA, 498 bp, Homo sapiens; identical to SEQ ID NO: 88158
  chr20:60921525-60922023
  Hypo

SEQ ID NO: 120062 - DNA, 154 bp, Homo sapiens; identical to SEQ ID NO: 88159
  chr20:60922248-60922402
  Hypo

SEQ ID NO: 120063 - DNA, 260 bp, Homo sapiens; identical to SEQ ID NO: 46332
  chr20:60925281-60925541
  Hypo

SEQ ID NO: 120064 - DNA, 224 bp, Homo sapiens; identical to SEQ ID NO: 88161
  chr20:60925825-60926049
  Hypo

SEQ ID NO: 120065 - DNA, 37 bp, Homo sapiens; identical to SEQ ID NO: 88162
  chr20:60943163-60943200
  Hyper

SEQ ID NO: 120066 - DNA, 30 bp, Homo sapiens; identical to SEQ ID NO: 88163
  chr20:60952466-60952496
  Hypo

SEQ ID NO: 120067 - DNA, 527 bp, Homo sapiens; identical to SEQ ID NO: 88164
  chr20:60953118-60953645
  Hypo

SEQ ID NO: 120068 - DNA, 180 bp, Homo sapiens; identical to SEQ ID NO: 88165
  chr20:60970803-60970983
  Hypo

SEQ ID NO: 120069 - DNA, 106 bp, Homo sapiens; identical to SEQ ID NO: 88166
  chr20:60976672-60976778
  Hypo

SEQ ID NO: 120070 - DNA, 67 bp, Homo sapiens; identical to SEQ ID NO: 88167
  chr20:60983219-60983286
  Hypo

SEQ ID NO: 120071 - DNA, 271 bp, Homo sapiens; identical to SEQ ID NO: 46336
  chr20:60983859-60984130
  Hypo

SEQ ID NO: 120072 - DNA, 80 bp, Homo sapiens; identical to SEQ ID NO: 88169
  chr20:60984435-60984515
  Hypo

SEQ ID NO: 120073 - DNA, 30 bp, Homo sapiens; identical to SEQ ID NO: 88170
  chr20:60986667-60986697
  Hypo

SEQ ID NO: 120074 - DNA, 103 bp, Homo sapiens; identical to SEQ ID NO: 88171
  chr20:60988390-60988493
  Hypo

SEQ ID NO: 120075 - DNA, 43 bp, Homo sapiens; identical to SEQ ID NO: 88172
  chr20:60992738-60992781
  Hypo

SEQ ID NO: 120076 - DNA, 30 bp, Homo sapiens; identical to SEQ ID NO: 88173
  chr20:61013248-61013278
  Hypo

SEQ ID NO: 120077 - DNA, 115 bp, Homo sapiens; identical to SEQ ID NO: 88174
  chr20:61020493-61020608
  Hypo

SEQ ID NO: 120078 - DNA, 30 bp, Homo sapiens; identical to SEQ ID NO: 88175
  chr20:61021131-61021161
  Hypo

SEQ ID NO: 120079 - DNA, 30 bp, Homo sapiens; identical to SEQ ID NO: 88177
  chr20:61270288-61270318
  Hypo

SEQ ID NO: 120080 - DNA, 30 bp, Homo sapiens; identical to SEQ ID NO: 88178
  chr20:61279729-61279759
  Hypo

SEQ ID NO: 120081 - DNA, 55 bp, Homo sapiens; identical to SEQ ID NO: 88179
  chr20:61284426-61284481
  Hypo

SEQ ID NO: 120082 - DNA, 575 bp, Homo sapiens; identical to SEQ ID NO: 88180
  chr20:61287982-61288557
  Hypo

SEQ ID NO: 120083 - DNA, 319 bp, Homo sapiens; identical to SEQ ID NO: 46339
  chr20:61291131-61291450
  Hypo

SEQ ID NO: 120084 - DNA, 135 bp, Homo sapiens; identical to SEQ ID NO: 88182
  chr20:61291658-61291793
  Hypo

SEQ ID NO: 120085 - DNA, 170 bp, Homo sapiens; identical to SEQ ID NO: 88183
  chr20:61292611-61292781
  Hypo

SEQ ID NO: 120086 - DNA, 373 bp, Homo sapiens; identical to SEQ ID NO: 88184
  chr20:61294499-61294872
  Hypo

SEQ ID NO: 120087 - DNA, 172 bp, Homo sapiens; identical to SEQ ID NO: 88185
  chr20:61299541-61299713
  Hypo

SEQ ID NO: 120088 - DNA, 427 bp, Homo sapiens; identical to SEQ ID NO: 88186
  chr20:61305557-61305984
  Hypo

SEQ ID NO: 120089 - DNA, 65 bp, Homo sapiens; identical to SEQ ID NO: 88187
  chr20:61312710-61312775
  Hypo

SEQ ID NO: 120090 - DNA, 458 bp, Homo sapiens; identical to SEQ ID NO: 88188
  chr20:61314248-61314706
  Hypo

SEQ ID NO: 120091 - DNA, 150 bp, Homo sapiens; identical to SEQ ID NO: 88189
  chr20:61318633-61318783
  Hypo

SEQ ID NO: 120092 - DNA, 108 bp, Homo sapiens; identical to SEQ ID NO: 88190
  chr20:61319024-61319132
  Hypo

SEQ ID NO: 120093 - DNA, 115 bp, Homo sapiens; identical to SEQ ID NO: 46346
  chr20:61321299-61321414
  Hypo

SEQ ID NO: 120094 - DNA, 182 bp, Homo sapiens; identical to SEQ ID NO: 88192
  chr20:61329166-61329348
  Hypo

SEQ ID NO: 120095 - DNA, 189 bp, Homo sapiens; identical to SEQ ID NO: 88193
  chr20:61330920-61331109
  Hypo

SEQ ID NO: 120096 - DNA, 1196 bp, Homo sapiens
  chr20:61339542-61340738
  Hyper
ttcacagaccaggcacgcccatgactgcggccagattttaaaaggaatcaccagaaatgtaatctccagtggtcctagagccccctgggcacccagcttctggcaccctgtggacacccaggagtgggggtcggcccaaccagctgcgcagccgcccagccctgccagcggggagcttcctccctccctgccctccggatacaccctcaccccaactgagcgagcccagggttgggggaggtgcatagttcccttcctagccggtgcgagaaattgcggagaacagggaagagggtggcaggaagggtctggtgcacgatacccgccgcgcccgctcggaatcctggttccctggagcgctcaccccagcccgccctgccccggggagcgcgagggggcgacccgccaggctgcacccgggcggggcggggatggcggcgggggctgcctccctcctccgccgccaccccccactgctgggcgcgccgcgcggccgccggctccgtggagacgcgcagagccgggagggcgcgggcgcggcgggaggtgtgcggggctggggtgcgcggagagcgcgagggaggagattctgagcgagggaggggagcgcgcccgggcagcagtgcgtgcgctcctcccggcgccacaagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcccgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcgggcaacgcgtcggagcgcgtcctggcggcacccagcagcgagctggacgtgaacaccgacat

SEQ ID NO: 120097 - DNA, 64 bp, Homo sapiens; identical to SEQ ID NO: 88196
  chr20:61364412-61364476
  Hypo

SEQ ID NO: 120098 - DNA, 30 bp, Homo sapiens; identical to SEQ ID NO: 46349
  chr20:61368079-61368109
  Hypo

SEQ ID NO: 120099 - DNA, 190 bp, Homo sapiens; identical to SEQ ID NO: 88198
  chr20:61374409-61374599
  Hypo

SEQ ID NO: 120100 - DNA, 285 bp, Homo sapiens; identical to SEQ ID NO: 88199
  chr20:61393765-61394050
  Hypo

SEQ ID NO: 120101 - DNA, 22 bp, Homo sapiens
  chr20:61411096-61411118
  Hypo
agttagaaagctcttcgttgtg

SEQ ID NO: 120102 - DNA, 168 bp, Homo sapiens; identical to SEQ ID NO: 88201
  chr20:61412187-61412355
  Hypo

SEQ ID NO: 120103 - DNA, 413 bp, Homo sapiens; identical to SEQ ID NO: 88202
  chr20:61415908-61416321
  Hypo

SEQ ID NO: 120104 - DNA, 136 bp, Homo sapiens; identical to SEQ ID NO: 88203
  chr20:61424061-61424197
  Hypo

SEQ ID NO: 120105 - DNA, 388 bp, Homo sapiens; identical to SEQ ID NO: 88204
  chr20:61424743-61425131
  Hypo

SEQ ID NO: 120106 - DNA, 93 bp, Homo sapiens; identical to SEQ ID NO: 88205
  chr20:61447670-61447763
  Hyper

SEQ ID NO: 120107 - DNA, 680 bp, Homo sapiens; identical to SEQ ID NO: 88206
  chr20:61448109-61448789
  Hyper

SEQ ID NO: 120108 - DNA, 30 bp, Homo sapiens; identical to SEQ ID NO: 88207
  chr20:61452912-61452942
  Hypo

SEQ ID NO: 120109 - DNA, 30 bp, Homo sapiens; identical to SEQ ID NO: 88208
  chr20:61460276-61460306
  Hypo

SEQ ID NO: 120110 - DNA, 30 bp, Homo sapiens; identical to SEQ ID NO: 88209
  chr20:61462692-61462722
  Hypo

SEQ ID NO: 120111 - DNA, 30 bp, Homo sapiens; identical to SEQ ID NO: 88210
  chr20:61466999-61467029
  Hypo

SEQ ID NO: 120112 - DNA, 290 bp, Homo sapiens; identical to SEQ ID NO: 88211
  chr20:61471909-61472199
  Hypo

SEQ ID NO: 120113 - DNA, 685 bp, Homo sapiens; identical to SEQ ID NO: 46356
  chr20:61505851-61506536
  Hypo

SEQ ID NO: 120114 - DNA, 30 bp, Homo sapiens; identical to SEQ ID NO: 88213
  chr20:61527484-61527514
  Hypo

SEQ ID NO: 120115 - DNA, 30 bp, Homo sapiens; identical to SEQ ID NO: 88214
  chr20:61527715-61527745
  Hypo

SEQ ID NO: 120116 - DNA, 120 bp, Homo sapiens; identical to SEQ ID NO: 88215
  chr20:61528027-61528147
  Hypo

SEQ ID NO: 120117 - DNA, 265 bp, Homo sapiens; identical to SEQ ID NO: 88216
  chr20:61532464-61532729
  Hypo

SEQ ID NO: 120118 - DNA, 69 bp, Homo sapiens; identical to SEQ ID NO: 88217
  chr20:61541112-61541181
  Hypo

SEQ ID NO: 120119 - DNA, 30 bp, Homo sapiens; identical to SEQ ID NO: 88218
  chr20:61559777-61559807
  Hyper

SEQ ID NO: 120120 - DNA, 682 bp, Homo sapiens
  chr20:61560285-61560967
  Hyper
tttgaaagtacaatccggaaaactcagcaattcttaaaaaaaaatggctttccgctgttataagcctccttcctaagactcagggtccgcagcagaataccctgacccaaaataaaaatactatgacaaaaatactccaggaggcagccggctttacttcgtttaaagccggatttcgcttagtcccgtgaaagcgaaggagcaccagcgcttcctgattccgcacagttctctcggcagagacggcccgtcctctccaagaaccggaagccggacagcgtcaggacgttttattcttctcacctgggattcagagaggcagcggccaaggacagggcccccgccgaggccaccgggcagcgtccaggtctcggcctttgggaggggagcagcgggggaggggcacggggaggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcgtgtctgtgccaggccccccacgctgtgctccagggcctcagtgcccggcgcgccgggggctgtatcgccagccacttggg

SEQ ID NO: 120121 - DNA, 92 bp, Homo sapiens; identical to SEQ ID NO: 88221
  chr20:61567398-61567490
  Hypo

SEQ ID NO: 120122 - DNA, 348 bp, Homo sapiens; identical to SEQ ID NO: 88222
  chr20:61570543-61570891
  Hypo

SEQ ID NO: 120123 - DNA, 30 bp, Homo sapiens; identical to SEQ ID NO: 46360
  chr20:61571213-61571243
  Hypo

SEQ ID NO: 120124 - DNA, 30 bp, Homo sapiens; identical to SEQ ID NO: 88224
  chr20:61583985-61584015
  Hyper

SEQ ID NO: 120125 - DNA, 448 bp, Homo sapiens
  chr20:61585299-61585747
  Hyper
ttcatccaggcctgccgggcagggccagctccccagggattcagggcctcctcactggcggctggtttgagtggctccgccttcactacgtccctcccaggctcgatgtttaaaaaggagcccttgccgcagccttcactacgtccctcccaggctcgatgtttaaaaaggagcccttgccgcagccttcactacgtccctcccaggctcgatgtttaaaaaggagcccttgccacagctcttcaacttcctttgcaggcccttattgggtagcgccaaggattctggaggggcctgtgggtcaaggctgccacacgcacgccttttcctagcccgccctcctgcagccacatcacaaaggctgggccaggcgagaacagagctggagggcggcacccacactctccggtttgctgctcgcctggcccggccccgcacagttcccttt

SEQ ID NO: 120126 - DNA, 30 bp, Homo sapiens
  chr20:61585974-61586004
  Hyper
caggcctcaggtagccgactgtctgggcca

SEQ ID NO: 120127 - DNA, 80 bp, Homo sapiens; identical to SEQ ID NO: 88226
  chr20:61618954-61619034
  Hypo

SEQ ID NO: 120128 - DNA, 2317 bp, Homo sapiens
  chr20:61636751-61639068
  Hyper
ggaaaaggccttccccggggtcttcctgcgcccgcggtccagctcctctgcagacggccatcgtgggctctccgcagggctgcggagtctcggagtcaccgaggtgggaggtgccggccacgcgcgtcctcaggaacagagcactgccctgcagtttagcacgaagggccggctggagcgggagcgcgaggcccactgcaagaggatcaggagccagtaagtccggcttttcttcgtctccacctttcgtgcgcccggggccaggaccgcctgtccggaatctgaccagtgcccgtcctcgccgtggccctgggaccccgcggtggtcttcttttggggacgaacggcagtgcccgaaggatgctctacccacccccgttcctagacttgctgggtcccgacaatacccagtgggtgccgcgagttcccgggcgcagagtccagcgtccggctctcgagctcaatcccgcgccccgacggccttggcgcttcccgctgcgctaaactgtccaccgcgcacaggctggaagcgaagtcgggccccctcctcctggtctgcagggtccctccaggcctttcctgtccgggcagagagacagtcacaggggcgatcggaggacgcgtgcgggagggccgggggcccgcgcggtcacggcttctcgtgacagtgtttgcaaagcgcggagggcgtcccggagaaggcggcgcacttgtcagggcagggccccagggcggcgcctgcggagaaggggcacacagtggcctggccgaagggcgtcaagggcgcggcgtttacgggcgcggccaggccctggccctggttgaggaaggccaccaggcgccgcatctcgtccagggcctgcgcctgcatgaggatatagttcttggcgagcagcagcgtggcgatcttggagagcttgcgcaccgacgggctgtgcgcgtaggggatgacggctcgcagcccgtccagcgcgtcgtttaggtcgtgcatgcgccgccgctcgcgcgcgttgatgctgagccgcagagaccgctgctctcgcggccgccgccgcccgtccgccgcgctccctggcccgcgccgccgccgccgctgctcgaaggcgtcgtcctcgtccccgctctgttcgccgctgctctccgccgcctgagctggggcgcgaggtgcaggcgccgcggggaggtcgccgcccgggcccggagtgccgtagccgcgggccgcttcgggttctcgcgccgccccgtaggcgagacccgcagccgccgccgcgtagccgtggcttagtgccaggtacgcgtcccccgacagcgacttgagctcggccatggccgcgccgcctgggctcgggggctcgccgggtgggcggatgctcatgtgggtgagcagcccccgaggccggcccgagcccgccgctgccgctgccgctgcgatgaggctcccggctctgcgcgtcggtctggcttgcctgcgggtcccagagcctcggcgcccgctgcctcctccgcctcttccttctctcccacctcctctccctcccagccgcgacgcgcagggggcgggctctacctccccctcgcccccgcttcggttttaagccgcggaggcgcccggtgggacctcgctgctgtccaatcaggggggaccgggtgagctcctcttcctggagccgggctccaccagcgccgcaggctcacaggccgggggtgggggctctggaccgaggggcggcgcggggcggcgcggggcggcgcgcgcggtcctggagcgctagtacttgcttctcgactccccggccgccgcctccggccgccccggggattccgccaccaaacgcacgcgtcccaggtgggcacccgcctcggtccgtctttgagtctgaccctagcgcaagagtccctggcgacacgcaggggccagagcgggggggcgcgccgcaatagcagcagcgccagcgccaacaccctgtcccgctgaggggccgcttcgggtcggggtcagggtcgtgggcgctctggtgcagccgcggcgcagcgtgtacccggagcccgcacactccctgctcggggcgccctgtggccaggcttgaggggcagagtgagagggagtttctagaacctgttgaaaaacgccacgagcgttgcaggccggggagggcgggaaggtggagggcagcgcggcctggggctccccgggggtgggaggggagctctgtgagctgcaggaccgcctcttccctgccagccgcttcctgggcatctatcagcgaaacgcgtgaggcttggtgggctttcccggagcctccgaacccctggggtc

SEQ ID NO: 120129 - DNA, 78 bp, Homo sapiens; identical to SEQ ID NO: 88234
  chr20:61650430-61650508
  Hypo

SEQ ID NO: 120130 - DNA, 420 bp, Homo sapiens; identical to SEQ ID NO: 88235
  chr20:61655406-61655826
  Hypo

SEQ ID NO: 120131 - DNA, 23 bp, Homo sapiens
  chr20:61662281-61662304
  Hypo
agtcagtgctggggccgggcgcg

SEQ ID NO: 120132 - DNA, 124 bp, Homo sapiens; identical to SEQ ID NO: 88237
  chr20:61664446-61664570
  Hyper

SEQ ID NO: 120133 - DNA, 113 bp, Homo sapiens; identical to SEQ ID NO: 88238
  chr20:61665862-61665975
  Hypo

SEQ ID NO: 120134 - DNA, 45 bp, Homo sapiens; identical to SEQ ID NO: 88239
  chr20:61666827-61666872
  Hypo

SEQ ID NO: 120135 - DNA, 59 bp, Homo sapiens; identical to SEQ ID NO: 88240
  chr20:61674697-61674756
  Hypo

SEQ ID NO: 120136 - DNA, 376 bp, Homo sapiens; identical to SEQ ID NO: 88241
  chr20:61675324-61675700
  Hypo

SEQ ID NO: 120137 - DNA, 30 bp, Homo sapiens; identical to SEQ ID NO: 88242
  chr20:61676232-61676262
  Hypo

SEQ ID NO: 120138 - DNA, 30 bp, Homo sapiens; identical to SEQ ID NO: 88243
  chr20:61677586-61677616
  Hypo

SEQ ID NO: 120139 - DNA, 50 bp, Homo sapiens; identical to SEQ ID NO: 88244
  chr20:61681372-61681422
  Hypo

SEQ ID NO: 120140 - DNA, 30 bp, Homo sapiens; identical to SEQ ID NO: 88245
  chr20:61683138-61683168
  Hypo

SEQ ID NO: 120141 - DNA, 321 bp, Homo sapiens; identical to SEQ ID NO: 88246
  chr20:61695617-61695938
  Hypo

SEQ ID NO: 120142 - DNA, 807 bp, Homo sapiens
  chr20:61703300-61704107
  Hyper
cccactctaaggacccgctcctccccgcccccgcccccaaagccgctcctctcacggcccccgaccccgcaggcaccgactgttctcagccccgcccctcgaggccccgccccgcggcttcccgccggggattgcggctgcgcctctgaccctccgctccgggctccgggctcaggtcccacacctgcccgcgcccccaggccccgccgtcccccagagcctgcagcgggcgccgcgcaggccgccgggctcctccgggtgggccgggctcgggcttttggagccgcgcgcccaccgacccctcccacgggcggcggggggagagcccacccagaggcgcagcggggccggtggtgtttcccgccctcccagggggccgcgggtccgggggcagcagcggggcgcggggcggagggaggcccggcgggaacgggcgccccctttgcacccacagccgtggaacgccgaggtctcagctcccctacggcgcgcgccccgagaccccgcaagggcagtgctggggacgcggggccgagactcgaggacgcccgaggccgggacggggtgtgggggcgtcccccaggctcccgggtcccagtgcaggggctcgcggtcaggaggttaggtggatgagtgaaggggaaaagcgcggttctagctgcctgctcaggcttggggcgatgtgaacgtcggggtttgcccctcgaccccccaccagaacgcagatacttctcagcaaagaggagcttggggcagcccactccccacagaggaagggaggggcccgctccacggaggacctggggg

SEQ ID NO: 120143 - DNA, 201 bp, Homo sapiens; identical to SEQ ID NO: 88250
  chr20:61714761-61714962
  Hypo

SEQ ID NO: 120144 - DNA, 199 bp, Homo sapiens; identical to SEQ ID NO: 88251
  chr20:61725248-61725447
  Hypo

SEQ ID NO: 120145 - DNA, 1274 bp, Homo sapiens
  chr20:61733260-61734534
  Hyper
cctgagtgtcccctgcgtgggttagtgtgtgcgcccgcccggtgccctccgtcttgggagtctgggctgctgctccgcgggctctggagccggcgctccccacgagcccggactctccgccgcgcccgggagctgcgcaatcggctgctaagacgccggcgccaccggctgggccctgttctcccctctcttttctacagtcttacccgcagctgacagggttcgaaagagcatgaaacggaggagacgttacagcaacgtgtcagctgaaatgatgggcgtagacgcacgtcagcggcggaaatggtttctatcaaaatgaaagtgtttagagattttcctcaagtttcaaatgaggcgaatcccgttttccgcgatgctgcagcgcgcgggttttaaccgcagggtcacgcggaacgccgcgccgcgcgactgtgcctcggtctctgcgcccggctctccctccggtccgcaagaggaggaaggcccgcggcgtgccgaggtcagcggcgcggagccaccaggcgagacggtcacggacgcctgaaccgaggtcaccgaggccacggggccgggaggccctcagcagagcccgggggctccgcacctcaaggccggccaggaagaaacagcagcaggagcccagggcgccccggggagcccccgacacgcgggccgagcgcccagagcggcccaggccctcgcgaggagaccggcctccccagggcggggcttccgactcgggcgcccgtgagccccggaggcggcgcgaaggggcagagtccgcgtttctaaccagcccccgggtgggcggtggcccgcgcggcacggtgggcgcgagcgccgtgggctggggccggcctgggctttcagggcgagggctttccgcgccggccccagcccacccggccccgctgcgcgcccctcacgctgcagcctgggaacctgggccgggagctgcgggccgctccggggaagcgggcctgacctcccctccccaccgccgcccctgcggtgagatcctgcctgccggggcgcaggggcccgcggttgggctccgggagacggaagaggccccacagctcgggccccacgcagtggacgctgccacttaattttggcgtaattgatgtcaaggcgggtgcccgggcccccagtgaaatgcctcatgaactcgctgcgaggaacggcgctccacgcggtgcacggtggccaatcagagctgccgcttctgatggaggctgagccggctggggaggcgtcttggccaagaa

SEQ ID NO: 120146 - DNA, 208 bp, Homo sapiens; identical to SEQ ID NO: 38267
  chr20:61747797-61748005
  Hyper

SEQ ID NO: 120147 - DNA, 139 bp, Homo sapiens; identical to SEQ ID NO: 88255
  chr20:61748817-61748956
  Hypo

SEQ ID NO: 120148 - DNA, 181 bp, Homo sapiens; identical to SEQ ID NO: 88256
  chr20:61749739-61749920
  Hypo

SEQ ID NO: 120149 - DNA, 204 bp, Homo sapiens; identical to SEQ ID NO: 88257
  chr20:61751588-61751792
  Hypo

SEQ ID NO: 120150 - DNA, 59 bp, Homo sapiens; identical to SEQ ID NO: 88258
  chr20:61753309-61753368
  Hypo

SEQ ID NO: 120151 - DNA, 189 bp, Homo sapiens; identical to SEQ ID NO: 88259
  chr20:61763539-61763728
  Hypo

SEQ ID NO: 120152 - DNA, 84 bp, Homo sapiens; identical to SEQ ID NO: 88260
  chr20:61764128-61764212
  Hypo

SEQ ID NO: 120153 - DNA, 73 bp, Homo sapiens; identical to SEQ ID NO: 88261
  chr20:61765333-61765406
  Hypo

SEQ ID NO: 120154 - DNA, 45 bp, Homo sapiens; identical to SEQ ID NO: 88262
  chr20:61765608-61765653
  Hypo

SEQ ID NO: 120155 - DNA, 31 bp, Homo sapiens; identical to SEQ ID NO: 88263
  chr20:61767248-61767279
  Hypo

SEQ ID NO: 120156 - DNA, 30 bp, Homo sapiens; identical to SEQ ID NO: 88264
  chr20:61771384-61771414
  Hypo

SEQ ID NO: 120157 - DNA, 30 bp, Homo sapiens; identical to SEQ ID NO: 88265
  chr20:61772713-61772743
  Hypo

SEQ ID NO: 120158 - DNA, 30 bp, Homo sapiens; identical to SEQ ID NO: 88266
  chr20:61782559-61782589
  Hypo

SEQ ID NO: 120159 - DNA, 39 bp, Homo sapiens; identical to SEQ ID NO: 88267
  chr20:61790599-61790638
  Hypo

SEQ ID NO: 120160 - DNA, 30 bp, Homo sapiens; identical to SEQ ID NO: 88268
  chr20:61798362-61798392
  Hypo

SEQ ID NO: 120161 - DNA, 61 bp, Homo sapiens; identical to SEQ ID NO: 88269
  chr20:61799802-61799863
  Hypo

SEQ ID NO: 120162 - DNA, 565 bp, Homo sapiens; identical to SEQ ID NO: 88270
  chr20:61806408-61806973
  Hyper

SEQ ID NO: 120163 - DNA, 352 bp, Homo sapiens; identical to SEQ ID NO: 88271
  chr20:61807183-61807535
  Hyper

SEQ ID NO: 120164 - DNA, 2535 bp, Homo sapiens
  chr20:61807775-61810310
  Hyper
gacacttgcgaagggcgaggaattgcggctgggaagggtcaggttgaagccgcaccaaagggggaggggcgtcctgatggttgaggaccggcggagtcggtgcgggcagaaccaacccgagttcctgccgcccttcctaaccggctgtccatgggctgggcagtgctggagagggtggaaaaggaaggaagcaggacctgctcccagggaggcccaggctctgctccgagggcagatggcgcaggggctgggttggccctaggaggaaggagatggggacagaggcctgccggccgcgccggcctgcgctccttgcagtctaaacaaaggccagcgggggaggctccggacggtgaggcttggggaagccactgatccctggccctagagggccagatcgggggcgccccaaggaccctatcgagctggcagtgactgcagtcgggccgtggagtgtcgcctgtgattccgtggtccctacgggcaagagctcccatcccggtctgaaactgtgagaaccgcaagctccgatgggggcggggaaggacgacctttaattcccaccccactgtacggagcccagcagggccatccgcaggaggccggcgggacccttgcctttctcaggactgagaggcttggaggaccgcggtgtgagctgcgcggcagagtgcgttctgcaggcgccagacaggagacgcgaacccgcggtcagggcccgagtgcgggtgcgtgtctgcgggtgccgctgggctgcgtgccggcgaggcgtgcgcgtggcgaggcgtgcgcgtggcggggtgtggctagaggtgtcaatgtgcagctggaggggctgcgcgcgtgggtgcaggagggccatgtgaggggctggagtgtgtgggagacaggcgtttccttgggtctccgtgtggccgccgggcgcagggcacggtcgagggcgctcgatggctgagtccgcgtgagccgaggagcgcgcggggcgggacgcggtgcgaatgcgcgggaggcacgaggcgcgcagtgcgtgtgtgcgcgtgtgcgcggcgcgcgtgccccgcagttctcaaggacacctcggggaggcagcggcggggccggtgtccgggtgacgtcaccgcgcgccccagtgataatcggccggtgccggagcggagcgcggatacgcgcggaggcaacggcgacggcggcggcggcggcgggcgcggggacagttgcatcggggccgggccgggctagcaggagctgggcgcctgcagcgtggaccccgtggacactcggctcgcagccggcctgcggcgctcggggacttgcctggctcccttctcggggttcccgcgcccttctccgcccagggcagcagcgcgcggggcccccgggagccgaagagcaggcgggaactggcggcggcgcgggaggcgcagggagcggaggcggcagcagcggctcccgccgggactggtaattacgctcggggccgggccggggcgagccgggcaagcggcctctctgggtctccccgtctttctctccacgaacagctcgagcgccttctcgcgggcccgctgcgcgcggagaggacgagctcgctgggttgtaaaaagagacgagttttcatctttgagcatcgagattcgttcttttaaccgcattcggtgcgcgctcctgggtcggcacgggcagggcgacggcaggggaaggcagctgcggaggagctcgcgccgcccagtcggagcggttctgcgcccctcggagccccgcgggaggcggccgggtgcgcacgcgctcaccacccccacccccggaatccgtcttcgcgattcccgggcgccccagctccaggaacgcccggagggacgcacttgggggcccactctctgccgcggaaaggggagaagtgtgggctcctccgagtcgggggcggactgggacagcacagtcggctgagcgcagcgcccccgccctgcccgccacgcggcgaagacgcctgagcgttcgcgcccctcgggcgaggaccccacgcaagcccgagccggtcccgaccctggccccgacgctcgccgcccgccccagccctgagggcccctctgcgtgttcacagcggaccttgatttaatgtctatacaattaaggcacgcggtgaatgccaagagaggcgcctccgccgctcctttctcatggaaatggcccgcgagcccgtccggcccagcgcccctcccgcgggaggaaggcgagcccggcccccggcggccattcgcgccgcggacaaatccggcgaacaatgcgcccgcccagagtgcggcccagctgccgggccggggatctggccgcgggacacaaaggggcccgcacgcctctggcgtcgcggggcgggtgggggcggccgagggcggccgaggggggagcctgcggccggggccaggctgcggccagccggcccccggccacgtgtgtccgcagcgcggagcgcccaggcgcccgcagagggcggcggggcccgggagacaaagggagggtccacggggagcggcgggc

SEQ ID NO: 120165 - DNA, 30 bp, Homo sapiens; identical to SEQ ID NO: 46371
  chr20:61820146-61820176
  Hypo

SEQ ID NO: 120166 - DNA, 156 bp, Homo sapiens; identical to SEQ ID NO: 88280
  chr20:61823043-61823199
  Hypo

SEQ ID NO: 120167 - DNA, 30 bp, Homo sapiens; identical to SEQ ID NO: 88281
  chr20:61830522-61830552
  Hypo

SEQ ID NO: 120168 - DNA, 99 bp, Homo sapiens; identical to SEQ ID NO: 88282
  chr20:61838424-61838523
  Hypo

SEQ ID NO: 120169 - DNA, 37 bp, Homo sapiens; identical to SEQ ID NO: 88283
  chr20:61857454-61857491
  Hypo

SEQ ID NO: 120170 - DNA, 180 bp, Homo sapiens; identical to SEQ ID NO: 88284
  chr20:61862280-61862460
  Hyper

SEQ ID NO: 120171 - DNA, 170 bp, Homo sapiens; identical to SEQ ID NO: 88285
  chr20:61883234-61883404
  Hypo

SEQ ID NO: 120172 - DNA, 1698 bp, Homo sapiens
  chr20:61884629-61886327
  Hyper
acctcaggttatctccgcggccccagcgagcctcccaggaaagcgccggaagctccttccttcctgcaggaaggacacgatgcctccgccgtccctaggtccgcccgcaagcctgtgcccctaagccgagcacaggacacccaagctgcacagccacggactccgagggtttcgctgctcaaaactctgaaacagccccttctggcccttctagcttcaagaggaggaggggggcgcgcggtccagctgcgctccgcagcccacaaagcatcgtttcctttttaagacgggagacccagggccaattagcatcgaagcaaagcagcttccccagcctggacaggcgaggcctttgtttagccccctcccccgagggcaccgggctccgggaaagaatccgccccccaggcgtcccagggagcttcggactccggggcagaatggaaacttggccgagggagccccgaccaatcccgacaccgaagacgcccgcgctgcgccccgggcatcggctccagccccttctcgcctccgcgtagctccacgccgggcggaatggggggcggcgggggcgggcggggccggtttgctcgcgggtgggcaggacgttctcaccccccgccccctacactcgcaaactcgcaggcacagcctccgtcatcgccccacccgaatctcagaatcggaacttggccgctcactcggcgcccggggccggctgcgggaaacgctcgcacagacagagacaggcgcgcacccgggggcgcacccggggccacacacgcctccccaggcgatggggtccaggcggccccgcccgaaggcttccgtccggccagcccatccagccgctgccccgcacctgtccccgccgctccggacccgcggccgccccccgcgcacgcacaccggggacgggacccggcgccgcgactccccacgccccgcaggcgacgccaccttcggccgtagcagcccggggtccgaggcatcccccctcggagctggcgcgggacccagcgaacgggccccggggcggagggacgcttcgggaccccacagccgccgtgggtcgggcaccgggggctccaggaggctcgcggaggggtcgccactcaccagctgaaaagcgcagaggacgacgagcgcgcagcggccggagcaggagcccatggtgcccgcctatacaggaggcccccgggtgccccgcgctcggcccccgcccccgctccgcccgctccccacgcgccgcagcctggaccccgccccctccgcatcccgttcccccctcctccccgcaacccccggcccagccccagccccgggtaacagctgcgctgcgtctcccctcccacccccgcctgcggcccctgggggcttcgcgccggccggagagggggaccgttcttaaaggggcgatggcgcggcctctcgggtagcgaggggcggcgccgcggccccaggacagacctgcagctgaggggagcccgccctggacgcggcagggatgaccggcgtccgccccctcctgcaggatgacctgcccagcacctgctcccgccgtgcgccctccggcgtgagatccccatcaaccttccccgtgtggggtctgagcgacccgcatccgcgaggcgttttctctgagagtctcagagattccttggcttggagaagtcctggacccgggtccagagctca

SEQ ID NO: 120173 - DNA, 30 bp, Homo sapiens; identical to SEQ ID NO: 38284
  chr20:61886725-61886755
  Hyper

SEQ ID NO: 120174 - DNA, 157 bp, Homo sapiens; identical to SEQ ID NO: 88292
  chr20:61894135-61894292
  Hypo

SEQ ID NO: 120175 - DNA, 30 bp, Homo sapiens; identical to SEQ ID NO: 88293
  chr20:61940064-61940094
  Hypo

SEQ ID NO: 120176 - DNA, 33 bp, Homo sapiens; identical to SEQ ID NO: 46375
  chr20:61941734-61941767
  Hypo

SEQ ID NO: 120177 - DNA, 144 bp, Homo sapiens; identical to SEQ ID NO: 88295
  chr20:61942831-61942975
  Hypo

SEQ ID NO: 120178 - DNA, 74 bp, Homo sapiens; identical to SEQ ID NO: 88296
  chr20:61957937-61958011
  Hypo

SEQ ID NO: 120179 - DNA, 118 bp, Homo sapiens; identical to SEQ ID NO: 88297
  chr20:61965232-61965350
  Hypo

SEQ ID NO: 120180 - DNA, 584 bp, Homo sapiens; identical to SEQ ID NO: 88298
  chr20:61973825-61974409
  Hypo

SEQ ID NO: 120181 - DNA, 69 bp, Homo sapiens; identical to SEQ ID NO: 88299
  chr20:61974643-61974712
  Hypo

SEQ ID NO: 120182 - DNA, 30 bp, Homo sapiens; identical to SEQ ID NO: 88300
  chr20:61979634-61979664
  Hypo

SEQ ID NO: 120183 - DNA, 135 bp, Homo sapiens; identical to SEQ ID NO: 88301
  chr20:61979961-61980096
  Hypo

SEQ ID NO: 120184 - DNA, 911 bp, Homo sapiens; identical to SEQ ID NO: 88302
  chr20:61980587-61981498
  Hypo

SEQ ID NO: 120185 - DNA, 751 bp, Homo sapiens; identical to SEQ ID NO: 88303
  chr20:61981745-61982496
  Hypo

SEQ ID NO: 120186 - DNA, 31 bp, Homo sapiens; identical to SEQ ID NO: 88304
  chr20:61982616-61982647
  Hypo

SEQ ID NO: 120187 - DNA, 30 bp, Homo sapiens; identical to SEQ ID NO: 88305
  chr20:61983281-61983311
  Hypo

SEQ ID NO: 120188 - DNA, 57 bp, Homo sapiens; identical to SEQ ID NO: 88306
  chr20:61986049-61986106
  Hypo

SEQ ID NO: 120189 - DNA, 165 bp, Homo sapiens; identical to SEQ ID NO: 88307
  chr20:61986524-61986689
  Hypo

SEQ ID NO: 120190 - DNA, 30 bp, Homo sapiens; identical to SEQ ID NO: 88308
  chr20:61990604-61990634
  Hypo

SEQ ID NO: 120191 - DNA, 226 bp, Homo sapiens; identical to SEQ ID NO: 88309
  chr20:61990843-61991069
  Hypo

SEQ ID NO: 120192 - DNA, 92 bp, Homo sapiens; identical to SEQ ID NO: 88310
  chr20:62011877-62011969
  Hypo

SEQ ID NO: 120193 - DNA, 30 bp, Homo sapiens; identical to SEQ ID NO: 88311
  chr20:62026530-62026560
  Hypo

SEQ ID NO: 120194 - DNA, 229 bp, Homo sapiens; identical to SEQ ID NO: 88312
  chr20:62028677-62028906
  Hypo

SEQ ID NO: 120195 - DNA, 262 bp, Homo sapiens; identical to SEQ ID NO: 88313
  chr20:62031112-62031374
  Hypo

SEQ ID NO: 120196 - DNA, 146 bp, Homo sapiens; identical to SEQ ID NO: 88314
  chr20:62031607-62031753
  Hypo

SEQ ID NO: 120197 - DNA, 482 bp, Homo sapiens; identical to SEQ ID NO: 88315
  chr20:62031973-62032455
  Hypo

SEQ ID NO: 120198 - DNA, 159 bp, Homo sapiens; identical to SEQ ID NO: 46386
  chr20:62033495-62033654
  Hypo

SEQ ID NO: 120199 - DNA, 209 bp, Homo sapiens; identical to SEQ ID NO: 46387
  chr20:62037523-62037732
  Hypo

SEQ ID NO: 120200 - DNA, 665 bp, Homo sapiens; identical to SEQ ID NO: 88318
  chr20:62038025-62038690
  Hypo

SEQ ID NO: 120201 - DNA, 150 bp, Homo sapiens; identical to SEQ ID NO: 88319
  chr20:62039576-62039726
  Hypo

SEQ ID NO: 120202 - DNA, 30 bp, Homo sapiens; identical to SEQ ID NO: 88320
  chr20:62042564-62042594
  Hypo

SEQ ID NO: 120203 - DNA, 395 bp, Homo sapiens; identical to SEQ ID NO: 88321
  chr20:62046201-62046596
  Hypo

SEQ ID NO: 120204 - DNA, 84 bp, Homo sapiens; identical to SEQ ID NO: 88322
  chr20:62048313-62048397
  Hypo

SEQ ID NO: 120205 - DNA, 101 bp, Homo sapiens; identical to SEQ ID NO: 88323
  chr20:62050926-62051027
  Hypo

SEQ ID NO: 120206 - DNA, 40 bp, Homo sapiens; identical to SEQ ID NO: 88324
  chr20:62051926-62051966
  Hypo

SEQ ID NO: 120207 - DNA, 118 bp, Homo sapiens; identical to SEQ ID NO: 88325
  chr20:62052467-62052585
  Hypo

SEQ ID NO: 120208 - DNA, 157 bp, Homo sapiens; identical to SEQ ID NO: 88326
  chr20:62053182-62053339
  Hypo

SEQ ID NO: 120209 - DNA, 175 bp, Homo sapiens; identical to SEQ ID NO: 88327
  chr20:62053798-62053973
  Hypo

SEQ ID NO: 120210 - DNA, 215 bp, Homo sapiens; identical to SEQ ID NO: 88328
  chr20:62054221-62054436
  Hypo

SEQ ID NO: 120211 - DNA, 30 bp, Homo sapiens; identical to SEQ ID NO: 88329
  chr20:62054771-62054801
  Hypo

SEQ ID NO: 120212 - DNA, 30 bp, Homo sapiens; identical to SEQ ID NO: 88330
  chr20:62057304-62057334
  Hypo

SEQ ID NO: 120213 - DNA, 42 bp, Homo sapiens; identical to SEQ ID NO: 46395
  chr20:62058718-62058760
  Hypo

SEQ ID NO: 120214 - DNA, 85 bp, Homo sapiens; identical to SEQ ID NO: 88332
  chr20:62060772-62060857
  Hypo

SEQ ID NO: 120215 - DNA, 30 bp, Homo sapiens; identical to SEQ ID NO: 88334
  chr20:62069071-62069101
  Hypo

SEQ ID NO: 120216 - DNA, 30 bp, Homo sapiens; identical to SEQ ID NO: 88335
  chr20:62071331-62071361
  Hypo

SEQ ID NO: 120217 - DNA, 43 bp, Homo sapiens; identical to SEQ ID NO: 88336
  chr20:62071788-62071831
  Hypo

SEQ ID NO: 120218 - DNA, 30 bp, Homo sapiens; identical to SEQ ID NO: 88337
  chr20:62075804-62075834
  Hypo

SEQ ID NO: 120219 - DNA, 34 bp, Homo sapiens; identical to SEQ ID NO: 88338
  chr20:62078339-62078373
  Hypo

SEQ ID NO: 120220 - DNA, 570 bp, Homo sapiens; identical to SEQ ID NO: 88339
  chr20:62090078-62090648
  Hypo

SEQ ID NO: 120221 - DNA, 32 bp, Homo sapiens; identical to SEQ ID NO: 88340
  chr20:62092270-62092302
  Hypo

SEQ ID NO: 120222 - DNA, 181 bp, Homo sapiens; identical to SEQ ID NO: 88341
  chr20:62094124-62094305
  Hypo

SEQ ID NO: 120223 - DNA, 30 bp, Homo sapiens; identical to SEQ ID NO: 88342
  chr20:62096894-62096924
  Hypo

SEQ ID NO: 120224 - DNA, 128 bp, Homo sapiens; identical to SEQ ID NO: 88343
  chr20:62097848-62097976
  Hypo

SEQ ID NO: 120225 - DNA, 1110 bp, Homo sapiens
  chr20:62102787-62103897
  Hyper
gggtcccaggtctgccgcagcccctcccccgggcctcgctctgccaaggaggggtcctgagcccgggatgtgcacgggggcggccggcggctgcagagatgggacagcgcaggagctgagcgcaggagctgagggggttcgcggggccagggaggggcgtcggcgccgagggggcaggacagacagctgcgctcagcccgggctggggtgggggggtcatgggagggcccctcccccatctcaggaacccagaagctcaccctagtctgagggagagcggctcgggaggatggcggaggacaggccagacccctcccccccgccctcgcttggtcgggcggccccagccccgcgggtccccgagagtcccggagagtccagacccagcgctgccgccgtccctccccggccggccctttgttcggcgcagaggccgcggggaggggcctcccaggctgaggagggggctggggcggccgcacgtctctgtcctgcgggcctggagcccccaccccgacctgagcggccccgaccccggaatccttcctgcccgcgcgctgtacaatcgctctccggtctcggcccagcactcccgccggggagcgccggccccggacccagacccaggggcagggagccaaacccgccgcagccagcctggccggggtcgccgatggggtcgccgatgggggtcgccatgggggtcgccacgggggccccgccggccactcacacgtaggcgtggtagatgaacgcccagccgcgcggccgctccagcacgttgtagaggaaattctgcagcttgcggtagaaggcgttgcgcttggggggcttcccggcgcccgcgccgcccgcgcgaggtttgctgaggatgctgccgcgcttgggggcctcggagccggcgatcagcagcgccccgtcccgggtggagtcgggcgcgccggggtccagccccacgaagcccaccttcagcttcttctccccgctcgggccggggtatacgccgccgttgcgcgacttctgcaccatggtgcctggcgggaggcgccccgggtcgggctcaggctcagcgggggcggagcgcggggggcggcgcgggccccagcccag

SEQ ID NO: 120226 - DNA, 163 bp, Homo sapiens; identical to SEQ ID NO: 46399
  chr20:62115182-62115345
  Hypo

SEQ ID NO: 120227 - DNA, 44 bp, Homo sapiens; identical to SEQ ID NO: 88347
  chr20:62117912-62117956
  Hypo

SEQ ID NO: 120228 - DNA, 858 bp, Homo sapiens
  chr20:62119313-62120171
  Hyper
agggggtccggggggcgcggggcccaccccccagcagcaggcgcacacggctctggggtcgctcagtttattggtaaaacgggcactgagcgtggcgagcgctgggcgcggaagcctggggcgggggcgcctttcctcttgaagaacttccactggaccttgatggcgagcatccagtcgctgaccgagggcctctggcaagcggaggtgcagacatgcgcctggcgggggtgcggggcgccggaccggcgcgcggggcgggggcggggcgggggcccgggcccggggttcggagcgcggcaccgccggggagggtcgcgccgcgggcgcccgcgcttcacttgcccgccttctgcgccttctgcgccgacttggtgaccttgccggcgccgccgctcttcttctccacgttcttgatgacgcctacggccaccgtctgcctcatgtcgcgcacggcgaagcggcctggggggcggggggcggcgtgtgggcggggccggaggacttgaccccccccaaccccagggctctggccgggcgggggcgcaaccgcgtcgggaatgtcctcggaacacgcttagcgcagagcgcgcccctgtgaagacggccggcctcgcgggagtcctgcctgggcggctgctccacggtctgcggggcggccacggggcgggggcagccctaacgctgccactgggcgaccgcgggccttcctcactcgcggggcctccctcactttcggggcctcgtctgcacacagggcccaccccagctcgtctgggcagggtcacctgcactcagtgacacggaggccgtggctctcctgccatgctctgggccaagctccgcaggaaagggggc

SEQ ID NO: 120229 - DNA, 526 bp, Homo sapiens; identical to SEQ ID NO: 88350
  chr20:62126038-62126564
  Hypo

SEQ ID NO: 120230 - DNA, 196 bp, Homo sapiens; identical to SEQ ID NO: 88351
  chr20:62131908-62132104
  Hypo

SEQ ID NO: 120231 - DNA, 30 bp, Homo sapiens; identical to SEQ ID NO: 88352
  chr20:62137607-62137637
  Hypo

SEQ ID NO: 120232 - DNA, 30 bp, Homo sapiens; identical to SEQ ID NO: 88353
  chr20:62141242-62141272
  Hypo

SEQ ID NO: 120233 - DNA, 126 bp, Homo sapiens; identical to SEQ ID NO: 88354
  chr20:62149153-62149279
  Hypo

SEQ ID NO: 120234 - DNA, 36 bp, Homo sapiens; identical to SEQ ID NO: 88355
  chr20:62149530-62149566
  Hypo

SEQ ID NO: 120235 - DNA, 253 bp, Homo sapiens; identical to SEQ ID NO: 88356
  chr20:62153209-62153462
  Hypo

SEQ ID NO: 120236 - DNA, 76 bp, Homo sapiens; identical to SEQ ID NO: 88357
  chr20:62157231-62157307
  Hypo

SEQ ID NO: 120237 - DNA, 30 bp, Homo sapiens; identical to SEQ ID NO: 88358
  chr20:62163260-62163290
  Hypo

SEQ ID NO: 120238 - DNA, 276 bp, Homo sapiens; identical to SEQ ID NO: 88359
  chr20:62165579-62165855
  Hypo

SEQ ID NO: 120239 - DNA, 30 bp, Homo sapiens; identical to SEQ ID NO: 88360
  chr20:62166949-62166979
  Hypo

SEQ ID NO: 120240 - DNA, 272 bp, Homo sapiens; identical to SEQ ID NO: 88361
  chr20:62167554-62167826
  Hypo

SEQ ID NO: 120241 - DNA, 237 bp, Homo sapiens; identical to SEQ ID NO: 46405
  chr20:62168240-62168477
  Hypo

SEQ ID NO: 120242 - DNA, 248 bp, Homo sapiens; identical to SEQ ID NO: 88363
  chr20:62170122-62170370
  Hypo

SEQ ID NO: 120243 - DNA, 252 bp, Homo sapiens; identical to SEQ ID NO: 46407
  chr20:62172062-62172314
  Hypo

SEQ ID NO: 120244 - DNA, 553 bp, Homo sapiens; identical to SEQ ID NO: 88365
  chr20:62172646-62173199
  Hypo

SEQ ID NO: 120245 - DNA, 115 bp, Homo sapiens; identical to SEQ ID NO: 88366
  chr20:62181335-62181450
  Hypo

SEQ ID NO: 120246 - DNA, 237 bp, Homo sapiens; identical to SEQ ID NO: 88367
  chr20:62185322-62185559
  Hyper

SEQ ID NO: 120247 - DNA, 30 bp, Homo sapiens; identical to SEQ ID NO: 88368
  chr20:62197386-62197416
  Hypo

SEQ ID NO: 120248 - DNA, 47 bp, Homo sapiens; identical to SEQ ID NO: 88369
  chr20:62200790-62200837
  Hypo

SEQ ID NO: 120249 - DNA, 159 bp, Homo sapiens; identical to SEQ ID NO: 88370
  chr20:62204228-62204387
  Hypo

SEQ ID NO: 120250 - DNA, 123 bp, Homo sapiens; identical to SEQ ID NO: 88371
  chr20:62221319-62221442
  Hypo

SEQ ID NO: 120251 - DNA, 30 bp, Homo sapiens; identical to SEQ ID NO: 88372
  chr20:62250986-62251016
  Hypo

SEQ ID NO: 120252 - DNA, 35 bp, Homo sapiens; identical to SEQ ID NO: 46411
  chr20:62274577-62274612
  Hypo

SEQ ID NO: 120253 - DNA, 30 bp, Homo sapiens; identical to SEQ ID NO: 88374
  chr20:62275052-62275082
  Hypo

SEQ ID NO: 120254 - DNA, 30 bp, Homo sapiens; identical to SEQ ID NO: 88375
  chr20:62276993-62277023
  Hypo

SEQ ID NO: 120255 - DNA, 163 bp, Homo sapiens; identical to SEQ ID NO: 88376
  chr20:62281532-62281695
  Hypo

SEQ ID NO: 120256 - DNA, 141 bp, Homo sapiens; identical to SEQ ID NO: 88377
  chr20:62283695-62283836
  Hyper

SEQ ID NO: 120257 - DNA, 94 bp, Homo sapiens; identical to SEQ ID NO: 88378
  chr20:62290954-62291048
  Hypo

SEQ ID NO: 120258 - DNA, 60 bp, Homo sapiens; identical to SEQ ID NO: 88379
  chr20:62310644-62310704
  Hypo

SEQ ID NO: 120259 - DNA, 30 bp, Homo sapiens; identical to SEQ ID NO: 46414
  chr20:62311251-62311281
  Hypo

SEQ ID NO: 120260 - DNA, 1111 bp, Homo sapiens; identical to SEQ ID NO: 88381
  chr20:62320911-62322022
  Hypo

SEQ ID NO: 120261 - DNA, 30 bp, Homo sapiens; identical to SEQ ID NO: 16693
  chr20:62329526-62329556
  Hypo

SEQ ID NO: 120262 - DNA, 192 bp, Homo sapiens; identical to SEQ ID NO: 88383
  chr20:62331754-62331946
  Hypo

SEQ ID NO: 120263 - DNA, 96 bp, Homo sapiens; identical to SEQ ID NO: 88384
  chr20:62340225-62340321
  Hypo

SEQ ID NO: 120264 - DNA, 77 bp, Homo sapiens; identical to SEQ ID NO: 88385
  chr20:62340648-62340725
  Hypo

SEQ ID NO: 120265 - DNA, 346 bp, Homo sapiens
  chr20:62369069-62369415
  Hyper
ggctggaggcaggtccgcgcacccagctcggcacgcgcgcctgcaccgggccttggacccgaggctgacgaccccgccccccgccccccacctctacccccaaggcccgaggacgctgtagcccccaggaagagggcgcggaggcagcgggcgaggctgcagggcagtgcgacggcggcggaagcggtgagtgccaggctgtcccggggaccagggtggggtccgcagggcaccgaccagccttcctcgcccccagtccctactgaggcggacccacctctgctccctcagcaagtcggacaccagactgcacgagctgcaccggggcccgcgcagcagcaggggt

SEQ ID NO: 120266 - DNA, 33 bp, Homo sapiens; identical to SEQ ID NO: 88387
  chr20:62378380-62378413
  Hypo

SEQ ID NO: 120267 - DNA, 1084 bp, Homo sapiens; identical to SEQ ID NO: 88388
  chr20:62383131-62384215
  Hypo

SEQ ID NO: 120268 - DNA, 42 bp, Homo sapiens; identical to SEQ ID NO: 88389
  chr20:62386430-62386472
  Hypo

SEQ ID NO: 120269 - DNA, 495 bp, Homo sapiens; identical to SEQ ID NO: 88390
  chr20:62398454-62398949
  Hypo

SEQ ID NO: 120270 - DNA, 198 bp, Homo sapiens; identical to SEQ ID NO: 88391
  chr20:62400759-62400957
  Hypo

SEQ ID NO: 120271 - DNA, 30 bp, Homo sapiens; identical to SEQ ID NO: 88392
  chr20:62403252-62403282
  Hypo

SEQ ID NO: 120272 - DNA, 163 bp, Homo sapiens; identical to SEQ ID NO: 88393
  chr20:62404995-62405158
  Hypo

SEQ ID NO: 120273 - DNA, 77 bp, Homo sapiens; identical to SEQ ID NO: 88394
  chr20:62407078-62407155
  Hypo

SEQ ID NO: 120274 - DNA, 320 bp, Homo sapiens; identical to SEQ ID NO: 88395
  chr20:62407384-62407704
  Hypo

SEQ ID NO: 120275 - DNA, 47 bp, Homo sapiens; identical to SEQ ID NO: 88397
  chr20:62415068-62415115
  Hypo

SEQ ID NO: 120276 - DNA, 30 bp, Homo sapiens; identical to SEQ ID NO: 88398
  chr20:62417499-62417529
  Hypo

SEQ ID NO: 120277 - DNA, 74 bp, Homo sapiens; identical to SEQ ID NO: 88399
  chr20:62422247-62422321
  Hypo

SEQ ID NO: 120278 - DNA, 267 bp, Homo sapiens; identical to SEQ ID NO: 88400
  chr20:62427164-62427431
  Hypo

SEQ ID NO: 120279 - DNA, 30 bp, Homo sapiens; identical to SEQ ID NO: 88401
  chr20:62431319-62431349
  Hypo

SEQ ID NO: 120280 - DNA, 30 bp, Homo sapiens; identical to SEQ ID NO: 88402
  chr20:62433257-62433287
  Hypo

SEQ ID NO: 120281 - DNA, 96 bp, Homo sapiens; identical to SEQ ID NO: 88403
  chr20:62440444-62440540
  Hypo

SEQ ID NO: 120282 - DNA, 348 bp, Homo sapiens; identical to SEQ ID NO: 88404
  chr20:62461291-62461639
  Hyper

SEQ ID NO: 120283 - DNA, 166 bp, Homo sapiens; identical to SEQ ID NO: 88405
  chr20:62463049-62463215
  Hyper

SEQ ID NO: 120284 - DNA, 378 bp, Homo sapiens
  chr20:62463430-62463808
  Hyper
gttgtctgcgggggacgaatggctccgggagggggcgggaaccagcggcccgggcctcgccccagcccgtgtgcagccccgatccgaacggcctgggacgcgtctccaccactcggcgcccggactctgcgcgtcgcttctcgcctccgccgtcctcagccctcgggcgggtagagtgggaagcgcggccccgcattcctggccggcctgcgcaggggtaaaggccacctcgcttcctctccccgggcgcggcgggaagggaggtgagcctgtggccggcagccgcgcgagggagtcgagcccggcccggccaaccaatggggaggcgcccgggccgtccagcctgcctccctgcgggcccagcgcagcggattcctc

SEQ ID NO: 120285 - DNA, 99 bp, Homo sapiens; identical to SEQ ID NO: 88407
  chr20:62472040-62472139
  Hypo

SEQ ID NO: 120286 - DNA, 30 bp, Homo sapiens; identical to SEQ ID NO: 88408
  chr20:62474624-62474654
  Hypo

SEQ ID NO: 120287 - DNA, 212 bp, Homo sapiens; identical to SEQ ID NO: 46423
  chr20:62481430-62481642
  Hypo

SEQ ID NO: 120288 - DNA, 147 bp, Homo sapiens; identical to SEQ ID NO: 88410
  chr20:62487806-62487953
  Hypo

SEQ ID NO: 120289 - DNA, 506 bp, Homo sapiens; identical to SEQ ID NO: 88411
  chr20:62488253-62488759
  Hypo

SEQ ID NO: 120290 - DNA, 74 bp, Homo sapiens; identical to SEQ ID NO: 88412
  chr20:62513823-62513897
  Hypo

SEQ ID NO: 120291 - DNA, 20 bp, Homo sapiens
  chr20:62586346-62586366
  Hypo
taatcccacggaggccgagg

SEQ ID NO: 120292 - DNA, 162 bp, Homo sapiens; identical to SEQ ID NO: 88414
  chr20:62600647-62600809
  Hyper

SEQ ID NO: 120293 - DNA, 98 bp, Homo sapiens; identical to SEQ ID NO: 88415
  chr20:62607076-62607174
  Hypo

SEQ ID NO: 120294 - DNA, 30 bp, Homo sapiens; identical to SEQ ID NO: 88416
  chr20:62632965-62632995
  Hypo

SEQ ID NO: 120295 - DNA, 98 bp, Homo sapiens; identical to SEQ ID NO: 88417
  chr20:62662173-62662271
  Hypo

SEQ ID NO: 120296 - DNA, 247 bp, Homo sapiens; identical to SEQ ID NO: 88418
  chr20:62673837-62674084
  Hyper

SEQ ID NO: 120297 - DNA, 227 bp, Homo sapiens
  chr20:62680216-62680443
  Hyper
tgtagttggggtggtcgcgcaagtgctgcacgcgcagccgttcggcttcctccacgaagggccgcttctccgccgcgttcagctccttccacgctttgcctgcgggccgtgggcgccagtgagtggaacgccgtcgggcgggtgggcgccgagccctccgtgcgcccgggacgccccgcgagggtttggcgcagcccccgcaccccgcggcccgggacccctgcccc

SEQ ID NO: 120298 - DNA, 130 bp, Homo sapiens; identical to SEQ ID NO: 88421
  chr20:62680766-62680896
  Hyper

SEQ ID NO: 120299 - DNA, 482 bp, Homo sapiens
  chr20:62694285-62694767
  Hyper
ggggcccggtcgctccgggatgtctgagctctgggaggggcgtgcccggggcgcctccctcgcggggtattgtgggatcacgagtcactggcgacggtgggtcaggactacacttcccaggaggctgtgcgcgccgcgtggcgcctgggagttgtggtccagagcgcgggcgcggcgggcgcggcaggcgggcgcgtggactacgcatcctaggatgccgcgcgcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggtgaggggcgcgggccgccaggaccccggg

SEQ ID NO: 120300 - DNA, 30 bp, Homo sapiens; identical to SEQ ID NO: 88424
  chr20:62695018-62695048
  Hyper

SEQ ID NO: 120301 - DNA, 30 bp, Homo sapiens; identical to SEQ ID NO: 88425
  chr20:62695315-62695345
  Hyper

SEQ ID NO: 120302 - DNA, 30 bp, Homo sapiens; identical to SEQ ID NO: 88426
  chr20:62701901-62701931
  Hypo

SEQ ID NO: 120303 - DNA, 30 bp, Homo sapiens; identical to SEQ ID NO: 88427
  chr20:62705558-62705588
  Hypo

SEQ ID NO: 120304 - DNA, 201 bp, Homo sapiens; identical to SEQ ID NO: 88428
  chr20:62714665-62714866
  Hyper

SEQ ID NO: 120305 - DNA, 450 bp, Homo sapiens; identical to SEQ ID NO: 88429
  chr20:62715171-62715621
  Hyper

SEQ ID NO: 120306 - DNA, 214 bp, Homo sapiens; identical to SEQ ID NO: 88430
  chr20:62722733-62722947
  Hypo

SEQ ID NO: 120307 - DNA, 101 bp, Homo sapiens; identical to SEQ ID NO: 88431
  chr20:62726693-62726794
  Hypo

SEQ ID NO: 120308 - DNA, 954 bp, Homo sapiens
  chr20:62733381-62734335
  Hyper
ggcttttctgagcctcggtttccttccgtgtgcaaaggggaccgcagaaccctctttgtggggttgtgggggaaggctggggcgcccgggagggtcccgggtcgcgtccgacctcaggaaggcggggcttcagcagcggcctcggaccctccctccagggggcgctgtgggctcacgcgggcccagccttgggccccggggcgctgcggcgggaaccgcggtgactagcggggtcttaaagcgggtggcggggccgggctctcctgggaccaggagcccagagcgtggagacgtggcgggctgagccgctcagtgcggcccctgccccgcgcccaccccgccccgtgtcaggaggtccgcggagcgggaggacccgcctcccggggagagctcgcccgcccctccctcccggctggccgcggggcggtctgcagaccctttggccgtgccggatctgcctggtccccggggagaagacgctgaggatcccattgctggtctgtggatggggacaggagacgcccgaggtaagaaggggtccgggttctttggaggaatcctggttggcgccttctctgcagcagagacgcccggctggggccggagggcaaactgggggcagggtgggagacctcggccctgagggctgtaggggctcttgcctgggcgctccttaagctcccccgccccctccgccccccaccccgcggtgctcactctcagtcctgccttgcgcacattcccacgcccgggcctctcctgcccgcccctcgttgttcacttgctcattacgcctcacacctggctctgccgcgggcttggagcgggtgtctgggaaacacagtctcacttgtctcctcaaggggctccggggcaccgtaacagcgtgcagagcgcagtcaggctgccgtgctgctgctttgcgaggtgtgactgcagcgcagccaggaaaca

SEQ ID NO: 120309 - DNA, 115 bp, Homo sapiens; identical to SEQ ID NO: 88434
  chr20:62736331-62736446
  Hypo

SEQ ID NO: 120310 - DNA, 46 bp, Homo sapiens; identical to SEQ ID NO: 88435
  chr20:62737744-62737790
  Hypo

SEQ ID NO: 120311 - DNA, 36 bp, Homo sapiens; identical to SEQ ID NO: 16700
  chr20:62762699-62762735
  Hypo

SEQ ID NO: 120312 - DNA, 22 bp, Homo sapiens
  chr20:62766300-62766322
  Hypo
cgaatcacaaacacacgctccc

SEQ ID NO: 120313 - DNA, 152 bp, Homo sapiens; identical to SEQ ID NO: 88438
  chr20:62767680-62767832
  Hypo

SEQ ID NO: 120314 - DNA, 195 bp, Homo sapiens; identical to SEQ ID NO: 88439
  chr20:62784544-62784739
  Hypo

SEQ ID NO: 120315 - DNA, 30 bp, Homo sapiens; identical to SEQ ID NO: 38302
  chr20:62793356-62793386
  Hyper

SEQ ID NO: 120316 - DNA, 30 bp, Homo sapiens; identical to SEQ ID NO: 88441
  chr20:62796246-62796276
  Hypo

SEQ ID NO: 120317 - DNA, 17 bp, Homo sapiens
  chr20:62815469-62815486
  Hypo
gccgacagtgttatttt

SEQ ID NO: 120318 - DNA, 30 bp, Homo sapiens; identical to SEQ ID NO: 88443
  chr20:62819320-62819350
  Hypo

SEQ ID NO: 120319 - DNA, 58 bp, Homo sapiens; identical to SEQ ID NO: 88444
  chr20:62832330-62832388
  Hypo

SEQ ID NO: 120320 - DNA, 66 bp, Homo sapiens; identical to SEQ ID NO: 88445
  chr20:62839592-62839658
  Hypo

SEQ ID NO: 120321 - DNA, 30 bp, Homo sapiens; identical to SEQ ID NO: 88446
  chr20:62863399-62863429
  Hypo

SEQ ID NO: 120322 - DNA, 30 bp, Homo sapiens; identical to SEQ ID NO: 88447
  chr20:62863671-62863701
  Hypo

SEQ ID NO: 120323 - DNA, 30 bp, Homo sapiens; identical to SEQ ID NO: 88448
  chr20:62868739-62868769
  Hypo

SEQ ID NO: 120324 - DNA, 114 bp, Homo sapiens; identical to SEQ ID NO: 88449
  chr20:62871823-62871937
  Hypo

SEQ ID NO: 120325 - DNA, 30 bp, Homo sapiens; identical to SEQ ID NO: 46431
  chr20:62873290-62873320
  Hypo

SEQ ID NO: 120326 - DNA, 473 bp, Homo sapiens
  chr20:62947861-62948334
  Hyper
cgcggaagccccttccgagccccctcgggccgggaacgcgggaggaggcggcgccctgcgccgggaggccccagacaccgtgggcgggcggctgtgcgcggccaggctgcgtgggagcgggcagcggcggcggggggcgctccgcgcgggggttggggcgcgggggttggggaggcgggggcgcccgggccgcgcttcccttcgcgggtgactcagcagccgccttcctcagcggggcggggcgcggcgggggcgcggggaggctgtgggcacgcggcttccccgcgccggggtgcaggtcctcgccgccgcccccgcgaggaagtgcgaggctggacgctgggaggcgcgcgtgggccgggagattccttctcgcctgccggctaccagccggcccgcccacgccgccgagatcccgactccacgttccctccccacggaggagtcggggcagcgcacggaggcggaaaggc

SEQ ID NO: 120327 - DNA, 30 bp, Homo sapiens; identical to SEQ ID NO: 88494
  chr21:14752739-14752769
  Hypo

SEQ ID NO: 120328 - DNA, 35 bp, Homo sapiens; identical to SEQ ID NO: 88495
  chr21:15309741-15309776
  Hypo

SEQ ID NO: 120329 - DNA, 102 bp, Homo sapiens; identical to SEQ ID NO: 88496
  chr21:15383566-15383668
  Hypo

SEQ ID NO: 120330 - DNA, 176 bp, Homo sapiens; identical to SEQ ID NO: 88497
  chr21:15442571-15442747
  Hypo

SEQ ID NO: 120331 - DNA, 42 bp, Homo sapiens; identical to SEQ ID NO: 88498
  chr21:15442995-15443037
  Hypo

SEQ ID NO: 120332 - DNA, 62 bp, Homo sapiens; identical to SEQ ID NO: 88499
  chr21:15443988-15444050
  Hypo

SEQ ID NO: 120333 - DNA, 77 bp, Homo sapiens; identical to SEQ ID NO: 88500
  chr21:15444767-15444844
  Hypo

SEQ ID NO: 120334 - DNA, 75 bp, Homo sapiens; identical to SEQ ID NO: 88501
  chr21:15446513-15446588
  Hypo

SEQ ID NO: 120335 - DNA, 107 bp, Homo sapiens; identical to SEQ ID NO: 88502
  chr21:15455882-15455989
  Hypo

SEQ ID NO: 120336 - DNA, 555 bp, Homo sapiens; identical to SEQ ID NO: 88503
  chr21:15588356-15588911
  Hyper

SEQ ID NO: 120337 - DNA, 34 bp, Homo sapiens; identical to SEQ ID NO: 88504
  chr21:15693964-15693998
  Hypo

SEQ ID NO: 120338 - DNA, 94 bp, Homo sapiens; identical to SEQ ID NO: 88505
  chr21:15694238-15694332
  Hypo

SEQ ID NO: 120339 - DNA, 30 bp, Homo sapiens; identical to SEQ ID NO: 46436
  chr21:15762808-15762838
  Hypo

SEQ ID NO: 120340 - DNA, 30 bp, Homo sapiens; identical to SEQ ID NO: 88507
  chr21:15955683-15955713
  Hypo

SEQ ID NO: 120341 - DNA, 23 bp, Homo sapiens
  chr21:16033840-16033863
  Hypo
ttgcgtctatgaattcgactttt

SEQ ID NO: 120342 - DNA, 179 bp, Homo sapiens; identical to SEQ ID NO: 88509
  chr21:16438535-16438714
  Hyper

SEQ ID NO: 120343 - DNA, 211 bp, Homo sapiens; identical to SEQ ID NO: 88510
  chr21:18985471-18985682
  Hyper

SEQ ID NO: 120344 - DNA, 85 bp, Homo sapiens; identical to SEQ ID NO: 88511
  chr21:19274379-19274464
  Hypo

SEQ ID NO: 120345 - DNA, 96 bp, Homo sapiens; identical to SEQ ID NO: 88512
  chr21:19274828-19274924
  Hypo

SEQ ID NO: 120346 - DNA, 42 bp, Homo sapiens; identical to SEQ ID NO: 88513
  chr21:19517459-19517501
  Hypo

SEQ ID NO: 120347 - DNA, 30 bp, Homo sapiens; identical to SEQ ID NO: 38308
  chr21:19617785-19617815
  Hyper

SEQ ID NO: 120348 - DNA, 30 bp, Homo sapiens
  chr21:19618035-19618065
  Hyper
ctttggtcccagcaccgtgttcactcggat

SEQ ID NO: 120349 - DNA, 17 bp, Homo sapiens
  chr21:19668175-19668192
  Hypo
agaatcagaataggccg

SEQ ID NO: 120350 - DNA, 172 bp, Homo sapiens; identical to SEQ ID NO: 46439
  chr21:20359980-20360152
  Hypo

SEQ ID NO: 120351 - DNA, 40 bp, Homo sapiens; identical to SEQ ID NO: 88517
  chr21:20703497-20703537
  Hypo

SEQ ID NO: 120352 - DNA, 104 bp, Homo sapiens; identical to SEQ ID NO: 88518
  chr21:21264013-21264117
  Hypo

SEQ ID NO: 120353 - DNA, 35 bp, Homo sapiens; identical to SEQ ID NO: 88519
  chr21:22173764-22173799
  Hypo

SEQ ID NO: 120354 - DNA, 1021 bp, Homo sapiens
  chr21:22369922-22370943
  Hyper
ccaacagcaatgggtcgagatgtagaggaaacactctgtacgttatttttccgcccaccctttagcgcctgaggagacagacagtgtagactttagggtacaattgcttcccctctgtcgcggcggggtggggagcgtgggaaggggacagccgcgcaaggggccagcctgctccaggtttgagcgagagagggagaaggaggtccacggagagacaagaatctccctcctcccacgcccaaaaggaataagctgcggggcacaccgcccgcctccagatcccccattcacgttgagccggggcgcgctcggggcggtcgcctgcagtatcagtatcagcatcagcatcagcatcagcatctgcatgagcatcagctcagctcagctcagctcagcatcagctcagctgtcctgaggcagccggcggctgtgaaggagctccaggctgcccccatccccacgcccttctcggctcagggcgtgcatgaacctgcggatggccggcgggcgagtggcgccttcgcgatcgcggccgcccctctaggcggaggcaccggggaccgaacccgtgacttcgagctccactgcggacgaatcccgggaccgcgcgcctcgcggaagagcggccgccgtgcagcgcggagggatacgcctcggccgcacctcccctcgccgcgcccccgcccccgccgccctccccgcccggctctgctgccgccgcggcggccgctgctgctgctgcttctgccgccgctgccgccgccgctgcctggatatagtgcggcaagagcggagcttgcagtcactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaaggtaggag

SEQ ID NO: 120355 - DNA, 30 bp, Homo sapiens; identical to SEQ ID NO: 88525
  chr21:25159328-25159358
  Hypo

SEQ ID NO: 120356 - DNA, 41 bp, Homo sapiens; identical to SEQ ID NO: 46441
  chr21:25338183-25338224
  Hypo

SEQ ID NO: 120357 - DNA, 30 bp, Homo sapiens; identical to SEQ ID NO: 88527
  chr21:25540338-25540368
  Hypo

SEQ ID NO: 120358 - DNA, 30 bp, Homo sapiens; identical to SEQ ID NO: 88528
  chr21:26734320-26734350
  Hypo

SEQ ID NO: 120359 - DNA, 25 bp, Homo sapiens
  chr21:26737217-26737242
  Hypo
tgcgcccggccgagggatttttttt

SEQ ID NO: 120360 - DNA, 30 bp, Homo sapiens; identical to SEQ ID NO: 88530
  chr21:26785920-26785950
  Hypo

SEQ ID NO: 120361 - DNA, 659 bp, Homo sapiens; identical to SEQ ID NO: 88531
  chr21:26934159-26934818
  Hyper

SEQ ID NO: 120362 - DNA, 67 bp, Homo sapiens; identical to SEQ ID NO: 88532
  chr21:27011420-27011487
  Hyper

SEQ ID NO: 120363 - DNA, 30 bp, Homo sapiens; identical to SEQ ID NO: 88533
  chr21:27011609-27011639
  Hypo

SEQ ID NO: 120364 - DNA, 953 bp, Homo sapiens
  chr21:27011772-27012725
  Hyper
gtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctgtaagttgctcgggttcctctacccttcctgcctggaccagcctgcccccaccctccagccccccacggggcgctggctgacagtgtctgggcggctctgggccgaggtcgccgcggggcgtctgaccttgcgcccaggcgagcgggaaacccagggtgcccgcgagcggacgctgggagcaagggagcgcgaggtcgtgggtttcttgtgaattgcgtctgattttgtcagttctagatacagaaaattaagggttcccactagcaggttctcatctgtttgcaaagttggggtaagttttcagacagagggacgtgattcgaatgcaaaactcactacccactggtaagatgctaagaccccaagaaagatggcatcactgggaggcgggcgccggccacactttgagtccccggggagggggcagcgtccgcgtggtctgggctctgtagcgtcccagctgagccggcgatatgcagcgcacttgtggggcggaggtggagggaattcgtggctgctgagcc

SEQ ID NO: 120365 - DNA, 30 bp, Homo sapiens; identical to SEQ ID NO: 88537
  chr21:27184709-27184739
  Hypo

SEQ ID NO: 120366 - DNA, 62 bp, Homo sapiens; identical to SEQ ID NO: 88538
  chr21:27541809-27541871
  Hyper

SEQ ID NO: 120367 - DNA, 75 bp, Homo sapiens; identical to SEQ ID NO: 88539
  chr21:27543433-27543508
  Hyper

SEQ ID NO: 120368 - DNA, 809 bp, Homo sapiens
  chr21:27944913-27945722
  Hyper
caaatcccctaaacacgagactgctatttccaaggtggaaagggaaagaaaagaaatgcaaaaggtaaaagttaaaggaaaaggaacaaaacaaaaccgcgtgcggctggaagtgcgcgggtttctgccgtcgcctcgcggaaaaggcagaagcgtctgcaaaggtccttctgcaaaggtcccggtccgtccagctcaacccacgttagcccggaccgtgacccaagggcagccccgagcctctgaccctctccgccgccctccgtcactgacctgcgtagacaaagagcaggaccaacttcggaagcaagacccctggacgcacgggtagcctcggagcgtccatccaagccggtggcctgaggcttggagcgaagggagagcccggaaccggagggaatggggaggatggagggcgatcagatggagagagcagcgctcctgagagccgggtggagcagagacccggccattgcctagggagccttccaagggagcccgggccgggcgcgtcccgggccagcgactgcgggactccgcggagctggggcgcccgtggcccgagacgggctgcgctgggggcccaggtctctttgtctcgccccactgcgctcaggcgcggggaaggcggccactccggcgtccttggccacccaggctcacatttcatctccgcgggtggcaacgactgcgggcagggggcgggggtggccccgactcctccccaagcccgggttcttccttctaaagagtgactaggggaccaagaaacttttcctaaccccttgctttggcgattgctatggagt

SEQ ID NO: 120369 - DNA, 55 bp, Homo sapiens; identical to SEQ ID NO: 88542
  chr21:28215942-28215997
  Hyper

SEQ ID NO: 120370 - DNA, 1585 bp, Homo sapiens
  chr21:28216223-28217808
  Hyper
gcacaagctccaactcgctaaaggtggaaggagtcaggttacaaactctccctccccggcctaaatgctttgctttagtttgcagaaaatcgtttgtcagtttttttcttggttattcattattcgggcaaatgcaagtatgttttctagctgagttcaccaatccaaacctcaaaccacattcctccactccaggcctccgttctgtccgcggacttatgatcctgcctgccagcaggagtctaccctgaagtcgcgtgggatagataaagtgaggagaggaggatgaatggacagacaaacgagagcaattcttctacctgtgggctgtcctacgccttgcagtgccgggtcctgcggcgaccactgagccccttcgtcctcgccctcagtcccttcgtcctcgtcttcggtctccgctttcccagtcggccggggctcgtcgtccacgaccccgcacgtgccgccgacgtcgccctgccgattccgccgcaggaggtggaactgtagtggtgccggcggcttctcccctggggcggcggtggcgaggcgctcgctggcggcgggcagcggctggatgaaatacgcctcccccagcaggtagaaggcgccgcgcacgccctcgcagaggctgagggcggcagccgagctgggatcgccattcacggtgccggagtagaagcagtgcgccaggtcggtttccggaagcggcgtctcggacccggatttgcgccccacgttctggagcgtgaagccgggcgccaaaaagctgctgtcgggccgcagctccagatccagctgctggtcaaaggcgtgcaggcggaggcgcgtggtcccgtgtcccggggcgcgctccagctccggcaccactagctcctcgtcctcctcggaggggcgcccgagtgcgtccgacacggccagtagcgccgcggcgagcagcagcagcgtgggtactggcccaaagctccgagaccccggagcccgctccgcgttccccatgtcgctgcccagcttgcgccttccgaacccctcgggcacagctcgctgcattggagccccaggagacaccgctcgtagcagcgcacggagcgagggacctttagttcgggtcgggagagcaaagcctcgttggcctgctctggattgttaaaattaacaatttctattattcgttggaagggcgcgcagagccggctacagccgaagctcccggagtcactaaaaggaggcgctgcagttctgccggcgcgcgggaagtttttcttccagcgcaaagttggagacactgagaggcaggcgcaggcagagtggctctgctgggacaagaagcgctctggggcgcctccggggctgaggcaacgcggagattggtgcctggcgcccctcttcggcctccgccttggctgcgatgttgctcactctgctcagggctctcccctctccgtccggtagcgcaccctggctttgcaatagcccctggctcggagccgctttccagcgagtgcaagaaccgggcagccgagcggtccttttatagtggaccagtgaaacccccacccccaccccactcctcccctttggccct

SEQ ID NO: 120371 - DNA, 80 bp, Homo sapiens
  chr21:28217853-28217933
  Hyper
gcgctccgcgctgcgggctcgggagggggagggggcagcctccgcgctggctccacgccactgctcgtcaatctaggggc

SEQ ID NO: 120372 - DNA, 81 bp, Homo sapiens; identical to SEQ ID NO: 13938
  chr21:28218267-28218348
  Hyper

SEQ ID NO: 120373 - DNA, 166 bp, Homo sapiens; identical to SEQ ID NO: 88547
  chr21:28218552-28218718
  Hyper

SEQ ID NO: 120374 - DNA, 196 bp, Homo sapiens; identical to SEQ ID NO: 88548
  chr21:28218958-28219154
  Hyper

SEQ ID NO: 120375 - DNA, 30 bp, Homo sapiens
  chr21:28337895-28337925
  Hyper
agcagctccacctggcgggcccgggagatg

SEQ ID NO: 120376 - DNA, 30 bp, Homo sapiens; identical to SEQ ID NO: 88549
  chr21:28338210-28338240
  Hyper

SEQ ID NO: 120377 - DNA, 290 bp, Homo sapiens
  chr21:28338463-28338753
  Hyper
cggagtagagttggtcgatgttctgcaccagccccttgctcctgcgccgctgcgccagggggtgcgggtggccgggaggctcggctcgctcctgcacctcctccccctgccgccggcggggctgggcggctgctgcagcagtcggaggctgcccggctttatcctgggcaggtgtcgcggcggggccgaccgcggccaggggcaggcggaacgcgcacagcagcagggacgcccacccgagcagcatagtgcgctgcccgcggggaggggctgcgcgactgggactttat

SEQ ID NO: 120378 - DNA, 339 bp, Homo sapiens
  chr21:28339162-28339501
  Hyper
ggaggttccaagctccggggcccacttcctttcttattttgtgggtttccttggctctgctgggaccaggaggaagggaagaaagagaggggaaaaagccgtaaaaattaaaacaaaaatgcaggggggcagcctgaggcgagctggtgaagcggcgtgtctgtgtcccttcggctgcggtctcctcctgcccgccgtcatccccagtcggcagctgcgagcgccgagagcagcgcgagcgctgtgaagatgcgaggaggtggaacaatgaatttatagcggcatgccatcctgcaatggcaatttcaacagttcgtcactgcacgctgcctcttaaag

SEQ ID NO: 120379 - DNA, 497 bp, Homo sapiens
  chr21:28339851-28340348
  Hyper
gtgggaagttcctgccgcaagtttttcccctttgcacacccgtgcgctctggcctcgcagaccgtgcaactccatccaccagccagagcttttcagcttcccgtgcgtcccctaaccaccgcgttcccttcgcttcctcccctccgtcccggcacccggtttcctccctccccattctccagcctcttgatgctttgacgctcgccggattcgggctccgggtgactaacttctcccggccaccagcagagcggctggacagccagagagcccagggcgcttcctggcgcgctgcggtaccccggggcgagaacgcccgccgcttgggaactccgcagctttgtgtgcgaacggcgggctcccagctttctccagcacgcctttcgtcagggtccacaatctgtcccttactcccagcccactggaacttcctttgctctaaaaaggcagagcgagaaagagttaactcttagagggaattccgctcattttttttc

SEQ ID NO: 120380 - DNA, 30 bp, Homo sapiens; identical to SEQ ID NO: 88555
  chr21:28793121-28793151
  Hypo

SEQ ID NO: 120381 - DNA, 135 bp, Homo sapiens; identical to SEQ ID NO: 88556
  chr21:30275964-30276099
  Hypo

SEQ ID NO: 120382 - DNA, 44 bp, Homo sapiens; identical to SEQ ID NO: 88557
  chr21:30653794-30653838
  Hypo

SEQ ID NO: 120383 - DNA, 30 bp, Homo sapiens; identical to SEQ ID NO: 88558
  chr21:30973204-30973234
  Hypo

SEQ ID NO: 120384 - DNA, 165 bp, Homo sapiens; identical to SEQ ID NO: 88559
  chr21:31015159-31015324
  Hypo

SEQ ID NO: 120385 - DNA, 44 bp, Homo sapiens; identical to SEQ ID NO: 88560
  chr21:31057107-31057151
  Hypo

SEQ ID NO: 120386 - DNA, 190 bp, Homo sapiens; identical to SEQ ID NO: 88561
  chr21:31059342-31059532
  Hypo

SEQ ID NO: 120387 - DNA, 805 bp, Homo sapiens
  chr21:31311376-31312181
  Hyper
gtggctgcagcggctcgcgatcccttgcccagagtaggggtgccggtccctgcgaacctggatccccgcactctagcccgcgttcctggagcccagattgaaaaacccgccaactgtacctcccggggaaggccggcaccctccaggagggaagcagtgacgcggctcccccttttttgtgtagcctcccatgagcactgacctccaccttccccagctccggctcctgcgccgccgcgcgctgcctcgcccgggacccgctacacccgcgttggtgcggcgaccgaccacgtctcccgagcaggcagcctggggctcactcaccgatcctgagtacttgcggggcggtctgagggaggatatagcagaggaaatagaggagtgcccagctggtgtccctggtccagagcccgggctgggcgaggagtgtgccgtgctccatcttcctagcttcttaattcatgccgagatacagccgctgccggacgcccgagagatgcacccaacttgggccgggtccccgcctcatcctctctggatgctccggttccaagcacgctgcgcgctccccacggagcgagctcgagggaacccgcgtgggaccgcggagctggctggcaaggctgagctctctcggggctcctcagtgctgtcgctagcccatcacggctcctcctcctcctcttccatgggccgcagaccgcggaggatcagcgctctctggctcccggagcccagagaccagctgaggaaagttgctgccccgatctgcaggaacgtctccctcattcgtcctttggtcaga

SEQ ID NO: 120388 - DNA, 19 bp, Homo sapiens
  chr21:31312405-31312424
  Hyper
actgatcaagatactcgcg

SEQ ID NO: 120389 - DNA, 19 bp, Homo sapiens
  chr21:31312484-31312503
  Hyper
cacacgctcttttttctct

SEQ ID NO: 120390 - DNA, 17 bp, Homo sapiens
  chr21:31347914-31347931
  Hypo
gacgactgatcaagact

SEQ ID NO: 120391 - DNA, 30 bp, Homo sapiens; identical to SEQ ID NO: 46447
  chr21:32592616-32592646
  Hypo

SEQ ID NO: 120392 - DNA, 23 bp, Homo sapiens
  chr21:32677003-32677026
  Hypo
ttttatttttgagaccgagtctc

SEQ ID NO: 120393 - DNA, 263 bp, Homo sapiens; identical to SEQ ID NO: 88570
  chr21:32716235-32716498
  Hyper

SEQ ID NO: 120394 - DNA, 19 bp, Homo sapiens
  chr21:33143333-33143352
  Hypo
tttttttttttgagacgga

SEQ ID NO: 120395 - DNA, 55 bp, Homo sapiens; identical to SEQ ID NO: 88572
  chr21:33244992-33245047
  Hyper

SEQ ID NO: 120396 - DNA, 152 bp, Homo sapiens; identical to SEQ ID NO: 38334
  chr21:33245337-33245489
  Hyper

SEQ ID NO: 120397 - DNA, 84 bp, Homo sapiens; identical to SEQ ID NO: 88574
  chr21:33245793-33245877
  Hyper

SEQ ID NO: 120398 - DNA, 274 bp, Homo sapiens; identical to SEQ ID NO: 88575
  chr21:33246140-33246414
  Hyper

SEQ ID NO: 120399 - DNA, 23 bp, Homo sapiens
  chr21:33491252-33491275
  Hypo
actttcttcttctttcgcatcct

SEQ ID NO: 120400 - DNA, 164 bp, Homo sapiens; identical to SEQ ID NO: 88577
  chr21:33579243-33579407
  Hypo

SEQ ID NO: 120401 - DNA, 17 bp, Homo sapiens
  chr21:33604215-33604232
  Hypo
tccgtctcaaaacaaaa

SEQ ID NO: 120402 - DNA, 30 bp, Homo sapiens; identical to SEQ ID NO: 88579
  chr21:33614037-33614067
  Hypo

SEQ ID NO: 120403 - DNA, 76 bp, Homo sapiens; identical to SEQ ID NO: 88580
  chr21:33627506-33627582
  Hypo

SEQ ID NO: 120404 - DNA, 84 bp, Homo sapiens; identical to SEQ ID NO: 88581
  chr21:33628811-33628895
  Hypo

SEQ ID NO: 120405 - DNA, 30 bp, Homo sapiens; identical to SEQ ID NO: 46448
  chr21:33630406-33630436
  Hypo

SEQ ID NO: 120406 - DNA, 197 bp, Homo sapiens; identical to SEQ ID NO: 88583
  chr21:33694545-33694742
  Hypo

SEQ ID NO: 120407 - DNA, 30 bp, Homo sapiens; identical to SEQ ID NO: 88584
  chr21:33720348-33720378
  Hypo

SEQ ID NO: 120408 - DNA, 125 bp, Homo sapiens; identical to SEQ ID NO: 88585
  chr21:33721756-33721881
  Hypo

SEQ ID NO: 120409 - DNA, 134 bp, Homo sapiens; identical to SEQ ID NO: 88586
  chr21:33754456-33754590
  Hypo

SEQ ID NO: 120410 - DNA, 49 bp, Homo sapiens; identical to SEQ ID NO: 88587
  chr21:33784031-33784080
  Hyper

SEQ ID NO: 120411 - DNA, 53 bp, Homo sapiens; identical to SEQ ID NO: 88588
  chr21:33784912-33784965
  Hyper

SEQ ID NO: 120412 - DNA, 30 bp, Homo sapiens; identical to SEQ ID NO: 88589
  chr21:33805592-33805622
  Hypo

SEQ ID NO: 120413 - DNA, 202 bp, Homo sapiens; identical to SEQ ID NO: 88590
  chr21:33855579-33855781
  Hypo

SEQ ID NO: 120414 - DNA, 28 bp, Homo sapiens
  chr21:33945034-33945062
  Hypo
ggtctgaaggaggcggagctcaggccta

SEQ ID NO: 120415 - DNA, 278 bp, Homo sapiens; identical to SEQ ID NO: 46451
  chr21:33954157-33954435
  Hypo

SEQ ID NO: 120416 - DNA, 30 bp, Homo sapiens; identical to SEQ ID NO: 88593
  chr21:33958272-33958302
  Hypo

SEQ ID NO: 120417 - DNA, 84 bp, Homo sapiens; identical to SEQ ID NO: 46452
  chr21:33983236-33983320
  Hypo

SEQ ID NO: 120418 - DNA, 30 bp, Homo sapiens; identical to SEQ ID NO: 46453
  chr21:34127723-34127753
  Hypo

SEQ ID NO: 120419 - DNA, 1325 bp, Homo sapiens
  chr21:34392013-34393338
  Hyper
ctggttctcaagagccgggtgtaaggaaggaaaatcaaagattgaatttagatgtatgtattggaggggaatattggaggaagggggagcaggggagcacgcccagcctcctctcctgtctttcccgcccccttgtctaaactcaaaaccgagtccgggcgcgccttgcagggcgcccgagctctgcagcggcgttgcgggctgaacccatccggcacaaactgcgggccactggcccctcacacctgggagtttgcggcgctggcctgcagcccggggcccacgtggcggaagctttcccgggcgcgcgctgcgcagccccgcggggccggggagacaccgctcgggagtcctccgctcggctgcagaatctttatcagctgcactttaccgcagccctggctaggacgctaggcggtggagcgccctatccaggtgcgccgccgcaccatggatcaccgcgcccggtcccgcagtcccgccatggcctggggaggcccgaagcccggggacagtggccggcccatctccggctccgcggacccccggctcaggcgggagggcaggcgggtccctgcaggcccccagggagcccgggagcctctctctggcgtcattcagtcccggggcaacctgaagcgcggtagatattggagagggggcgtctgttggggggacctggcgtcattactgatggctagcagggaggagggaacgggttgtcacctcggcctcataaggccgtgagtgagtagtccagggcctcttcaggcatttttgaaactggattaactaggggggaaattgtagcactgaagccaccgtgactgtcttttgcgctgtgtggaaactccggtaaaactctttgggcaacagtcttatcaccagctcttcaacgtgtgcagcccttctggtcctgtccctgttctgggccccaggaatgcaaagcaggtccaggcactgtgaagaccctggcggtggaggaagaggcttcccggctgtggaggaagccagacccttacaacacaagacgagaaccagacctgcgtgggggagctctggatgctacaggggctcaaggaggggtggaggggccttcccaggccaacccctgaacggcttggacaagatgctcagatggacgggaggaacggcgtgtgggatgggggagctggaggcgggtgggtgggggggggaggatggggaaagcgctggcccacccagtgtgggaggggtagaggaaaagcccgcaggggccaggttgggaccccgtaggccgggttagagggcttggacttgatcctgacaggcgacagggagacata

SEQ ID NO: 120420 - DNA, 1774 bp, Homo sapiens; identical to SEQ ID NO: 88599
  chr21:34394993-34396767
  Hyper

SEQ ID NO: 120421 - DNA, 789 bp, Homo sapiens; identical to SEQ ID NO: 88600
  chr21:34396987-34397776
  Hyper

SEQ ID NO: 120422 - DNA, 2550 bp, Homo sapiens
  chr21:34397990-34400540
  Hyper
tccccaagaatctcccggccacgggcgcccattggttgtgcgcagggaggaggcgtgtgcccggcctggcgagtttcattgagcggaattagcccggatgacatcagcttcccagccccccggcgggcccagctcattggcgaggcagcccctccaggacacgcacattgttccccgcccccgcccccgccaccgctgccgccgtcgccgctgccaccgggctataaaaaccggccgagcccctaaaggtgcggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctggtgagctccccgtggtctccagatgcagcacatggactctgggccccgcgccggctctgggtgcatgtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataacctgttgcatgagagcagaggggagatagagagagcttaattataggtacccgcgtgcagctaaaaggagggccagagatagtagcgagggggacgaggagccacgggccacctgtgccgggaccccgcgctgtggtactgcggtgcaggcgggagcagcttttctgtctctcactgactcactctctctctctctccctctctctctctctcattctctctcttttctcctcctctcctggaagttttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcatcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgacccccacctccgggaaaagattctaaaaacttctttccctgagagcgtggcctgacttgcagactcggcttgggcagcac

SEQ ID NO: 120423 - DNA, 404 bp, Homo sapiens; identical to SEQ ID NO: 88607
  chr21:34401144-34401548
  Hyper

SEQ ID NO: 120424 - DNA, 2454 bp, Homo sapiens
  chr21:34442144-34444598
  Hyper
tgctggaggaaggcacgtgagttgcagcctgaccagtgcgaccagtcctccttcaacagccccgcttgccttgaaaaggcgcccttactccgctcagggggcctgtcccgcgcggctggcacaggcgctcacaataacctcctaaagcggtgccagccgcacctccgcgcggccccggcacaagcagccaatgaacacgcggctgcgcccggcctcgcgcctccattggctgcgccccgccacccgctgccccgcaggttcccaagccgggtttaaaggggtagggcgcgggccagggccccaccatcgtttccccgcgcgcaggtccgcggggaggggcggcctgccgaccggcccaccccagggcgttcctgaagggcgtcctcggccgcccccaccgcctcccagatgtactatgcggtttcccaggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttga

SEQ ID NO: 120425 - DNA, 95 bp, Homo sapiens; identical to SEQ ID NO: 16704
  chr21:34459377-34459472
  Hypo

SEQ ID NO: 120426 - DNA, 113 bp, Homo sapiens; identical to SEQ ID NO: 88612
  chr21:34466080-34466193
  Hypo

SEQ ID NO: 120427 - DNA, 103 bp, Homo sapiens; identical to SEQ ID NO: 88613
  chr21:34466627-34466730
  Hypo

SEQ ID NO: 120428 - DNA, 80 bp, Homo sapiens; identical to SEQ ID NO: 88614
  chr21:34471025-34471105
  Hypo

SEQ ID NO: 120429 - DNA, 422 bp, Homo sapiens; identical to SEQ ID NO: 88615
  chr21:34481844-34482266
  Hyper

SEQ ID NO: 120430 - DNA, 30 bp, Homo sapiens; identical to SEQ ID NO: 88616
  chr21:34494179-34494209
  Hypo

SEQ ID NO: 120431 - DNA, 62 bp, Homo sapiens; identical to SEQ ID NO: 88617
  chr21:34499655-34499717
  Hyper

SEQ ID NO: 120432 - DNA, 223 bp, Homo sapiens; identical to SEQ ID NO: 88618
  chr21:34508376-34508599
  Hypo

SEQ ID NO: 120433 - DNA, 86 bp, Homo sapiens; identical to SEQ ID NO: 88619
  chr21:34525146-34525232
  Hypo

SEQ ID NO: 120434 - DNA, 30 bp, Homo sapiens; identical to SEQ ID NO: 88620
  chr21:34538805-34538835
  Hypo

SEQ ID NO: 120435 - DNA, 30 bp, Homo sapiens; identical to SEQ ID NO: 88621
  chr21:34637000-34637030
  Hypo

SEQ ID NO: 120436 - DNA, 167 bp, Homo sapiens; identical to SEQ ID NO: 88622
  chr21:34675270-34675437
  Hypo

SEQ ID NO: 120437 - DNA, 81 bp, Homo sapiens; identical to SEQ ID NO: 88623
  chr21:34927282-34927363
  Hypo

SEQ ID NO: 120438 - DNA, 30 bp, Homo sapiens; identical to SEQ ID NO: 88624
  chr21:35426849-35426879
  Hypo

SEQ ID NO: 120439 - DNA, 303 bp, Homo sapiens; identical to SEQ ID NO: 88625
  chr21:35574350-35574653
  Hyper

SEQ ID NO: 120440 - DNA, 30 bp, Homo sapiens; identical to SEQ ID NO: 88626
  chr21:35755245-35755275
  Hypo

SEQ ID NO: 120441 - DNA, 205 bp, Homo sapiens; identical to SEQ ID NO: 88627
  chr21:35819430-35819635
  Hypo

SEQ ID NO: 120442 - DNA, 46 bp, Homo sapiens; identical to SEQ ID NO: 88628
  chr21:35832327-35832373
  Hypo

SEQ ID NO: 120443 - DNA, 30 bp, Homo sapiens; identical to SEQ ID NO: 88629
  chr21:35947071-35947101
  Hypo

SEQ ID NO: 120444 - DNA, 19 bp, Homo sapiens
  chr21:36005713-36005732
  Hypo
caggcgtgagccaccgtgc

SEQ ID NO: 120445 - DNA, 1842 bp, Homo sapiens
  chr21:36041468-36043310
  Hyper
gctgggcagaaggggcgcagaggcttggggccaagcggagtttgccctgcgggtcctgcgcaaggccccagtgccccggctaaacctttgccgcaggatcccggagccggcgtccttcaaggagcacagagggccccgtagcacgccccttgcccagcgccaccgacccttaagcagcgtcaaggaaggagtcccgatcaaggacagggatctgcggccatggccgaggccgcggagccggagggggttgccccgggtccccaggggccgccggaggtccccgcgcctctggctgagagacccggagagccaggagccgcgggcggggaggcagaagggccggaggggagcgagggcgcagaggaggcgccgaggggcgccgccgctgtgaaggaggcaggaggcggcgggccagacaggggcccggaggccgaggcgcggggcacgaggggggcgcacggcgagactgaggccgaggagggagccccggagggtgccgaggtgccccaaggaggggaggagacaagcggcgcgcagcaggtggagggggcgagcccgggacgcggcgcgcagggcgagccccgcggggaggctcagagggagcccgaggactctgcggcccccgagaggcaggaggaggcggagcagaggcctgaggtcccggaaggtagcgcgtccggggaggcgggggacagcgtagacgcggagggcccgctgggggacaacatagaagcggagggcccggcgggcgacagcgtagaggcggagggccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggtaaagctcgcttccctcaattcttaggacgacccccttccattcgaggtcttggtcatctcagatcccagagggacgcgcagggaggaacccttggtggtatcctgattgtcatcaggcgcttccatgcgcgggcggtaggcgggacagccgggatttcccggagaagagtttccagggcatttgcgggaggactcaatggtttggaagcaaagactttgggggtgggggcgacggggagtgcgatgg

SEQ ID NO: 120446 - DNA, 190 bp, Homo sapiens; identical to SEQ ID NO: 88634
  chr21:36596361-36596551
  Hypo

SEQ ID NO: 120447 - DNA, 30 bp, Homo sapiens; identical to SEQ ID NO: 88635
  chr21:37430856-37430886
  Hypo

SEQ ID NO: 120448 - DNA, 109 bp, Homo sapiens; identical to SEQ ID NO: 88636
  chr21:37527928-37528037
  Hypo

SEQ ID NO: 120449 - DNA, 30 bp, Homo sapiens; identical to SEQ ID NO: 88637
  chr21:37565748-37565778
  Hypo

SEQ ID NO: 120450 - DNA, 30 bp, Homo sapiens; identical to SEQ ID NO: 88638
  chr21:37619012-37619042
  Hypo

SEQ ID NO: 120451 - DNA, 19 bp, Homo sapiens
  chr21:37632345-37632364
  Hypo
tgggaggctgaggcacgag

SEQ ID NO: 120452 - DNA, 23 bp, Homo sapiens
  chr21:37699121-37699144
  Hypo
ttttttttttgagaccgagtctc

SEQ ID NO: 120453 - DNA, 33 bp, Homo sapiens; identical to SEQ ID NO: 88641
  chr21:37704743-37704776
  Hypo

SEQ ID NO: 120454 - DNA, 133 bp, Homo sapiens; identical to SEQ ID NO: 46460
  chr21:37750031-37750164
  Hypo

SEQ ID NO: 120455 - DNA, 46 bp, Homo sapiens; identical to SEQ ID NO: 88643
  chr21:37754435-37754481
  Hypo

SEQ ID NO: 120456 - DNA, 145 bp, Homo sapiens; identical to SEQ ID NO: 88644
  chr21:37758492-37758637
  Hypo

SEQ ID NO: 120457 - DNA, 120 bp, Homo sapiens; identical to SEQ ID NO: 88645
  chr21:37775052-37775172
  Hypo

SEQ ID NO: 120458 - DNA, 30 bp, Homo sapiens; identical to SEQ ID NO: 88646
  chr21:37780714-37780744
  Hypo

SEQ ID NO: 120459 - DNA, 23 bp, Homo sapiens
  chr21:37781166-37781189
  Hypo
ttttagacggagtttcgctcttg

SEQ ID NO: 120460 - DNA, 83 bp, Homo sapiens; identical to SEQ ID NO: 88648
  chr21:37781609-37781692
  Hypo

SEQ ID NO: 120461 - DNA, 210 bp, Homo sapiens; identical to SEQ ID NO: 88649
  chr21:38063485-38063695
  Hyper

SEQ ID NO: 120462 - DNA, 97 bp, Homo sapiens; identical to SEQ ID NO: 88650
  chr21:38064515-38064612
  Hyper

SEQ ID NO: 120463 - DNA, 1156 bp, Homo sapiens
  chr21:38064998-38066154
  Hyper
cgttggaccttcttccgcaatcgggaccactccaggtctccccggagaaggctgagtctccagcgcgtggattcagatcaggactctgtctaagtaggcgagagctggggataccgctgggggctttggcgaagctaagaaagcactggcttcttattctcaccagacatctcaacacccacgtgcgctgggtcccgcagtctctcgcccgccccacgcgggtcccagccctggtccttactccccgcgcgggaagaatctggggagggtgggggcggagaggcggctgatcggagagtgggagggaggatgggagatgggcagaggctgcccgcatcagggccaggacagacgtccgcgcggccccaggcactcacttgagtgtcacgcaagtcaccccaacaccgcacaagacagtggcggggtgcgcaccgaggcccctacctggggggtgtgcgcgcactgaacgaccccttctccaggtgcgcgagccgctccggcggccgtgcacactgcgcccccttccgcccacctgcctggcctgcgtttctaaccacgcgggcggtcccgagacttcgcgcaaaaggcaggaccgcgactcccaataatgatatcttcgaaataaccccctgctgagccggcgcccagggccgggggtagagtcccgagtcccttttgcggaattaaggagacctctggcgaccggggagcctgcccctgtgaccgctccagcagcccctgccgcgtgcgtgcccgagtgtggcccgcagctcccaaagcccaggtgtgtgtggcctagggcggggagagttggcgacccgggcccatcaccgccccagtgccaccgccccagtgcctgaccagatggggtgcggtccctacgcccggcgtggccccgccgccgctcagatctgaagtccggctttcgctcgccctgcgcggcggaacctctgacccggagcagctctaggccgtgggcttcgtctcctcctcctggaaggaatgaatgggctccccgacacacacctctcagaaaactcacctttcacgctgaccttcaaaagaaaagaaagaaagaaaaagaaaaatccgctcgaagcgggaaaatgtccacgcccggatttggggtggacacgcgccccggcctggctggagg

SEQ ID NO: 120464 - DNA, 176 bp, Homo sapiens; identical to SEQ ID NO: 88653
  chr21:38066809-38066985
  Hyper

SEQ ID NO: 120465 - DNA, 162 bp, Homo sapiens; identical to SEQ ID NO: 88654
  chr21:38067345-38067507
  Hyper

SEQ ID NO: 120466 - DNA, 30 bp, Homo sapiens; identical to SEQ ID NO: 38364
  chr21:38067871-38067901
  Hyper

SEQ ID NO: 120467 - DNA, 605 bp, Homo sapiens
  chr21:38068178-38068783
  Hyper
tagcctctcccatcccgcggggaacggccggagttcttcccttgatctctcccgagtcggcttccgctggggatggatcgcaggtaggcgccggcgcggcctggggaagaacagttgcggagcatctgaagcggaaaatccaagcagatgtgaggcgatccgggcccgcctcgttcctcttggggcctgaatttcttccagataagtttcctaatggaacatttctaagaggtggggtacgaggcggcttgctcgcacgcgcagtgggacagactgcgggtggggacgtactgagaggtccggacctcaatgcgtccgacccgtctccacaccgcccttttccagcccccagtctcctttcattccctactcttcaggctcctttggggccagtgggtgaaccgccatttagaacggtgcctcggactcgggggtcgtgcgctccatctctgcctcccccctggggcccgcgaggctggtccgggctttctgagctgggcgttcggctttaggcccaatacctggaccaggaatttcttctccccgcgccagaagggaaagacataggaggtgtcccaatctgcggtcaccgccgatgctcctga

SEQ ID NO: 120468 - DNA, 931 bp, Homo sapiens
  chr21:38069124-38070055
  Hyper
cggcgaaaggatgtgcttgggggagccgagtacacaacgtctgcttgggcagctgctgggcaggcgttgggcctggaggtatctcacacccacgtatcttccagtcttcaaacacggcattgctctgcctcccgtagcgcgcttcgaacctgcctcgcggacacgtgaacagaggctgtccctgggaagataagtgcgctttcccgtaaaatccgggaaatttgccttgaggaaagtttccgttcttgttacttgtcgggtttctcccacttccacttagccatgtttctgcgatctgggtaatccctttcaagcccaggaggaattctcccgggtccataattgagggtcggaagccgtgggggtgagaaacgcattaaatcctcccgaagcccaggaggtgccagagcgggctcagggggccgcctgcggaagctgcggcaggggctgggtccgtagcctctaaccccttggagctccttctcccagaggcccggagccggcagctgtcagcgcagccaggagcgggatcctgggcgcggaggtgggtccgactcgccaggcttgggcattggagacccgcgccgctagcccatggccctctgctcaagccgctgcaacaggaaagcgctcctggatccgaaaccccaaaggaaagcgctgttactctgtgcgtccggctcgcgtggcgtcgcggtttcggagcaccaagcctgcgagccctggccacgatgtggactccgcaaggggctagggacaggcagggggagagcccgggtttgcgcacaccttccagcccctggagggagcctgctcggcttcgaacgccttcgaacttttgaccttcaaaggagtccctggaaaaggtcaggagcgcctgctgcaggcacggttgccgaaggccaggccttcctggcgcaggggagggcca

SEQ ID NO: 120469 - DNA, 639 bp, Homo sapiens; identical to SEQ ID NO: 88660
  chr21:38070425-38071064
  Hyper

SEQ ID NO: 120470 - DNA, 52 bp, Homo sapiens; identical to SEQ ID NO: 88661
  chr21:38071635-38071687
  Hyper

SEQ ID NO: 120471 - DNA, 551 bp, Homo sapiens; identical to SEQ ID NO: 88662
  chr21:38072016-38072567
  Hyper

SEQ ID NO: 120472 - DNA, 972 bp, Homo sapiens
  chr21:38072905-38073877
  Hyper
agggtcagcttcaggcgctgcgagtcagcggggatcacggtgaggcccaagcactgcaggctgaggccacagagcgaacacttgtgctgagccgggccctctcgtgaggctggggtgcgggaagtccgggcaggagagacccgcccccgccgttgctgagctgagacccggctgaaagagaggggtccgattaattcgaaaatggcagacagagctgagcgctgccgttcttttcaggattgaaaatgtgccagtgggccaggggcgctgggacccgcggtgcggaagactcggaacaggaagaaatagtggcgcgctgggtgggctgccccgccgcccacgccggttgccgctggtgacagtggctgcccggccaggcacctccgagcagcaggtctgagcgtttttggcgtcccaagcgttccgggccgcgtcttccagagcctctgctcccagcggggtcgctgcggcctggcccgaaggatttgactctttgctgggaggcgcgctgctcagggttctggtgggtcctctgggcccaggagctgggagggctgcgccggcctctggagccccgggagccagtgccgaggtagggagacaacttccgccgcagggcgccggacggtcggggcagagcaggcgacaggtgtccctaggccgcagggcgcttccatagcgccatccccaccaggcactctactcgaaatcggaaagctcgaccttttgcgttcgcctctgccaagcctgttatttgtgctggccgctgggtctggagctgcgcttctcggcccctccccggtggagcgcagagggctggtctgcaagcgcggcctccagccccgcggctccccggcccaggagccaggcgcgggctgacccgggagcacccggcagcggagggggctggaagcggaccctaggcctctcctgtgccacccggccctaccgcgcggccgcggggcgctctcc

SEQ ID NO: 120473 - DNA, 40 bp, Homo sapiens; identical to SEQ ID NO: 88666
  chr21:38074462-38074502
  Hyper

SEQ ID NO: 120474 - DNA, 30 bp, Homo sapiens; identical to SEQ ID NO: 38375
  chr21:38075927-38075957
  Hyper

SEQ ID NO: 120475 - DNA, 35 bp, Homo sapiens; identical to SEQ ID NO: 13975
  chr21:38076386-38076421
  Hyper

SEQ ID NO: 120476 - DNA, 1002 bp, Homo sapiens
  chr21:38076747-38077749
  Hyper
ccaggagggaaagcccgcaggcgcagaggggacaatccgggaagtggtaaaggggacacccgggcacagggcctgtgctttcgttgcaggcgaggaagtggagcgcgcgctgcagattcagcgcggggctagaggaggggacctggatccctgaaccccggggcggaaagggagcctccgggcggctgtgggtgccgcgctcctcggagccagcagctgctggggcggcgtccgaactccccaggtctgcgcacggcaatgggggcaccgggccttctgtctgtcctcagaatacgtaggatacccgcgggcgacaagccgggccaggctaggagcctccttccctgcccctccccatcggccgcgggaggctttcttggggcgtccccacgaccacccccttctcacccggtccccagtttggaaaaaggcgcaagaagcgggcttttcagggaccccggggagaacacgagggctccgacgcgggagaaggattgaagcgtgcagaggcgccccaaattgcgacaatttactgggatccttttgtggggaaaggaggcttagaggctcaagctataggctgtcctagagcaactaggcgagaacctggccccaaactccctccttacgccctggcacaggttcccggcgactggtgttcccaagggagccccctgagcctaccgcccttgcagggggtcgtgctgcggcttctgggtcataaacgccgaggtcgggggtggcggagctgtagaggctgcccgcgcagaaagctccaggatcccaatatgtgcttgcgtggagcagggagcggaagaggcagccggtcctcaccctcctctcccgccacgcacatatccttcttgacttcgaagtggtttgcaatccgaaagtgagaccttgagtcctcagatggccggcaacgcgccgaggtcacgctccccagaaacacccctctcccctcccctaccccagctccccctggggcgggtggtaattggg

SEQ ID NO: 120477 - DNA, 72 bp, Homo sapiens; identical to SEQ ID NO: 38379
  chr21:38078415-38078487
  Hyper

SEQ ID NO: 120478 - DNA, 44 bp, Homo sapiens; identical to SEQ ID NO: 88672
  chr21:38078751-38078795
  Hyper

SEQ ID NO: 120479 - DNA, 845 bp, Homo sapiens
  chr21:38079908-38080753
  Hyper
taggtttttagttgccgaatagggaagggtttgcgaagccgctgccctgggccgaggtgcattttacgcttccagaggtcgaggcctccagagaccgcgatgcccagggcgttcccggggaggctgagagacccagggtgctctgggtgactgcacggcgactcctcgggaacccactcgtggctgcccgcttggaagggctttgcggccccgggaacgatctccaggatctccacggctggtcaggttccccgtccctcgtatcccgcgctgcccgggggctcctgcctttggttcagtgctcgcggcaccaccgcactcaggacggcagtggggggctggggctggggctgggcctggcccagcgtgggttggggcgggggacgcgccagcagcgcccgcagctcgctccgcaggggtcgcagccaggggtcgggagctaggctcgtgggccgggagacgccgggcgcgttgtcctccggggaggttggggtgcaggcggtgcaccgaccctcgccatctggcgctgcagccaccagccacggcgcttagtggagggtctgcggccaggctcccggcggaaagattccggggagggctcgggggttgtcccagcccgcgctaagcgccgcagcctcgcccggctttcctgcttcctcggactgtgcaggggaagcctggggtctcgcggggcgcagcagtcaggtcgagggtgcagcaggaggggagtcctgacgggcaggtccctctttcccctggtgcgcaacactggttggtagcttttgcggaggtggtgaagaagggcaggaggcctgttgagcggaggagtccggggatccctaatt

SEQ ID NO: 120480 - DNA, 705 bp, Homo sapiens
  chr21:38081208-38081913
  Hyper
tgggcctggcaggctcgcacaggcgcccgggctgccggccgctgcggggatttctcccccagccttttctttttaacagagggcaaaggggcgacggcgagagcacagatggcggctgcggagccggggaggcggcggggagacgcgcgggactcgtggggagggctggcagggtgcaggggttccgcgtgacctgcccggctcccaggcatcgggctgggcgctgcagtttaccgatttgctttcgtccctcgtccaggtttaggagacgcgtggggacagccgagccgcgccgggcccctggacggcgtcgccaaggagctgggatcgcacttgctgcaggtagagcggcctcgccgggggaggagcgcagccgccgcaggctcccttcccaccccgccaccccagcctccaggcgtcccttccccaggagcgccaggcagatccagaggctgccgggggctggggatggggtggtccccactgcggagggatggacgcttagcatgtcggatgcggcctgcggccaaccctaccctaaccctacgtctgcccccacaccccgccgaaggccccaggactccccaggccacctgagacctacgccaggggcgcctcccgagcgtggtcaagtgctttccaatctcacttccctcagcaggttccacccagcgcttgctctgtgccaggcgccagggctggagc

SEQ ID NO: 120481 - DNA, 696 bp, Homo sapiens
  chr21:38082478-38083174
  Hyper
ctaaggtcacacagcaaggggtggagcggagttagcccactggcctagctctagagcccacccggataaccagaacttggtgaggcctccgggctcttgcttggtttggagccaggtgcttagcgccccgagcccggggccattcaccctgcaggagctgcacgcgcccctgacctcggcttttccctggcagcagaggggctttgcgggtcggccgggtagccctgagcacagctcgccacttccaggtgggctgttggcgctggctggggacacatcccgatctttcaaatgccctttacagagcctcatcaacgacccgattcattcccccctcctgtcatttgtctctgccatcgaaaaatgcctaccgagagctgctctgcatttccgccctctattttgtgttttactttaaaataataataaaaaaaatgttggctgcaggacgccatgacttaggtcagcgagtcagccgctagctctgcatttccaaaaagcagatcttttcacaactctcttgccccaagtgccctggtgtggtttattttttaaaatgcatgcctgcggaagagaagacccggggaatattcgaaaccccgagcttttacaacataaagcgcatggtgtggccgcggcgagtaatggcgctctgggagccctgcccaggcggcctctgctcgccctcctccactt

SEQ ID NO: 120482 - DNA, 234 bp, Homo sapiens; identical to SEQ ID NO: 88679
  chr21:38092055-38092289
  Hypo

SEQ ID NO: 120483 - DNA, 958 bp, Homo sapiens
  chr21:38119754-38120712
  Hyper
ttccctgctttgtaacgcggctcctggaacatttcaggtcgcgtcctgagattggacagcacggcctagactaaggcgggggagggcgacagcgaccccgcgggtgcagcgcgtgggcggccgaggggtggtggctgcgcccggggcttgggggtggggtggctgcggccgcgccccttgctgccctctaacgtgtcgcctgtccccgcagcgcccgccgccgccgtgcgcaggttcggcgaggacaccgcgcccccgagcttcccgagctgcggccactaccgcgaggagcccgcgctgggcccggccaaagccgcccgccaggccgcccgggacggggcgcggctggcgctggcccgcgcggcacccgagtgctgcgcgcccccgacccccgaggccccgggcgcgccggcgcagctgcccttcgtgctgctcaactaccaccgcgtgctggcccggcgcggaccgctggggggcgccgcacccgccgcctccggcctggcctgcgctcccggcggccccgaggcggcgaccggcgcgctgcggctccggcacccgagccccgccgccacctccccgcccggcgcgcccctgccgcactacctgggcgcctcggtcatcatcaccaacgggaggtgacccgctggccgcccgcgccaggagcctggacccggcctcccggggctgcggcgccaccgagcccggcaaatgcgcacgacctacattaatttatgcagagacagctgtttgaattggaccccgccgccgacttgcggatttccaccgcggaggccccgcgcgccggtgccgagggccgaggagcgcccgggtccgggcaggtgaccgcccgcctctgtcctgcgagggccggtgcgacccagttgctgggggcttggtttcctcaccttgaaatcgggcttcacgcgtcttgccttgtccccaacgttccacaacagtc

SEQ ID NO: 120484 - DNA, 40 bp, Homo sapiens; identical to SEQ ID NO: 46465
  chr21:38363098-38363138
  Hypo

SEQ ID NO: 120485 - DNA, 247 bp, Homo sapiens
  chr21:38378381-38378628
  Hyper
gctgccgctctaaggcggtggaagcgagattctccggaaacccagggaatccgatgctcgcacaggaccaaagcccgaggccgcggggaccacagagggacggagaagccgggactcctcacatcccacatccggcaggggaagcccagcaggtgagcgcaggtccccccagtccccgagggagtgcgcccgacggaaacgcccctagcccgcgggcctcgctttcctctcccgggttcctgggtca

SEQ ID NO: 120486 - DNA, 335 bp, Homo sapiens; identical to SEQ ID NO: 88684
  chr21:38378928-38379263
  Hyper

SEQ ID NO: 120487 - DNA, 65 bp, Homo sapiens; identical to SEQ ID NO: 88685
  chr21:38379523-38379588
  Hyper

SEQ ID NO: 120488 - DNA, 30 bp, Homo sapiens; identical to SEQ ID NO: 88686
  chr21:38383158-38383188
  Hypo

SEQ ID NO: 120489 - DNA, 30 bp, Homo sapiens; identical to SEQ ID NO: 88687
  chr21:38593074-38593104
  Hyper

SEQ ID NO: 120490 - DNA, 367 bp, Homo sapiens; identical to SEQ ID NO: 88688
  chr21:38593362-38593729
  Hyper

SEQ ID NO: 120491 - DNA, 77 bp, Homo sapiens; identical to SEQ ID NO: 88689
  chr21:38602978-38603055
  Hypo

SEQ ID NO: 120492 - DNA, 30 bp, Homo sapiens; identical to SEQ ID NO: 88690
  chr21:38603457-38603487
  Hypo

SEQ ID NO: 120493 - DNA, 63 bp, Homo sapiens; identical to SEQ ID NO: 88691
  chr21:38606032-38606095
  Hypo

SEQ ID NO: 120494 - DNA, 216 bp, Homo sapiens; identical to SEQ ID NO: 88692
  chr21:38638487-38638703
  Hypo

SEQ ID NO: 120495 - DNA, 30 bp, Homo sapiens; identical to SEQ ID NO: 46467
  chr21:38823635-38823665
  Hypo

SEQ ID NO: 120496 - DNA, 23 bp, Homo sapiens
  chr21:38880597-38880620
  Hypo
tctcccctgctgagacggagtct

SEQ ID NO: 120497 - DNA, 102 bp, Homo sapiens; identical to SEQ ID NO: 88695
  chr21:38918459-38918561
  Hypo

SEQ ID NO: 120498 - DNA, 142 bp, Homo sapiens; identical to SEQ ID NO: 46469
  chr21:38935380-38935522
  Hypo

SEQ ID NO: 120499 - DNA, 77 bp, Homo sapiens; identical to SEQ ID NO: 88697
  chr21:38936189-38936266
  Hyper

SEQ ID NO: 120500 - DNA, 30 bp, Homo sapiens; identical to SEQ ID NO: 46470
  chr21:38987670-38987700
  Hypo

SEQ ID NO: 120501 - DNA, 138 bp, Homo sapiens; identical to SEQ ID NO: 88699
  chr21:39047670-39047808
  Hyper

SEQ ID NO: 120502 - DNA, 295 bp, Homo sapiens; identical to SEQ ID NO: 88700
  chr21:39286580-39286875
  Hyper

SEQ ID NO: 120503 - DNA, 395 bp, Homo sapiens; identical to SEQ ID NO: 88701
  chr21:39287999-39288394
  Hyper

SEQ ID NO: 120504 - DNA, 126 bp, Homo sapiens
  chr21:39288775-39288901
  Hyper
tgctggggaaaaagccgcacagcgccggcgcggtccgggaggaaggggcgggggcgagcaggacagagccacagacccagagacgcccaccccgccgcccatgccagctagcgtgtcagcgcgtcg

SEQ ID NO: 120505 - DNA, 145 bp, Homo sapiens; identical to SEQ ID NO: 88703
  chr21:39289180-39289325
  Hyper

SEQ ID NO: 120506 - DNA, 30 bp, Homo sapiens; identical to SEQ ID NO: 88704
  chr21:39953590-39953620
  Hypo

SEQ ID NO: 120507 - DNA, 30 bp, Homo sapiens; identical to SEQ ID NO: 88705
  chr21:40022607-40022637
  Hypo

SEQ ID NO: 120508 - DNA, 82 bp, Homo sapiens; identical to SEQ ID NO: 38398
  chr21:40032153-40032235
  Hyper

SEQ ID NO: 120509 - DNA, 291 bp, Homo sapiens
  chr21:40032557-40032848
  Hyper
tcgcactaactccctcggcgccgacgggctcagcccatggtgtgggcgccgggttcagggaggctccggctcccgccaatcgcggagcagggcggccgccccgacgcgcgacttgcgaacccggagtgcgcgccgggggcggggcagggacgcgtgggcgggaatgcacgcgcgtggccaggtgcgcgtgggtgcgagcgcgcgggagtcttcgagtgcgcgcgtgtccgtgtgcgcgtgggtgtgggtgtgctcgcgtgtccgtgcgcgcgccctcggggccaagagcgc

SEQ ID NO: 120510 - DNA, 252 bp, Homo sapiens; identical to SEQ ID NO: 88708
  chr21:40033106-40033358
  Hyper

SEQ ID NO: 120511 - DNA, 30 bp, Homo sapiens; identical to SEQ ID NO: 88709
  chr21:40106338-40106368
  Hyper

SEQ ID NO: 120512 - DNA, 30 bp, Homo sapiens; identical to SEQ ID NO: 88710
  chr21:40394086-40394116
  Hypo

SEQ ID NO: 120513 - DNA, 146 bp, Homo sapiens; identical to SEQ ID NO: 88711
  chr21:40510522-40510668
  Hypo

SEQ ID NO: 120514 - DNA, 206 bp, Homo sapiens; identical to SEQ ID NO: 88712
  chr21:40630336-40630542
  Hypo

SEQ ID NO: 120515 - DNA, 41 bp, Homo sapiens; identical to SEQ ID NO: 88713
  chr21:40717636-40717677
  Hypo

SEQ ID NO: 120516 - DNA, 30 bp, Homo sapiens; identical to SEQ ID NO: 38401
  chr21:40984793-40984823
  Hyper

SEQ ID NO: 120517 - DNA, 36 bp, Homo sapiens; identical to SEQ ID NO: 88715
  chr21:42218886-42218922
  Hyper

SEQ ID NO: 120518 - DNA, 30 bp, Homo sapiens; identical to SEQ ID NO: 88716
  chr21:42447793-42447823
  Hypo

SEQ ID NO: 120519 - DNA, 39 bp, Homo sapiens; identical to SEQ ID NO: 46472
  chr21:42448116-42448155
  Hypo

SEQ ID NO: 120520 - DNA, 145 bp, Homo sapiens; identical to SEQ ID NO: 88718
  chr21:42572656-42572801
  Hypo

SEQ ID NO: 120521 - DNA, 30 bp, Homo sapiens; identical to SEQ ID NO: 88719
  chr21:42606870-42606900
  Hypo

SEQ ID NO: 120522 - DNA, 63 bp, Homo sapiens; identical to SEQ ID NO: 88720
  chr21:42613756-42613819
  Hypo

SEQ ID NO: 120523 - DNA, 611 bp, Homo sapiens; identical to SEQ ID NO: 88721
  chr21:42688619-42689230
  Hyper

SEQ ID NO: 120524 - DNA, 104 bp, Homo sapiens; identical to SEQ ID NO: 88722
  chr21:42797863-42797967
  Hyper

SEQ ID NO: 120525 - DNA, 47 bp, Homo sapiens; identical to SEQ ID NO: 88723
  chr21:42798497-42798544
  Hyper

SEQ ID NO: 120526 - DNA, 530 bp, Homo sapiens; identical to SEQ ID NO: 88724
  chr21:42878710-42879240
  Hyper

SEQ ID NO: 120527 - DNA, 45 bp, Homo sapiens; identical to SEQ ID NO: 88725
  chr21:42880059-42880104
  Hyper

SEQ ID NO: 120528 - DNA, 194 bp, Homo sapiens; identical to SEQ ID NO: 88726
  chr21:42880402-42880596
  Hyper

SEQ ID NO: 120529 - DNA, 18 bp, Homo sapiens
  chr21:42925199-42925217
  Hypo
ttaaagattacaggccgg

SEQ ID NO: 120530 - DNA, 30 bp, Homo sapiens; identical to SEQ ID NO: 46474
  chr21:42953643-42953673
  Hypo

SEQ ID NO: 120531 - DNA, 30 bp, Homo sapiens; identical to SEQ ID NO: 46475
  chr21:43033404-43033434
  Hypo

SEQ ID NO: 120532 - DNA, 30 bp, Homo sapiens; identical to SEQ ID NO: 88730
  chr21:43187812-43187842
  Hyper

SEQ ID NO: 120533 - DNA, 55 bp, Homo sapiens; identical to SEQ ID NO: 88731
  chr21:43188093-43188148
  Hyper

SEQ ID NO: 120534 - DNA, 30 bp, Homo sapiens; identical to SEQ ID NO: 88732
  chr21:43188455-43188485
  Hyper

SEQ ID NO: 120535 - DNA, 430 bp, Homo sapiens; identical to SEQ ID NO: 88733
  chr21:43248491-43248921
  Hypo

SEQ ID NO: 120536 - DNA, 272 bp, Homo sapiens; identical to SEQ ID NO: 88734
  chr21:43255502-43255774
  Hypo

SEQ ID NO: 120537 - DNA, 61 bp, Homo sapiens; identical to SEQ ID NO: 88735
  chr21:43376373-43376434
  Hypo

SEQ ID NO: 120538 - DNA, 38 bp, Homo sapiens; identical to SEQ ID NO: 46479
  chr21:43493035-43493073
  Hypo

SEQ ID NO: 120539 - DNA, 30 bp, Homo sapiens; identical to SEQ ID NO: 88737
  chr21:43520167-43520197
  Hypo

SEQ ID NO: 120540 - DNA, 123 bp, Homo sapiens; identical to SEQ ID NO: 88738
  chr21:43521309-43521432
  Hypo

SEQ ID NO: 120541 - DNA, 43 bp, Homo sapiens; identical to SEQ ID NO: 88739
  chr21:43526266-43526309
  Hypo

SEQ ID NO: 120542 - DNA, 30 bp, Homo sapiens; identical to SEQ ID NO: 88740
  chr21:43527383-43527413
  Hypo

SEQ ID NO: 120543 - DNA, 60 bp, Homo sapiens; identical to SEQ ID NO: 88741
  chr21:43640641-43640701
  Hyper

SEQ ID NO: 120544 - DNA, 30 bp, Homo sapiens; identical to SEQ ID NO: 88742
  chr21:43714330-43714360
  Hypo

SEQ ID NO: 120545 - DNA, 95 bp, Homo sapiens; identical to SEQ ID NO: 88743
  chr21:43725826-43725921
  Hypo

SEQ ID NO: 120546 - DNA, 245 bp, Homo sapiens; identical to SEQ ID NO: 46481
  chr21:43786496-43786741
  Hypo

SEQ ID NO: 120547 - DNA, 30 bp, Homo sapiens; identical to SEQ ID NO: 88745
  chr21:43852234-43852264
  Hypo

SEQ ID NO: 120548 - DNA, 30 bp, Homo sapiens; identical to SEQ ID NO: 88746
  chr21:43859152-43859182
  Hypo

SEQ ID NO: 120549 - DNA, 45 bp, Homo sapiens; identical to SEQ ID NO: 46482
  chr21:43864728-43864773
  Hypo

SEQ ID NO: 120550 - DNA, 30 bp, Homo sapiens; identical to SEQ ID NO: 88748
  chr21:43981657-43981687
  Hypo

SEQ ID NO: 120551 - DNA, 193 bp, Homo sapiens; identical to SEQ ID NO: 88749
  chr21:43991300-43991493
  Hypo

SEQ ID NO: 120552 - DNA, 102 bp, Homo sapiens; identical to SEQ ID NO: 88750
  chr21:44037537-44037639
  Hypo

SEQ ID NO: 120553 - DNA, 191 bp, Homo sapiens; identical to SEQ ID NO: 88751
  chr21:44073316-44073507
  Hyper

SEQ ID NO: 120554 - DNA, 30 bp, Homo sapiens; identical to SEQ ID NO: 88752
  chr21:44081613-44081643
  Hypo

SEQ ID NO: 120555 - DNA, 43 bp, Homo sapiens; identical to SEQ ID NO: 88753
  chr21:44086020-44086063
  Hypo

SEQ ID NO: 120556 - DNA, 30 bp, Homo sapiens; identical to SEQ ID NO: 46484
  chr21:44093215-44093245
  Hypo

SEQ ID NO: 120557 - DNA, 30 bp, Homo sapiens; identical to SEQ ID NO: 88755
  chr21:44163509-44163539
  Hypo

SEQ ID NO: 120558 - DNA, 30 bp, Homo sapiens; identical to SEQ ID NO: 88756
  chr21:44187199-44187229
  Hypo

SEQ ID NO: 120559 - DNA, 42 bp, Homo sapiens; identical to SEQ ID NO: 88757
  chr21:44283111-44283153
  Hypo

SEQ ID NO: 120560 - DNA, 88 bp, Homo sapiens; identical to SEQ ID NO: 88758
  chr21:44283686-44283774
  Hypo

SEQ ID NO: 120561 - DNA, 378 bp, Homo sapiens; identical to SEQ ID NO: 46486
  chr21:44338174-44338552
  Hypo

SEQ ID NO: 120562 - DNA, 52 bp, Homo sapiens; identical to SEQ ID NO: 88760
  chr21:44340200-44340252
  Hypo

SEQ ID NO: 120563 - DNA, 30 bp, Homo sapiens; identical to SEQ ID NO: 88761
  chr21:44361878-44361908
  Hypo

SEQ ID NO: 120564 - DNA, 30 bp, Homo sapiens; identical to SEQ ID NO: 88762
  chr21:44474704-44474734
  Hypo

SEQ ID NO: 120565 - DNA, 129 bp, Homo sapiens; identical to SEQ ID NO: 88763
  chr21:44480656-44480785
  Hypo

SEQ ID NO: 120566 - DNA, 115 bp, Homo sapiens; identical to SEQ ID NO: 88764
  chr21:44482572-44482687
  Hypo

SEQ ID NO: 120567 - DNA, 62 bp, Homo sapiens; identical to SEQ ID NO: 88765
  chr21:44482892-44482954
  Hypo

SEQ ID NO: 120568 - DNA, 30 bp, Homo sapiens; identical to SEQ ID NO: 88766
  chr21:44483216-44483246
  Hypo

SEQ ID NO: 120569 - DNA, 50 bp, Homo sapiens; identical to SEQ ID NO: 88767
  chr21:44483958-44484008
  Hypo

SEQ ID NO: 120570 - DNA, 1442 bp, Homo sapiens
  chr21:44494615-44496057
  Hyper
gtaagaagccgccgccgtgagcggagcagcaccttcctccgcgggtcgcgggagtcacctacgggaagggactctccgtctggcacaggccctgtctggcctggggcgcgcatgctccgccgccgaatcttccagaaagccgtggacccgaggccccggcagacgcaggcggcccagcgccttgcttttggcccctcgcctcgccctggagccctctctcgcaaggtaagggactgccgggaacgcagatcgcaagccgtcggggctctgtagaactcagaggcgctcggcggaaagctcgccaggcgacccagacccgaacccgcgggctccccaagacaacagcgccgggcggccggatgcacgtgcgtcccgggaaggcgggttcagctggcatcgcctggccggttccgttcgctccttaaaccacaagacccccttggggtcacgacgttcccggggcacccctgcactcgcgcgccagcactcccggaggggcctggggaaggccacgcgcacggagagcgggaaactcctctaggtttccaggtgggagatccagaccctactgagacccggaaaccgccggccactccgcctccggaagcgacactttgggacaaagctggggacaagtaagcccagaagatcctcgggaagccgagaatttcgcgctccgctctcccacccacgctccgcctcccgcttgcatcctacagctcagctgcggtctcgcctggggctcagggaagtgaggtcccaggaaaacctccatcccccgaacgcaacctgggcagagccccgcgtccctcccccagcgggcacccacctcgcgtgccgcccgcgcaacgacagcgtttaccgccaccccacacggtccgccaaaaagggcgatttgcaaacagccatttcccatccacaatgcagcgaactcaatgctgggcaccgaaacgtgcatctcccccggattcccaccccgcgtccctgctccacgctccaggactcgccgccagtggggtccactccgccggcgcgggggctggggtgggagcccggggccacgtgcacggccagcccccatcttctgggcggtcaagaccgcaggcgtgggcgccggtggggcgggggtcttgggagaccctgtctcgccgcctttcggtgcagatgatgcaactctgggcggaggcgcggagagggaaaccgggacccagttgagatcctctgtccagagaggggagcgagtctcggtggggccggatctcacctggacggatacatggaaaagaggggcgagcggctgccccgactgcggcgaggcggagacggcgaccccggggtggcggcctcgcggggacccacggcgaggggagcaggcgggcggtgattggcggagaggcgggggcggaggccggcgccggccaatgtctcgtggcagagcaccc

SEQ ID NO: 120571 - DNA, 596 bp, Homo sapiens; identical to SEQ ID NO: 88771
  chr21:44496362-44496958
  Hyper

SEQ ID NO: 120572 - DNA, 145 bp, Homo sapiens; identical to SEQ ID NO: 88772
  chr21:44561152-44561297
  Hypo

SEQ ID NO: 120573 - DNA, 203 bp, Homo sapiens; identical to SEQ ID NO: 88773
  chr21:44752326-44752529
  Hypo

SEQ ID NO: 120574 - DNA, 409 bp, Homo sapiens; identical to SEQ ID NO: 88774
  chr21:44836740-44837149
  Hypo

SEQ ID NO: 120575 - DNA, 253 bp, Homo sapiens; identical to SEQ ID NO: 88775
  chr21:44837378-44837631
  Hypo

SEQ ID NO: 120576 - DNA, 671 bp, Homo sapiens; identical to SEQ ID NO: 88776
  chr21:44840856-44841527
  Hypo

SEQ ID NO: 120577 - DNA, 353 bp, Homo sapiens
  chr21:44847511-44847864
  Hyper
ggacgtgcgggggcccgggggcctcgcgggctcgcgcgtggggctggcggcgcggatgccctggggcgctgcagaccccgagaggccgcttgcccgcggggacgtcagccgcttttgctgttaaaatctgaaatgttcagcaagttagaaacttgaaacctaaggaagcgtgaccggccgctctggaagcccccgccgcgcggccggtcccggccccggccctcagcggcgctggcgtctgcgcgtcccggggctgcccccgcagcatgtggggctgggaccctcttcccgcgcgggccccgggcggacgctgcgggcggtgacggagccaggccggccgcctgggtagggga

SEQ ID NO: 120578 - DNA, 378 bp, Homo sapiens; identical to SEQ ID NO: 88779
  chr21:44866552-44866930
  Hypo

SEQ ID NO: 120579 - DNA, 30 bp, Homo sapiens; identical to SEQ ID NO: 46493
  chr21:44871839-44871869
  Hypo

SEQ ID NO: 120580 - DNA, 139 bp, Homo sapiens; identical to SEQ ID NO: 88781
  chr21:44881175-44881314
  Hypo

SEQ ID NO: 120581 - DNA, 98 bp, Homo sapiens; identical to SEQ ID NO: 88782
  chr21:45078776-45078874
  Hypo

SEQ ID NO: 120582 - DNA, 35 bp, Homo sapiens; identical to SEQ ID NO: 88783
  chr21:45140241-45140276
  Hypo

SEQ ID NO: 120583 - DNA, 111 bp, Homo sapiens; identical to SEQ ID NO: 88784
  chr21:45140489-45140600
  Hypo

SEQ ID NO: 120584 - DNA, 97 bp, Homo sapiens; identical to SEQ ID NO: 88785
  chr21:45140831-45140928
  Hypo

SEQ ID NO: 120585 - DNA, 750 bp, Homo sapiens
  chr21:45148278-45149028
  Hyper
ctgggtgggtggcttcggcttctgtgcagcgctcaccctgctctcccctggaacgcctggaactagggtggtcaggctggggtggaggagctcccctggaatgttccagagcttcccccactcctgccgttctgagtcaccctgcctccccggaggaggaggaggatcagctgagccgccgcgctcacgtagtgtctggctgtctgcctgtctgcctcgctgtgagcagagtgggatgctgccgataaggcgcgcacgtgggccctgggaggagcccgaggcagccactcccgcacgtgggcaggaggagggctgctcacaccaccggccgagggaggaggactgcgggctgcgcctgggcaggggatgagcttgtgtcgcgggcggcagggggaagggagtcggagagctcctgcggtccagccggatgactgatgaggttgaaagcacttccgctgcggcccccgcaggaagttcccaggaggaagttgcgaccctttctaagccatcccactggcctggactctgctgggattattttgaccccccagggcagagtgtagccatctgactggctttctctctcggcaggagacggggcgcacgcctgcaggtgggggagccccaatacgtcacacggatgagcggggcaaagcccagccccccaccccgcacccgcccgcccgcaatcctgccccctggctgcggcctccgcggctcttcccaccccggctccgctgggtgcttggc

SEQ ID NO: 120586 - DNA, 189 bp, Homo sapiens; identical to SEQ ID NO: 88787
  chr21:45170219-45170408
  Hypo

SEQ ID NO: 120587 - DNA, 80 bp, Homo sapiens; identical to SEQ ID NO: 88788
  chr21:45186755-45186835
  Hypo

SEQ ID NO: 120588 - DNA, 30 bp, Homo sapiens; identical to SEQ ID NO: 88789
  chr21:45187186-45187216
  Hypo

SEQ ID NO: 120589 - DNA, 30 bp, Homo sapiens; identical to SEQ ID NO: 88790
  chr21:45187276-45187306
  Hypo

SEQ ID NO: 120590 - DNA, 215 bp, Homo sapiens; identical to SEQ ID NO: 88791
  chr21:45195149-45195364
  Hypo

SEQ ID NO: 120591 - DNA, 41 bp, Homo sapiens; identical to SEQ ID NO: 88792
  chr21:45198310-45198351
  Hypo

SEQ ID NO: 120592 - DNA, 30 bp, Homo sapiens; identical to SEQ ID NO: 88793
  chr21:45198576-45198606
  Hypo

SEQ ID NO: 120593 - DNA, 102 bp, Homo sapiens; identical to SEQ ID NO: 88794
  chr21:45201249-45201351
  Hypo

SEQ ID NO: 120594 - DNA, 79 bp, Homo sapiens; identical to SEQ ID NO: 88795
  chr21:45232923-45233002
  Hypo

SEQ ID NO: 120595 - DNA, 30 bp, Homo sapiens; identical to SEQ ID NO: 88796
  chr21:45245930-45245960
  Hypo

SEQ ID NO: 120596 - DNA, 30 bp, Homo sapiens; identical to SEQ ID NO: 16719
  chr21:45247147-45247177
  Hypo

SEQ ID NO: 120597 - DNA, 101 bp, Homo sapiens; identical to SEQ ID NO: 88798
  chr21:45249923-45250024
  Hypo

SEQ ID NO: 120598 - DNA, 40 bp, Homo sapiens; identical to SEQ ID NO: 88799
  chr21:45250324-45250364
  Hypo

SEQ ID NO: 120599 - DNA, 30 bp, Homo sapiens; identical to SEQ ID NO: 88800
  chr21:45256017-45256047
  Hypo

SEQ ID NO: 120600 - DNA, 181 bp, Homo sapiens; identical to SEQ ID NO: 88801
  chr21:45268768-45268949
  Hypo

SEQ ID NO: 120601 - DNA, 92 bp, Homo sapiens; identical to SEQ ID NO: 88802
  chr21:45272579-45272671
  Hypo

SEQ ID NO: 120602 - DNA, 30 bp, Homo sapiens; identical to SEQ ID NO: 46501
  chr21:45273343-45273373
  Hypo

SEQ ID NO: 120603 - DNA, 334 bp, Homo sapiens; identical to SEQ ID NO: 46502
  chr21:45273579-45273913
  Hypo

SEQ ID NO: 120604 - DNA, 99 bp, Homo sapiens; identical to SEQ ID NO: 46503
  chr21:45276620-45276719
  Hypo

SEQ ID NO: 120605 - DNA, 30 bp, Homo sapiens; identical to SEQ ID NO: 46504
  chr21:45299990-45300020
  Hypo

SEQ ID NO: 120606 - DNA, 30 bp, Homo sapiens; identical to SEQ ID NO: 88807
  chr21:45349806-45349836
  Hypo

SEQ ID NO: 120607 - DNA, 56 bp, Homo sapiens; identical to SEQ ID NO: 88808
  chr21:45352946-45353002
  Hypo

SEQ ID NO: 120608 - DNA, 62 bp, Homo sapiens; identical to SEQ ID NO: 88809
  chr21:45353502-45353564
  Hypo

SEQ ID NO: 120609 - DNA, 220 bp, Homo sapiens; identical to SEQ ID NO: 88810
  chr21:45365737-45365957
  Hypo

SEQ ID NO: 120610 - DNA, 83 bp, Homo sapiens; identical to SEQ ID NO: 88811
  chr21:45375005-45375088
  Hypo

SEQ ID NO: 120611 - DNA, 90 bp, Homo sapiens; identical to SEQ ID NO: 88812
  chr21:45387435-45387525
  Hypo

SEQ ID NO: 120612 - DNA, 30 bp, Homo sapiens; identical to SEQ ID NO: 88813
  chr21:45400824-45400854
  Hypo

SEQ ID NO: 120613 - DNA, 72 bp, Homo sapiens; identical to SEQ ID NO: 88814
  chr21:45406862-45406934
  Hypo

SEQ ID NO: 120614 - DNA, 30 bp, Homo sapiens; identical to SEQ ID NO: 88815
  chr21:45411378-45411408
  Hypo

SEQ ID NO: 120615 - DNA, 73 bp, Homo sapiens; identical to SEQ ID NO: 88816
  chr21:45411841-45411914
  Hypo

SEQ ID NO: 120616 - DNA, 19 bp, Homo sapiens
  chr21:45412668-45412687
  Hypo
tcaccgtgcctggctcaag

SEQ ID NO: 120617 - DNA, 30 bp, Homo sapiens; identical to SEQ ID NO: 88818
  chr21:45435826-45435856
  Hypo

SEQ ID NO: 120618 - DNA, 78 bp, Homo sapiens; identical to SEQ ID NO: 88819
  chr21:45508617-45508695
  Hypo

SEQ ID NO: 120619 - DNA, 153 bp, Homo sapiens; identical to SEQ ID NO: 88820
  chr21:45516450-45516603
  Hypo

SEQ ID NO: 120620 - DNA, 121 bp, Homo sapiens; identical to SEQ ID NO: 88821
  chr21:45583747-45583868
  Hypo

SEQ ID NO: 120621 - DNA, 44 bp, Homo sapiens; identical to SEQ ID NO: 88822
  chr21:45626242-45626286
  Hypo

SEQ ID NO: 120622 - DNA, 30 bp, Homo sapiens; identical to SEQ ID NO: 46510
  chr21:45657028-45657058
  Hypo

SEQ ID NO: 120623 - DNA, 131 bp, Homo sapiens; identical to SEQ ID NO: 46511
  chr21:45681620-45681751
  Hypo

SEQ ID NO: 120624 - DNA, 110 bp, Homo sapiens; identical to SEQ ID NO: 88825
  chr21:45682528-45682638
  Hypo

SEQ ID NO: 120625 - DNA, 30 bp, Homo sapiens; identical to SEQ ID NO: 88826
  chr21:45683130-45683160
  Hypo

SEQ ID NO: 120626 - DNA, 30 bp, Homo sapiens; identical to SEQ ID NO: 46513
  chr21:45710106-45710136
  Hypo

SEQ ID NO: 120627 - DNA, 314 bp, Homo sapiens; identical to SEQ ID NO: 88828
  chr21:45712867-45713181
  Hypo

SEQ ID NO: 120628 - DNA, 54 bp, Homo sapiens; identical to SEQ ID NO: 88829
  chr21:45713401-45713455
  Hypo

SEQ ID NO: 120629 - DNA, 55 bp, Homo sapiens; identical to SEQ ID NO: 88830
  chr21:45727163-45727218
  Hypo

SEQ ID NO: 120630 - DNA, 30 bp, Homo sapiens; identical to SEQ ID NO: 88831
  chr21:45748750-45748780
  Hypo

SEQ ID NO: 120631 - DNA, 48 bp, Homo sapiens; identical to SEQ ID NO: 88832
  chr21:45749108-45749156
  Hypo

SEQ ID NO: 120632 - DNA, 293 bp, Homo sapiens; identical to SEQ ID NO: 88833
  chr21:45749406-45749699
  Hypo

SEQ ID NO: 120633 - DNA, 196 bp, Homo sapiens; identical to SEQ ID NO: 88834
  chr21:45749930-45750126
  Hypo

SEQ ID NO: 120634 - DNA, 261 bp, Homo sapiens; identical to SEQ ID NO: 88835
  chr21:45750395-45750656
  Hypo

SEQ ID NO: 120635 - DNA, 45 bp, Homo sapiens; identical to SEQ ID NO: 88836
  chr21:45751076-45751121
  Hypo

SEQ ID NO: 120636 - DNA, 86 bp, Homo sapiens; identical to SEQ ID NO: 88837
  chr21:45752956-45753042
  Hypo

SEQ ID NO: 120637 - DNA, 282 bp, Homo sapiens; identical to SEQ ID NO: 88838
  chr21:45753623-45753905
  Hypo

SEQ ID NO: 120638 - DNA, 574 bp, Homo sapiens
  chr21:45769972-45770546
  Hyper
gctgcgggcgcgggacgcggcgcgggagacgctctccgggctgagtgacgcagagcgctgcgggcggctccactgcaccgggcacgcggcgcacgctcgggcgagatgtggatggccccgcggggccagggcggcggtgctgcgcggggacgcgggtgacgccggggcgcgggcggctccgagcaggtaggtgcccgccggggccggggcgagggcgcgagcccgggtgcggggactgaggcggccgtcccgggagcttgtgaaggttgaggcggggtgcaagggcgcggatcggggtgccgagtgcgtgcaggggtgcggggtgcggggaccgaggcggccggccccggtgctgctgcagggcgcggcggaatgcaggggcgcggtggggtgcaggggcgcaggcggggttcggggcgctggtgcagggcgcggtggggtgcaagggcgcaggcggggttcggggcgctggtgcagggcacggcggggtgcaggggcgcgggtggggctcgaggcgctggtgcagggcgcggtggggtgcaggggcgcgaaggggctccgggcactggtgcag

SEQ ID NO: 120639 - DNA, 301 bp, Homo sapiens; identical to SEQ ID NO: 88841
  chr21:45790866-45791167
  Hypo

SEQ ID NO: 120640 - DNA, 30 bp, Homo sapiens; identical to SEQ ID NO: 88842
  chr21:45799305-45799335
  Hypo

SEQ ID NO: 120641 - DNA, 30 bp, Homo sapiens; identical to SEQ ID NO: 88843
  chr21:45819379-45819409
  Hypo

SEQ ID NO: 120642 - DNA, 43 bp, Homo sapiens; identical to SEQ ID NO: 88844
  chr21:45824452-45824495
  Hypo

SEQ ID NO: 120643 - DNA, 89 bp, Homo sapiens; identical to SEQ ID NO: 88845
  chr21:45825899-45825988
  Hypo

SEQ ID NO: 120644 - DNA, 72 bp, Homo sapiens; identical to SEQ ID NO: 88846
  chr21:45844751-45844823
  Hypo

SEQ ID NO: 120645 - DNA, 30 bp, Homo sapiens; identical to SEQ ID NO: 88847
  chr21:45847614-45847644
  Hypo

SEQ ID NO: 120646 - DNA, 30 bp, Homo sapiens; identical to SEQ ID NO: 88848
  chr21:45870052-45870082
  Hypo

SEQ ID NO: 120647 - DNA, 183 bp, Homo sapiens
  chr21:45875549-45875732
  Hyper
gcccagccctgggagcgtggattcccacccaccccatgaccatccccccgccgcgagtgctggggtctcgggggtcccaggttccgggggtcctagggccggagggtctaaaggctggaggtcctgggggtccgagcctctcccggccggctccgcgcgcggccccgccgtccacgcccagcg

SEQ ID NO: 120648 - DNA, 32 bp, Homo sapiens; identical to SEQ ID NO: 88850
  chr21:45875956-45875988
  Hyper

SEQ ID NO: 120649 - DNA, 240 bp, Homo sapiens; identical to SEQ ID NO: 88851
  chr21:45918988-45919228
  Hypo

SEQ ID NO: 120650 - DNA, 259 bp, Homo sapiens; identical to SEQ ID NO: 88852
  chr21:45929112-45929371
  Hypo

SEQ ID NO: 120651 - DNA, 249 bp, Homo sapiens; identical to SEQ ID NO: 88853
  chr21:45939565-45939814
  Hypo

SEQ ID NO: 120652 - DNA, 30 bp, Homo sapiens; identical to SEQ ID NO: 88854
  chr21:45940440-45940470
  Hypo

SEQ ID NO: 120653 - DNA, 30 bp, Homo sapiens; identical to SEQ ID NO: 88855
  chr21:45958213-45958243
  Hypo

SEQ ID NO: 120654 - DNA, 63 bp, Homo sapiens; identical to SEQ ID NO: 88856
  chr21:45959291-45959354
  Hypo

SEQ ID NO: 120655 - DNA, 172 bp, Homo sapiens; identical to SEQ ID NO: 88857
  chr21:45959901-45960073
  Hypo

SEQ ID NO: 120656 - DNA, 194 bp, Homo sapiens; identical to SEQ ID NO: 88858
  chr21:45991563-45991757
  Hypo

SEQ ID NO: 120657 - DNA, 46 bp, Homo sapiens; identical to SEQ ID NO: 88859
  chr21:46010155-46010201
  Hypo

SEQ ID NO: 120658 - DNA, 30 bp, Homo sapiens; identical to SEQ ID NO: 16724
  chr21:46015435-46015465
  Hypo

SEQ ID NO: 120659 - DNA, 78 bp, Homo sapiens; identical to SEQ ID NO: 88861
  chr21:46021444-46021522
  Hypo

SEQ ID NO: 120660 - DNA, 41 bp, Homo sapiens; identical to SEQ ID NO: 88862
  chr21:46022629-46022670
  Hypo

SEQ ID NO: 120661 - DNA, 141 bp, Homo sapiens; identical to SEQ ID NO: 88863
  chr21:46032641-46032782
  Hypo

SEQ ID NO: 120662 - DNA, 102 bp, Homo sapiens; identical to SEQ ID NO: 88864
  chr21:46035158-46035260
  Hypo

SEQ ID NO: 120663 - DNA, 255 bp, Homo sapiens; identical to SEQ ID NO: 46528
  chr21:46036572-46036827
  Hypo

SEQ ID NO: 120664 - DNA, 30 bp, Homo sapiens; identical to SEQ ID NO: 88866
  chr21:46066733-46066763
  Hypo

SEQ ID NO: 120665 - DNA, 58 bp, Homo sapiens; identical to SEQ ID NO: 46529
  chr21:46068645-46068703
  Hypo

SEQ ID NO: 120666 - DNA, 1515 bp, Homo sapiens
  chr21:46126008-46127523
  Hyper
cccagctgcagatcgaggcctagtgcgagcacaggtccccccagacccttcccagtgcccaccaaccggcggcctaggccaggtagaactggcagcgcctcccctgctgcaacaccaggctctggtagaaacttcagaaaacatgcaccggcaaaaccaaggaagggtggctgcgtcccgggttcttccgcgcagctgtgtgtacacgcatgcacacacccacacgcacacacccacgtgcacacccccatgcacacgcacccacttgcacgcccatgcacgcacacacgcgcgtgcacccatgcgcacgcacccatgcacacacacgcgcgcacacacccacgtgcgcacccacatgtacacacccacgtgcacacacccacgcgtacacacccacgcgcacacaccgctgtccccagccgtgcagaacgatcctccctgagtccccggctccgacccacacgcagcactcgctaaacgcttcccacgcagtcgttttgctgggttgcgcttcacccacttctcagagggggcggccgaggcagaggtgtcggggatcgagcagctccgggcctcaggggtcgccccgccaccgttttcctttcccagatgctgggacgggggcagggaggggctccccaggctgaacccgactaggtcaccctagaagcgaggcgagcttctcttctgtttttcttcggcgcccctgagcccctgacagtgcccaagctgcccatgggattggattcgccagagcctcctacgcagaccccacccagggccaaagccaaccccaagccccaccaccttggtggtgtgggatgaaaagtgagccatcgagagatggggtccccccacccccaacccctccaaggacaaaggcgggctgggaagcacccgctttcacgtccgcccctgcccggctttcctagcggaattggcgccggcatcagttgggggttgtgggatcagtgaggaatcccgtggggtcgcctccatttatcagttgtgtggggttgggcgagcacccctagccccagcccaggcgatcagggcgcgaagcccactggacgcggatttgggattaggacgggggtgacagccaggaggaccgcacctgccctccccactcctgccgctccacccctgcccccaccgcaacaccaaggtctccaccaggaagatgggggtggggaaaggacgcggggtgggggggggtgcggggagagaggacacagggtcggaagggtgaggggtagtggcagaggcggaggccgaggccacgcagctgcggggcgcagggaggggcagaggaggggcgttcagatgggaacctagtccagacccgtcggggccctcgtgtgcggctcgttatcctggaaccagagaggctggagacccttggcttgtctggagcggaaccgtagtgtccaatagagtgtgtggggctcagccctaaagctaaacattctttatttcctgatgaccatgggggcggagcgggggaaaagccct

SEQ ID NO: 120667 - DNA, 28 bp, Homo sapiens
  chr21:46127878-46127906
  Hyper
ctagcctgtgccccccgattccccccct

SEQ ID NO: 120668 - DNA, 88 bp, Homo sapiens; identical to SEQ ID NO: 88871
  chr21:46128221-46128309
  Hyper

SEQ ID NO: 120669 - DNA, 212 bp, Homo sapiens; identical to SEQ ID NO: 38420
  chr21:46128884-46129096
  Hyper

SEQ ID NO: 120670 - DNA, 326 bp, Homo sapiens; identical to SEQ ID NO: 88873
  chr21:46129376-46129702
  Hyper

SEQ ID NO: 120671 - DNA, 39 bp, Homo sapiens; identical to SEQ ID NO: 88874
  chr21:46130020-46130059
  Hyper
